(12) United States Patent
Boukharov et al.

(10) Patent No.: US 8,067,671 B2
(45) Date of Patent: Nov. 29, 2011

(54) METHODS FOR GENETIC CONTROL OF PLANT PEST INFESTATION AND COMPOSITIONS THEREOF

(75) Inventors: Andrey A. Boukharov, Wildwood, MO (US); Zijin Du, Chesterfield, MO (US); Liang Guo, St. Louis, MO (US); David K. Kovalic, Clayton, MO (US); Maolong Lu, St. Louis, MO (US); James P. McCarter, St. Louis, MO (US); Nancy M. Miller, Fenton, MO (US); Mark Vaudin, Cambridgeshire (GB); Deryck Jeremy Williams, University City, MO (US); Wei Wu, St. Louis, MO (US)

(73) Assignee: Monsanto Technology LLC, St. Louis, MO (US)

( * ) Notice: Subject to any disclaimer, the term of this patent is extended or adjusted under 35 U.S.C. 154(b) by 610 days.

(21) Appl. No.: 12/101,830

(22) Filed: Apr. 11, 2008

(65) Prior Publication Data

US 2009/0188005 A1 Jul. 23, 2009

Related U.S. Application Data

(62) Division of application No. 11/360,355, filed on Feb. 23, 2006.

(60) Provisional application No. 60/655,875, filed on Feb. 24, 2005.

(51) Int. Cl.
*C12N 15/82* (2006.01)
*C12N 15/87* (2006.01)
*A01H 1/00* (2006.01)

(52) U.S. Cl. .................. 800/285; 800/279; 800/288
(58) Field of Classification Search .................. None
See application file for complete search history.

(56) References Cited

U.S. PATENT DOCUMENTS

| | | | |
|---|---|---|---|
| 6,506,559 B1 | 1/2003 | Fire et al. | 435/6 |
| 7,622,301 B2 | 11/2009 | Ren et al. | 800/286 |
| 7,659,444 B2 | 2/2010 | Ren et al. | 800/279 |
| 7,803,984 B2 | 9/2010 | Trick et al. | 800/279 |
| 2003/0061626 A1 | 3/2003 | Plaetinck et al. | 514/44 |
| 2003/0150017 A1 | 8/2003 | Mesa et al. | 800/279 |
| 2004/0098761 A1 | 5/2004 | Trick et al. | 800/279 |
| 2004/0133943 A1 | 7/2004 | Plaetinck et al. | 435/6 |
| 2005/0188438 A1 | 8/2005 | Ren et al. | 800/286 |
| 2006/0037101 A1 | 2/2006 | Ren et al. | 800/279 |
| 2007/0250947 A1 | 10/2007 | Boukharov et al. | 800/285 |
| 2007/0271630 A1 | 11/2007 | Boukharov et al. | 800/285 |
| 2009/0093620 A1 | 4/2009 | Kovalic | 536/23.1 |

FOREIGN PATENT DOCUMENTS

| | | |
|---|---|---|
| WO | WO 01/37654 | 5/2001 |
| WO | WO 03/052110 | 6/2003 |
| WO | WO 2004/098282 | 11/2004 |
| WO | WO 2005/019408 | 3/2005 |
| WO | WO 2007/095469 | 8/2007 |

OTHER PUBLICATIONS

Office Action regarding U.S. Appl. No. 11/360,355, dated Jul. 21, 2010.
Smith et al., "Total silencing by intron-spliced hairpin RNAs," *Nature*, 407:319-320, 2000.
Thomas et al., "Size constraints for targeting post-transcriptional gene silencing and for RNA-directed methylation in *Nicotiana benthamiana* using a potato virus X vector," *The Plant J.*, 25(4):417-425, 2001.
Office Action regarding U.S. Appl. No. 11/360,355, dated Jul. 22, 2008.
Declaration of Dr. Greg J. Bunkers Under 37 C.F.R. § 1.132 regarding U.S. Appl. No. 11/360,355, dated Jan. 20, 2009.
Amendment and Response to Office Action regarding U.S. Appl. No. 11/360,355, dated Jan. 21, 2009.
Final Office Action regarding U.S. Appl. No. 11/360,355, dated May 20, 2009.
Request for Continued Examination; Amendment; Telephonic Interview Summary; and Response to Final Office Action regarding U.S. Appl. No. 11/360,355, dated Sep. 18, 2009.
Office Action regarding U.S. Appl. No. 11/360,355, dated Dec. 18, 2009.
Amendment; Telephonic Interview Summary; and Response to Office Action regarding U.S. Appl. No. 11/360,355, dated May 4, 2010.
U.S. Appl. No. 60/395,153, filed Jul. 10, 2002, Trick et al.
Aboobaker et al., "Medical significance of *Caenorhabditis elegans*," *Annals of Medicine*, 32:23-30, 2000.
Aboobaker et al., "Use of RNA interference to investigate gene function in the human filarial nematode parasite *Brugio malayi*," *Mol. Biochem. Parasitol.*, 129:41-51, 2003.
Altschul et al., "Basic local alignment search tool," *J. Mol. Biol.*, 215:403-410, 1990.
Ashrafi et al., "Genome-wide RNAi analysis of *Caenorhabditis elegans* fat regulatory genes," *Nature*, 421:268-272, 2003.
Bargmann, "Neurobiology of the *Caenorhabditis elegans* genome," *Science*, 282:2028-2033, 1998.

(Continued)

*Primary Examiner* — Li Zheng
(74) *Attorney, Agent, or Firm* — SNR Denton US LLP; Erin C. Robert, Esq.

(57) ABSTRACT

The present invention is directed to controlling plant pest infestation, and particularly plant nematode infestation, by inhibiting one or more biological functions in the plant pest. The invention discloses methods and compositions for use in controlling plant pest infestation by providing one or more different recombinant double stranded RNA molecules in the diet of the pest in order to achieve a reduction in pest infestation through suppression of pest gene expression. The invention is also directed to methods for making transgenic plants that express the double stranded RNA molecules, to methods for detecting cells comprising the disclosed sequences, and to methods for detecting the disclosed sequences in biological samples.

9 Claims, No Drawings

OTHER PUBLICATIONS

Barker et al., "Plant and soil nematodes: societal impact and focus for the future," The Committee on National Needs and Priorities in Nematology, Cooperative State Research Service, U.S. Department of Agriculture and Society of Nematologists, 1994.
Burglin et al., "*Caenorhabditis elegans* as a model for parasitic nematodes," *Intl. J. for Parasitology*, 28:395-411, 1998.
Davis et al., "Nematode parasitism genes," *Annu. Rev. Phytopathol.*, 38:365-396, 2000.
Dong et al., "Genetic analysis of parasitism in the soybean cyst nematode heterodera glycines," *Genetics*, 146:1311-1318, 1997.
Elbashir et al., "RNA interference is mediated by 21- and 22-nucleotide RNAs," *Genes Dev.*, 5(2):188-200, 2001.
EST Accession No. CB278684, dated Feb. 26, 2003.
EST Accession No. CB281513, dated Feb. 27, 2003.
EST Accession No. CB374668, dated Mar. 18, 2003.
EST Accession No. CB375671, dated Mar. 18, 2003.
Fairbairn et al., "Plant delivered RNAi (PD-RNAi): a novel strategy to control plant parasitic nematodes by inactivating nematode genes in planta," (Annual Meeting Abstract #372), American Society for Plant Biology, 2005.
Fire et al. "Potent and specific genetic interference by double-strnaded RNA in *Caenorhabditis elegans*," *Nature*, 391:806-811, 1998.
Foster et al., "Wolbachia genome of *Brugia malayi*: endosymbiont evolution within a human pathogenic nematode," *PLOIS Biol.*, 3(4):599-614, 2005.
Fraser et al., "Functional genomic analysis of *C. elegans* chromosome I by systematic RNA interference," *Nature*, 408:325-330, 2000.
Geary et al., "*Caenorhabditis elegans*: how good a model for veterinary parasites," *Veterinary Parasitology*, 101:371-386, 2001.
Gonczy et al., "Functional genomic analysis of cell division in *C. elegans* using RNAi of genes on chromosome III," *Nature*, 408(16):331-336, 2000.
Hamilton et al., "A species of small antisense RNA in post-transcriptional gene silencing in plants," *Science*, 286:950-952, 1999.
Harris et al., "Wormbase: a multi-species resource for nematode biology and genomics," *Nucleic Acids Research*, 32:D411-D417, 2004.
Hussein et al., "Suppression of secreted acetylcholinesterase expression in *Nippostrongylus brasiliensis* by RNA interference," *Mol. Biochem. Parasitol.*, 122:91-94, 2002.
Imhof et al., "Fitness effects of advantageous mutations in evolving *Escherichia coli* populations," *Proc. Natl Acad. Sci. USA*, 98:1113-1117, 2001.
Kamath et al., "Effectiveness of specific RNA-mediated interference through ingested double-stranded RNA in *Caenorhabditis elegans*," *Genome Biol.* 2(1):Research 0002.1-0002-10, 2001.
Kamath et al., "Systematic functional analysis of the *Caenorhabditis elegans* genome using RNAi," *Nature*, 421:231-237, 2003.
Kwa et al., "Beta-tubulin genes from the parasitic nematode *Haemonchus contortus* modulate drug resistance in *Caenorhabditis elegans*," *J. Mol. Biol.*, 246:500-510, 1995.
Lustigman et al., "RNA interference targeting cathepsin L and Z-like cysteine proteases of *Onchocerca volvulus* confirming their essential function during L3 molting," *Mol. Biochem. Parasitol.*, 138:165-170, 2004.
Maeda et al., "Large-scale analysis of gene function in *Caenorhabditis elegans* by high-throughput RNAi," *Curr. Biol.*, 11(3):171-176, 2001.
Martin, "Modes of action of anthelmintic drugs," *Vet J.*, 154:11-34, 1997.
Martinez et al., "Single-stranded antisense siRNAs guide target RNA cleavage in RNAi," *Cell*, 110:563-574, 2002.
McCarter et al., "Analysis and functional classification of transcripts from the nematode *Meloidogyne incognita*," *Genome Biology*, 4:R26.1-R26.19, 2003.
McCarter et al., Nematode gene sequences: update for Dec. 2003, *J. of Nematology*, 35(4):465-469, 2003.
McCarter, "Genomic filtering: an approach to discovering novel antiparasitics," *Trends in Parasitology*, 20(10):462-468, 2004.
McManus et al., "Gene silencing in mammals by small interfering RNAs," *Nature Reviews*, 3:737-747, 2002.
Mitreva et al., "A survey of SL1-spliced transcripts from the root-lesion nematode *Pratylenchus penetrans*," *Mol. Gen. Genomics*, 272:138-148, 2004.
Mitreva et al., "Comparative genomics of gene expression in the parasitic and free-living nematodes *Strongyloides stercoralis* and *Caenorhabditis elegans*," *Genome Research*, 14:209-220, 2004.
Montgomery et al., "RNA as a target of double-stranded RNA-mediated genetic interference in *Caenorhabditis elegans*," *Proc. Natl. Acad. Sci. USA*, 95:15502-15507, 1998.
Omura et al., "An anthelmintic compound, nafuredin, shows selective inhibition of complex I in *Helminth mitochondria*," *Proc. Natl. Acad. Sci. USA*, 98:60-62, 2001.
Papp et al., "Dosage sensitivity and the evolution of gene families in yeast," *Nature*, 424:194-197, 2003.
Papp et al., "Metabolic network analysis of the causes and evolution of enzyme dispensability in yeast," *Nature*, 429:661-664, 2004.
Parkinson et al., "A transcriptomic analysis of the *Phylum nematoda*," *Nature Genetics*, 36:1259-1267, 2004.
Piano et al., "Gene clustering based on RNAi phenotypes of ovary-enriched genes in *C. elegans*," *Curr. Biol.*, 12:1959-1964, 2002.
Piano et al., "RNAi analysis of genes expressed in the ovary of *Caenorhabditis elegans*," *Curr. Biol.*, 10:1619-1622, 2000.
Redmond et al., "Expression of *Haemonchus contortus* pepsinogen in *Caenorhabditis elegans*," *Mol. Biochem. Parasitol.*, 112:125-131, 2001.
Ruvkun, "The taxonomy of developmental control in *Caenorhabditis elegans*," *Science*, 282:2033-2041, 1998.
Scholl et al., "Horizontally transferred genes in plant parasitic nematodes: a high-throughput genomic approach," *Genome Biology*, 4:R39.1-R39.12, 2003.
Simmer et al., "Genome-wide RNAi of *C. elegans* using the hypersensitive rrf-3 strain reveals novel gene functions," *PLOS Biol.*, 1(1):77-84, 2003.
Sonnichsen et al., "Full-genome RNAi profiling of early embryogenesis in *Caenorhabditis elegans*," *Nature*, 434:462-469, 2005.
Urwin et al., "Ingestion of double-stranded RNA by preparasitic juvenile cyst nematodes leads to RNA interference," *Mol. Plant Microbe Interact.*, 15:747-752, 2002.
Winston et al., "Systemic RNAi in *C. elegans* requires the putative transmembrane protein SID-1," *Science*, 295:2456-2459, 2002.
Winzeler et al., "Functional characterization of the *S. cerevisiae* genome by gene deletion and parallel analysis," *Science*, 285:901-906, 1999.
Zheng et al., "Conservation and diversification of Wnt signaling function during the evolution of nematode vulva development," *Natl. Genet.*, 37:300-304, 2005.
Davy et al., "A protein-protein interaction map of the *Caenoryhabditis elegans* 26S proteasome," *EMBO Reports*, 21(9):821-828, 2001.
Eisen, "Phylogenomics: improving functional predictions for uncharacterized genes by evolutionary analysis," *Genome Research*, 8:163-167, 1998.
Response to Official Action regarding U.S. Appl. No. 11/360,355, dated Dec. 20, 2010.
Official Action regarding U.S. Appl. No. 11/360,355, dated Mar. 17, 2011.
Hamilton et al., "Two classes of short interfering RNA in RNA silencing," *The EMBO J.*, 21(17):4671-4679, 2002.
Schwarz et al., "Asymmetry in the assembly of the RNAi enzyme complex," *Cell*, 115:199-208, 2003.
Silhavy et al., "A viral protein suppresses RNA silencing and binds silencing-generated, 21- to 25-nucleotide double-stranded," *The EMBO J.*, 21(12):3070-3080, 2002.
Qiu et al., "A computational study of off-target effects of RNA interference," *Nucleic Acids Res.*, 33(6):1834-1847, 2005.
Response to Office Action regarding U.S. Appl. No. 11/360,355, dated Jun. 15, 2011.
Notice of Allowance regarding U.S. Appl. No. 11/360,355, dated Aug. 30, 2011.

METHODS FOR GENETIC CONTROL OF PLANT PEST INFESTATION AND COMPOSITIONS THEREOF

CROSS REFERENCE TO RELATED APPLICATIONS

This application is a division of U.S. application Ser. No. 11/360,355, filed Feb. 23, 2006, which claims the benefit of priority to U.S. Provisional Patent Application Ser. No. 60/655,875 filed Feb. 24, 2005, and the sequence listing filed along with that application, which is incorporated herein by reference in its entirety, each of the disclosures of which are hereby incorporated by reference in their entirety.

FIELD OF THE INVENTION

The present invention relates generally to the field of molecular biology and more specifically to the genetic control of plant pests, and even more particularly to the genetic control of *Heterodera* nematode infestations in plants. More specifically, the present invention relates to methods for modifying expression of one or more polynucleotide and/or protein molecules in one or more cells or tissues of a pest species. The present invention discloses substantially the entire genome sequence of the plant nematode pest, *Heterodera glycines*, and describes the use of these sequences to modify the expression of one or more target polynucleotide or protein molecules in at least the cells of a *Heterodera* species by providing in its diet a dsRNA that comprises a part of, or all, or substantially all of one or more polynucleotide molecules of the present invention.

BACKGROUND OF THE INVENTION

Plants and animals are targets of many different pests, including but not limited to nematode and insect pest species. Crops are often the targets of nematode infestations. Chemical nematicides are not effective in eradicating the nematode infestations. Chemical pesticidal agents are not selective and exert their effects on non-target fauna as well, often effectively sterilizing for a period of time a field over which the chemical nematicidal agents have been applied. Some chemical pesticidal agents have been shown to accumulate in food, and to exhibit adverse effects on workers that manufacture and apply such chemical agents. Thus there has been a long felt need for methods for controlling or eradicating nematode pest infestation on or in plants, i.e., methods which are selective, environmentally inert, non-persistent, biodegradable, and that fit well into pest resistance management schemes. Plant biotechnology provides a means to control pest infestations by providing plants that express one or more pest control agents. Recombinant pest control agents have generally been reported to be proteins selectively toxic to a target pest that are expressed by the cells of a recombinant plant. Recently, small RNA molecules provided in the diet of the pest species *Meloidogyne incognita* have been shown to exhibit effects on the viability of the pest by affecting gene expression in the pest cells (Tobias et al. WO 01/37654 A2). Recombinant approaches to plant pest control can be selective, and are environmentally inert and non-persistent because they are fully biodegradable.

The phenomenon of dsRNA mediated gene silencing has been demonstrated in a number of plant and animal systems (Fire et al. 1998 Nature 391:806-811; Waterhouse et al. 1998 PNAS USA 95:13959-13964; Tabara et al. 1998 Science 282:430-431; Fire et al. WO 99/32619 A1; Trick et al. WO 2004/005485 A2). Methods for delivering dsRNA into the animal systems involved generating transgenic insects that express double stranded RNA molecules or injecting dsRNA solutions into the body of the animal or within the egg sac prior to or during embryonic development. Double stranded RNA mediated gene suppression has been demonstrated in plant parasitic nematodes either by providing dsRNA or miRNA's in the nematodes' diet or by soaking the nematodes in solutions containing such RNA molecules (Atkinson et al., (The University of Leeds) WO 03/052110 A2; Trick et al., (Kansas State University Research Foundation) US 2004-009876A1). Cyst nematodes (*Heterodera* and *Globodera* species) are particularly damaging pests of crop plants. Cyst nematodes include but are not limited to *Heterodera avenae, H. cruciferae, H. glycines, H. hordecalis, H. latipons, H. oryzae, H. oryzicola, H. rostochinesis, H. zeae, H. schachtii, G. achilleae, G. artemisiae, G. mexicana, G. millefolii, G. pallida, G. rostochiensis, G. tabacum, G. tabacum solanacearum, G. tabacum tabacum, G. tabacum virginiae, Globodera* sp. Bouro, *Globodera* sp. Canha, *Globodera* sp. Ladeiro, *Globodera* sp. New Zealand-EK-2004, and *Globodera* sp. Peru-EK-2004. These species are known to parasitize a wide variety of crops including, but not limited to barley, corn, oats, rice, rye, wheat, cabbage, cauliflower, soybean, sugar beet, spinach, mustards, and potato. Cyst nematodes are particularly problematic. Eggs persist and remain viable in the soil for many years. Genetic resistance by conventional crop breeding has limited success in identifying resistance genes effective against the wide variety of races and biotypes of the cyst nematodes. Of particular concern is the soybean cyst nematode, *Heterodera glycines*, herein referred to as SCN.

Therefore, there exists a need for improved methods and compositions useful to modulate gene expression by repressing, delaying or otherwise reducing gene expression within a particular plant nematode pest for the purpose of controlling the nematode infestation or to introduce novel agronomically valuable phenotypic traits.

SUMMARY OF THE INVENTION

The present invention comprises methods and compositions for inhibiting expression of one or more target genes and proteins at least in cyst nematodes such as members of the *Heterodera* and *Globodera* species. More specifically, the present invention comprises a method of modulating or inhibiting expression of one or more target genes in *Heterodera glycines* and *Heterodera schactii*, to cause cessation of feeding, growth, development, reproduction and infectivity and eventually result in the death of the nematode pest. The method comprises introduction of partial or fully, stabilized double-stranded RNA (dsRNA) or its modified forms, such as small interfering RNA (siRNA) or micro RNA (miRNA) sequences, into the cells of the nematode wherein expression of at least one or more target genes is inhibited in the target nematode pest, wherein inhibition of the one or more target genes exerts a deleterious effect upon the nematode pest, wherein the dsRNA, siRNA, or miRNA are derived from the target gene sequences, specifically inhibit such target genes in the target pest, and so are specific to nematode pests such as those of the *Heterodera* species. It is specifically contemplated that the methods and compositions of the present invention will be useful in limiting or eliminating *Heterodera* infestation in or on any cyst nematode host by providing one or more compositions comprising dsRNA molecules in the diet of the nematode, wherein the diet is all or part of a plant cell.

In another aspect of the present invention, DNA molecules of the present invention comprise molecules that function as promoter sequences, polypeptide coding sequences, non-coding regulatory sequences, or polyadenylation sequences isolated from the genome of the soybean cyst nematode, the polynucleotide sequence of which is at least from about 75, 76, 77, 78, 79, 80, 81, 82, 83, 84, 85, 86, 87, 88, 89, 90, 91, 92, 93, 94, 95, 96, 97, 98, 99, or about 100% identical to sequences selected from the group consisting of SEQ ID NO: 1 through SEQ ID NO:45568, the complement thereof, or a portion thereof. A DNA molecule selected from the group consisting of SEQ ID NO:97730 through SEQ ID NO:119145 exhibits promoter activity, and a DNA molecule selected from the group consisting of SEQ ID NO:45569 through SEQ ID NO:47643 comprises at least one protein coding sequence, whether or not a complete open reading frame is exhibited.

Accordingly, in another aspect of the present invention, a set of isolated and purified polynucleotide sequences as set forth in SEQ ID NO:45569 through SEQ ID NO:47643 are provided as target sequences for the design of DNA constructs that express a stabilized dsRNA, siRNA, or miRNA molecule for inhibition of expression of a target gene in a nematode pest. A stabilized dsRNA, siRNA, or miRNA molecule can comprise two or more polynucleotide molecules that are arranged in a sense and an antisense orientation relative to at least one promoter, wherein the polynucleotide molecule that comprises a sense strand and an antisense strand are linked or connected by a spacer sequence of at least from about five to about one thousand nucleotides, wherein the sense strand and the antisense strand are at least about the same length, and wherein each of the two polynucleotide sequences shares at least about 80% sequence identity, at least about 90%, at least about 95%, at least about 98%, or even about 100% sequence identity, to a polynucleotide sequence as set forth in one of SEQ ID NO:45569 through SEQ ID NO:47643.

The present invention provides a method for identifying a DNA molecule for use as a DNA construct expressing a dsRNA-mediated gene silencing sequence in a plant cell, comprising selecting a target polynucleotide molecule of a *Heterodera glycines* polynucleotide sequence comprising 21 or more contiguous nucleotides wherein said polynucleotide sequence is selected from the group consisting of SEQ ID NO:45569-50775, SEQ ID NO:45569-47643, and SEQ ID NO:47644-50775.

The present invention also provides a recombinant DNA molecule for use in plant transformation, constructed to contain at least one polynucleotide molecule transcribed as a single stranded RNA molecule. The single stranded RNA molecule is capable of forming in vivo a double stranded RNA molecule through intermolecular hybridization that, when provided in the diet of a nematode pest, inhibits the expression of at least one target gene in one or more cells of the target organism. The polynucleotide molecule is operably linked to at least one promoter sequence that functions in a transgenic plant cell to transcribe the polynucleotide molecule into one or more ribonucleic acid molecules. The RNA molecule(s) self assemble into double stranded RNA molecules and are provided in the diet of a target pest that feeds upon the transgenic plant. The provision of the dsRNA molecule in the diet of the pest achieves the desired inhibition of expression of one or more target genes within the pest organism, resulting in fecundicity, morbidity, and/or mortality of the target pest.

The present invention also provides a recombinant plant cell having in its genome at least one recombinant DNA sequence that is transcribed to produce at least one dsRNA molecule that functions when the cell and/or its contents are ingested by a target nematode or pest to inhibit the expression of at least one target gene in the target nematode or pest. The dsRNA molecule is transcribed from all or a portion of a polynucleotide molecule that at least in part exhibits from about 75 to about 100% identity to a target nematode specific polynucleotide sequence as set forth in SEQ ID NO:45569 through SEQ ID NO:50775.

The present invention also provides a recombinant DNA construct for expression of a dsRNA-mediated gene silencing sequence in a plant cell, which comprises at least two different target sequences that, when expressed in vivo as RNA sequences and provided in the diet of a target nematode pest, inhibit the expression of at least two different target genes in one or more cells or tissues of the target nematode pest. A first target sequence exhibits at least from about 75 to about 100 percent identity to a first specific polynucleotide sequence region as set forth in SEQ ID NO:45569-SEQ ID NO:50775, and a second target sequence that is different from the first target sequence exhibits at least about 75 to about 100 percent identity to a second specific polynucleotide sequence region as set forth in SEQ ID NO:45569 through SEQ ID NO:50775, wherein the two or more target sequences are assembled in a DNA construct and expressed together as a single RNA transcript, and are constructed to form one or more dsRNA's useful in suppression of the one or more target genes. The DNA construct is transformed into a soybean cell, and the cell is regenerated into a recombinant plant. The dsRNA molecules are thus provided in the diet of the target nematode pest in a target nematode pest inhibitory concentration. Ingestion by the target nematode pest of recombinant plant cells or tissues expressing the recombinant dsRNA achieves the desired inhibition of expression of one or more target genes in the nematode, resulting in the fecundicity, morbidity, and/or mortality of the target nematode pest.

Another aspect of the present invention is the use of the nucleotide sequences disclosed herein to identify target sequences that occur in the transcript RNA of other plant pests, in particular insect pests, fungal pests, and nematode pests, that could be targeted simultaneously and/or contemporaneously with a single expression construct designed to suppress related genes in multiple plant pests by identifying sequences of sufficient length and identity in two or more different plant pests, and ensuring that the DNA construct used to produce a recombinant plant expresses one or more dsRNA molecules that function to effectively suppress one or more related genes in the two or more different plant pests. In particular, some contiguous nucleotide sequences equal to or greater than about 21-24 nucleotides in length are identified herein to be present within the genome of the soybean cyst nematode (SCN) *Heterodera glycines* and have been identified to be present as well in *Heterodera schactii*, and to some extent, other pest species as well, such as in several other nematode pest species as well as in other plant pest species such as specific insect nucleotide sequences, and in animal pest species such as insect pest species. Such sequences may be useful for effectively suppressing a target sequence in these plant pests, particularly when expressed as a dsRNA molecule in a recombinant plant cell that is provided in the diet of the pest, and can provide resistance to the plant from pest infestation from all or substantially all pests in which such sequences appear, in particular if the sequences in common are within genes shown to be essential for survival, reproduction, mobility, and/or development and differentiation.

The target sequences disclosed in the present invention can be used to identify related target sequences that occur in the transcript RNA of other pest species, particularly nematode species including but not limited to pests such as *Heterodera* species such as *H. avenae, H. ciceri, H. crucifera, H. cyperi, H. fici, H. goettingiana, H. hordecalis, H. humuli, H. latipons, H. litoralis, H. medicaginis, H. mediterranea, H. oryzae, H. oryzicola, H. riparia, H. rostochinesis, H. salixophila, H. schachtii, H. sorghi, H. trifolii, H. turcomanica*, and *H. zeae*, *Meloidogyne* species such as *M. arenaria, M. chitwoodi, M. artiellia, M. fallax, M. hapla, M. javanica, M. incognita, M. microtyla, M. partityla, M. panyuensis*, and *M. paranaensis*, *Globodera* species such as *G. pallida, G. rostochiensis*, and *G. tabacum, Pratylenchus* species such as *P. brachyurus, P. crenatus, P. coffeae, P. magnica, P. neglectu, P. penetrans, P. scribneri, P. thornei*, and *P. vulnus*. Other plant pest nematode species that are within the scope of the present invention include but are not limited to *Xiphinema* species, *Nacobbus* species, *Hoplolaimus* species, *Paratylenchus* species, *Rotylenchulus* species, *Criconemella* species, *Hemicycliophora* species, *Helicotylenchus* species, *Rotylenchus* species, *Belonolaimus* species, *Trichodorus* species, *Tylenchorhynchus* species, *Radopholus* species, *Longidorus* species, *Dolichodorus* species, *Aphenlenchoides* species, *Ditylenchus* species, *Anguina* species, and *Tylenchulus* species. A DNA construct that expresses a dsRNA molecule in a plant cell that has a target sequence common to multiple plant pests provides plant resistance to pest infestation from each pest containing such target sequences. A particular target sequence can be amplified within a single dsRNA transcript, and can contain only a single contiguous sequence of at least from about 17 to about 21 to about 50 nucleotides in common between any combination of pests, or can be comprised of a chimera consisting of various contiguous sequences of at least from about 17 to about 21 to about 50 or more nucleotides, each such contiguous sequence either being in common between two or more pests, or unique to only a single pest, such that the chimera, when present as a dsRNA sequence and provided in the diet of any one or more of the targeted pests, results in the effective control such one or more pests.

The present invention also provides a method for producing a transgenic plant by introducing into the genome of the plants' cells a polynucleotide sequence consisting of all or a portion of at least one of the aforementioned SCN specific recombinant DNA sequences, linked to linked substantially the complement of that sequence. Transgenic plants are generated from the transformed plant cell, and progeny plants, seeds, and plant products, each comprising the polynucleotide sequence, are produced from the transgenic plants.

The methods and compositions of the present invention may be applied to any monocot and dicot plant, depending on the pest species to be controlled and the host range of the nematode pest. Specifically, the plants are intended to comprise without limitation alfalfa, aneth, apple, apricot, artichoke, arugula, asparagus, avocado, banana, barley, beans, beet, blackberry, blueberry, broccoli, brussel sprouts, cabbage, canola, cantaloupe, carrot, cassava, cauliflower, celery, cherry, cilantro, citrus, clementine, coffee, corn, cotton, cucumber, Douglas fir, eggplant, endive, escarole, eucalyptus, fennel, figs, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, raspberry, rice, rye, sorghum, Southern pine, soybean, spinach, squash, strawberry, sugar beet, sugarcane, sunflower, sweet potato, sweetgum, tangerine, tea, tobacco, tomato, turf, a vine, watermelon, wheat, yams, and zucchini plants. Preferably, the present invention is related to a transgenic soybean plant that contains in its genome a DNA construct that expresses a dsRNA molecule from any sequence of the present invention.

The invention also provides a computer readable medium having recorded thereon one or more of the sequences as set forth in SEQ ID NO:1 through SEQ ID NO:171306 and, with reference to nucleotide sequences, the complements thereof, for use in a number of computer based applications, including but not limited to DNA identity and similarity searching, protein identity and similarity searching, transcription profiling characterizations, comparisons between genomes, and artificial hybridization analyses.

BRIEF DESCRIPTION OF THE SEQUENCES

SEQ ID NO:1-SEQ ID NO:45568 correspond to individual sequences (singletons) and assembled singletons forming contiguous overlapping sequences (contigs) derived from DNA sequence analysis of one or more libraries produced from the genome of the soybean cyst nematode strain OP25.

SEQ ID NO:45569-SEQ ID NO:97729 correspond to sequences predicted to encode various proteins, tRNA's, rRNA's and the like, which were identified using the bioinformatics described herein as applied to SEQ ID NO:1-SEQ ID NO:45568, and are further defined in blocks of sequences corresponding to coding sequences characterized as (a) essential to SCN survival (SEQ ID NO:45569-SEQ ID NO:50775) and (b) other coding sequences and elements (SEQ ID NO:50776-SEQ ID NO:97729); and where the essential sequences are further defined in blocks of sequences corresponding to unigenes, EST's, or cDNA's which were (c) linked through bioinformatics analyses described herein to counterpart sequences entirely or partially known in the art (SEQ ID NO:47644-SEQ ID NO:50775) and (d) unique sequences exhibiting no known relationship to sequences known in the art (SEQ ID NO:45569-47643).

SEQ ID NO:97730-SEQ ID NO:119145 correspond to sequences predicted to comprise all or substantially all of one or more SCN promoter sequences.

SEQ ID NO:119146-SEQ ID NO:124352 correspond to amino acid sequences predicted to be encoded from the (a) essential and (b) other coding sequences set forth in SEQ ID NO:45569-SEQ ID NO:97729, and are further defined in blocks of sequences corresponding to (c) peptides essential to SCN survival, as set forth in SEQ ID NO:121221-SEQ ID NO:124352, each based on one or more BLASTP relationship to one or more proteins known to be essential to survival of *C. elegans* or other organisms (translated from SEQ ID NO:47644-SEQ ID NO:50775), and (d) other peptides lacking any BLASTP relationship to proteins known in the art, as set forth in SEQ ID NO:119146-SEQ ID NO:121220 (translated from SEQ ID NO:45569-SEQ ID NO:47643).

DETAILED DESCRIPTION OF THE INVENTION

The following is a detailed description of the invention provided to aid those skilled in the art in practicing the present invention. Those of ordinary skill in the art may make modifications and variations in the embodiments described herein without departing from the spirit or scope of the present invention.

The inventors have discovered all or substantially all of the polynucleotide sequences that comprise the genomic DNA obtained from the soybean cyst nematode *Heterodera glycines*, aligned the sequences to derived large blocks of sequence corresponding to genomic contigs set forth herein, analyzed these contigs to identify and characterize untranslated regulatory sequences, for example, promoters, introns, transcriptional initiation sequences, and polyadenylation signals. Genomic polynucleic acid sequences encoding all or part of one or more proteins and characterized as being essential for survival, such as amino acid sequences involved in various metabolic or catabolic biochemical pathways, cell division, reproduction, energy metabolism, digestion, neurological function and the like, are identified in the genomic DNA sequences disclosed in the present invention, and regions of such sequences are demonstrated herein as being useful for selection for use in preparing DNA constructs for use in transforming cells, and that also express double stranded RNA molecules from such constructs in the transformed cells, and when provided in the diet of a target pest, whether artificial diet or a natural diet, especially a plant cell, plant tissues or other plant parts, such as leaves, roots, stems, flowers, fruits or seeds, results in the fecundicity, morbidity, and/or mortality of the pest.

As described herein, ingestion by a target nematode pest of compositions containing one or more dsRNA molecules, wherein at least one segment of the dsRNA molecule corresponds to a substantially identical segment of RNA produced in the cells of the nematode, will result in death, growth inhibition, stunting, inhibition of maturation or fecundity of the nematode. These results indicate that a polynucleotide molecule, either DNA or RNA, derived from SCN can be used to design a DNA construct according to the methods of the present invention to express a recombinant gene product in a transgenic host cell. The host cell can be transformed to contain one or more of the polynucleotide molecules derived from sequences disclosed herein. The DNA construct transformed into the host cell transcribes one or more RNA sequences that form into a dsRNA molecule in the cell or biological fluids within the transformed host, thus making the dsRNA available for ingestion by nematode when it feeds upon the transgenic host. Therefore, the transformed host cell now contains within its genome the genetic potential to defend the host cell and its parents, siblings and children from attack by the nematode.

The present invention relates to genetic control of nematode infestations in host organisms. More particularly, the present invention includes the DNA constructs, selection of target polynucleotides and methods for delivery of nematode control agents to a nematode. The present invention provides methods for employing stabilized dsRNA molecules in the diet of the nematode as a means for suppression of targeted genes in the nematode, thus achieving desired control of nematode infestations in, or about the host or symbiont targeted by the nematode. The preferred host is a plant wherein the plant is transformed with a recombinant DNA construct that expresses recombinant stabilized dsRNA, siRNA, and/or miRNA molecules. The recombinant DNA construct comprises a nucleotide sequence that is transcribed into RNA by the host cell. The term "recombinant DNA" or "recombinant nucleotide sequence" refers to DNA that contains a genetically engineered modification through manipulation as a result of methods for mutagenesis, use of restriction enzymes, and thermal amplification methods, and the like.

The dsRNA molecules, siRNA molecules, and/or miRNA molecules of the present invention are homologous or complementary to at least about a contiguous 17-21 nucleotide sequence selected from the group consisting of SEQ ID NO:45569 through SEQ ID NO:97729. Isolated and purified nucleotide sequences from a SCN are provided from a genomic library constructed from polynucleotide sequences of the pest. The ingestion of such nucleotide sequences results in the reduction or elimination of an essential gene product necessary for the nematode's growth and development or other biological function.

The present invention also contemplates a transformed plant cell and transformed plants and their progeny. The transformed plant cells and transformed plants express one or more of the dsRNA, siRNA, or miRNA sequences of the present invention from one or more of the DNA sequences as set forth in SEQ ID NO:1-SEQ ID NO:45568 and SEQ ID NO:45569 through SEQ ID NO:97729, or the complement thereof.

As used herein the words "gene suppression", when taken together, are intended to refer to any method for reducing the levels of a gene product as a result of gene transcription to mRNA. Gene suppression is also intended to mean the reduction of protein expression from a gene or a coding sequence including posttranscriptional gene suppression and transcriptional suppression. Posttranscriptional gene suppression is intended to refer to that suppression mediated by the homology between all or a part of an RNA transcript transcribed from a gene or coding sequence targeted for suppression and the corresponding double stranded RNA used for suppression, and refers to the substantial and measurable reduction of the amount of available mRNA available in the cell for binding by ribosomes. The transcribed RNA can be in the sense orientation to effect what is referred to as co-suppression, in the anti-sense orientation to effect what is referred to as anti-sense suppression, or in both orientations producing a dsRNA to effect what is referred to as RNA interference (RNAi). Transcriptional suppression is intended to refer to that suppression mediated by the presence in the cell of a dsRNA, a gene suppression agent, exhibiting substantial sequence identity to a promoter DNA sequence or the complement thereof to effect what is referred to as promoter trans suppression. Gene suppression may be effective against a native plant gene associated with a trait, e.g., to provide plants with reduced levels of a protein encoded by the native gene or with enhanced or reduced levels of an affected metabolite. Gene suppression can also be effective against target genes in plant nematodes that may ingest or contact plant material containing gene suppression agents, specifically designed to inhibit or suppress the expression of one or more homologous or complementary sequences in the cells of a nematode or other pest.

Post-transcriptional gene suppression by anti-sense or sense oriented RNA to regulate gene expression in plant cells is disclosed in U.S. Pat. Nos. 5,107,065, 5,759,829, 5,283,184, and 5,231,020. The use of dsRNA to suppress genes in plants is disclosed in WO 99/53050, WO 99/49029, U.S. Patent Application Publication 2003/0175965 A1, and 2003/0061626 A1, U.S. patent application Ser. No. 10/465,800, and U.S. Pat. Nos. 6,506,559, and 6,326,193.

A preferred method of post transcriptional gene suppression in plants employs both sense-oriented and anti-sense-oriented, transcribed RNA, which is stabilized, e.g., as a hairpin and stem and loop structure. A preferred DNA construct for effecting post-transcriptional gene suppression is one in which a first segment transcribes an RNA molecule in an anti-sense orientation relative to the mRNA of the gene transcript targeted for suppression, the first segment further linked to a second segment spacer region that is not homologous or complementary to the first segment, and linked to a third segment that transcribes an RNA, wherein a portion is substantially complementarity to the first segment. Such a construct would be expected to form a stem and loop structure by hybridization of the first segment with the third segment and a loop structure forms comprising the second segment (WO94/01550, WO98/05770, US 2002/0048814A1, and US 2003/0018993A1).

As used herein, the term "nucleic acid", "polynucleic acid", or "polynucleotide" refers to a single or double-stranded polymer of deoxyribonucleotide or ribonucleotide bases (also referred to as nucleotides) read from the 5' to the 3' end. The polynucleic acid may optionally contain non-naturally occurring or altered nucleotide bases that permit correct read through by a polymerase. The term "nucleotide sequence" or "polynucleic acid sequence" may refer to both the sense and antisense strands of a polynucleic acid molecule as either individual single strands or in the duplex. The term "ribonucleic acid" (RNA) is inclusive of RNAi (inhibitory RNA), dsRNA (double stranded RNA), siRNA (small interfering RNA), mRNA (messenger RNA), miRNA (micro-RNA), tRNA (transfer RNA, whether charged or discharged with a corresponding acylated amino acid), and cRNA (complementary RNA) and the term "deoxyribonucleic acid" (DNA) is inclusive of cDNA and genomic DNA and DNA-RNA hybrids. The words "nucleic acid segment", "nucleotide sequence segment", or more generally "segment" will be understood by those in the art as a functional term that includes genomic sequences, ribosomal RNA sequences, transfer RNA sequences, messenger RNA sequences, operon sequences and smaller engineered nucleotide sequences or portions thereof that control or affect the expression of a gene product or that may be adapted to express proteins, polypeptides or peptides. A polynucleic acid may optionally contain naturally occurring or altered nucleotide bases that prevent polymerization by a first polymerase copying the strand that contains such base(s), i.e., one or more bases that cannot be templated by the first polymerase while polymerizing the nascent or growing strand, so that any nucleotide sequence extending beyond the non-templated base(s) results in a cohesive end that can be used to link the polynucleic acid to one or more other nucleic acid sequences linked to the complement of the cohesive end, resulting in a chimeric nucleotide sequence. The naturally occurring or altered nucleotide base(s) can then be templated to link the fragments comprising the chimeric nucleotide sequence by exposing the chimera to a second polymerase that recognizes the naturally occurring or altered nucleotide base(s) and copies that/those base(s) with fidelity (Jarrell et al. U.S. Pat. No. 6,358,712; Newton et al. 1993 21:1155-1162). This method may be particularly useful when assembling multi-component sequences for expression of an RNA sequence that folds into a dsRNA sequence and functions to suppress one or more genes in one or more target organisms.

As used herein, the term "nematode" refers to plant parasitic nematodes, in particular to members of the Tylenchoidea superfamily, and more specifically to the Heteroderidae family of nematodes that include the cyst nematodes (including at least Heterodera and Globodera species) and the rootknot nematodes (Meloidogyne species). More specifically to Heterodera species and even more specifically to Heterodera glycines, the soybean cyst nematode. Nematode species that were shown to have homologous target sequences with H. glycines polynucleotides of the present invention were: rootknot nematode species—Meloidogyne species such as M. arenaria, M. chitwoodi, M. artiellia, M. fallax, M. hapla, M. javanica, M. incognita, M. microtyla, M. partityla, M. panyuensis, and M. paranaensis; cyst nematode species—Heterodera species such as H. schachtii, Globodera species such as G. rostochiensis, G. pallida, and G. tabacum, Heterodera species such as H. trifolii, H. medicaginis, H. ciceri, H. mediterranea, H. cyperi, H. salixophila, H. zeae, H. goettingiana, H. riparia, H. humuli, H. latipons, H. sorghi, H. fici, H. litoralis, and H. turcomanica; lesion nematode species—Pratylenchus species such as P. scribneri, P. magnica, P. thornei, P. crenatus, P. brachyrus, P. vulnus, P. penetrans, P. coffeae, and P. neglectus; other plant parasitic nematode species include: Hirschmanniella species, Radopholus species such as R. similis, and Pratylenchoid magnicauda. Animal intestinal parasitic nematode species for which polynucleotides have been identified as a result of comparisons to the sequence data disclosed herein include Ascaris lumbricoides, and Ascaris suum.

As used herein, a "pest resistance" trait is a characteristic of a transgenic plant, transgenic animal, transgenic host or transgenic symbiont that causes the plant, animal, host, or symbiont to be resistant to attack from a pest that typically is capable of inflicting damage or loss to the plant, animal, host or symbiont. Such pest resistance can arise from a natural genetic variation or more typically from incorporation of recombinant DNA that confers pest resistance. Fire et al. (U.S. Pat. No. 6,506,599) generically described inhibition of pest infestation, and demonstrated gene suppression in the non-pest nematode species Caenorhabditis elegans. Similarly, Plaetinck et al. (US 2003/0061626A1) suggests using dsRNA to inhibit gene function in a variety of nematode pests. Mesa et al. (US 2003/0150017A1) describe using DNA sequences to transform host cells to express dsRNA sequences that are substantially identical to target sequences in specific pathogens, and particularly describe constructing recombinant plants expressing such dsRNA sequences for ingestion by various plant pests, facilitating down-regulation of a gene in the genome of the pest, and improving the resistance of the plant to the pest infestation. As used herein, the term "expression" refers to the transcription and stable accumulation of a nucleotide sequence comprising both sense and antisense RNA derived from the nucleic acid sequences disclosed in the present invention, whether or not the RNA sequence is capped, spliced, and polyadenylated and trafficked into the cytoplasm of the cell. Expression may also refer to translation of mRNA into a polypeptide or protein. As used herein, the term "sense" RNA refers to an RNA transcript corresponding to a sequence or segment that, when produced by the target nematode, is in the form of a mRNA that is capable of being translated into polypeptide by the target nematode cell. As used herein, the term "antisense RNA" refers to an RNA transcript that is complementary to all or a part of a mRNA that is normally produced in a cell of a nematode. The complementarity of an antisense RNA may be with any part of the specific gene transcript, i.e., at the 5' non-coding sequence, 3' non-translated sequence, introns, or the coding sequence. As used herein, the term "RNA transcript" refers to the product resulting from RNA polymerase-catalyzed transcription of a DNA sequence. When the RNA transcript is a perfect complementary copy of the DNA sequence, it is referred to as the primary transcript or it may be an RNA sequence derived from post-transcriptional processing of the primary transcript and is referred to as the mature RNA.

Exposure of a plant cyst forming nematode to the dsRNA, siRNA, or miRNA sequences of the present invention may occur during the nematodes' juvenile J2, J3, J4, adult female or adult male developmental stages. Exposure may occur as the J2 or male nematode is migrating through the plant vasculature, for example the cortical cells, or during or after establishment of a feeding site within syncytial cells. Exposure may occur by the production of the dsRNA in neighboring transfer-like cells with movement into the feeding site. dsRNA, siRNA, or miRNA may enter the nematode through a variety of means including, for example, through the stylet and pharnyx, the anus, the extratory duct, or amphidial and phasmid channels. dsRNA produced in the tissues of the feeding site may enter the nematode by transport through the feeding tube (Hussey, R S and Grundler et. al., 1998, Nematode parasitism of plants, Ch. 9, *The Physiology and Biochemistry of Free-living and Plant-parasitic Nematodes*, eds R N Perry and D J Wright), directly from the cytoplasm, from extracellular regions, or from other plant compartments. Movement of dsRNA, siRNA, or miRNA into the nematode may require that the RNA exhibit a molecular weight of less than or substantially less than 25 Kda (feeding tube size threshold). Creating an siRNA or miRNA in the plant that is bioavailable to the nematode may require preventing the siRNA from entering or remaining within the plant RISC complex, a protein complex well in excess of 25 KD. For example, this may be accomplished through a number of means such as (1) by co-expressing a small RNA-binding protein that exhibits a greater affinity for the plant RISC complex compared to the nematode specific siRNA, (2) by producing in the transgenic cell a nematode specific siRNA that is incompatible with the plant RISC complex yet functional in the nematode RISC complex, or (3) by down-regulating RISC complex expression in the feeding site established by the nematode. Small RNA-binding proteins may be optimized for binding to a specific siRNA or miRNA by modifying amino acid residues by phage display or other peptide selection methods.

As used herein, the phrase "inhibition of gene expression" or "inhibiting expression of a target gene in the cell of a nematode" may refer to the absence (or observable decrease) in the level of protein and/or mRNA product from the target gene. In the event that a particular transcript or translation product is not detectable, whether or not the lack of detection is a result of the expression of a dsRNA specifically designed to suppress the levels of such transcript or translation product, the phrase "inhibition of gene expression" or "inhibiting expression of a target gene in the cell of a nematode" may refer to the observation of a phenotypic effect or the lack thereof within the plant or within or about the target pest that feeds upon the transgenic plant. Specificity refers to the ability to inhibit the target gene without manifest effects on other genes of the cell and without any effects on any gene within the cell that is producing the dsRNA molecule. The inhibition of gene expression of one or more target genes in the nematode may result in novel phenotypic traits in the nematode.

Without limiting the scope of the present invention, there is provided, in one aspect, a method for controlling plant infestation by a nematode or other plant pest using stabilized dsRNA strategies. The method involves generating stabilized dsRNA molecules as one type of nematode control agents, that when provided in the diet of the nematode, induce gene silencing. As used herein, the phrase "generating a stabilized dsRNA molecule" refers to the methods of employing recombinant DNA technologies to construct a DNA nucleotide sequence that transcribes a stabilized dsRNA. As used herein, the term "silencing" refers the effective "down-regulation" of expression of one or more targeted nucleotide sequences within one or more cells of a nematode or other plant pest and, hence, the elimination of the ability of the targeted nucleotide sequence(s) to cause its normal effect within the cell.

The present invention also provides in part a delivery system for providing a nematode control agent to a nematode through exposure of the nematode to a host, such as a plant containing the one or more control agents of the present invention by ingestion of the plants' cells or the contents of those cells. One embodiment of the present invention provides for generating a transgenic plant cell or a plant that contains a recombinant DNA construct transcribing the stabilized dsRNA molecules of the present invention. As used herein, the phrase "generating a transgenic plant cell or a plant" refers to the methods of employing recombinant DNA technologies to construct a plant transformation vector transcribing the stabilized dsRNA molecules of the present invention, to transform a plant cell or a plant with such vector, and to generate the transformed plant cell or transgenic plant containing a part of the vector that transcribes the stabilized dsRNA molecules. In particular, the method of the present invention may comprise a recombinant DNA construct in a cell of a plant that results in dsRNA transcripts that are substantially homologous to an RNA sequence expressed by a nucleotide sequence contained within the genome of a nematode. Where the nucleotide sequence within the genome of a nematode comprises a gene essential to the viability and infectivity of the nematode, its down-regulation results in a reduced capability of the nematode to survive and/or infect and/or cause damage to host cells. Hence, such down-regulation results in a "deleterious effect" on the maintenance, viability, and infectivity of the nematode, in that it prevents or reduces the nematode's ability to feed off of and survive on nutrients derived from the host cells. By virtue of this reduction in the nematode's viability and infectivity, resistance and/or enhanced tolerance to infection by a nematode or other plant pest is facilitated in the cells of a plant.

It is envisioned that the compositions of the present invention can be incorporated within the seeds of a plant species either as a product of expression from a recombinant gene incorporated into the genome of the plant cells, or incorporated into a coating or seed treatment that is applied to the seed before planting. A plant derived from a single plant cell transformed to contain a recombinant or heterologous gene is considered herein to be a transgenic event.

The present invention also includes seeds and plants having more that one agronomically important trait. Such combinations are referred to as "stacked" traits. These stacked traits can include a combination of traits that are directed at the same target nematode pest, or they can be directed at different target nematode pests, or to one or more insect pests, or can provide herbicide tolerance to the plant, for example tolerance to glyphosate herbicide. The stacked traits can be achieved by breeding to plants that have the trait or by building a chimeric DNA construct that contains multiple plant expression cassettes and transforming the expression cassettes into the genome of the plant.

Cells of a plant seed of the present invention may express one or more dsRNA's, the sequence of any one of which is derived from a target sequence, i.e., a nematode specific sequence disclosed herein in SEQ ID NO:1-SEQ ID NO:45569, and also may express a nucleotide sequence that provides herbicide tolerance, for example, resistance to glyphosate, N-(phosphonomethyl) glycine, including the isopropylamine salt form of such herbicide. Herbicides for which transgenic plant tolerance has been demonstrated include but are not limited to: glyphosate, glufosinate, sulfonylureas, imidazolinones, bromoxynil, delapon, cyclohezanedione, protoporphyrionogen oxidase inhibitors, and isoxasflutole herbicides. Polynucleotide molecules encoding proteins involved in herbicide tolerance are known in the art, and include, but are not limited to a polynucleotide molecule encoding 5-enolpyruvylshikimate-3-phosphate synthase, bromoxynil nitrilase, phytoene desaturase, norflurazon, acetohydroxyacid synthase and the bar gene for tolerance to glufosinate and bialaphos (U.S. Pat. Nos. 5,627,061, 5,633,435, 6,040,497, 5,094,945, and 4,810,648).

As used herein, the term "pest control agent", or "gene suppression agent" refers to one or more particular RNA molecules consisting of a first RNA segment and a second RNA segment that are complimentary to each other and are linked by a third RNA segment. The complementarity between the first and the second RNA segments results in the ability of the two segments to hybridize in vivo and in vitro to form a double stranded molecule, i.e., a stem comprising the first and the second segments linked together by the third segment which forms a loop between the first and second segments, so that the entire structure forms into a stem and loop structure. Structures consisting of a first and a second segment that hybridize more tightly to each other may form into a stem-loop knotted structure. The first and the second segments, when hybridized together, correspond invariably, and not respectively, to a sense and an antisense sequence with respect to the target RNA transcribed from the target gene in the target nematode that is suppressed by the ingestion of the dsRNA molecule, or ingestion of an siRNA molecule derived from the dsRNA molecule. The pest control agent can also be a substantially purified (or isolated) nucleic acid molecule and more specifically nucleic acid molecules or nucleic acid fragment molecules thereof from a genomic DNA (gDNA) or cDNA library. Such substantially purified molecules can be applied to a seed, whether a seed from a transgenic plant or otherwise, in the form of a seed treatment, together with a pharmaceutically acceptable carrier for stabilizing the dsRNA molecules, resulting in the dsRNA being bioavailable within a plant grown from the seed, or bioavailability within the rhizosphere of the root system of the plant grown from the seed. A seed may be treated with one or more agents, each exhibiting different activities designed to provide the seed, the germinating seedling, and the growing plant or root with one or more advantages in comparison to other plants, such as pest resistance, including bacterial, fungal, and nematode resistance, fertilizers, growth stimulants, gene stimulants or suppressors, herbicide functions to which the seed, germ, and or roots and seedling are resistant, and the like. Alternatively, the fragments may comprise smaller dsRNA oligonucleotides comprising from about 15 to about 750 or more consecutive nucleotides selected from the group consisting of SEQ ID NO:1-SEQ ID NO:45569 and the complements thereof, or from about 15 to about 30 nucleotides, or from about 21 to about 24 consecutive nucleotides. The pest control agent may also refer to a DNA construct that comprises the polynucleic acid molecules or nucleic acid fragment molecules of the present invention and the DNA construct is a transgene incorporated into the genome of a host cell. The pest control agent may further refer to a plant comprising such a DNA construct in its genome or in the genome of a subcellular organelle that comprises the polynucleic acid molecules or nucleic acid fragment molecules described in the present invention. The method of the present invention provides for the production of a dsRNA transcript, the nucleotide sequence of which is substantially homologous to a targeted RNA sequence encoded by a target nucleotide sequence within the genome of a target pest.

As used herein, the term "genome" as it applies to cells of a nematode, a plant pest, or a host encompasses not only chromosomal DNA found within the nucleus, but organelle DNA found within subcellular components of the cell. The sequences of the present invention, when introduced into plant cells, can therefore be either chromosomally integrated or organelle-localized. The term "genome" as it applies to bacteria encompasses both the chromosome and plasmids within a bacterial host cell. The DNA's of the present invention introduced into bacterial host cells can therefore be either chromosomally integrated, localized to a plasmid, or to a viral vector capable of replication in the bacterial host.

In certain preferred embodiments expression of the gene targeted for suppression in the plant pest is inhibited by at least about 10%, at least about 33%, at least about 50%, at least about 80%, at least about 90%, at least about 95%, or by at least about 99% or more within cells of the nematode so a significant inhibition takes place. Significant inhibition is intended to refer to inhibition sufficient to result in a detectable phenotype (e.g., cessation of growth, paralysis, sterility, behavioral effects, second generation effects, effects observed on nematodes ingesting dsRNA or on their progeny, morbidity, or mortality, etc.) or a detectable decrease in RNA and/or protein corresponding to the target gene being inhibited. Although in certain embodiments of the invention inhibition occurs in substantially all cells of the nematode, in other preferred embodiments inhibition occurs in only a subset of cells that are contacted with the dsRNA, or that are expressing the target gene transcript.

The advantages of the present invention may include, but are not limited to the ease of introducing dsRNA into the nematode or other pest cells, the low concentration of dsRNA, siRNA, or miRNA which can be used, the stability of dsRNA, siRNA, or miRNA and the effectiveness of the inhibition. The present invention provides a method for selecting polynucleotide sequences of a target gene sequence and is not limited to in vitro use of specific sequence compositions identified by the method or to the set of exemplary target genes of the present invention. Segments of the nucleotide sequences of the present invention may be selected for their level of gene inhibition/suppression by scanning segments of the *H. glycines* sequences to identify segments that exhibit preferred levels of gene suppression or pest inhibition when provided as a dsRNA molecule in the diet of one or more target pests such as *H. glycines*.

As used herein, the term "sequence identity", "sequence similarity" or "homology" is used to describe sequence relationships between two or more nucleotide or amino acid sequences. The percentage of "sequence identity" between two sequences is determined by comparing two optimally aligned sequences over a comparison window, wherein the portion of the sequence in the comparison window may comprise additions or deletions (i.e., gaps) as compared to the reference sequence (which does not comprise additions or deletions) for optimal alignment of the two sequences. The percentage identity of a reference sequence to another is calculated by determining the number of positions at which the reference sequence (whether nucleic acid or amino acid sequence) is identical to another sequence to yield the number of matched positions, dividing the number of matched positions by the total number of positions in the window of comparison, and multiplying the result by 100 to yield the percentage of sequence identity. A sequence that is identical at every position in comparison to a reference sequence is said to be, with respect to a nucleotide sequence or amino acid sequence, identical to the reference sequence and vice-versa. A first nucleotide sequence when observed in the 5' to 3' direction is said to be the "complement" of, or complementary to, a second or reference nucleotide sequence observed in the 3' to 5' direction if the reverse complement of the first nucleotide sequence is identical at every nucleotide position with the second or reference sequence. As used herein, two nucleic acid sequence molecules are said to exhibit "complete complementarity" when every nucleotide of one of the sequences, when read 5' to 3', is complementary to every nucleotide of the other sequence when read 3' to 5'. A nucleotide sequence that is complementary to a reference nucleotide sequence will exhibit a sequence identical to the reverse complement sequence of the reference nucleotide sequence.

In practicing the present invention, a target gene may be derived from a nematode or other pest species that causes damage to one or more different crop plants and/or yield losses to such plants. Several criteria may be employed in the selection of target genes. The gene may be one whose protein product has a rapid turnover rate, so that dsRNA inhibition will result in a rapid decrease in protein levels. In certain embodiments it is advantageous to select a gene for which a small decrease in expression level results in deleterious effects for the pest. It may be desirable to target a broad range of nematode species and so a nucleotide sequence is selected that is highly conserved across the targeted range of species. Conversely, for the purpose of conferring specificity, in certain embodiments a nucleotide sequence is selected that contains regions that are poorly conserved between individual targeted pest species, or between the targeted pest and other organisms. In certain embodiments it may be desirable to select a nucleotide sequence that exhibits no known homology to sequences in other organisms. As used herein, the term "derived from" refers to a specified nucleotide sequence that may be obtained from a particular source or species.

Target genes for use in the present invention may include, for example, those that play important roles in the viability, growth, development, reproduction and infectivity of a particular pest. These target genes may be one or more of any house keeping gene, transcription factor and pest specific gene that provides an observable phenotype, in particular a phenotype that results in the suppression of feeding on or the inability to utilize a transgenic soybean plant expressing a SCN derived dsRNA as a nutrient source. For example, target genes that are anticipated herein to be effective in producing such phenotypes are similar to those that have been shown to affect the viability, growth, development, mobility, neurological stimulation, muscular function, and reproduction in *C. elegans*, including but not limited to the following phenotypes: (Adl) adult lethal, (Age), (Bli) blistered, (Bmd) body morphology defect, (Ced) Cell death abnormality, (Clr) clear, (Daf) DAuer Formation, (Dpy) dumpy, (Egl) egg laying defect, (Emb) embryonic lethal, (Evl) everted vulva, (Fem) feminization of XX and XO animals, (Fgc) Fewer Germ Cells, (Fog) feminization of germline, (Gon) GONad development abnormal, (Gro) slow growth, (Him) high incidence of male progeny, (Hya) HYperActive, (Let) larval lethal, (Lin) lineage abnormal, (Lon) long body, (Lpd), (Lva) larval arrest, (Lvl) larval lethal, (Mab) Male ABnormal, (Mei) Defective meiosis, (Mig) MIGration of cells abnormal, (Mlt) molt defect, (Morphology), (Mut) Mutator, (Muv) MUlti-Vulva, (Oma) Oocyte MAturation defective, (Pat) Paralyzed, Arrested elongation at Two-fold, (Pch) PatCHy coloration, (Pnm) Pronuclear migration alteration in early embryo, (Prl) paralyzed, (Prz) PaRaLyzed, (Pvl) protruding vulva, (Pvu) protruding vulva, (Rde), (Reproductive), (Rol) roller, (Rot) centrosome pair and associated pronuclear rotation abnormal, (Rup) exploded, (Sck) sick, (Sle) Slow embryonic development, (Slu) SLUggish, (Sma) small, (Spd) SpinDle, abnormal embryonic, (Spo) Abnormal embryonic spindle position and orientation, (Ste) sterile, (Stp) sterile progeny, (Unc) uncoordinated, (Unclassified), (Vul) vulvaless, (WT), (defect) morphological or behavioral defects. SCN genome sequences predicted to encode various gene products set forth herein annotated to the *C. elegans* specific genes previously shown to exert a negative effect or observable phenotype in *Drosophila* or in *C. elegans* are anticipated to be effective targets for achieving a similar phenotype when expressed in planta as a dsRNA for the purpose of suppressing a gene in SCN specifically targeted by the dsRNA. Gene sequences unique to SCN and not annotated to sequences or gene products from other organisms are also anticipated to be effective for achieving control of SCN when such sequences are provided in the diet of the SCN as a dsRNA because the target genes are unique to SCN pest metabolism, physiology, and pathogenicity.

DNA segments of the present invention are desired for use in constructing dsRNA expression sequences, particularly if the DNA segments exhibit at least from about 70% identity, or at least from about 75% identity, or at least from about 80% identity, or at least from about 90% identity, or at least from about 95% identity, or at least from about 98% identity, or at least about 100% identity to contiguous 17-24 nucleotide sequences found within the nematode genome or other pest sequences targeted for suppression. Sequences less than about 80% identical to a target gene are anticipated to be less effective and so less desirable. Inhibition is specific to the nematodes' gene or gene families, the sequence of which corresponds substantially to the dsRNA. Expression of unrelated genes is not affected. This specificity allows the selective targeting of a nematode or other pest species, resulting in the absence of an effect on non-target organisms exposed to the compositions of the present invention.

The regions predicted to be more effective at dsRNA-mediated gene silencing include regions that exhibit higher siRNA efficiency. Higher siRNA efficiency may be achieved by any technique, including, but not limited to, computational methods such as algorithms designed to predict siRNA efficiency based on thermodynamic characteristics of a given dsRNA (or DNA) sequence, generally considering sequences of from about 17, to about 18, to about 19, to about 20, to about 21, to about 22, to about 23, or even to about 24 contiguous nucleotides corresponding to a sequence that is being targeted for suppression (Schwarz et al., 200, Cell 115:199-208; Chalk et al. 2004, Biochem. Biophys. Res. Comm. 319:264-274; Ui-Tei et al., NAR 2004, 32:936-948; Reynolds et al., 2004, Nature Biotechnology 22:326-330).

Inhibition of a target gene using the stabilized dsRNA technology of the present invention is sequence-specific in that nucleotide sequences corresponding to the duplex region of the RNA are targeted for genetic inhibition. RNA containing a nucleotide sequences identical to a portion of the target gene is preferred for inhibition. RNA sequences with insertions, deletions, and single point mutations relative to the target sequence are also effective for gene specific inhibition. In performance of the present invention, it is preferred that the inhibitory dsRNA and the portion of the target gene share at least from about 75% sequence identity, or from about 80% sequence identity, or from about 90% sequence identity, or from about 95% sequence identity, or from about 99% sequence identity, or even about 100% sequence identity. Alternatively, the duplex region of the RNA may be defined functionally as a nucleotide sequence that hybridizes with a portion of the target gene transcript. A greater sequence homology across a target gene sequence that is less than full-length in comparison to the target gene compensates for a less homologous sequence that more closely approximates the full length of the target gene. The length of a nucleotide sequence that is identical to a portion of the target gene sequence can be from about 21, to about 25, to about 50, to about 100, to about 200, to about 300, or more contiguous bases. Normally, a sequence of greater than 20-100 nucleotides is preferable, although a sequence of greater than about 200-300 nucleotides may be preferred, depending on the length of the target gene. The invention has the advantage of being able to tolerate sequence variations due to genetic mutation, strain polymorphism, or evolutionary divergence. Therefore the nucleic acid molecule introduced into a plant for expression as a pest specific dsRNA gene suppression construct may not need to exhibit absolute homology, and may not need to represent the full length of the sequence targeted for suppression.

The dsRNA molecules may be synthesized either in vivo or in vitro. The dsRNA may be formed by a single self-complementary RNA strand or two complementary RNA strands expressed from separate expression constructs. Endogenous RNA polymerase of the cell may mediate transcription in vivo, or cloned RNA polymerase can be used for transcription in vivo or in vitro. Inhibition may be achieved by specific transcription in an organ, tissue, or cell type; stimulation of an environmental condition (e.g., infection, stress, temperature, chemical inducers); and/or engineering transcription at a developmental stage or age of the transgenic plant expressing the dsRNA construct. The RNA sequences expressed from the recombinant construct may or may not be polyadenylated. The RNA sequences expressed from the recombinant construct may or may not be capable of being translated into a polypeptide by a cell's translational apparatus.

The RNA, dsRNA, siRNA, or miRNA of the present invention intended for use in controlling plant pest infestation may be produced chemically or enzymatically through manual or automated reactions or in vivo in an organism other than the plant for which pest control is intended. RNA may also be produced by partial or total organic synthesis. Any modified ribonucleotide can be introduced by in vitro enzymatic or organic synthesis. The RNA may be synthesized by a cellular RNA polymerase or a bacteriophage RNA polymerase (e.g., T3, T7, SP6). If synthesized chemically or by in vitro enzymatic synthesis, the RNA may be purified prior to introduction into the cell or formulated in an agronomically acceptable carrier and applied to the soil, to the roots, or to the seed prior to planting. For example, RNA can be purified from a mixture by extraction with a solvent or resin, precipitation, electrophoresis, chromatography, or a combination thereof. Alternatively, the RNA may be used with no, or a minimum of, purification to avoid losses due to sample processing. The RNA may be dried for storage or dissolved in an aqueous solution. The solution may contain buffers or salts to promote annealing, and/or stabilization of the duplex strands.

For transcription from a transgene in vivo or from an expression cassette, a regulatory region (e.g., promoter, enhancer, silencer, leader, intron and polyadenylation) may be used to modulate the transcription of the RNA strand (or strands). Therefore, in one embodiment, the polynucleotide sequences constructed to facilitate transcription of the RNA molecules of the present invention are operably linked to one or more promoter sequences functional in a plant host. The polynucleotide sequences may be placed under the control of an endogenous promoter normally present in the host genome. The polynucleotide sequences of the present invention, under the control of an operably linked promoter sequence, may further be flanked by additional sequences that advantageously affect its transcription and/or the stability of a resulting transcript. Such sequences are generally located upstream of the promoter and/or downstream of the 3' end of the expression construct. The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream, within, or downstream of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, termination sequences, pausing sequences, polyadenylation recognition sequences, and the like.

In another embodiment, the nucleotide sequence of the present invention comprises an inverted repeat sequence separated by a spacer sequence. The spacer sequence may be a region comprising any sequence of nucleotides that facilitates secondary structure formation between the inverted repeat sequences. In one embodiment, the spacer sequence is part of the sense or antisense polynucleotide sequence for mRNA. The spacer sequence may alternatively comprise any combination of nucleotides or homologues thereof that are capable of being linked covalently to a nucleic acid molecule. The spacer sequence may comprise a contiguous sequence of nucleotides of from about 8-100 nucleotides in length, or alternatively from about 100-200 nucleotides in length, or from about 200-400 nucleotides in length, or from about 400-500 nucleotides in length, or from about 500 to about 1500 nucleotides in length.

The gene or genes targeted for suppression may be amplified using any thermal amplification means and the precise nucleotide sequence determined. One skilled in the art is able to modify the thermal amplification conditions in order to ensure optimal amplicon product formation, and the amplicon may be used as a template for in vitro transcription to generate sense and antisense RNA with the included minimal promoters.

As used herein, the phrase "a substantially purified nucleic acid", "an artificial sequence", "an isolated and substantially purified nucleic acid", or "an isolated and substantially purified nucleotide sequence", with respect to a naturally occurring nucleotide sequence, refers to a nucleic acid molecule that is substantially removed from the composition with which it is associated in its natural state. Examples of a substantially purified nucleic acid molecule include: (1) a DNA sequence comprising the contiguous sequence at least about 17, or about 18, or about 19 or more nucleotides in length consisting of a portion of a naturally occurring DNA molecule, but which is not flanked by polynucleotide sequences occur naturally on either end of the contiguous sequence; (2) a nucleic acid molecule comprising a naturally occurring contiguous nucleotide sequence isolated from its naturally occurring state and incorporated into a DNA construct; (3) a cDNA, a genomic DNA fragment isolated and purified substantially from all other genomic DNA to which it was originally naturally associated, an amplicon fragment produced using thermal amplification procedures, or a restriction fragment; (4) recombinant DNA; and (5) synthetic DNA. A substantially purified nucleic acid may also be comprised of one or more segments of any of the sequences referred to hereinabove.

Nucleic acid molecules, fragments thereof, and complements thereof selected from the group consisting of SEQ ID NO:1-45568 may be employed as probes or primers to identify related nucleic acid molecules from other species for use in the present invention to produce desired dsRNA, siRNA, and miRNA molecules. Such related nucleic acid molecules include the nucleic acid molecules that encode the complete amino acid sequence of a protein, and the promoters and flanking sequences of such molecules. In addition, such related nucleic acid molecules include nucleic acid molecules that encode gene family members. Such molecules can be readily obtained by using the above-described nucleic acid molecules or fragments thereof to screen complementary DNA or genomic DNA libraries obtained from a nematode or other plant pest species. The screen can be any physical means such as northern, southern, or any immunologically based screening method that detects either the specific sequence of a nucleotide molecule, or the transcribed and/or translated product of such nucleotide molecule, or any mathematical algorithm that is used for comparing nucleotide sequences in silico.

Nucleic acid molecules, fragments thereof, and complements thereof selected from the group consisting of SEQ ID NO:45569-SEQ ID NO:97729 may also be used in a similar fashion to screen other genomes, libraries, and organisms for related sequences. Such related sequences are expected to include but not be limited to homologues that include nucleic acid molecules that encode, in whole or in part, protein homologues of other pest species, plants or other organisms. Such molecules can be readily obtained by using the above-described nucleic acid molecules or fragments thereof to screen EST, cDNA or gDNA libraries. Such homologous molecules may differ in their nucleotide sequences from those found in one or more of SEQ ID NO:1-SEQ ID NO:45568 and SEQ ID NO:45569 through SEQ ID NO:97729 or complements thereof, because perfect complementarity is not required for such related sequences to hybridize to each other. In a particular embodiment, methods for 3' or 5' RACE may be used to obtain such sequences (Frohman, M. A. et al., *Proc. Natl. Acad. Sci.* (*U.S.A.*) 85:8998-9002, 1988; Ohara, O. et al., *Proc. Natl. Acad. Sci.* (*U.S.A.*) 86:5673-5677, 1989). In general, any of the above described nucleic acid molecules or fragments may be used to generate dsRNA's, siRNA's, and/or siRNA's that are suitable for use in a diet, in a spray-on mix, or in a recombinant DNA construct of the present invention.

As used herein, the phrase "coding sequence", "structural nucleotide sequence" or "structural nucleic acid molecule" refers to a polynucleotide molecule that is translated into a polypeptide when placed under the control of appropriate regulatory sequences. The structural nucleotide sequence, coding sequence, or structural nucleic acid molecule can be referred to using other terms in the art, but is intended to include DNA as well as RNA molecules. A coding sequence can include, but is not limited to, genomic DNA sequences or portions thereof identified to encode or to be capable of encoding a polypeptide, a cDNA produced as a result of reverse transcription of mRNA that has been purified substantially because if its ability to hybridize to a polyT sequence, expressed sequence tagged (EST) sequences, and recombinant nucleotide sequences produced specifically for expression of a protein sequence.

Two molecules are said to be "minimally complementary" if they can hybridize to one another with sufficient stability to permit them to remain annealed to one another under at least conventional "low-stringency" conditions. Similarly, the molecules are said to be complementary if they can hybridize to one another with sufficient stability to permit them to remain annealed to one another under conventional "high-stringency" conditions. Conventional stringency conditions are described by Sambrook, et al., (1985). Appropriate stringency conditions which promotes hybridization of two different nucleic acid sequences are, for example, incubation of the two sequences together in 6.0× sodium chloride/sodium citrate (SSC) at about 45° C. where one of the two different sequences is tethered in some fashion to a solid support and the untethered sequence is linked to a reporter molecule such as a ligand that can be detected using an immunological means, a fluorophores, a radioisotope, or an enzyme. The hybridization of the two sequences under the above conditions can be followed by a wash in 2.0×SSC at 50° C. to remove any excess reagents or unbound or unhybridized probe or untethered molecules (*Current Protocols in Molecular Biology*, John Wiley & Sons, N.Y. (1989), 6.3.1-6.3.6). For example, the salt concentration in the wash step can be selected from a low stringency of about 2.0×SSC at 50° C. to a high stringency of about 0.2×SSC at 50° C. In addition, the temperature in the wash step can be increased from low stringency conditions at room temperature (about 22° C.) to high stringency conditions (about 65° C.). Temperature and salt may be varied together or independent of each other.

A nucleic acid for use in the present invention may specifically hybridize to one or more of nucleic acid molecules from nematodes or complements thereof under moderately stringent conditions, for example at about 2.0×SSC and about 65° C. A nucleic acid for use in the present invention will include those nucleic acid molecules that specifically hybridize to one or more of the nucleic acid molecules disclosed therein as set forth in SEQ ID NO:1 through SEQ ID NO:47643 or complements thereof under high stringency conditions. Preferably, a nucleic acid for use in the present invention will exhibit at least from about 70%, at least from about 80%, at least from about 90%, at least from about 95%, at least from about 98% or even about 100% sequence identity with one or more nucleic acid molecules as set forth in SEQ ID NO:45569 through SEQ ID NO:47643.

Nucleic acids of the present invention may be entirely synthetically constructed or assembled piecemeal from naturally occurring or combinations of naturally occurring and synthetic components. All or any portion of the nucleic acids of the present invention may be synthesized without reference to codon usage calculated for any particular plant species, however when a particular sequence is intended to be effective in suppression of one or more genes in one or more pest species, it is preferable that the sequence be selected such that the sequence in any gene or species targeted for suppression be entirely or substantially entirely identical or entirely or substantially entirely complementary to the suppressor sequence.

The present invention also relates to recombinant DNA constructs for expression in a microorganism. Heterologous nucleic acids from which an RNA of interest is transcribed can be introduced into a microbial host cell, such as a bacterial cell or a fungal cell, in order to produce quantities of double stranded RNA for use in suppression of one or more genes in one or more plant pests.

The present invention also contemplates transformation of a polynucleotide sequence of the present invention into a plant to achieve nematode or other plant pest inhibitory levels of expression of one or more dsRNA molecules. A plant transformation vector comprises one or more nucleotide sequences that is/are capable of being transcribed as an RNA molecule and that is/are substantially homologous and/or complementary to one or more nucleotide sequences encoded by the genome of the nematode, or other plant pest, such that upon uptake of the RNA molecule, results in a down-regulation of expression of at least one of the respective nucleotide sequences of the nematode or other plant pest. In one embodiment the plant transformation vector is an isolated and purified DNA molecule comprising a promoter operatively linked to a contiguous nucleotide sequence comprising one or more polynucleotide molecules of the present invention selected from the group consisting of SEQ ID NO:45569 through SEQ ID NO:50775. The polynucleotide molecule includes a segment comprising all or part of a RNA molecule complementary to a targeted RNA within a nematode or pest cell, and may also contain a functional intron sequence positioned either upstream of or within the transcribed RNA sequence, and may also contain a five prime (5') untranslated leader sequence (i.e., a UTR or 5'-UTR) positioned between the promoter and the point of transcription initiation.

A plant transformation vector may contain sequences for suppression of more than one gene, thus allowing production of more than one dsRNA for inhibiting expression of two or more genes. One skilled in the art will readily appreciate that segments of DNA whose sequence corresponds to that present in different genes can be combined into a single composite DNA segment for expression in a transgenic plant to achieve suppression of one or more nematode or pest genes, one or more plant genes, or a combination thereof. Alternatively, a plasmid of the present invention already containing at least one DNA segment can be modified by the sequential insertion of additional DNA segments between an enhancer and/or promoter and the terminator sequences. A nematode or other plant pest control agent of the present invention may be designed for the inhibition of multiple genes, and the genes to be inhibited can be obtained from the same nematode or other plant pest species in order to enhance the effectiveness of the pest control agent, or from different races/variants of the same pest species, or from different pest species or other organisms. In certain embodiments, the genes derived from different nematodes or other plant pests provide for a broadening of the range of nematodes and other plant pests against which the pest control agent is effective. When multiple genes in one pest are targeted for suppression, a polycistronic DNA element can be fabricated (Fillatti, US Patent Application Publication No. US 2004-0029283 A1).

A promoter that drives expression of a polynucleotide sequence in a particular species of plant is selected for use in expression constructs in which a nucleotide sequence of the present invention is to be used to transform a plant. Promoters that function in different plant species are known in the art. Promoters useful for expression of polypeptides in plants are those that are inducible, viral, synthetic, or constitutive as described in Odell et al. (1985 Nature 313:810-812), and/or promoters that are temporally regulated, spatially regulated, and spatio-temporally regulated. For the purpose of the present invention, e.g., for optimum control of species that feed on roots, it is preferable to achieve the highest levels of expression of these genes within the roots of plants. A number of promoters exhibiting root-enhanced levels of expression of operably linked sequences have been identified. (Lu et al., 2000 J. Plant Phys., 156(2):277-283; U.S. Pat. Nos. 5,837, 848 and 6,489,542). Expression of the constructs of the present invention may preferably be from polymerase III promoters as an alternative to conventional polymerase II promoters, and also may be linked to inducible promoters, or heterologous promoters that require heterologous accessory proteins, such as for example, phage T7 promoters and the like. Promoters that are induced as a result of the establishment by a cyst nematode of a feeding site (feeding site specific promoters), and promoters up-regulated by nematode invasion are specifically contemplated for use in the present invention (Gheysen et al., 2002, Ann. Rev. Phytopathol. 40:191-219).

A recombinant DNA vector or construct of the present invention will typically comprise a marker that confers a selectable phenotype on transformed plant cells, and may also be used to select for plants or plant cells that contain the exogenous nucleic acids of the present invention. The marker may encode biocide resistance, antibiotic resistance (e.g., kanamycin, G418 bleomycin, hygromycin, etc.), or herbicide resistance (e.g., glyphosate, etc.). Examples of selectable markers include, but are not limited to, a neo gene (Potrykus et al., 1985 Mol. Gen. Genet. 199:183-188) which codes for kanamycin resistance and can be selected for using kanamycin, G418, etc.; a bar gene which codes for bialaphos resistance; a mutant EPSP synthase gene (Hinchee et al., 1988 Bio/Technology 6:915-922) which encodes glyphosate resistance; a nitrilase gene which confers resistance to bromoxynil (Stalker et al., 1988 J. Biol. Chem. 263:6310-6314); a mutant acetolactate synthase gene (ALS) which confers imidazolinone or sulphonylurea resistance (European Patent Application 154,204); an AMPA-acetyltransferase gene for resistance to phosphonates (U.S. Pat. No. 6,448,476), a methotrexate resistant DHFR gene (Thillet et al., 1988 J. Biol. Chem. 263:12500-12508), and compositions for chloroplast or plastid transformation selection (U.S. Pat. Nos. 5,693,507, 5,451,513, and WO 95/24492).

A recombinant vector or construct of the present invention may also include a screenable marker for monitoring expression. Exemplary screenable markers include a β-glucuronidase or uidA gene (GUS) which encodes an enzyme for which various chromogenic substrates are known (Jefferson, Plant Mol. Biol, Rep. 5.387-405, 1987; Jefferson et al., EMBO J. 6:3901-3907, 1987); an R-locus gene, which encodes a product that regulates the production of anthocyanin pigments (red color) in plant tissues (Dellaporta et al., Stadler Symposium 11:263-282, 1988); a β-lactamase gene (Sutcliffe et al., Proc. Natl. Acad. Sci. (U.S.A.) 75:3737-3741, 1978), a gene which encodes an enzyme for which various chromogenic substrates are known (e.g., PADAC, a chromogenic cephalosporin); a luciferase gene (Ow et al., Science 234:856-859, 1986) a xy/E gene (Zukowsky et al., Proc. Natl. Acad. Sci. (U.S.A.) 80:1101-1105, 1983) which encodes a catechol dioxygenase that can convert chromogenic catechols; an α-amylase gene (Ikatu et al., Bio/Technol. 8:241-242, 1990); a tyrosinase gene (Katz et al., J. Gen. Microbiol. 129:2703-2714, 1983) which encodes an enzyme capable of oxidizing tyrosine to DOPA and dopaquinone which in turn condenses to melanin; an α-galactosidase, which catalyzes a chromogenic α-galactose substrate; and a β-galactosidase which catalyzes the conversion of a chromogenic β-galactoside substrate.

In general a functional recombinant DNA is introduced at a non-specific location in a plant genome. In special cases it may be useful to insert a recombinant DNA construct by site-specific integration. Several site-specific recombination systems exist which are known to function implants include cre-lox as disclosed in U.S. Pat. No. 4,959,317 and FLP-FRT as disclosed in U.S. Pat. No. 5,527,695.

Preferred plant transformation vectors include those derived from a Ti plasmid of *Agrobacterium tumefaciens* (e.g. U.S. Pat. Nos. 4,536,475, 4,693,977, 4,886,937, 5,501,967 and European Patent Application No. 0122791). *Agrobacterium rhizogenes* plasmids (or "Ri") are also useful. Other preferred plant transformation vectors include those disclosed, e.g., by Herrera-Estrella (1983 Nature 303:209-213), Bevan (1983 Nature 304:184-187), Klee (1985 Bio/Technol. 3:637-642) and Eur. Pat Appl. No. EP0 120 516.

Methods and compositions for transforming plants by introducing a recombinant DNA construct into a plant genome includes any of a number of methods known in the art. One method for constructing transformed plants is microprojectile bombardment as illustrated in U.S. Pat. No. 5,015, 580 (soy), U.S. Pat. No. 5,550,318 (corn), U.S. Pat. No. 5,538,880 (corn), U.S. Pat. No. 6,153,812 (wheat), U.S. Pat. No. 6,160,208 (corn), U.S. Pat. No. 6,288,312 (rice) and U.S.

Pat. No. 6,399,861 (corn). Another method for constructing transformed plants is *Agrobacterium*-mediated transformation in cotton (U.S. Pat. No. 5,159,135), corn (U.S. Pat. No. 5,591,616), and soy (U.S. Pat. Nos. 5,824,877 & 6,384,301).

The term "transgenic plant cell" or "transgenic plant" refers to a plant cell or a plant that contains an exogenous or heterologous polynucleotide sequence. A transgenic plant also comprises progeny (seeds, and plants and seeds produced from such seeds, etc.) of any generation of such a transgenic plant or a seed of any generation of all such transgenic plants wherein said progeny or seed comprises the exogenous or heterologous polynucleotide sequence. The heterologous or polynucleotide sequence is a DNA molecule that is transcribed into the RNA, sRNA, dsRNA, siRNA, or miRNA or fragment thereof of the present invention.

A transgenic plant formed using *Agrobacterium* mediated transformation methods contains at least a single recombinant DNA sequence inserted into the plant chromosome and is referred to as a transgenic event. Such transgenic plants are referred to as being heterozygous for the inserted exogenous sequence. A transgenic plant homozygous with respect to a transgene can be obtained by sexually mating (selfing) an independent segregant transgenic plant that contains a single exogenous gene sequence to itself, for example an F0 plant, to produce F1 seed. One fourth of the F1 seed produced will be homozygous with respect to the transgene. F1 seed can be tested using a SNP or related thermal amplification assay that allows distinction between heterozygotes and homozygotes (i.e., a zygosity assay).

Transgenic plants can also be prepared by crossing a first plant having a recombinant DNA construct with a second plant lacking the construct. For example, a recombinant DNA designed for targeting the suppression of a target gene can be introduced into a first plant line to produce a transgenic plant which can be crossed with a second plant line to introgress the recombinant gene suppression DNA into the second plant line. The second plant line may already contain or be later transformed or bred with another transgenic line to contain one or more transgenes that are different from the gene suppression construct being introgressed from the first plant line.

Without intending to be limited to any single embodiment, the nucleotide sequences of the present invention exhibit a wide variety of usefulness. For example, the sequences can be used to synthesize dsRNA molecules either in in vivo or in vitro systems selected for their ability to cause gene suppression and therefore pest inhibition and such moleculed can be expressed in a transgenic plant, applied to the rhizosphere or biosphere of a plant, or applied in a seed coating or treatment for causing gene suppression in a pest. The sequences can be used in kits incorporating methods for detecting DNA, RNA, or siRNA's in a seed, plant, tissue, biological sample, meal, oil, flour, food product, commodity product, and the like. The sequences can be used for detecting the presence of a homologous sequence in a biological sample. The sequences can be used to construct a dsRNA for suppression of a target gene and can be linked to an RNA segment that binds specifically to one or more receptor molecules, bringing the dsRNA segment into close proximity to a membrane surface, and increasing its likelihood of being taken up by a cell which contains a gene that is targeted for suppression by the dsRNA.

In one embodiment, a nucleotide sequence of the present invention can be recorded on one or more computer readable media. As used herein, "computer readable media" refers to any tangible medium of expression that can be read and accessed directly by a computer. Such media include, but are not limited to: magnetic storage media, such as floppy discs, hard discs, and magnetic tape. Optical storage media include physical storage devices such as compact diskettes. Electrical storage media include random access and read only memory devices (RAM and ROM). A skilled artisan can readily appreciate that any of the presently known computer readable mediums can be used to create a manufacture comprising a computer readable medium having recorded thereon one or more sequences of the present invention. These devices can be accessed with a computer and used to perform a search and comparison of any other sequence of like composition (i.e., nucleotide sequences compared to nucleotide sequences, amino acid sequences compared to amino acid sequences, etc) to determine whether and to what extent a similarity or identity is present between the sequences being compared.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available for creating a computer readable medium having recorded thereon one or more sequences of the present invention. The choice of the data storage structure will generally be based on the means chosen to access the stored information. In addition, a variety of data processor programs and formats can be used to store the sequence information of the present invention on computer readable medium. The sequence information can be represented in a word processing text file, formatted in commercially available software such as Word-Perfect, Microsoft Word, or shareware such as Linux, or represented in the form of an ASCII text file, stored in a database application, such as DB2, Sybase, Oracle, or the like. The skilled artisan can readily adapt any number of data processor structuring formats (e.g. text file or database) in order to obtain computer readable medium having recorded thereon the nucleotide sequence information of the present invention.

Computer software is publicly available which allows a skilled artisan to access sequence information provided in a computer readable medium. Software which implements the BLAST (Altschul et al., *J. Mol. Biol.* 215: 403-410, 1990) and BLAZE (Brutlag, et al., *Comp. Chem.* 17: 203-207, 1993) search algorithms on a Sybase system can be used to identify open reading frames (ORFs) within sequences such as the EST's that are provided herein and that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification, and DNA replication, restriction, modification, recombination, and repair.

EXAMPLES

Example 1

This Example illustrates the construction and DNA sequence analysis of SCN genome libraries.

SCN genomic DNA libraries (LIB5513, LIB 5514, LIB5519, and LIB5520) were constructed from SCN strain OP25 genomic DNA (Dong et al., 1997, Genetics 146:1311-1318). The libraries were generated by ligating size-selected physically sheared DNA into the high copy number plasmid pUC18 and the resulting ligation mixture was transformed into *E. coli* by electroporation. 10 micrograms of SCN genomic DNA were resuspended into 30 microliters TE buffer. The DNA was sheared by sonication. The sonicated DNA was 5' end-repaired using T4 DNA polymerase (New England BioLabs) and 10 mM dNTP's in a total reaction volume of 35 microliters and equilibrated to 1× ligation buffer (New England BioLabs). 3' overhangs were repaired by treatment with T4 polynucleotide kinase. The mixture was incubated at 15° C. for 20 minutes, and transferred to 65° C. for 15 minutes to inactivate the kinase and polymerase, and incubated at room temperature for an additional 10 minutes. The repaired DNA was size fractionated by electrophoresis in a 0.7% agarose gel adjacent to a 1 Kb molecular weight marker at 80 volts for two hours in TBE buffer. The 2-4 KB and 4-8 KB DNA fragments were excised from the agarose gel and transferred into microcentrifuge tubes. The size-selected DNA fragments were isolated from the agarose gel and a second round of size selection was performed to eliminate small DNA fragments co-migrating with the selected range in first gel fractionation. Approximately 100 nanograms of the size-selected repaired DNA was inserted by ligation into a pUC18-HincII digested vector (molar ratio of 5 to 1). The ligated DNA was transformed into *E. coli* DH10B cells by electroporation and planted to LB plates containing 100 micrograms per milliliter ampicillin and incubated for 18-24 hours at 37 C. Several colonies that arose after incubation were randomly selected. The colonies were tested to determine the average DNA insert size and the average number of colonies in the library that appeared to contain no inserted recombinant DNA. Four libraries were constructed. The average insert size in library LIB5513 was 2-4 KB, in library LIB5514 was 4-8 KB, in library LIB5519 was 2-4 KB, and in library LIB5520 was 4-8 KB. Samples of each library were collected and combined together and deposited with the American Type Culture Collection (ATCC) at Rockville Md., USA on Feb. 15, 2005. The combined library was submitted to ATCC, designated as LIB5513_14_19_20, and the ATCC has assigned the patent deposit number PTA-6583 to the deposited material.

The cells of the libraries were then plated on large bioassay plates containing Luria Broth (Difco) supplemented with 100 microgram/milliliter carbenicillin (ICN Biomedical), 64 microgram/milliliter IPTG (Shelton Scientific) and 80 microgram/milliliter X-Gal (Shelton Scientific). Individual blue transformants were then picked into 1.2 ml Terrific Broth (Difco) supplemented with 125 μg/ml Ampicillin (Calbiochem) in 96 deep-well boxes by Genetix Q-bot. The boxes were incubated for 21 hours at 37° C., each well archived to individual wells in 384-well glycerol plates, and then pelleted and stored at −20 C.

Alkaline lysis DNA extraction was performed on samples of pelleted clones using a QUIAGEN bead based platform on an automated robotic preparation system. Eluted DNA was stored for sequencing at 4° C. in a 96-well COSTAR plate. Two microliters of the DNA solution was then transferred into a 384 well microtiter plate (AXYGEN) using a Hamilton MPH96 Pipetting Robot. The pipetted DNA was then denatured for 5 minutes at 95° C., and two microliters of Big Dye Reaction Mix (Big Dye Terminators v3.0, 3.2 pmol sequencing primer, 1×TNK, and 0.5M $MgCl_2$) was then added to the denatured DNA using a Hamilton MPH96 Pipetting Robot. Each clone was sequenced using M13 forward and reverse primers in a PCR sequencing reaction using the conditions as follows: 95° C. for 5 seconds, 45° C. for 5 seconds, 60° C. for 2 minutes 30 seconds for a total of 25 cycles. The sequencing reactions were ethanol precipitated and re-suspended in water and loaded onto an ABI 3730xl Sequencing Analyzer (APPLIED BIOSYSTEMS) to generate sequence trace data for each sample. Approximately 400,000 sequencing reads were generated from the four *Heterodera glycines* genome libraries.

Example 2

This Example illustrates the analysis, characterization, and assembly of the sequences obtained from DNA sequence analysis of the SCN genome libraries.

The sequence trace data was converted to sequence and quality files and standard quality control procedures were applied through the use of the block 0/1 pipelines. Quality control procedures included sequence quality trimming, sequence identity, cloning sequence removal, and contamination identification and removal. The results of the general sequencing pre-processing steps were stored in the sequence database SeqDB. Data passing quality controls were retrieved for inclusion in the assembly step. The dataset to be assembled consisted of 338,266 sequence reads that passed the block 0/1 process, represented by an initial output of 404,372 sequencing reads that were submitted to the block 0/1 process. A file of clone pair constraints was produced on the basis of known clone naming conventions and library construction details (insert size range). The clone pair constraint file consisted of 159,389 pairwise entries. Fasta, quality, and constraint files were used as input to the PCAP program (Version Date: Sep. 3, 2004, Huang, X., Wang, J., Aluru, S., Yang, S.-P. and Hillier, L. (2003): PCAP: A Whole-Genome Assembly Program. Genome Research, 13: 2164-2170), and the sequences were assembled. 45,568 output genomic contig sequences were produced whose sum length represented about 80.8 Million bases. These contig sequences are represented by the sequences as set forth in SEQ ID NO:1-SEQ ID NO:45568 and were subsequently used as input sequences to define generic regions of the SCN genome sequence corresponding to predicted coding sequences (referred to herein as vcDNA's or virtual complementary DNA's) and predicted promoter and intronic sequences.

SCN expressed sequences were collected from public sources and used to compare the genomic sequences identified herein as well as to identify unique sequences not present in any known public database set. Public sequences were collected into a file which contained non-identical contigs from (1) the Genome Sequencing Center at Washington University in St. Louis, Mo., USA (Nemagene clusters; McCarter et al., 2003, J. Nematology 35:465-469), (2) Parkinson contigs (Nembase clusters; Parkinson et al., 2004, Nature Genetics 36:1259-1267), (3) EST's in GenBank not contained in contigs (singletons), and (4) nucleotide sequences representing non-EST DNA sequences in GenBank (e.g., mRNAs). These sequences were compiled into and referred to herein as an essential gene sequence list corresponding to sequences as set forth herein at SEQ ID NO:47644-SEQ ID NO:50775.

Gene finding results were consolidated in a relational database in such a way that each predicted gene is represented by a set of coordinates that define the position of all segments of the gene on the genomic DNA contig (gDNA). The genes are described herein, and in particular in the Feature Fields of the Sequence Listing with reference to the nucleotide positions of each vcDNA giving rise to an amino acid sequence and in the amino acid sequence SEQ ID NO's as nucleotide sequences corresponding to portions of vcDNA's encoding the amino acid sequence. Sequences between the indicated protein coding portions correspond to predicted intronic sequences. Other sequence segments that are represented at least in the genomic sequences set forth in SEQ ID NO:1-SEQ ID NO:45568 include but are not limited to peptide-encoding segments such as initial exon, internal exon, terminal exon, or single exon and the like, and non-coding segments including promoter regions, transcription initiation sequences, transcription termination sequences, and polyadenylation signal sequences, and the like. Often the same position within a gDNA contig is predicted to contain a gene by more than one gene finding program. Thus, in order to prepare a library of genes where each position (locus) of the genome is represented by a single gene, several different gene prediction methods were applied and the results were consolidated according to the following algorithm.

1. For each gDNA contig, all clusters of overlapping genes were defined. Each cluster was assumed to correspond to a single gene. The cluster was defined as a set of sequences located on the same DNA strand and either predicted to overlap based on nucleotide sequence identity along the lengths of the sequences or predicted to be located closer than 50 nucleotides from each other. Only peptide-encoding segments were considered when defining a cluster. The start and end positions of the cluster define the maximal dimension of the gene.

2. For each cluster the preferred gene was selected, which represents this locus in the library. The selection algorithm is described as follows:

(a) All genes in a cluster were ranked by the gene-prediction method that produced them. The ranking by the different methods was intended to describe assumed accuracy of the method in predicting genes. The ranking was ordered arbitrarily using FgeneSH, Genemark.hmm and AAT/NAP data results. The AAT/GAP results were not ranked at all, but were used only if there were no other prediction for the locus, i.e. cluster contained only gene(s) predicted by AAT/GAP.

(b) The highest ranking gene was selected unless there were several equally ranked genes (i.e. predicted by the same method) or the cluster coverage by this gene was below 60%. The cluster coverage was computed as the ratio of the gene length to the length of the cluster (maximal dimension of the gene).

(c) For equally ranked genes, the gene with highest cluster coverage was selected.

(d) If the cluster coverage for the best-ranking gene was below 60%, the lower ranking genes were considered (in the ranking order) and the first one providing a gain in cluster coverage of at least 10% was selected.

(e) If a cluster contained only AAT/GAP-predicted genes—the one with the best cluster coverage was selected.

(f) For all other clusters, additional filtering was completed—only sequences that exhibited a translation product of at least 16 amino acids in length were selected.

(g) If a cluster contained only Genemark.hmm-predicted genes—no gene was selected and the locus was assumed not to contain any gene.

The method described above resulted in a list of "preferred" genes. The actual DNA sequence for each of these genes was prepared by extracting a subsequence (region of a sequence) of a gDNA contig which corresponded to the coordinates of the gene. The sequences prepared contained all predicted exons and introns of the gene. In the case of AAT/GAP and FgeneSH genes they also may contain regions between transcription and translation initiation sequences, and between translation termination and polyadenylation sequences.

The three gene-predicting programs—FgeneSH, Genemark.hmm and AAT/NAP—in addition to predicting positions of genes, also predict sequences of the translation product, if any. Thus, the "preferred" genes and their translated peptide sequences were simultaneously predicted by these methods. Virtual cDNA sequences (vcDNA) were prepared from genes derived only from AAT/GAP prediction results by extracting regions of genomic DNA (gDNA) corresponding to the predicted exons and splicing them together. These virtual cDNA sequences were translated using a translator tool. The feature fields of indicated peptide SEQ ID NO's identify genomic contig sequence positions (for example, Contig_ID=SeqID_XXX) for the coding sequence contained therein. Additional information provided in the feature fields includes the identity of SCN-specific sequences, the nucleotide positions of these sequences in the vcDNA sequence, homology to existing sequences in publicly available databases, a numerical evaluation of the extent of the homology, and the predicted function if any associated with the peptide.

The vcDNA sequences were used to identify sequences corresponding to SCN specific promoter sequences using the following procedure:

1. For each gene predicted by either of the FgeneSH, Genemark.hmm or AAT/NAP prediction algorithms, the position of the first peptide-encoding segment was used as the reference point for sequence extraction. The sequence of the gDNA contig which starts 1000 nucleotides upstream and ends 2 nucleotides downstream of the reference point was extracted.

2. The resulting sequence of the upstream region was shorter if the gene was located closer than 1000 nucleotides to the end of the genomic contig. If there was another gene located upstream and predicted by one of these methods—FgeneSH, Genemark.hmm or AAT/NAP, the upstream region was shortened (truncated) so that it did not overlap with the closest peptide-encoding segment of that gene. If the resulting sequence was shorter than 50 nucleotides, it was not included as a promoter sequence in the library of promoter sequences.

3. If the resulting sequence did not end with the translation initiation codon ATG, i.e., the predicted gene was not N-terminal complete—then the sequence was not included as a promoter sequence in the library of promoter sequences.

4. Sequences located upstream of AAT/GAP-predicted genes were not included in the library of promoter sequences since this program did not predict a translation initiation position and in certain situations placed the predicted gene on the wrong strand of a gDNA contig.

Example 3

This Example illustrates the annotation of predicted SCN genes.

Two methodologies were used to provide annotations of the predicted *Heterodera glycines* (SCN) peptides, including Gene ontology (GO) and SmartBlast. Both GO and SmartBlast procedures were developed through homology-based sequence searches. In GO procedures, the peptide sequences from SCN peptides were used to BLAST against a protein sequence database, for example, the non-redundant protein (nr-aa) database maintained by the National Center for Biotechnology Information as part of GenBank. The highly conserved homologues of nr-aa from a variety of species were further selected with a minimal E value of 1E-08. The selected SCN homologues were subjected to the sequence match with a protein sequence database (GO proteins from GO Ontology consortium). Finally, three categories according to the GO Ontology consortium (molecular function; biological process; and cellular component) were used to annotate the SCN sequences. In SmartBlast procedures, the peptide sequences from SCN peptides were also used to blast against the non-redundant protein as described above. The homologues were also selected with a minimal E value of 1E-08. Those homologues were subjected to filtering using some non-meaningful words, such as "putative". The best meaningful homologues were used for SCN sequence annotation. The conditions used to provide the homolog annotation and the best hit with respect to any predicted SCN gene product were referred to in one or more of the feature fields for each of the SCN protein sequences selected from the group consisting of SEQ ID NO:119146-SEQ ID NO:121220, and were further identified as to molecular function, enzyme activity, cellular component and biological process. Genes characterized as encoding proteins that may be essential for survival based on the proteins' relationship at least to one or more *C. elegans* homologs and the phenotype of the knockout of the *C. elegans* homolog were further identified in one or more of the feature fields of each of the peptide sequences. The phenotype observed, abbreviations for each, and the standard nomenclature assigned for each with reference to that same phenotype and nomenclature in *C. elegans* was identified previously hereinabove.

Example 4

This Example illustrates a method for screening the SCN genome sequences, the predicted vcDNA sequences, and the predicted amino acid sequence encoded therefrom, against other sequences and selecting sequences unique to SCN.

The sequences disclosed herein can be used in a method to provide a DNA construct for expression of a dsRNA that is effective for silencing of a gene in a soybean cyst nematode or other plant pest by expressing such DNA construct in the cells of a transgenic plant and providing the plant in the diet of the nematode or pest. DNA sequences can be selected from the sequences of the present invention that are useful in achieving dsRNA-mediated gene silencing by selecting from a target gene a DNA sequence consisting of at least from about 17 to about 21 or more contiguous nucleotides. Effective short interfering RNA's (siRNAs) for gene repression are normally from about 21 to about 23-nt long double-stranded RNA duplexes. These siRNA's are known to incorporate into the RNA-inducing silencing complex (RISC). Once unwound, the single-stranded antisense strand guides RISC to the target mRNA, and induces the cleavage of the target messages, resulting in translational inhibition (Dykxhoorn, et al. Molecular Cell Biology, 4:457-467, 2003). Plant siRNA sequences have been characterized generally as contiguous nucleotide sequences of from about 24 nucleotides in length (Tang, 2003, Genes & Development 17:49-63). It is preferred that interfering RNA molecules are selected from the sequences as set forth in SEQ ID NO:1-SEQ ID NO:97729 to limit the un-intended "off-target" effect of gene repression by limiting the potential base-pairing with unintended targets of the host or other non-target organisms.

Example 5

This example illustrates the identification of SCN genes that can be targeted for suppression using the nucleotide sequences of the present invention.

A comparison of the SCN genes was made to the genes identified in *C. elegans* for which knockouts have been previously identified to result in an observable phenotype. RNAi phenotypes include maternal sterile, embryonic lethal and a variety of postembryonic phenotypes. The relationship between *C. elegans* knockout phenotypes and their protein sequences were obtained. These protein sequences were then compared to the protein sequences translated from the SCN genomic sequences of the present invention.

A BLAST searchable "All Protein Database" was constructed, which was composed of genome-wise SCN peptides and *C. elegans* proteins. A reciprocal blast procedure was used to identify the possible orthologues of *C. elegans* for each SCN peptide.

The All Protein Database was queried using protein sequences of the SCN peptides using the "blastp" algorithm with an E-value cutoff of 1e-8. Up to 1000 hits were retained for each SCN peptide used in the query, and separated by organism names, either *C. elegans* or SCN. For *C. elegans*, a list was retained for the hits with SCN sequences exhibiting a more significant E-value than the best hit of the organism. The list contains likely duplicated SCN genes, and was referred to as a Core List. Another list was retained for all the hits from each organism, sorted by the E-value, and was referred to as a Hit List. The hit was identified as an orthologue of the query sequence if it was within the Core List.

Knockout phenotypes of SCN were inferred according to the degree of evolutionary relationship determined to exist between SCN and *C. elegans* proteins with reference to the knockout phenotypes of *C. elegans* genes, referred to herein above. For example, *C. elegans* C37H5.8 corresponds to a HSP-6 protein, and a knockout of this gene has been associated with the observed phenotypes of embryonic lethality and larval arrest. Orthologue identification from the above query indicated that an SCN amino acid sequence corresponding to SEQ ID NO:119310 is an orthologue of C37H5.8. Therefore, it is believed that because of the relationship of the SCN sequence corresponding to SEQ ID NO:119310 to the *C. elegans* orthologue C37H5.8, suppression of the SCN gene corresponding to SCN vcDNA sequence as set forth at SEQ ID NO:45733 encoding the C37H5.8 orthologue at SEQ ID NO:119310 would be expected to result in an observable phenotype corresponding to embryonic lethal and/or larva arrest in SCN. SCN genes have been categorized based on their relationship to identifiable orthologues with genes or sequences in other organisms and some are further identified as essential genes. Such information has been provided for each amino acid sequence predicted from the vcDNA sequences and is listed in the feature fields for each sequence in the sequence listing. The feature field in the sequence listing has been used to identify important features of the DNA molecules of the present invention. A DNA construct that contains target sequences from multiple SCN essential genes can be constructed to express a chimeric dsRNA molecule that affects more than one SCN gene. This aspect of the present invention reduces the possibility of selecting for a population of SCN that is unaffected by the dsRNA molecule.

SCN genes were grouped into Pfam protein families. Pfam is a comprehensive database of protein domain families, based on multiple alignments of protein domains or conserved protein regions (*Nucleic Acids Research* 2004 32:D138-D141; *Proteins* 28:405-420, 1997.). Peptide sequences of a subset of SCN genes have been matched to Pfam entries with HMMPFAM program, with an expectation value cutoff of 0.1 (Biological sequence analysis: probabilistic models of proteins and nucleic acids, Cambridge University Press, 1998.) The subset included 5207 SCN protein sequences that were analyzed by this method, and 3397 of the 5207 protein sequences were grouped into 909 families, as set forth in Table 1.

In order to target a protein gene family for suppression with a single dsRNA molecule, it may be necessary to identify conserved DNA sequence regions among protein gene family members. After the amino acid sequence translations from the virtual cDNA sequences were grouped into protein families, the conserved sequence regions were identified through multiple sequence alignment of the DNA sequences of the family members. For example, using the program CLSUTALW (ref. *Nucleic Acids Res.* 22:4673-4680), member sequences of a Pfam group can be aligned. One example is illustrated by an alignment of SEQ ID NO's representative of the nucleotide sequences encoding the protein family members in the MRP_L47 family, a mitochondrial ribosomal protein family, corresponding to SEQ ID NO:49132 (HG02471), SEQ ID NO:50709 (HGC08009), and SEQ ID NO:46538 (HG2_27019.C1.o1.np). An alignment of these three sequences allows the identification of conserved contiguous residues present in each of the three sequences. The conserved segments consisting of at least 21 contiguous nucleotides are representative of the preferred polynucleotide regions for expression in a double stranded RNA sequence for use in targeting the suppression of each member of the entire gene family. The comparison of protein sequences of family members identified and grouped in Table 1 enables the identification of related polynucleotide regions common among the family members by locating the corresponding cDNA and genomic contig sequences identified in the feature field of the Sequence Listing. Using this method of comparison, the protein sequences of family members identified in Table 1 and in SEQ ID NO:119146-SEQ ID NO:124352 allows the skilled artisan to identify the related polynucleotide regions that are common among the family members by locating the corresponding virtual cDNA (vcDNA) and genomic contiguous sequences as set forth in SEQ ID NO:1-SEQ ID NO:119145. These sequences can then be used in a DNA construct to express a dsRNA molecule in plant cells that is directed to the suppression of one or more genes in any of one or more plant pests. These polynucleotides can then be used in a DNA construct to express a homologous dsRNA molecule in plant cells.

TABLE 1

SCN GENE FAMILIES and ANNOTATIONS
SCN gene families

| Gene name | SCN gene family members | Protein annotation |
|---|---|---|
| bZIP_1 | SeqID_122625 SeqID_119811 SeqID_124042 SeqID_124331 SeqID_121799 | bZIP transcription factor |
| Mito_carr | SeqID_121264 SeqID_122047 SeqID_122051 SeqID_122111 SeqID_122259 SeqID_122457 SeqID_122504 SeqID_122594 SeqID_121347 SeqID_121360 SeqID_121361 SeqID_122965 SeqID_122993 SeqID_123057 SeqID_123135 SeqID_123186 SeqID_123212 SeqID_123240 SeqID_123284 SeqID_123348 SeqID_123379 SeqID_123391 SeqID_123930 SeqID_119420 SeqID_119539 SeqID_120127 SeqID_120194 SeqID_120280 SeqID_121563 SeqID_121585 SeqID_120988 SeqID_121115 SeqID_123589 SeqID_123608 SeqID_123626 SeqID_123732 SeqID_123814 SeqID_123863 SeqID_121678 SeqID_124088 SeqID_124151 SeqID_124350 SeqID_121751 SeqID_121752 SeqID_121870 | Mitochondrial carrier protein |
| bZIP_2 | SeqID_121260 SeqID_122546 SeqID_122625 SeqID_119811 SeqID_124042 SeqID_121799 | Basic region leucine zipper |
| Sec7 | SeqID_120412 | Sec7 domain |
| MutS_IV | SeqID_119581 | MutS family domain IV |
| CtaG_Cox11 | SeqID_119768 | Cytochrome c oxidase assembly protein Cta |
| Synaptobrevin | SeqID_122614 SeqID_122853 SeqID_123133 SeqID_123159 SeqID_123266 SeqID_120966 SeqID_121065 SeqID_123723 | Synaptobrevin |
| Fer2 | SeqID_122093 SeqID_122357 SeqID_119370 SeqID_124223 SeqID_124309 | 2Fe—2S iron-sulfur cluster binding domain |
| WD40 | SeqID_121225 SeqID_121265 SeqID_122030 SeqID_122050 SeqID_122140 SeqID_122192 SeqID_122212 SeqID_122243 SeqID_122288 SeqID_122350 SeqID_122349 SeqID_122434 SeqID_122449 SeqID_122509 SeqID_122514 SeqID_122539 SeqID_122547 SeqID_121310 SeqID_121337 SeqID_121375 SeqID_122883 SeqID_122959 SeqID_122996 SeqID_123045 | WD domain, G-beta repeat |

TABLE 1-continued

SCN GENE FAMILIES and ANNOTATIONS
SCN gene families

| Gene name | SCN gene family members | Protein annotation |
|---|---|---|
| | SeqID_123090 SeqID_123107 | |
| | SeqID_123122 SeqID_123198 | |
| | SeqID_123318 SeqID_123329 | |
| | SeqID_121391 SeqID_119248 | |
| | SeqID_119272 SeqID_119279 | |
| | SeqID_119343 SeqID_119431 | |
| | SeqID_119538 SeqID_119627 | |
| | SeqID_119670 SeqID_119769 | |
| | SeqID_119826 SeqID_119840 | |
| | SeqID_119913 SeqID_119990 | |
| | SeqID_121523 SeqID_120032 | |
| | SeqID_120112 SeqID_120134 | |
| | SeqID_120235 SeqID_120302 | |
| | SeqID_120344 SeqID_120362 | |
| | SeqID_120457 SeqID_120458 | |
| | SeqID_120507 SeqID_120508 | |
| | SeqID_120576 SeqID_120747 | |
| | SeqID_120826 SeqID_120866 | |
| | SeqID_120885 SeqID_120945 | |
| | SeqID_120994 SeqID_120997 | |
| | SeqID_121007 SeqID_121094 | |
| | SeqID_121096 SeqID_121116 | |
| | SeqID_121184 SeqID_121199 | |
| | SeqID_123563 SeqID_123612 | |
| | SeqID_123643 SeqID_123841 | |
| | SeqID_123880 SeqID_121640 | |
| | SeqID_123965 SeqID_124104 | |
| | SeqID_124118 SeqID_124150 | |
| | SeqID_124186 SeqID_124334 | |
| | SeqID_121790 SeqID_121804 | |
| | SeqID_121816 SeqID_121840 | |
| | SeqID_121844 | |
| Skp1 | SeqID_121262 SeqID_122339 SeqID_121318 SeqID_119848 | Skp1 family, dimerisation domain |
| Fer4 | SeqID_122076 SeqID_122198 SeqID_120449 SeqID_120455 SeqID_124131 | 4Fe—4S binding domain |
| Enolase_C | SeqID_122156 SeqID_123621 | Enolase, C-terminal TIM barrel domain |
| Mucin | SeqID_120313 | Mucin-like glycoprotein |
| NHL | SeqID_121326 | NHL repeat |
| FAT | SeqID_122973 SeqID_120212 | FAT domain |
| Iso_dh | SeqID_122456 SeqID_120630 SeqID_123561 | Isocitrate/isopropylmalate dehydrogenase |
| APH | SeqID_122384 SeqID_122682 SeqID_121416 SeqID_119410 SeqID_119453 SeqID_119764 SeqID_121622 SeqID_120808 SeqID_124140 SeqID_121803 | Phosphotransferase enzyme family |
| Suf | SeqID_122937 | Suppressor of forked protein (Suf) |
| Enolase_N | SeqID_122156 SeqID_123621 | Enolase, N-terminal domain |
| Ldh_1_C | SeqID_122492 SeqID_120389 SeqID_123782 | lactate/malate dehydrogenase, alpha/beta C-t |
| HMG_CoA_synt | SeqID_122417 SeqID_120809 SeqID_121837 | Hydroxymethylglutaryl-coenzyme A synthas |
| PLDc | SeqID_119325 SeqID_120704 | Phospholipase D Active site motif |
| Glycos_transf_1 | SeqID_121164 | Glycosyl transferases group 1 |
| Dala_Dala_lig_C | SeqID_119260 | D-ala D-ala ligase C-terminus |
| Kunitz_BPTI | SeqID_122170 SeqID_119622 SeqID_119623 | Kunitz/Bovine pancreatic trypsin inhibito |
| Nuc_sug_transp | SeqID_119240 | Nucleotide-sugar transporter |
| cobW | SeqID_122575 | CobW/HypB/UreG, nucleotide-binding domain |
| L15 | SeqID_121270 SeqID_122374 SeqID_123713 | Ribosomal protein L15 |
| Ldh_1_N | SeqID_122492 SeqID_121371 SeqID_122868 SeqID_120389 SeqID_123782 | lactate/malate dehydrogenase, NAD binding do |
| CLP_protease | SeqID_122193 SeqID_122948 SeqID_124275 SeqID_120143 SeqID_123619 SeqID_121952 | Clp protease |
| HEAT_PBS | SeqID_122486 SeqID_120345 SeqID_123693 | PBS lyase HEAT-like repeat |
| NIC | SeqID_121904 | Nucleoporin interacting component |
| SecY | SeqID_122609 SeqID_123948 | eubacterial secY protein |

TABLE 1-continued

SCN GENE FAMILIES and ANNOTATIONS
SCN gene families

| Gene name | SCN gene family members | Protein annotation |
| --- | --- | --- |
| PCI | SeqID_122070 SeqID_122383 SeqID_119309 SeqID_119633 SeqID_120088 SeqID_120892 SeqID_123711 SeqID_123975 SeqID_121783 | PCI domain |
| Abhydro_lipase | SeqID_119405 | ab-hydrolase associated lipase region |
| Mra1 | SeqID_123459 | Suppressor Mra1 |
| tRNA-synt_1b | SeqID_123017 SeqID_120260 SeqID_121648 | tRNA synthetases class I (W and Y) |
| NIF | SeqID_121832 | NLI interacting factor-like phosphatase |
| Laminin_G_1 | SeqID_120488 | Laminin G domain |
| tRNA-synt_1c | SeqID_122217 SeqID_122354 SeqID_123425 SeqID_119559 SeqID_120889 SeqID_123797 | tRNA synthetases class I (E and Q), cata |
| Laminin_G_2 | SeqID_120488 | Laminin G domain |
| tRNA-synt_1e | SeqID_119570 SeqID_119679 | tRNA synthetases class I (C) catalytic d |
| Acyl-CoA_dh_M | SeqID_123412 SeqID_119407 SeqID_119554 | Acyl-CoA dehydrogenase, middle domain |
| Mak16 | SeqID_123061 SeqID_120231 SeqID_120297 | Mak16 protein |
| Clp1 | SeqID_120900 | Pre-mRNA cleavage complex II protein Clp1 |
| Guanylate_cyc | SeqID_119460 | Adenylate and Guanylate cyclase catalyst |
| Acyl-CoA_dh_N | SeqID_122997 SeqID_123412 SeqID_119407 SeqID_119740 SeqID_124296 | Acyl-CoA dehydrogenase, N-terminal doma |
| RNase_PH_C | SeqID_122716 SeqID_120146 | 3' exoribonuclease family, domain 2 |
| MoeZ_MoeB | SeqID_120491 | MoeZ/MoeB domain |
| Chitin_synth_2 | SeqID_120016 | Chitin synthase |
| PAP_central | SeqID_122343 SeqID_119183 SeqID_120181 SeqID_120989 SeqID_121025 SeqID_123810 | Poly(A) polymerase central domain |
| rve | SeqID_119251 SeqID_119810 | Integrase core domain |
| RED_N | SeqID_120411 | RED-like protein N-terminal region |
| Ank | SeqID_123070 SeqID_119179 SeqID_119568 SeqID_119583 SeqID_119584 SeqID_119680 SeqID_119792 SeqID_119874 SeqID_120226 SeqID_121617 | Ankyrin repeat |
| CKS | SeqID_122543 SeqID_121066 | Cyclin-dependent kinase regulatory subunit |
| Band_7 | SeqID_122693 SeqID_119534 SeqID_123829 | SPFH domain/Band 7 family |
| PAF-AH_p_II | SeqID_120737 SeqID_121196 | Platelet-activating factor acetylhydrolas |
| SF-assemblin | SeqID_120078 | SF-assemblin/beta giardin |
| Ribosomal_S24e | SeqID_122807 SeqID_120291 SeqID_124204 SeqID_124210 SeqID_121954 | Ribosomal protein S24e |
| Ribosomal_S17e | SeqID_122394 SeqID_119329 SeqID_123964 | Ribosomal S17 |
| Sof1 | SeqID_122192 SeqID_120865 SeqID_120866 SeqID_124334 | Sof1-like domain |
| LrgB | SeqID_120612 | LrgB-like family |
| DUF1650 | SeqID_122945 SeqID_123077 SeqID_120203 | Protein of unknown function (DUF1650) |
| Laminin_EGF | SeqID_121392 SeqID_119297 SeqID_119335 SeqID_119714 SeqID_119816 SeqID_120849 SeqID_120911 | Laminin EGF-like (Domains III and V) |
| TruB_N | SeqID_119847 | TruB family pseudouridylate synthase (N term |
| tRNA-synt_2b | SeqID_122133 SeqID_122759 SeqID_119832 SeqID_120346 SeqID_120388 SeqID_120642 SeqID_121608 SeqID_121085 SeqID_121645 SeqID_124158 SeqID_124247 | tRNA synthetase class II core domain (G, |
| tRNA-synt_2c | SeqID_120391 | tRNA synthetases class II (A) |
| Innexin | SeqID_123073 SeqID_123480 SeqID_120601 | Innexin |

TABLE 1-continued

SCN GENE FAMILIES and ANNOTATIONS
SCN gene families

| Gene name | SCN gene family members | Protein annotation |
|---|---|---|
| tRNA-synt_2d | SeqID_122320 SeqID_119409 SeqID_121659 SeqID_124019 | tRNA synthetases class II core domain (F |
| MFS_1 | SeqID_119430 SeqID_119607 SeqID_120612 | Major Facilitator Superfamily |
| Cyt-b5 | SeqID_122136 SeqID_122505 SeqID_119879 SeqID_123602 | Cytochrome b5-like Heme/Steroid bindin |
| MAM33 | SeqID_122105 SeqID_123650 | Mitochondrial glycoprotein |
| ZZ | SeqID_120217 | Zinc finger, ZZ type |
| Dpy-30 | SeqID_122847 SeqID_121204 | Dpy-30 motif |
| K_tetra | SeqID_122369 SeqID_119930 SeqID_120530 | K+ channel tetramerisation domain |
| Tim44 | SeqID_123264 SeqID_119402 | Tim44-like domain |
| Mtap_PNP | SeqID_121534 SeqID_121548 SeqID_121569 | Phosphorylase family 2 |
| PDZ | SeqID_119401 SeqID_120527 | PDZ domain (Also known as DHR or GLGF) |
| CHCH | SeqID_123527 | CHCH domain |
| Ribonuc_red_sm | SeqID_122881 SeqID_120548 SeqID_121571 SeqID_121595 | Ribonucleotide reductase, small chain |
| Pro_isomerase | SeqID_122368 SeqID_122436 SeqID_122839 SeqID_123273 SeqID_121384 SeqID_119354 SeqID_120150 SeqID_123750 SeqID_123891 SeqID_121707 SeqID_124224 | Cyclophilin type peptidyl-prolyl cis-tr |
| DIX | SeqID_123325 | DIX domain |
| Hydrolase | SeqID_119435 | haloacid dehalogenase-like hydrolase |
| Peptidase_C1 | SeqID_121248 SeqID_121247 SeqID_121267 SeqID_122029 SeqID_122165 SeqID_122555 SeqID_122593 SeqID_123403 SeqID_123446 SeqID_121447 SeqID_119313 SeqID_123567 SeqID_123581 SeqID_123578 SeqID_121782 SeqID_121853 SeqID_121879 | Papain family cysteine protease |
| Peptidase_C2 | SeqID_123259 SeqID_120192 SeqID_120374 | Calpain family cysteine protease |
| E1-E2_ATPase | SeqID_122184 SeqID_119574 SeqID_119844 SeqID_120162 | E1-E2 ATPase |
| Peptidase_M13 | SeqID_122218 | Peptidase family M13 |
| FLYWCH | SeqID_119876 SeqID_120405 | FLYWCH zinc finger domain |
| Peptidase_M14 | SeqID_122059 SeqID_122194 SeqID_119546 SeqID_123807 SeqID_124007 | Zinc carboxypeptidase |
| Sec62 | SeqID_121454 | Translocation protein Sec62 |
| Sec63 | SeqID_120914 | Sec63 domain |
| Peptidase_M16 | SeqID_123296 SeqID_119755 SeqID_124192 | Insulinase (Peptidase family M16) |
| EGF | SeqID_119714 SeqID_119985 SeqID_120013 SeqID_120488 SeqID_120732 SeqID_120849 | EGF-like domain |
| Ribonuc_red_lgC | SeqID_121385 | Ribonucleotide reductase, barrel doma |
| UPF0027 | SeqID_121387 | Uncharacterized protein family UPF0027 |
| APC10 | SeqID_122598 SeqID_119693 SeqID_123584 | Anaphase-promoting complex, subunit 10 (APC1 |
| Integrin_alpha | SeqID_119890 | Integrin alpha cytoplasmic region |
| Dynein_heavy | SeqID_120763 SeqID_120973 | Dynein heavy chain |
| Chromo | SeqID_119766 SeqID_120561 | 'chromo' (CHRromatin Organisation MOdifier) |
| Surp | SeqID_122195 SeqID_120133 SeqID_124100 SeqID_124099 | Surp module |
| Lipase_GDSL | SeqID_122975 SeqID_120739 | GDSL-like Lipase/Acylhydrolase |
| ASC | SeqID_119784 | Amiloride-sensitive sodium channel |
| F-actin_cap_A | SeqID_123125 SeqID_119252 | F-actin capping protein alpha subunit |
| Ribosomal_L2_C | SeqID_122387 SeqID_122576 SeqID_119709 SeqID_123662 SeqID_124015 SeqID_121759 SeqID_121891 | Ribosomal Proteins L2, C-terminal doma |

TABLE 1-continued

SCN GENE FAMILIES and ANNOTATIONS
SCN gene families

| Gene name | SCN gene family members | Protein annotation |
|---|---|---|
| TPR_1 | SeqID_122178 SeqID_122894 SeqID_123022 SeqID_119202 SeqID_119274 SeqID_119429 SeqID_119528 SeqID_119687 SeqID_120074 SeqID_120605 SeqID_121168 SeqID_121175 SeqID_123940 | Tetratricopeptide repeat |
| NTP_transf_2 | SeqID_122343 SeqID_123810 | Nucleotidyltransferase domain |
| TPR_2 | SeqID_122178 SeqID_122894 SeqID_123022 SeqID_119202 SeqID_119274 SeqID_119429 SeqID_119528 SeqID_119687 SeqID_120074 SeqID_120591 SeqID_120605 SeqID_120748 SeqID_120947 SeqID_121168 SeqID_121175 SeqID_123940 | Tetratricopeptide repeat |
| TPR_4 | SeqID_119202 | Tetratricopeptide repeat |
| COesterase | SeqID_122237 SeqID_119940 SeqID_120067 SeqID_120891 SeqID_124012 | Carboxylesterase |
| TLE_N | SeqID_123010 SeqID_119913 | Groucho/TLE N-terminal Q-rich domain |
| F-box | SeqID_122666 SeqID_124313 | F-box domain |
| MRP-L47 | SeqID_122709 SeqID_120115 SeqID_124286 | Mitochondrial 39-S ribosomal protein L47 (MR |
| Col_cuticle_N | SeqID_121964 SeqID_121988 SeqID_121996 SeqID_122013 SeqID_122019 SeqID_122027 SeqID_122291 SeqID_122304 SeqID_122313 SeqID_122472 SeqID_122536 SeqID_122871 SeqID_122911 SeqID_122927 SeqID_122954 SeqID_123029 SeqID_123087 SeqID_123176 SeqID_123223 SeqID_123423 SeqID_119404 SeqID_119564 SeqID_119730 SeqID_119798 SeqID_120106 SeqID_120175 SeqID_120474 SeqID_120705 SeqID_120750 SeqID_123663 SeqID_121026 SeqID_121073 SeqID_123664 SeqID_123677 SeqID_123676 SeqID_123769 SeqID_123783 SeqID_123827 SeqID_121953 SeqID_121957 | Nematode cuticle collagen N-terminal do |
| Na_H_Exchanger | SeqID_120225 SeqID_120403 | Sodium/hydrogen exchanger family |
| ATP-synt_ab | SeqID_122131 SeqID_122660 SeqID_122734 SeqID_122935 SeqID_119160 SeqID_123656 SeqID_123806 SeqID_123805 SeqID_124022 | ATP synthase alpha/beta family, nucleot |
| zf-B_box | SeqID_120931 | B-box zinc finger |
| FMO-like | SeqID_122732 SeqID_120410 SeqID_124057 | Flavin-binding monooxygenase-like |
| Ribosomal_S26e | SeqID_122109 SeqID_120185 SeqID_123649 | Ribosomal protein S26e |
| Ribosomal_S19e | SeqID_122794 SeqID_123065 SeqID_123504 SeqID_124003 SeqID_124229 SeqID_121859 | Ribosomal protein S19e |
| Peptidase_C12 | SeqID_122328 SeqID_120007 SeqID_121135 SeqID_124005 | Ubiquitin carboxyl-terminal hydrolase, |
| Peptidase_C13 | SeqID_122230 SeqID_121453 SeqID_121467 SeqID_120219 SeqID_120537 SeqID_121597 SeqID_124041 SeqID_121721 SeqID_121872 SeqID_121883 | Peptidase C13 family |
| Peptidase_C14 | SeqID_123489 | Caspase domain |
| Peptidase_M24 | SeqID_122645 SeqID_124035 SeqID_124033 | metallopeptidase family M24 |
| Ribosomal_L6e_N | SeqID_122489 SeqID_123683 | Ribosomal protein L6, N-terminal doma |
| Paf1 | SeqID_119976 | Paf1 |
| DUF1671 | SeqID_123049 | Protein of unknown function (DUF1671) |

TABLE 1-continued

SCN GENE FAMILIES and ANNOTATIONS
SCN gene families

| Gene name | SCN gene family members | Protein annotation |
|---|---|---|
| Complex1_51K | SeqID_122912 SeqID_123104 SeqID_123995 | Respiratory-chain NADH dehydrogenase 51 |
| Peptidase_M28 | SeqID_122327 SeqID_122621 SeqID_119445 SeqID_123920 | Peptidase family M28 |
| PFK | SeqID_120213 | Phosphofructokinase |
| DAGAT | SeqID_123153 SeqID_120048 SeqID_121202 | Diacylglycerol acyltransferase |
| RNA_pol_Rpb7_N | SeqID_122067 SeqID_121484 SeqID_121111 SeqID_123690 | RNA polymerase Rpb7, N-terminal domain |
| DnaJ_C | SeqID_121279 SeqID_122722 SeqID_121405 SeqID_120879 SeqID_123882 | DnaJ C terminal region |
| zf-DNL | SeqID_122584 SeqID_124310 | DNL zinc finger |
| CNH | SeqID_123483 SeqID_120283 SeqID_121627 | CNH domain |
| DNA_ligase_A_M | SeqID_123044 SeqID_119293 | ATP dependent DNA ligase domain |
| DNA_ligase_A_N | SeqID_119293 | DNA ligase N terminus |
| LACT | SeqID_119637 | Lecithin:cholesterol acyltransferase |
| Ribosomal_L11_N | SeqID_122466 SeqID_122612 SeqID_122798 SeqID_120200 SeqID_120321 SeqID_121603 SeqID_123787 SeqID_124218 | Ribosomal protein L11, N-terminal dom |
| Sec8_exocyst | SeqID_123021 | Sec8 exocyst complex component specific |
| Coatomer_E | SeqID_122494 SeqID_120679 SeqID_123777 | Coatomer epsilon subunit |
| TT_ORF2 | SeqID_122828 SeqID_123933 | TT viral ORF2 |
| DNA_primase_S | SeqID_122299 SeqID_123968 | DNA primase small subunit |
| NACHT | SeqID_122493 SeqID_119176 | NACHT domain |
| Ribosomal_S27e | SeqID_122380 SeqID_122513 SeqID_119700 SeqID_120329 SeqID_123636 SeqID_123738 | Ribosomal protein S27 |
| Na_K-ATPase | SeqID_122309 SeqID_124043 | Sodium/potassium ATPase beta chain |
| TIP49 | SeqID_122138 SeqID_121376 SeqID_119157 SeqID_119793 SeqID_123801 | TIP49 C-terminus |
| GNT-I | SeqID_119837 | GNT-I family |
| Clathrin | SeqID_119727 | Region in Clathrin and VPS |
| MutS_V | SeqID_119581 SeqID_119594 SeqID_120288 SeqID_120369 | MutS domain V |
| Acyl_CoA_thio | SeqID_122480 SeqID_121327 SeqID_123795 SeqID_121650 SeqID_121919 | Acyl-CoA thioesterase |
| PTPA | SeqID_121340 SeqID_123363 SeqID_119880 | Phosphotyrosyl phosphate activator (PTPA) pr |
| UPF0113 | SeqID_122707 | Uncharacterised protein family (UPF0113) |
| dsrm | SeqID_119344 | Double-stranded RNA binding motif |
| Tom22 | SeqID_122077 SeqID_124129 | Mitochondrial import receptor subunit Tom22 |
| EGF_CA | SeqID_119714 SeqID_119985 SeqID_120013 SeqID_120732 | Calcium binding EGF domain |
| lsy1 | SeqID_122830 SeqID_120949 | lsy1-like splicing family |
| ELM2 | SeqID_120201 SeqID_120354 SeqID_121080 | ELM2 domain |
| HA2 | SeqID_122331 SeqID_119298 SeqID_120256 SeqID_120575 SeqID_123546 SeqID_124253 | Helicase associated domain (HA2) |
| RdRP | SeqID_119588 | RNA dependent RNA polymerase |
| 2-oxoacid_dh | SeqID_119602 SeqID_121525 SeqID_120978 | 2-oxoacid dehydrogenases acyltransferase |
| UDPGP | SeqID_123086 | UTP--glucose-1-phosphate uridylyltransferase |
| Arf | SeqID_121288 SeqID_122204 SeqID_122360 SeqID_122392 SeqID_122397 SeqID_122560 SeqID_122575 SeqID_122579 SeqID_122619 SeqID_122671 SeqID_123132 SeqID_123241 SeqID_123422 SeqID_119204 SeqID_119645 SeqID_119853 | ADP-ribosylation factor family |

TABLE 1-continued

SCN GENE FAMILIES and ANNOTATIONS
SCN gene families

| Gene name | SCN gene family members | Protein annotation |
|---|---|---|
| | SeqID_120523 SeqID_120531 | |
| | SeqID_121613 SeqID_123568 | |
| | SeqID_123726 SeqID_123740 | |
| | SeqID_123960 SeqID_123988 | |
| | SeqID_123991 | |
| UDPGT | SeqID_119517 | UDP-glucoronosyl and UDP-glucosyl transferas |
| Cystatin | SeqID_122804 SeqID_120505 SeqID_123974 | Cystatin domain |
| ATP-synt_F6 | SeqID_122448 SeqID_120742 SeqID_123680 | Mitochondrial ATP synthase coupling facto |
| Cyto_heme_lyase | SeqID_122106 SeqID_124078 | Cytochrome c/c1 heme lyase |
| DNA_pol_alpha_B | SeqID_120691 | DNA polymerase alpha subunit B |
| Arm | SeqID_122305 SeqID_122870 | Armadillo/beta-catenin-like repeat |
| | SeqID_121423 SeqID_119427 | |
| | SeqID_121148 SeqID_121201 | |
| | SeqID_124047 SeqID_121836 | |
| NTP_transferase | SeqID_122569 SeqID_122914 SeqID_120001 | Nucleotidyl transferase |
| LSM | SeqID_122052 SeqID_122121 | LSM domain |
| | SeqID_122135 SeqID_122405 | |
| | SeqID_122422 SeqID_122654 | |
| | SeqID_122720 SeqID_122860 | |
| | SeqID_123047 SeqID_119181 | |
| | SeqID_119424 SeqID_120049 | |
| | SeqID_120122 SeqID_121030 | |
| | SeqID_123658 SeqID_123725 | |
| | SeqID_123789 SeqID_123944 | |
| | SeqID_124195 | |
| NMT | SeqID_120382 | Myristoyl-CoA:protein N-myristoyltransferase |
| TRAP-delta | SeqID_122068 SeqID_120359 SeqID_123786 | Translocon-associated protein, delta subun |
| DDOST_48kD | SeqID_121541 SeqID_121553 | Dolichyl-diphosphooligosaccharide-protein |
| Ribosomal_S28e | SeqID_122545 SeqID_120643 SeqID_123620 | Ribosomal protein S28e |
| UPF0120 | SeqID_122142 SeqID_121137 | Uncharacterised protein family (UPF0120) |
| Ala_racemase_N | SeqID_121220 | Alanine racemase, N-terminal domain |
| MFAP1_C | SeqID_119946 | Micro-fibrillar-associated protein 1 C-termi |
| Aminotran_3 | SeqID_119827 | Aminotransferase class-III |
| ACBP | SeqID_121287 SeqID_119464 | Acyl CoA binding protein |
| PHD | SeqID_123154 SeqID_119379 | PHD-finger |
| | SeqID_119449 SeqID_119766 | |
| | SeqID_120788 | |
| Aminotran_4 | SeqID_122578 SeqID_119653 SeqID_119738 | Aminotransferase class IV |
| E3_binding | SeqID_121975 SeqID_120333 | e3 binding domain |
| Ribosomal_L37ae | SeqID_122763 SeqID_119302 | Ribosomal L37ae protein family |
| | SeqID_120838 SeqID_123781 | |
| | SeqID_124249 | |
| zf-CCCH | SeqID_121226 SeqID_122128 | Zinc finger C-x8-C-x5-C-x3-H type (and simil |
| | SeqID_122531 SeqID_122888 | |
| | SeqID_123330 SeqID_119331 | |
| | SeqID_119820 SeqID_120375 | |
| | SeqID_120658 SeqID_121599 | |
| | SeqID_121064 SeqID_123669 | |
| HMG-CoA_red | SeqID_120545 | Hydroxymethylglutaryl-coenzyme A reductas |
| CRAL_TRIO | SeqID_120518 | CRAL/TRIO domain |
| HAT | SeqID_120676 | HAT (Half-A-TPR) repeat |
| Asn_synthase | SeqID_120554 SeqID_120715 | Asparagine synthase |
| PDCD9 | SeqID_122558 SeqID_123575 | Mitochondrial 28S ribosomal protein S30 (PDC |
| zf-CSL | SeqID_122103 SeqID_120511 SeqID_123712 | CSL zinc finger |
| UBACT | SeqID_122346 SeqID_121362 | Repeat in ubiquitin-activating (UBA) protein |
| | SeqID_121432 SeqID_121452 | |
| | SeqID_119364 SeqID_124102 | |
| | SeqID_121935 | |
| Biotin_carb_C | SeqID_120976 | Biotin carboxylase C-terminal domain |

TABLE 1-continued

SCN GENE FAMILIES and ANNOTATIONS
SCN gene families

| Gene name | SCN gene family members | Protein annotation |
|---|---|---|
| Frizzled | SeqID_120827 | Frizzled/Smoothened family membrane region |
| FH2 | SeqID_120125 | Formin Homology 2 Domain |
| Coatomer_WDAD | SeqID_119681 SeqID_120257 | Coatomer WD associated region |
| zf-RanBP | SeqID_123008 SeqID_121015 | Zn-finger in Ran binding protein and oth |
| COQ7 | SeqID_122535 SeqID_119203 SeqID_123627 | Ubiquinone biosynthesis protein COQ7 |
| Ammonium_transp | SeqID_120017 | Ammonium Transporter Family |
| PTR2 | SeqID_119430 SeqID_120270 | POT family |
| MPPN | SeqID_119150 | MPPN (rrm-like) domain |
| Pyr_redox | SeqID_119535 SeqID_120156 | Pyridine nucleotide-disulphide oxidoreducta |
| Carn_acyltransf | SeqID_119995 | Choline/Carnitine o-acyltransferase |
| TUDOR | SeqID_121121 | Tudor domain |
| Krr1 | SeqID_120316 | Krr1 family |
| Asp | SeqID_122475 SeqID_123036 SeqID_123118 SeqID_123359 SeqID_121455 SeqID_120476 SeqID_120494 SeqID_123971 | Eukaryotic aspartyl protease |
| BACK | SeqID_120833 SeqID_121637 | BTB And C-terminal Kelch |
| Uso1_p115_head | SeqID_122989 | Uso1/p115 like vesicle tethering pro |
| ATP-synt_ab_C | SeqID_122371 SeqID_122660 SeqID_123656 SeqID_123806 SeqID_123805 | ATP synthase alpha/beta chain, C termin |
| Thiolase_C | SeqID_122429 SeqID_122772 SeqID_120310 SeqID_123864 | Thiolase, C-terminal domain |
| 5_nucleotid | SeqID_120648 | 5' nucleotidase family |
| FHA | SeqID_120176 SeqID_120836 | FHA domain |
| PID | SeqID_123247 | Phosphotyrosine interaction domain (PTB/PID) |
| Citrate_synt | SeqID_122637 SeqID_122705 SeqID_120172 SeqID_124243 | Citrate synthase |
| Helicase_C | SeqID_122054 SeqID_122318 SeqID_122331 SeqID_122336 SeqID_122624 SeqID_122677 SeqID_119233 SeqID_119298 SeqID_119324 SeqID_119620 SeqID_119843 SeqID_119917 SeqID_120153 SeqID_120168 SeqID_120256 SeqID_120323 SeqID_120342 SeqID_120575 SeqID_120689 SeqID_120814 SeqID_120914 SeqID_121032 SeqID_123546 SeqID_121674 SeqID_124119 SeqID_124137 SeqID_124148 SeqID_124325 | Helicase conserved C-terminal domain |
| Neur_chan_LBD | SeqID_121005 SeqID_121087 | Neurotransmitter-gated ion-channel lig |
| Ion_trans_2 | SeqID_121451 SeqID_119613 SeqID_119930 SeqID_119939 | Ion channel |
| Myosin_tail_1 | SeqID_123386 | Myosin tail |
| TMS_TDE | SeqID_122691 SeqID_119438 SeqID_124263 | TMS membrane protein/tumour differentially e |
| P16-Arc | SeqID_119921 | ARP2/3 complex 16 kDa subunit (p16-Arc) |
| ATP-synt_ab_N | SeqID_122110 SeqID_122131 SeqID_122660 SeqID_119160 SeqID_123806 SeqID_123811 SeqID_124022 | ATP synthase alpha/beta family, beta-ba |
| Endonuclease_NS | SeqID_123055 | DNA/RNA non-specific endonuclease |
| Thiolase_N | SeqID_122429 SeqID_122772 SeqID_121350 SeqID_122890 SeqID_122953 SeqID_123288 SeqID_123365 SeqID_121440 SeqID_121529 SeqID_120310 SeqID_123593 SeqID_123864 | Thiolase, N-terminal domain |
| Glycogen_syn | SeqID_121477 SeqID_120492 | Glycogen synthase |
| BTB | SeqID_119616 SeqID_120373 SeqID_121165 SeqID_121637 | BTB/POZ domain |
| DUF236 | SeqID_119224 SeqID_119247 SeqID_120712 SeqID_120713 | Protein of unknown function |

TABLE 1-continued

SCN GENE FAMILIES and ANNOTATIONS
SCN gene families

| Gene name | SCN gene family members | Protein annotation |
| --- | --- | --- |
| Ubiq_cyt_C_chap | SeqID_122228 SeqID_121449 SeqID_119888 SeqID_123755 | Ubiquinol-cytochrome C chaperone |
| Renin_r | SeqID_122129 SeqID_121442 SeqID_123862 | Renin receptor-like protein |
| Cwf_Cwc_15 | SeqID_122116 SeqID_120731 SeqID_121658 SeqID_124014 | Cwf15/Cwc15 cell cycle control protein |
| A_deaminase | SeqID_121003 | Adenosine/AMP deaminase |
| DUF164 | SeqID_121260 SeqID_123386 | Uncharacterized ACR, COG1579 |
| ATP-synt_C | SeqID_122557 SeqID_122592 SeqID_122805 SeqID_123522 SeqID_119902 SeqID_119958 SeqID_119959 SeqID_120137 SeqID_124207 SeqID_124336 | ATP synthase subunit C |
| ATP-synt_D | SeqID_122796 SeqID_123297 SeqID_123366 SeqID_123854 | ATP synthase subunit D |
| LAG1 | SeqID_121272 SeqID_122595 SeqID_121367 | Longevity-assurance protein (LAG1) |
| ATP-synt_E | SeqID_123534 | ATP synthase E chain |
| ATP-synt_F | SeqID_122088 SeqID_121348 SeqID_121745 SeqID_121827 SeqID_121881 | ATP synthase (F/14-kDa) subunit |
| Filamin | SeqID_120307 SeqID_120510 | Filamin/ABP280 repeat |
| MazG | SeqID_119952 | MazG nucleotide pyrophosphohydrolase domain |
| ATP-synt_G | SeqID_122669 SeqID_119783 SeqID_124110 | Mitochondrial ATP synthase g subunit |
| EF1_GNE | SeqID_121982 SeqID_122152 SeqID_122572 SeqID_119628 SeqID_119899 SeqID_123606 | EF-1 guanine nucleotide exchange domain |
| FAD_binding_1 | SeqID_122094 SeqID_122444 SeqID_123823 | FAD binding domain |
| FAD_binding_2 | SeqID_120807 | FAD binding domain |
| Dynein_light | SeqID_122635 SeqID_123252 SeqID_119812 SeqID_123564 | Dynein light chain type 1 |
| FAD_binding_3 | SeqID_122411 SeqID_123933 | FAD binding domain |
| Astacin | SeqID_122226 SeqID_122581 SeqID_123481 SeqID_119601 SeqID_120015 SeqID_120571 SeqID_120933 SeqID_121174 SeqID_121216 SeqID_124300 | Astacin (Peptidase family M12A) |
| Tfb4 | SeqID_122561 SeqID_123565 | Transcription factor Tfb4 |
| Adaptin_N | SeqID_120538 SeqID_120950 | Adaptin N terminal region |
| EFG_IV | SeqID_121397 SeqID_120540 | Elongation factor G, domain IV |
| S-AdoMet_synt_C | SeqID_123143 SeqID_119596 | S-adenosylmethionine synthetase, C-te |
| Ribosomal_S10 | SeqID_122673 SeqID_119858 SeqID_123703 SeqID_121948 | Ribosomal protein S10p/S20e |
| Ribosomal_S11 | SeqID_122146 SeqID_123024 SeqID_123430 SeqID_120073 SeqID_120744 SeqID_123697 SeqID_124177 | Ribosomal protein S11 |
| Ribosomal_S12 | SeqID_122060 SeqID_123235 SeqID_123361 SeqID_123428 SeqID_123434 SeqID_123629 SeqID_124279 | Ribosomal protein S12 |
| UCR_hinge | SeqID_122302 SeqID_123516 | Ubiquinol-cytochrome C reductase |
| SH3_1 | SeqID_123228 SeqID_119323 SeqID_120958 | SH3 domain |
| Ribosomal_S13 | SeqID_122782 SeqID_122809 SeqID_123978 SeqID_124200 | Ribosomal protein S13/S18 |
| SAP | SeqID_120587 | SAP domain |
| SH3_2 | SeqID_123228 SeqID_120958 | Variant SH3 domain |
| Ribosomal_S14 | SeqID_122064 SeqID_122107 SeqID_120012 SeqID_121048 SeqID_121107 SeqID_123630 SeqID_123890 | Ribosomal protein S14p/S29e |
| Brix | SeqID_121565 SeqID_123250 SeqID_119314 SeqID_120464 SeqID_120490 SeqID_121589 SeqID_121109 | Brix domain |
| Ribosomal_S15 | SeqID_122373 SeqID_123410 SeqID_123433 SeqID_121412 SeqID_123718 | Ribosomal protein S15 |

TABLE 1-continued

SCN GENE FAMILIES and ANNOTATIONS
SCN gene families

| Gene name | SCN gene family members | Protein annotation |
|---|---|---|
| Ras | SeqID_121288 SeqID_122204 SeqID_122360 SeqID_122392 SeqID_122397 SeqID_122560 SeqID_122575 SeqID_122579 SeqID_122619 SeqID_122671 SeqID_122838 SeqID_122872 SeqID_122903 SeqID_123052 SeqID_123189 SeqID_123241 SeqID_123414 SeqID_123422 SeqID_119204 SeqID_119290 SeqID_119645 SeqID_119708 SeqID_119885 SeqID_119891 SeqID_120379 SeqID_120664 SeqID_121613 SeqID_120982 SeqID_123605 SeqID_121093 SeqID_123568 SeqID_123726 SeqID_123740 SeqID_121691 SeqID_123960 SeqID_123988 SeqID_123991 SeqID_121918 | Ras family |
| zf-TAZ | SeqID_120357 | TAZ zinc finger |
| Ribosomal_S17 | SeqID_122602 SeqID_122629 SeqID_119883 SeqID_123918 SeqID_123925 | Ribosomal protein S17 |
| Ribosomal_S18 | SeqID_122652 | Ribosomal protein S18 |
| ELK | SeqID_120763 | ELK domain |
| Ribosomal_S19 | SeqID_122056 SeqID_123333 SeqID_123450 SeqID_123685 | Ribosomal protein S19 |
| C2 | SeqID_119599 SeqID_119684 SeqID_120248 | C2 domain |
| eIF-5_eIF-2B | SeqID_123321 SeqID_119265 SeqID_120603 SeqID_121769 | Domain found in IF2B/IF5 |
| VWD | SeqID_122463 SeqID_123112 SeqID_119726 SeqID_123592 | von Willebrand factor type D domain |
| GHMP_kinases | SeqID_123199 | GHMP kinases putative ATP- |
| PAP_RNA-bind | SeqID_120989 | Poly(A) polymerase predicted RNA binding |
| C4 | SeqID_119273 SeqID_119634 | C-terminal tandem repeated domain in t |
| P_proprotein | SeqID_121230 SeqID_122663 SeqID_123014 SeqID_123393 | Proprotein convertase P-domain |
| ELO | SeqID_122222 SeqID_122315 SeqID_119651 SeqID_121493 SeqID_120991 SeqID_124009 SeqID_124028 | GNS1/SUR4 family |
| p450 | SeqID_120075 SeqID_120579 | Cytochrome P450 |
| Complex1_30kDa | SeqID_121297 SeqID_119579 | Respiratory-chain NADH dehydrogenase, |
| wnt | SeqID_122540 | wnt family |
| OATP | SeqID_119717 | Organic Anion Transporter Polypeptide (OATP) |
| RIIa | SeqID_122847 SeqID_121204 | Regulatory subunit of type II PKA R-subunit |
| Pyrophosphatase | SeqID_122209 SeqID_123850 | Inorganic pyrophosphatase |
| A1_Propeptide | SeqID_122475 SeqID_123036 SeqID_123359 SeqID_121455 SeqID_120476 SeqID_120494 SeqID_123971 | A1 Propeptide |
| PRP1_N | SeqID_121212 | PRP1 splicing factor, N-terminal |
| RhoGAP | SeqID_120222 SeqID_120311 | RhoGAP domain |
| G-alpha | SeqID_120144 SeqID_120531 SeqID_120703 SeqID_121138 | G-protein alpha subunit |
| Guanylate_kin | SeqID_120766 | Guanylate kinase |
| HSF_DNA-bind | SeqID_123050 | HSF-type DNA-binding |
| DnaJ_CXXCXGXG | SeqID_121279 SeqID_122722 SeqID_121405 SeqID_121507 SeqID_120879 SeqID_121218 SeqID_123882 | DnaJ central domain (4 repeats) |
| Collagen | SeqID_121964 SeqID_121996 SeqID_122013 SeqID_122019 SeqID_122027 SeqID_122216 SeqID_122291 SeqID_122304 SeqID_122313 SeqID_122472 SeqID_122536 SeqID_122650 SeqID_121377 SeqID_122871 SeqID_122911 SeqID_122954 | Collagen triple helix repeat (20 copies) |

TABLE 1-continued

SCN GENE FAMILIES and ANNOTATIONS
SCN gene families

| Gene name | SCN gene family members | Protein annotation |
|---|---|---|
| | SeqID_123029 SeqID_123087 | |
| | SeqID_123176 SeqID_123223 | |
| | SeqID_123423 SeqID_119253 | |
| | SeqID_119404 SeqID_119418 | |
| | SeqID_119540 SeqID_119564 | |
| | SeqID_119634 SeqID_119798 | |
| | SeqID_119948 SeqID_119971 | |
| | SeqID_120106 SeqID_120175 | |
| | SeqID_120214 SeqID_120361 | |
| | SeqID_120474 SeqID_120626 | |
| | SeqID_120674 SeqID_120705 | |
| | SeqID_123663 SeqID_121026 | |
| | SeqID_121073 SeqID_121150 | |
| | SeqID_123664 SeqID_123677 | |
| | SeqID_123676 SeqID_123769 | |
| | SeqID_123783 SeqID_123827 | |
| | SeqID_121953 SeqID_121958 | |
| Tubulin_C | SeqID_122269 SeqID_122332 | Tubulin/FtsZ family, C-terminal domain |
| | SeqID_122440 SeqID_119159 | |
| | SeqID_119381 SeqID_119720 | |
| | SeqID_120775 SeqID_123545 | |
| | SeqID_123884 SeqID_123998 | |
| | SeqID_121849 SeqID_121940 | |
| JmjC | SeqID_122284 SeqID_120520 | jmjC domain |
| Zona_pellucida | SeqID_119201 SeqID_120047 | Zona pellucida-like domain |
| CH | SeqID_122025 SeqID_122264 | Calponin homology (CH) domain |
| | SeqID_122337 SeqID_122473 | |
| | SeqID_122788 SeqID_123499 | |
| | SeqID_119750 SeqID_120539 | |
| | SeqID_123855 SeqID_124085 | |
| | SeqID_124206 | |
| E-MAP-115 | SeqID_120063 | E-MAP-115 family |
| CPSase_L_D2 | SeqID_119260 SeqID_119619 | Carbamoyl-phosphate synthase L chain, A |
| | SeqID_120976 | |
| HMG_box | SeqID_122876 SeqID_122918 | HMG (high mobility group) box |
| | SeqID_121497 SeqID_120582 | |
| | SeqID_120832 SeqID_120943 | |
| Ribosomal_S25 | SeqID_122611 SeqID_122695 | S25 ribosomal protein |
| | SeqID_123417 SeqID_123597 | |
| | SeqID_124222 SeqID_124340 | |
| Ribosomal_S27 | SeqID_122053 SeqID_122726 | Ribosomal protein S27a |
| | SeqID_121490 SeqID_123637 | |
| | SeqID_123659 | |
| Galactosyl_T | SeqID_120408 | Galactosyltransferase |
| CS | SeqID_122778 SeqID_122828 | CS domain |
| | SeqID_123335 SeqID_121480 | |
| | SeqID_120610 | |
| Voltage_CLC | SeqID_120735 SeqID_121213 | Voltage gated chloride channel |
| Lactamase_B | SeqID_120930 | Metallo-beta-lactamase superfamily |
| eRF1_1 | SeqID_119244 | eRF1 domain 1 |
| eRF1_2 | SeqID_123076 SeqID_119244 | eRF1 domain 2 |
| Flavoprotein | SeqID_122326 SeqID_119773 | Flavoprotein |
| eRF1_3 | SeqID_123076 SeqID_119244 | eRF1 domain 3 |
| EMP24_GP25L | SeqID_122517 SeqID_119571 | emp24/gp25L/p24 family |
| | SeqID_123733 | |
| NOT2_3_5 | SeqID_122445 SeqID_121346 | NOT2/NOT3/NOT5 family |
| | SeqID_123876 | |
| Hydantoinase_A | SeqID_121246 SeqID_121266 | Hydantoinase/oxoprolinase |
| Plus-3 | SeqID_122270 | Plus-3 domain |
| IBB | SeqID_122870 SeqID_121423 | Importin beta binding domain |
| | SeqID_119952 SeqID_121148 | |
| Ald_Xan_dh_C2 | SeqID_120485 SeqID_121912 | Aldehyde oxidase and xanthine dehydroge |
| Complex1_49kDa | SeqID_120479 | Respiratory-chain NADH dehydrogenase, |
| SSrecog | SeqID_120076 | Structure-specific recognition protein |
| Aldo_ket_red | SeqID_123277 | Aldo/keto reductase family |
| TFIIS_C | SeqID_122597 SeqID_123714 | Transcription factor S-II (TFIIS) |
| Thioredoxin | SeqID_121221 SeqID_122115 | Thioredoxin |
| | SeqID_122712 SeqID_123314 | |
| | SeqID_120315 SeqID_120528 | |
| | SeqID_121134 SeqID_123686 | |
| | SeqID_123796 SeqID_121887 | |

TABLE 1-continued

SCN GENE FAMILIES and ANNOTATIONS
SCN gene families

| Gene name | SCN gene family members | Protein annotation |
|---|---|---|
| vATP-synt_E | SeqID_122754 SeqID_121463 SeqID_119218 SeqID_124020 SeqID_121724 | ATP synthase (E/31 kDa) subunit |
| Metallothio | SeqID_119714 | Metallothinein |
| Mo-co_dimer | SeqID_122426 SeqID_119301 SeqID_123908 | Mo-co oxidoreductase dimensation doma |
| ORC2 | SeqID_121926 | Origin recognition complex subunit 2 |
| Ribosomal_S30 | SeqID_122415 SeqID_123507 SeqID_120390 SeqID_123707 | Ribosomal protein S30 |
| SCP | SeqID_121229 SeqID_121227 SeqID_121228 SeqID_122770 SeqID_122767 SeqID_122864 SeqID_123501 SeqID_121425 SeqID_119399 SeqID_119556 SeqID_120347 SeqID_121641 | SCP-like extracellular protein |
| GPP34 | SeqID_120614 | Golgi phosphoprotein 3 (GPP34) |
| DM | SeqID_121139 | DM DNA binding domain |
| GTP_CDC | SeqID_119791 | Cell division protein |
| AhpC-TSA | SeqID_122512 SeqID_122760 SeqID_123258 SeqID_123300 SeqID_119348 SeqID_123739 SeqID_123758 | AhpC/TSA family |
| CAP_GLY | SeqID_123227 | CAP-Gly domain |
| XRCC1_N | SeqID_120679 | XRCC1 N terminal domain |
| DUF26 | SeqID_122879 | Domain of unknown function DUF26 |
| TRAP_beta | SeqID_122465 SeqID_119980 SeqID_123848 | Translocon-associated protein beta (TRAPB) |
| Cation_ATPase_N | SeqID_122184 SeqID_119574 SeqID_119844 SeqID_120162 SeqID_124141 SeqID_124234 | Cation transporter/ATPase, N-terminus |
| XPG_I | SeqID_120903 | XPG I-region |
| TFIID-31kDa | SeqID_122432 SeqID_123899 | Transcription initiation factor IID, 31 kD |
| ARPC4 | SeqID_123032 SeqID_121098 | ARP2/3 complex 20 kDa subunit (ARPC4) |
| Nop | SeqID_122208 SeqID_119511 SeqID_120274 SeqID_123696 | Putative snoRNA binding domain |
| DX | SeqID_119623 | DX module |
| Choline_kinase | SeqID_122682 SeqID_124140 SeqID_121776 | Choline/ethanolamine kinase |
| Seryl_tRNA_N | SeqID_122169 SeqID_124027 | Seryl-tRNA synthetase N-terminal domain |
| UFD1 | SeqID_122278 SeqID_122991 SeqID_120363 SeqID_123652 | Ubiquitin fusion degradation protein UFD1 |
| AICARFT_IMPCHas | SeqID_121071 | AICARFT/IMPCHase bienzyme |
| Adap_comp_sub | SeqID_122747 SeqID_119495 SeqID_120295 | Adaptor complexes medium subunit family |
| V_ATPase_I | SeqID_121161 | V-type ATPase 116 kDa subunit family |
| eIF-6 | SeqID_122640 SeqID_120843 SeqID_123945 | eIF-6 family |
| TAF | SeqID_121234 SeqID_122483 SeqID_122744 SeqID_122771 SeqID_119330 SeqID_121479 SeqID_121482 SeqID_124258 SeqID_124262 | TATA box binding protein associated fac |
| HSP70 | SeqID_121224 SeqID_121246 SeqID_121258 SeqID_121266 SeqID_122340 SeqID_122574 SeqID_121338 SeqID_123128 SeqID_123276 SeqID_121398 SeqID_121394 SeqID_121403 SeqID_121456 SeqID_119310 SeqID_119878 SeqID_121465 SeqID_121528 SeqID_120193 SeqID_120276 SeqID_120425 SeqID_120426 SeqID_120477 SeqID_120618 SeqID_120675 SeqID_123580 SeqID_121647 SeqID_123958 SeqID_121785 | Hsp70 protein |
| Rho_GDI | SeqID_123503 SeqID_119733 SeqID_121942 | RHO protein GDP dissociation inhibitor |
| E2F_TDP | SeqID_122353 SeqID_120460 SeqID_120823 SeqID_124183 | E2F/DP family winged-helix DNA-binding domai |

TABLE 1-continued

SCN GENE FAMILIES and ANNOTATIONS
SCN gene families

| Gene name | SCN gene family members | Protein annotation |
|---|---|---|
| VPS28 | SeqID_122699 SeqID_119677 SeqID_124233 | VPS28 protein |
| SNARE | SeqID_122431 SeqID_123902 | SNARE domain |
| CBM_14 | SeqID_120683 | Chitin binding Peritrophin-A domain |
| Fic | SeqID_119770 | Fic protein family |
| Peptidase_M16_C | SeqID_123083 SeqID_119755 | Peptidase M16 inactive domain |
| efhand | SeqID_122031 SeqID_122171 SeqID_122356 SeqID_122443 SeqID_122544 SeqID_122641 SeqID_122769 SeqID_122783 SeqID_122802 SeqID_122976 SeqID_123119 SeqID_119228 SeqID_119553 SeqID_119614 | EF hand |
| zf-CCHC | SeqID_122365 SeqID_122548 SeqID_123105 SeqID_121406 SeqID_121418 SeqID_119748 SeqID_119884 SeqID_119889 SeqID_121017 SeqID_121081 SeqID_121192 SeqID_123993 | Zinc knuckle |
| Rieske | SeqID_119282 | Rieske [2Fe—2S] domain |
| EF_TS | SeqID_122638 SeqID_121030 | Elongation factor TS |
| GTP_EFTU | SeqID_122392 SeqID_122600 SeqID_122657 SeqID_121329 SeqID_122792 SeqID_122872 SeqID_123241 SeqID_121430 SeqID_119311 SeqID_119332 SeqID_119352 SeqID_119600 SeqID_120413 SeqID_120540 SeqID_121558 SeqID_121576 SeqID_121613 SeqID_123754 SeqID_121709 SeqID_123950 SeqID_124180 SeqID_121717 SeqID_121740 SeqID_121805 SeqID_121824 | Elongation factor Tu GTP binding domain |
| TPD52 | SeqID_120171 | Tumour protein D52 family |
| UCR_TM | SeqID_119282 SeqID_121586 SeqID_121732 SeqID_121833 | Ubiquinol cytochrome reductase transmembrane |
| Coq4 | SeqID_120870 | Coenzyme Q (ubiquinone) biosynthesis protein |
| zf-HIT | SeqID_123532 | HIT zinc finger |
| CUB | SeqID_123097 SeqID_119304 | CUB domain |
| DUF32 | SeqID_119459 SeqID_119801 SeqID_121149 | Domain of unknown function DUF32 |
| adh_short | SeqID_121285 SeqID_122087 SeqID_122187 SeqID_122421 SeqID_122523 SeqID_122530 SeqID_122596 SeqID_121476 SeqID_120081 SeqID_120916 SeqID_123628 SeqID_123706 SeqID_123772 SeqID_123943 | short chain dehydrogenase |
| RGS | SeqID_121152 | Regulator of G protein signaling |
| PMM | SeqID_122570 SeqID_124322 | Eukaryotic phosphomannomutase |
| ER | SeqID_121000 | Enhancer of rudimentary |
| Patched | SeqID_120169 SeqID_120785 SeqID_120998 | Patched family |
| RRM_1 | SeqID_121236 SeqID_121239 SeqID_122099 SeqID_122100 SeqID_122122 SeqID_122126 SeqID_122158 SeqID_122202 SeqID_122250 SeqID_122361 SeqID_122469 SeqID_122526 SeqID_122528 SeqID_122549 SeqID_122676 SeqID_122700 SeqID_122831 SeqID_122888 SeqID_122938 SeqID_122962 SeqID_123004 SeqID_123008 SeqID_123071 SeqID_123101 SeqID_123331 SeqID_123370 SeqID_123384 SeqID_123396 SeqID_123424 SeqID_119150 SeqID_119180 SeqID_119191 SeqID_119215 SeqID_119241 SeqID_124159 SeqID_119361 SeqID_119362 SeqID_119398 | RNA recognition motif. (a.k.a. RRM, RBD, or |

TABLE 1-continued

SCN GENE FAMILIES and ANNOTATIONS
SCN gene families

| Gene name | SCN gene family members | Protein annotation |
|---|---|---|
| I-set | SeqID_119489 SeqID_119527 SeqID_119551 SeqID_124128 SeqID_119655 SeqID_119820 SeqID_119864 SeqID_119970 SeqID_121498 SeqID_121513 SeqID_120027 SeqID_123815 SeqID_120174 SeqID_120251 SeqID_120319 SeqID_120336 SeqID_120348 SeqID_120467 SeqID_120468 SeqID_120514 SeqID_120570 SeqID_120741 SeqID_120765 SeqID_123671 SeqID_121559 SeqID_121578 SeqID_121599 SeqID_121600 SeqID_121609 SeqID_120880 SeqID_120956 SeqID_121015 SeqID_121055 SeqID_121119 SeqID_121160 SeqID_123601 SeqID_123673 SeqID_123785 SeqID_123791 SeqID_123809 SeqID_123819 SeqID_123820 SeqID_123839 SeqID_121697 SeqID_124070 SeqID_124091 SeqID_124152 SeqID_124176 SeqID_124194 SeqID_124259 SeqID_121731 SeqID_121748 SeqID_121845 SeqID_121882 SeqID_121928 SeqID_121933 SeqID_123529 SeqID_119158 SeqID_119196 SeqID_119491 SeqID_119569 SeqID_119713 SeqID_119816 SeqID_120343 | Immunoglobulin I-set domain |
| TBC | SeqID_119295 SeqID_119731 SeqID_121193 | TBC domain |
| Calpain_III | SeqID_120374 | Calpain large subunit, domain III |
| CBFD_NFYB_HMF | SeqID_121234 SeqID_122039 SeqID_122046 SeqID_122119 SeqID_122455 SeqID_122483 SeqID_122582 SeqID_122688 SeqID_122744 SeqID_122766 SeqID_122771 SeqID_121314 SeqID_123003 SeqID_123317 SeqID_123463 SeqID_123473 SeqID_121448 SeqID_121446 SeqID_119330 SeqID_119493 SeqID_119512 SeqID_119521 SeqID_119609 SeqID_119776 SeqID_121479 SeqID_121482 SeqID_120790 SeqID_121601 SeqID_123744 SeqID_121643 SeqID_121663 SeqID_121675 SeqID_121684 SeqID_121688 SeqID_121706 SeqID_124105 SeqID_124164 SeqID_124258 SeqID_124262 SeqID_124276 SeqID_121771 SeqID_121809 SeqID_121823 SeqID_121905 | Histone-like transcription factor (CBF/ |
| UDPG_MGDP_dh_C | SeqID_123494 | UDP-glucose/GDP-mannose dehydrogenase |
| zf-UBP | SeqID_122511 SeqID_122662 SeqID_120244 | Zn-finger in ubiquitin-hydrolases and other |
| UPF0184 | SeqID_122379 SeqID_123860 | Uncharacterised protein family (UPF0184) |
| FF | SeqID_121478 SeqID_120846 SeqID_121180 | FF domain |
| Rhodanese | SeqID_123181 SeqID_123269 | Rhodanese-like domain |
| TBP | SeqID_120108 SeqID_121146 SeqID_121734 | Transcription factor TFIID (or TATA-binding |
| Cytochrom_C1 | SeqID_119212 | Cytochrome C1 family |
| PI-PLC-Y | SeqID_120248 | Phosphatidylinositol-specific phospholipase |

TABLE 1-continued

SCN GENE FAMILIES and ANNOTATIONS
SCN gene families

| Gene name | SCN gene family members | Protein annotation |
|---|---|---|
| Glycolytic | SeqID_121242 SeqID_121268 SeqID_122585 SeqID_121503 SeqID_120227 SeqID_120758 SeqID_123730 SeqID_124335 SeqID_121856 | Fructose-bisphosphate aldolase class-I |
| COX15-CtaA | SeqID_119736 | Cytochrome oxidase assembly |
| Actin | SeqID_121231 SeqID_121257 SeqID_122239 SeqID_122271 SeqID_122678 SeqID_122922 SeqID_122921 SeqID_122940 SeqID_122974 SeqID_122977 SeqID_122985 SeqID_123092 SeqID_123347 SeqID_123374 SeqID_123381 SeqID_123376 SeqID_123378 SeqID_123388 SeqID_123397 SeqID_123394 SeqID_123402 SeqID_119184 SeqID_121411 SeqID_119898 SeqID_121581 SeqID_121592 SeqID_123541 SeqID_123542 SeqID_123817 SeqID_123843 SeqID_121690 SeqID_124081 SeqID_124084 SeqID_124093 SeqID_124188 SeqID_124303 SeqID_121834 SeqID_121888 SeqID_121911 | Actin |
| ATP_synt_H | SeqID_122810 SeqID_120261 SeqID_124197 | ATP synthase subunit H |
| SET | SeqID_122866 SeqID_123437 SeqID_119452 SeqID_119703 SeqID_121141 | SET domain |
| Ribosomal_L5_C | SeqID_121970 SeqID_122399 SeqID_122665 SeqID_123116 SeqID_123183 SeqID_120376 SeqID_123547 SeqID_124178 | ribosomal L5P family C-terminus |
| ADK_lid | SeqID_121282 SeqID_122317 | Adenylate kinase, active site lid |
| GrpE | SeqID_122071 SeqID_123157 SeqID_123878 SeqID_121526 SeqID_120867 SeqID_123661 SeqID_121743 | GrpE |
| XRN_N | SeqID_122345 SeqID_121207 SeqID_124106 | XRN 5'-3' exonuclease N-terminus |
| Ribosomal_L1 | SeqID_122679 SeqID_122715 SeqID_124062 | Ribosomal protein L1p/L10e family |
| RhoGEF | SeqID_122254 SeqID_120745 | RhoGEF domain |
| Y_phosphatase | SeqID_123060 SeqID_119220 SeqID_119686 SeqID_119866 SeqID_119975 SeqID_120184 SeqID_120234 SeqID_120792 SeqID_121037 SeqID_121036 SeqID_121105 | Protein-tyrosine phosphatase |
| Ribosomal_L2 | SeqID_122387 SeqID_122576 SeqID_119709 SeqID_121219 SeqID_123662 SeqID_124015 SeqID_121891 | Ribosomal Proteins L2, RNA binding dom |
| 7tm_1 | SeqID_119786 | 7 transmembrane receptor (rhodopsin family) |
| Ribosomal_L3 | SeqID_122659 SeqID_122727 SeqID_123246 SeqID_121145 SeqID_123585 | Ribosomal protein L3 |
| Sdh_cyt | SeqID_122442 SeqID_123881 | Succinate dehydrogenase cytochrome b subunit |
| DNA_topoisoIV | SeqID_120500 | DNA gyrase/topoisomerase IV, subunit A |
| 7tm_2 | SeqID_120113 | 7 transmembrane receptor (Secretin family) |
| Ribosomal_L4 | SeqID_122113 SeqID_122385 SeqID_121324 SeqID_122845 SeqID_121127 SeqID_123536 SeqID_123727 | Ribosomal protein L4/L1 family |
| 7tm_3 | SeqID_120501 SeqID_120729 SeqID_120999 | 7 transmembrane receptor (metabotropic gluta |
| Ribosomal_L5 | SeqID_121970 SeqID_122399 SeqID_122665 SeqID_122908 SeqID_123116 SeqID_123183 | Ribosomal protein L5 |

TABLE 1-continued

SCN GENE FAMILIES and ANNOTATIONS
SCN gene families

| Gene name | SCN gene family members | Protein annotation |
|---|---|---|
| | SeqID_123517 SeqID_123547 SeqID_124178 | |
| PAPS_reduct | SeqID_120874 | Phosphoadenosine phosphosulfate reductase |
| Ribosomal_L6 | SeqID_122583 SeqID_123234 SeqID_121602 SeqID_120932 SeqID_123631 | Ribosomal protein L6 |
| ADAM_spacer1 | SeqID_119479 | ADAM-TS Spacer 1 |
| HSP90 | SeqID_121981 SeqID_122028 SeqID_122738 SeqID_121524 SeqID_120445 SeqID_120787 SeqID_121577 SeqID_123813 SeqID_121774 SeqID_121829 SeqID_121895 | HSP90 protein |
| Abhydrolase_1 | SeqID_119405 SeqID_121610 | alpha/beta hydrolase fold |
| Peptidase_M1 | SeqID_120743 SeqID_120851 | Peptidase family M1 |
| Herpes_LP | SeqID_120428 | Herpesvirus leader protein |
| Pescadillo_N | SeqID_122934 | Pescadillo N-terminus |
| Abhydrolase_3 | SeqID_119940 SeqID_120282 SeqID_120891 | alpha/beta hydrolase fold |
| CPSase_L_chain | SeqID_119260 SeqID_119619 | Carbamoyl-phosphate synthase L chain, |
| PMI_typeI | SeqID_122372 SeqID_123985 | Phosphomannose isomerase type I |
| Glyco_hydro_18 | SeqID_122290 SeqID_119433 SeqID_123731 SeqID_124053 | Glycosyl hydrolases family 18 |
| Profilin | SeqID_122484 SeqID_120556 SeqID_123780 SeqID_121762 SeqID_121862 | Profilin |
| RIO1 | SeqID_120808 | RIO1 family |
| TCTP | SeqID_122571 SeqID_123113 SeqID_121485 SeqID_120084 SeqID_120085 SeqID_123959 | Translationally controlled tumour protein |
| NTF2 | SeqID_122143 SeqID_123505 SeqID_123530 SeqID_119273 SeqID_120761 | Nuclear transport factor 2 (NTF2) domain |
| AP_endonuc_2 | SeqID_120685 | Xylose isomerase-like TIM barrel |
| GATase_2 | SeqID_122634 SeqID_119643 SeqID_123847 | Glutamine amidotransferases class-II |
| RRS1 | SeqID_122559 SeqID_122857 SeqID_123569 | Ribosome biogenesis regulatory protein (RRS1 |
| Gln-synt_C | SeqID_122482 SeqID_120289 | Glutamine synthetase, catalytic domain |
| Pribosyltran | SeqID_122656 SeqID_122880 SeqID_120272 SeqID_124138 | Phosphoribosyl transferase domain |
| DUF367 | SeqID_120808 | Domain of unknown function (DUF367) |
| PWP2 | SeqID_121293 | Periodic tryptophan protein 2 WD repeat asso |
| RNA_pol_Rpa2_4 | SeqID_119390 | RNA polymerase I, Rpa2 specific domain |
| HesB | SeqID_123420 | HesB-like domain |
| SPRY | SeqID_122960 SeqID_119817 | SPRY domain |
| COX4 | SeqID_122622 SeqID_122739 SeqID_121444 SeqID_121470 SeqID_120419 SeqID_121605 SeqID_123898 SeqID_121775 | Cytochrome c oxidase subunit IV |
| Gp-FAR-1 | SeqID_122790 SeqID_123533 SeqID_120157 SeqID_123934 SeqID_124215 | Nematode fatty acid retinoid binding protein |
| Gln-synt_N | SeqID_122482 SeqID_123792 | Glutamine synthetase, beta-Grasp domain |
| Transketolase_C | SeqID_119346 | Transketolase, C-terminal domain |
| Ctr | SeqID_119988 | Ctr copper transporter family |
| RCC1 | SeqID_122092 SeqID_120326 SeqID_123910 | Regulator of chromosome condensation (RCC1) |
| Pkinase_Tyr | SeqID_121233 SeqID_121271 SeqID_122086 SeqID_122117 SeqID_122221 SeqID_122233 SeqID_122285 SeqID_122384 SeqID_122470 SeqID_122618 SeqID_122687 SeqID_122758 SeqID_123026 SeqID_123421 SeqID_123491 SeqID_119148 SeqID_121409 SeqID_121416 SeqID_119206 SeqID_119219 | Protein tyrosine kinase |

TABLE 1-continued

SCN GENE FAMILIES and ANNOTATIONS
SCN gene families

| Gene name | SCN gene family members | Protein annotation |
|---|---|---|
| | SeqID_119238 SeqID_119245 | |
| | SeqID_119296 SeqID_119338 | |
| | SeqID_119410 SeqID_119412 | |
| | SeqID_119422 SeqID_119436 | |
| | SeqID_119453 SeqID_119472 | |
| | SeqID_119483 SeqID_119520 | |
| | SeqID_119525 SeqID_119541 | |
| | SeqID_119728 SeqID_119764 | |
| | SeqID_119789 SeqID_119828 | |
| | SeqID_120006 SeqID_120051 | |
| | SeqID_120126 SeqID_120166 | |
| | SeqID_120298 SeqID_120406 | |
| | SeqID_120418 SeqID_120428 | |
| | SeqID_120452 SeqID_120453 | |
| | SeqID_120550 SeqID_120636 | |
| | SeqID_120663 SeqID_120672 | |
| | SeqID_120772 SeqID_121622 | |
| | SeqID_120934 SeqID_120996 | |
| | SeqID_121189 SeqID_123672 | |
| | SeqID_123838 SeqID_123977 | |
| | SeqID_123989 SeqID_124109 | |
| | SeqID_124294 SeqID_121714 | |
| | SeqID_121742 SeqID_121803 | |
| | SeqID_121897 SeqID_121907 | |
| OSCP | SeqID_122390 SeqID_123173 | ATP synthase delta (OSCP) |
| | SeqID_123852 SeqID_121694 | subunit |
| Ham1p_like | SeqID_120320 | Ham1 family |
| Transketolase_N | SeqID_122651 SeqID_119261 | Transketolase, thiamine |
| | SeqID_123846 | diphosphate b |
| HD | SeqID_119514 SeqID_119787 | HD domain |
| MreB_Mbl | SeqID_121224 SeqID_121246 | MreB/Mbl protein |
| | SeqID_121258 SeqID_121266 | |
| | SeqID_122340 SeqID_119310 | |
| | SeqID_120675 SeqID_123580 | |
| Fzo_mitofusin | SeqID_119682 | fzo-like conserved region |
| GCFC | SeqID_120111 | GC-rich sequence DNA-binding factor-like pro |
| DER1 | SeqID_123172 SeqID_120680 | Der1-like family |
| Phosphorylase | SeqID_120862 | Carbohydrate phosphorylase |
| SH2 | SeqID_122470 SeqID_123228 | SH2 domain |
| | SeqID_119500 SeqID_120234 | |
| | SeqID_120452 SeqID_120453 | |
| | SeqID_120921 SeqID_120958 | |
| CXC | SeqID_121122 | Tesmin/TSO1-like CXC domain |
| Aldedh | SeqID_120628 | Aldehyde dehydrogenase family |
| CK_II_beta | SeqID_120267 | Casein kinase II regulatory subunit |
| ERM | SeqID_121435 SeqID_121811 | Ezrin/radixin/moesin family |
| 3HCDH_N | SeqID_122892 SeqID_119503 | 3-hydroxyacyl-CoA |
| | SeqID_120447 | dehydrogenase, NAD binding |
| Troponin | SeqID_121972 SeqID_122915 | Troponin |
| | SeqID_123477 SeqID_120512 | |
| | SeqID_123537 | |
| zf-U1 | SeqID_122257 SeqID_122817 | U1 zinc finger |
| | SeqID_119881 | |
| Dynamin_M | SeqID_121459 SeqID_121020 | Dynamin central region |
| LBP_BPI_CETP_C | SeqID_121024 | LBP/BPI/CETP family, C-terminal do |
| UBA | SeqID_122024 SeqID_122255 | UBA/TS-N domain |
| | SeqID_122435 SeqID_122689 | |
| | SeqID_120244 SeqID_123742 | |
| | SeqID_123895 SeqID_121722 | |
| | SeqID_121739 | |
| Dynamin_N | SeqID_122325 SeqID_119276 | Dynamin family |
| | SeqID_119682 SeqID_121020 | |
| | SeqID_123830 | |
| FG-GAP | SeqID_120791 | FG-GAP repeat |
| Supt5 | SeqID_119904 | Supt5 repeat |
| CHORD | SeqID_122778 SeqID_121480 | CHORD |
| | SeqID_120611 SeqID_124127 | |
| Ribosomal_S6e | SeqID_122091 SeqID_122108 | Ribosomal protein S6e |
| | SeqID_123156 SeqID_123278 | |
| | SeqID_123328 SeqID_123341 | |
| | SeqID_123427 SeqID_119761 | |
| | SeqID_123571 SeqID_124292 | |

TABLE 1-continued

SCN GENE FAMILIES and ANNOTATIONS
SCN gene families

| Gene name | SCN gene family members | Protein annotation |
|---|---|---|
| Gtr1_RagA | SeqID_123193 SeqID_121217 | Gtr1/RagA G protein conserved region |
| CAF1 | SeqID_122750 SeqID_123054 SeqID_123367 SeqID_124146 SeqID_121735 | CAF1 family ribonuclease |
| RNA_pol_Rpb6 | SeqID_122713 SeqID_120963 SeqID_124170 | RNA polymerase Rpb6 |
| Hist_deacetyl | SeqID_122658 SeqID_120496 SeqID_124304 | Histone deacetylase domain |
| RNA_pol_Rpb8 | SeqID_122008 SeqID_122789 SeqID_119393 SeqID_123747 | RNA polymerase Rpb8 |
| Ribosomal_L10e | SeqID_122247 SeqID_122929 SeqID_123115 SeqID_123302 SeqID_123354 SeqID_121429 SeqID_119804 SeqID_123702 SeqID_121800 SeqID_121851 | Ribosomal L10 |
| DUF1127 | SeqID_121449 | Domain of unknown function (DUF1127) |
| FARP | SeqID_121261 SeqID_122785 | FMRFamide related peptide family |
| ubiquitin | SeqID_121249 SeqID_121259 SeqID_121959 SeqID_121966 SeqID_121974 SeqID_121987 SeqID_122018 SeqID_122017 SeqID_122021 SeqID_122020 SeqID_122023 SeqID_122026 SeqID_122033 SeqID_122042 SeqID_122053 SeqID_122150 SeqID_122234 SeqID_122256 SeqID_122415 SeqID_122461 SeqID_122550 SeqID_122647 SeqID_122726 SeqID_122768 SeqID_121317 SeqID_121325 SeqID_122784 SeqID_122823 SeqID_123207 SeqID_123316 SeqID_123462 SeqID_123488 SeqID_123500 SeqID_119205 SeqID_121408 SeqID_121458 SeqID_119321 SeqID_119375 SeqID_119457 SeqID_119597 SeqID_119702 SeqID_119857 | Ubiquitin family |
| mRNA_cap_enzyme | SeqID_123044 SeqID_120040 | mRNA capping enzyme, catalytic domain |
| Ribosomal_60s | SeqID_122215 SeqID_122490 SeqID_123784 SeqID_124059 | 60s Acidic ribosomal protein |
| SHMT | SeqID_123444 | Serine hydroxymethyltransferase |
| TSP_1 | SeqID_121277 SeqID_119765 SeqID_121174 | Thrombospondin type 1 domain |
| Bin3 | SeqID_122035 SeqID_120646 SeqID_123803 | Bicoid-interacting protein 3 (Bin3) |
| APS_kinase | SeqID_119710 | Adenylylsulphate kinase |
| GSH_synthase | SeqID_122183 SeqID_119391 SeqID_120121 SeqID_120409 SeqID_120622 SeqID_120719 SeqID_120886 SeqID_120895 SeqID_121074 SeqID_123719 | Eukaryotic glutathione synthase |
| SFT2 | SeqID_123142 SeqID_121421 SeqID_120229 | SFT2-like protein |
| Homeobox | SeqID_119358 SeqID_119397 SeqID_119915 SeqID_120364 SeqID_120535 SeqID_121140 | Homeobox domain |
| Pox_A_type_inc | SeqID_121260 SeqID_122546 SeqID_123618 | Viral A-type inclusion protein repeat |
| iPGM_N | SeqID_122467 SeqID_123844 SeqID_120794 | BPG-independent PGAM N-terminus (iPGM_N) |
| RNA_pol_L | SeqID_122755 SeqID_120230 SeqID_123595 | RNA polymerase Rpb3/Rpb11 dimerisation doma |
| V-set | SeqID_123529 SeqID_119196 SeqID_119491 SeqID_119713 SeqID_119816 SeqID_120343 | Immunoglobulin V-set domain |
| CTP_synth_N | SeqID_122680 SeqID_120279 SeqID_120818 SeqID_123812 | CTP synthase N-terminus |
| AAA | SeqID_122138 SeqID_122219 SeqID_122276 SeqID_122358 SeqID_122493 SeqID_122675 SeqID_121315 SeqID_121378 | ATPase family associated with various cellul |

TABLE 1-continued

SCN GENE FAMILIES and ANNOTATIONS
SCN gene families

| Gene name | SCN gene family members | Protein annotation |
|---|---|---|
| | SeqID_123161 SeqID_119176 | |
| | SeqID_121460 SeqID_119267 | |
| | SeqID_119300 SeqID_119612 | |
| | SeqID_119652 SeqID_119734 | |
| | SeqID_119875 SeqID_120119 | |
| | SeqID_120736 SeqID_121618 | |
| | SeqID_120857 SeqID_120931 | |
| | SeqID_120938 SeqID_123801 | |
| | SeqID_123871 SeqID_124113 | |
| | SeqID_124117 SeqID_121875 | |
| | SeqID_121923 | |
| PP-binding | SeqID_123286 SeqID_123525 | Phosphopantetheine attachment site |
| | SeqID_120461 SeqID_124213 | |
| | SeqID_124214 | |
| CDC37 | SeqID_120246 | Cdc37 family |
| FtsJ | SeqID_120165 | FtsJ-like methyltransferase |
| Peroxin-13_N | SeqID_119323 | Peroxin 13, N-terminal |
| Ribosomal_S7e | SeqID_122524 SeqID_121334 | Ribosomal protein S7e |
| | SeqID_123124 SeqID_121922 | |
| Sugar_tr | SeqID_119607 SeqID_120612 | Sugar (and other) transporter |
| UCH | SeqID_122246 SeqID_122435 | Ubiquitin carboxyl-terminal hydrolase |
| | SeqID_122511 SeqID_121433 | |
| | SeqID_119366 SeqID_119785 | |
| | SeqID_119799 SeqID_120244 | |
| | SeqID_120577 SeqID_121090 | |
| | SeqID_123828 SeqID_123895 | |
| | SeqID_121784 | |
| HATPase_c | SeqID_121965 SeqID_121968 | Histidine kinase-, DNA gyrase B-, and HSP90 |
| | SeqID_121976 SeqID_122028 | |
| | SeqID_122252 SeqID_123282 | |
| | SeqID_124089 SeqID_120445 | |
| | SeqID_123704 | |
| Activin_recp | SeqID_123267 | Activin types I and II receptor domain |
| DUF602 | SeqID_119868 | Protein of unknown function, DUF602 |
| DUF1136 | SeqID_119196 | Repeat of unknown function (DUF1136) |
| TAFII28 | SeqID_123141 | hTAFII28-like protein conserved region |
| Pkinase | SeqID_121233 SeqID_121271 | Protein kinase domain |
| | SeqID_122086 SeqID_122117 | |
| | SeqID_122221 SeqID_122233 | |
| | SeqID_122285 SeqID_122384 | |
| | SeqID_122470 SeqID_122502 | |
| | SeqID_122618 SeqID_122687 | |
| | SeqID_122758 SeqID_122956 | |
| | SeqID_123026 SeqID_123491 | |
| | SeqID_119148 SeqID_121409 | |
| | SeqID_121416 SeqID_121441 | |
| | SeqID_119219 SeqID_119237 | |
| | SeqID_119238 SeqID_119245 | |
| | SeqID_119296 SeqID_119338 | |
| | SeqID_119365 SeqID_119410 | |
| | SeqID_119412 SeqID_119436 | |
| | SeqID_119453 SeqID_119472 | |
| | SeqID_119483 SeqID_119520 | |
| | SeqID_119525 SeqID_119576 | |
| | SeqID_119629 SeqID_119728 | |
| | SeqID_119764 SeqID_119789 | |
| | SeqID_119828 SeqID_119968 | |
| | SeqID_120006 SeqID_120126 | |
| | SeqID_120166 SeqID_120208 | |
| | SeqID_120298 SeqID_120406 | |
| | SeqID_120428 SeqID_120452 | |
| | SeqID_120453 SeqID_120550 | |
| | SeqID_120636 SeqID_120663 | |
| | SeqID_120672 SeqID_120701 | |
| | SeqID_120771 SeqID_120772 | |
| | SeqID_121561 SeqID_121583 | |
| | SeqID_121622 SeqID_120796 | |
| | SeqID_120934 SeqID_120996 | |
| | SeqID_121102 SeqID_121189 | |
| | SeqID_123672 SeqID_123947 | |
| | SeqID_123977 SeqID_123989 | |

TABLE 1-continued

SCN GENE FAMILIES and ANNOTATIONS
SCN gene families

| Gene name | SCN gene family members | Protein annotation |
|---|---|---|
| KH_1 | SeqID_124109 SeqID_124130 SeqID_124294 SeqID_121714 SeqID_121742 SeqID_121803 SeqID_121897 SeqID_121903 SeqID_121907 SeqID_121920 SeqID_122074 SeqID_122460 SeqID_121313 SeqID_123392 SeqID_123476 SeqID_119195 SeqID_120972 SeqID_124132 SeqID_121787 | KH domain |
| FA_hydroxylase | SeqID_122136 SeqID_123602 | Fatty acid hydroxylase |
| Clc-like | SeqID_122446 SeqID_120339 SeqID_120721 SeqID_123875 | Clc-like |
| KH_2 | SeqID_122074 SeqID_122370 SeqID_123179 SeqID_121535 SeqID_121549 SeqID_123699 SeqID_124132 SeqID_124172 SeqID_124328 SeqID_121787 | KH domain |
| Galactosyl_T_2 | SeqID_122573 SeqID_122681 SeqID_119322 SeqID_124349 | Galactosyltransferase |
| Piwi | SeqID_121243 SeqID_121305 SeqID_123411 SeqID_119347 SeqID_119676 SeqID_120129 SeqID_121773 SeqID_121792 | Piwi domain |
| RLI | SeqID_122076 SeqID_120449 SeqID_120808 SeqID_124131 | Possible metal-binding domain in RNase L inh |
| HORMA | SeqID_121286 SeqID_119567 SeqID_121728 | HORMA domain |
| RNA_pol_Rpb1_3 | SeqID_120039 SeqID_120437 SeqID_120506 | RNA polymerase Rpb1, domain 3 |
| Ldh_2 | SeqID_122223 SeqID_121410 SeqID_121556 SeqID_121574 SeqID_124002 | Malate/L-lactate dehydrogenase |
| Neuralized | SeqID_122352 SeqID_120365 SeqID_124000 SeqID_124184 | Neuralized |
| RNA_pol_Rpb1_4 | SeqID_120039 SeqID_120437 SeqID_120506 SeqID_120541 | RNA polymerase Rpb1, domain 4 |
| RNA_pol_Rpb1_5 | SeqID_120506 | RNA polymerase Rpb1, domain 5 |
| RNA_pol_Rpb1_6 | SeqID_120506 | RNA polymerase Rpb1, domain 6 |
| Clat_adaptor_s | SeqID_122102 SeqID_122224 SeqID_122801 SeqID_122988 SeqID_120385 SeqID_120859 SeqID_121131 SeqID_123790 SeqID_124166 | Clathrin adaptor complex small chain |
| IF4E | SeqID_122412 SeqID_120589 | Eukaryotic initiation factor 4E |
| Kinesin | SeqID_121296 SeqID_122362 SeqID_119669 SeqID_124181 | Kinesin motor domain |
| G10 | SeqID_122515 | G10 protein |
| Ground-like | SeqID_120751 | Ground-like domain |
| P34-Arc | SeqID_123215 SeqID_121855 | Arp2/3 complex, 34 kD subunit p34-Arc |
| Ribosomal_S8e | SeqID_122003 SeqID_122010 SeqID_122130 SeqID_122508 SeqID_121333 SeqID_123027 SeqID_121508 SeqID_121531 SeqID_121545 SeqID_123644 SeqID_121667 | Ribosomal protein S8e |
| Ribosomal_S3_C | SeqID_122370 SeqID_123179 SeqID_119376 SeqID_121535 SeqID_121126 SeqID_123699 | Ribosomal protein S3, C-terminal domai |
| ResIII | SeqID_122318 SeqID_119170 SeqID_121443 SeqID_119233 SeqID_119766 SeqID_120168 SeqID_123835 SeqID_124119 | Type III restriction enzyme, res subunit |
| TFIIE_beta | SeqID_121012 | TFIIE beta subunit core domain |
| AA_kinase | SeqID_122430 | Amino acid kinase family |
| Exo_endo_phos | SeqID_122447 SeqID_123874 | Endonuclease/Exonuclease/phosphatase fa |
| HLH | SeqID_122206 SeqID_119868 SeqID_120631 | Helix-loop-helix DNA-binding domain |

TABLE 1-continued

SCN GENE FAMILIES and ANNOTATIONS
SCN gene families

| Gene name | SCN gene family members | Protein annotation |
|---|---|---|
| Keratin_B2 | SeqID_120481 | Keratin, high sulfur B2 protein |
| TspO_MBR | SeqID_122231 SeqID_122587 SeqID_123338 SeqID_121431 SeqID_119499 SeqID_123778 SeqID_123779 SeqID_124344 SeqID_121908 | TspO/MBR family |
| C1-set | SeqID_119491 SeqID_120343 | Immunoglobulin C1-set domain |
| SCO1-SenC | SeqID_121873 | SCO1/SenC |
| T-box | SeqID_122717 SeqID_123320 | T-box |
| PSI | SeqID_119510 | Plexin repeat |
| AAA_2 | SeqID_122219 SeqID_122276 SeqID_121378 SeqID_119652 SeqID_119734 SeqID_121618 SeqID_120931 SeqID_123871 SeqID_124113 SeqID_121923 | ATPase family associated with various cellul |
| DUF477 | SeqID_122322 SeqID_124018 | Domain of unknown function (DUF477) |
| AAA_3 | SeqID_122493 SeqID_119176 SeqID_119742 SeqID_119875 SeqID_120649 SeqID_121618 | ATPase family associated with various cellul |
| ABC_membrane | SeqID_120493 | ABC transporter transmembrane region |
| fn3 | SeqID_119158 SeqID_119225 SeqID_119569 SeqID_120170 SeqID_120951 SeqID_121023 | Fibronectin type III domain |
| AAA_5 | SeqID_122219 SeqID_122493 SeqID_119176 SeqID_119875 SeqID_120649 SeqID_120763 SeqID_120931 SeqID_120936 SeqID_123871 | ATPase family associated with various cellul |
| Destabilase | SeqID_122806 SeqID_124205 | Destabilase |
| Glyco_transf_22 | SeqID_123460 SeqID_120564 | Alg9-like mannosyltransferase family |
| Not3 | SeqID_122203 SeqID_121162 | Not1 N-terminal domain, CCR4-Not complex com |
| CDC50 | SeqID_122266 SeqID_121335 SeqID_120160 SeqID_123808 | LEM3 (ligand-effect modulator 3) family/CD |
| Glyco_transf_25 | SeqID_121052 | Glycosyltransferase family 25 (LPS bi |
| PSS | SeqID_119991 | Phosphatidyl serine synthase |
| PRP38 | SeqID_123506 SeqID_121713 | PRP38 family |
| UCR_14kD | SeqID_122477 SeqID_121481 SeqID_121514 SeqID_123716 | Ubiquinol-cytochrome C reductase complex 14k |
| Biopterin_H | SeqID_122189 SeqID_122692 SeqID_122958 SeqID_120567 SeqID_123832 SeqID_124293 | Biopterin-dependent aromatic amino acid h |
| Cofilin_ADF | SeqID_122563 SeqID_122620 SeqID_121306 SeqID_121419 SeqID_119918 SeqID_124332 | Cofilin/tropomyosin-type actin-binding pr |
| MOZ_SAS | SeqID_123033 | MOZ/SAS family |
| SNase | SeqID_121415 SeqID_120155 | Staphylococcal nuclease homologue |
| Skp1_POZ | SeqID_121262 SeqID_122339 SeqID_122672 SeqID_121318 SeqID_119994 SeqID_123642 | Skp1 family, tetramerisation domain |
| Acyl_transf_3 | SeqID_119415 | Acyltransferase family |
| Ribosomal_L10 | SeqID_123472 SeqID_120199 SeqID_121812 | Ribosomal protein L10 |
| HMA | SeqID_122636 SeqID_123900 | Heavy-metal-associated domain |
| Ribosomal_S3Ae | SeqID_122253 SeqID_123202 SeqID_119906 SeqID_121492 SeqID_123962 | Ribosomal S3Ae family |
| Ribosomal_L11 | SeqID_122466 SeqID_122612 SeqID_122798 SeqID_120200 SeqID_121603 SeqID_120902 SeqID_123787 SeqID_121653 SeqID_124218 | Ribosomal protein L11, RNA binding do |
| eIF-1a | SeqID_122566 SeqID_123523 SeqID_119774 SeqID_124173 | Eukaryotic initiation factor 1A |
| Ribosomal_L13e | SeqID_121985 SeqID_121989 SeqID_122082 SeqID_119425 SeqID_123942 | Ribosomal protein L13e |
| Ribosomal_L12 | SeqID_122236 SeqID_121124 SeqID_123921 | Ribosomal protein L7/L12 C-terminal dom |

TABLE 1-continued

SCN GENE FAMILIES and ANNOTATIONS
SCN gene families

| Gene name | SCN gene family members | Protein annotation |
|---|---|---|
| S10_plectin | SeqID_122608 SeqID_119224 SeqID_123551 | Plectin/S10 domain |
| Ribosomal_L14 | SeqID_122293 SeqID_123957 | Ribosomal protein L14p/L23e |
| DUF625 | SeqID_120752 | Protein of unknown function (DUF625) |
| Sec23_trunk | SeqID_121381 SeqID_119647 | Sec23/Sec24 trunk domain |
| ig | SeqID_123529 SeqID_119196 SeqID_119491 SeqID_119569 SeqID_119713 SeqID_119816 SeqID_120343 | Immunoglobulin domain |
| Ribosomal_L16 | SeqID_122247 SeqID_122653 SeqID_123302 SeqID_124211 | Ribosomal protein L16 |
| Ion_trans | SeqID_119930 SeqID_120812 | Ion transport protein |
| NAF1 | SeqID_119903 | NAF1 domain |
| Aa_trans | SeqID_121971 SeqID_119531 | Transmembrane amino acid transporter protein |
| APG6 | SeqID_122694 SeqID_121500 | Autophagy protein Apg6 |
| SEC-C | SeqID_120562 | SEC-C motif |
| KE2 | SeqID_122599 SeqID_122773 SeqID_124174 SeqID_124230 SeqID_124235 | KE2 family protein |
| Lyase_1 | SeqID_120948 SeqID_121661 SeqID_121786 | Lyase |
| Ran_BP1 | SeqID_119729 SeqID_120815 | RanBP1 domain |
| PGM_PMM_IV | SeqID_119474 SeqID_120700 | Phosphoglucomutase/phosphomannomutase, C-t |
| BAH | SeqID_123089 | BAH domain |
| UQ_con | SeqID_121983 SeqID_122089 SeqID_122437 SeqID_122519 SeqID_122757 SeqID_123232 | Ubiquitin-conjugating enzyme |
| ENTH | SeqID_122942 SeqID_123389 | ENTH domain |
| DUF6 | SeqID_119240 | Integral membrane protein DUF6 |
| Ribosomal_L21e | SeqID_122144 SeqID_123108 SeqID_123268 SeqID_123293 SeqID_123298 SeqID_121434 SeqID_119745 SeqID_123751 SeqID_124341 SeqID_121876 | Ribosomal protein L21e |
| Cyclin_C | SeqID_120722 | Cyclin, C-terminal domain |
| ADK | SeqID_121282 SeqID_122317 SeqID_119710 | Adenylate kinase |
| MAS20 | SeqID_121991 SeqID_122410 SeqID_123936 | MAS20 protein import receptor |
| TIG | SeqID_122994 | IPT/TIG domain |
| DNA_pol_B | SeqID_120301 | DNA polymerase family B |
| Ribosomal_L22 | SeqID_121995 SeqID_122261 SeqID_122840 SeqID_123164 SeqID_123257 SeqID_121516 SeqID_120038 SeqID_123674 | Ribosomal protein L22p/L17e |
| Ribosomal_L14e | SeqID_122701 SeqID_123548 | Ribosomal protein L14 |
| Ribosomal_L23 | SeqID_122038 SeqID_123046 SeqID_119380 SeqID_119408 SeqID_123694 SeqID_124231 | Ribosomal protein L23 |
| SNF2_N | SeqID_119766 SeqID_120168 SeqID_120323 | SNF2 family N-terminal domain |
| Cgr1 | SeqID_122506 SeqID_123609 | Cgr1 family |
| Glutaredoxin | SeqID_123129 | Glutaredoxin |
| PUA | SeqID_122707 SeqID_119847 | PUA domain |
| tRNA_m1G_MT_9 | SeqID_122151 SeqID_123209 | tRNA m(1)G methyltransferase |
| RNA_pol_Rpb2_3 | SeqID_123375 SeqID_121089 | RNA polymerase Rpb2, domain 3 |
| Ribosomal_L29 | SeqID_122312 SeqID_122610 SeqID_123285 SeqID_119200 SeqID_123638 SeqID_123687 SeqID_121725 | Ribosomal L29 protein |
| RNA_pol_Rpb2_4 | SeqID_123375 SeqID_121089 | RNA polymerase Rpb2, domain 4 |
| zf-nanos | SeqID_121133 | Nanos RNA binding domain |
| RNA_pol_Rpb2_5 | SeqID_122280 SeqID_119390 SeqID_121089 SeqID_124072 | RNA polymerase Rpb2, domain 5 |
| Peptidase_S8 | SeqID_121230 SeqID_123401 SeqID_119631 | Subtilase family |
| PUF | SeqID_122211 SeqID_122825 SeqID_119161 SeqID_121389 SeqID_123824 SeqID_121723 | Pumilio-family RNA binding repeat |

TABLE 1-continued

SCN GENE FAMILIES and ANNOTATIONS
SCN gene families

| Gene name | SCN gene family members | Protein annotation |
| --- | --- | --- |
| RNA_pol_Rpb2_6 | SeqID_122280 SeqID_122552 SeqID_121330 SeqID_123182 SeqID_119390 SeqID_123587 SeqID_123831 | RNA polymerase Rpb2, domain 6 |
| Cyclin_N | SeqID_122428 SeqID_122670 SeqID_122816 SeqID_121486 SeqID_120722 SeqID_121612 SeqID_123768 SeqID_123905 | Cyclin, N-terminal domain |
| Mod_r | SeqID_123251 SeqID_123409 SeqID_120718 SeqID_123566 | Modifier of rudimentary (Mod(r)) protein |
| RNA_pol_Rpb2_7 | SeqID_122552 | RNA polymerase Rpb2, domain 7 |
| Ribosomal_L7Ae | SeqID_121269 SeqID_122134 SeqID_122180 SeqID_122335 SeqID_122367 SeqID_122404 SeqID_122604 SeqID_122718 SeqID_123155 SeqID_123294 SeqID_123455 SeqID_119560 SeqID_123888 SeqID_119859 SeqID_121504 SeqID_123633 SeqID_123660 SeqID_123698 SeqID_123927 SeqID_123935 SeqID_123992 SeqID_124144 | Ribosomal protein L7Ae/L30e/S12e/Gadd4 |
| POLO_box | SeqID_119828 SeqID_121022 | POLO box duplicated region |
| Nucleoporin2 | SeqID_120026 | Nucleoporin autopeptidase |
| zf-BED | SeqID_119515 | BED zinc finger |
| Ets | SeqID_119450 | Ets-domain |
| Ribosomal_S2 | SeqID_122439 SeqID_122525 SeqID_122923 SeqID_122995 SeqID_123127 SeqID_123308 SeqID_123382 SeqID_120337 SeqID_120668 SeqID_123668 SeqID_124044 | Ribosomal protein S2 |
| Rcd1 | SeqID_121351 SeqID_119153 | Cell differentiation family, Rcd1-like |
| Ribosomal_S4 | SeqID_121533 SeqID_121546 | Ribosomal protein S4/S9 N-terminal domai |
| GMC_oxred_C | SeqID_122311 | GMC oxidoreductase |
| Ribosomal_S5 | SeqID_122366 SeqID_123421 SeqID_123632 | Ribosomal protein S5, N-terminal domai |
| DUF1240 | SeqID_120294 | Protein of unknown function (DUF1240) |
| Topoisom_I | SeqID_123167 SeqID_121520 SeqID_121660 SeqID_121884 | Eukaryotic DNA topoisomerase I, catalytic |
| Ribosomal_S6 | SeqID_122928 SeqID_119470 | Ribosomal protein S6 |
| DUF1241 | SeqID_122262 SeqID_120893 | Protein of unknown function (DUF1241) |
| Ribosomal_S7 | SeqID_122487 SeqID_122488 SeqID_122733 SeqID_123383 SeqID_124307 SeqID_123688 SeqID_124272 | Ribosomal protein S7p/S5e |
| Ssl1 | SeqID_122605 SeqID_123911 SeqID_124066 SeqID_121741 | Ssl1-like |
| Ribosomal_S8 | SeqID_122779 SeqID_120839 | Ribosomal protein S8 |
| Nop52 | SeqID_122283 SeqID_120786 SeqID_121201 SeqID_124065 | Nucleolar protein, Nop52 |
| Ribosomal_L22e | SeqID_122791 SeqID_120882 | Ribosomal L22e protein family |
| Ribosomal_L30 | SeqID_121300 SeqID_122251 SeqID_122565 SeqID_123737 SeqID_123736 SeqID_121777 SeqID_121894 SeqID_121896 | Ribosomal protein L30p/L7e |
| AdoHcyase | SeqID_122459 SeqID_123859 | S-adenosyl-L-homocysteine hydrolase |
| Ribosomal_L15e | SeqID_121969 SeqID_122199 SeqID_123299 SeqID_119488 SeqID_119941 SeqID_120030 SeqID_123763 SeqID_123764 SeqID_124342 | Ribosomal L15 |
| V-ATPase_C | SeqID_120905 | V-ATPase subunit C |
| Proteasome | SeqID_121422 SeqID_121276 SeqID_121284 SeqID_121960 SeqID_121962 SeqID_122045 SeqID_122055 SeqID_122190 SeqID_122396 SeqID_122413 SeqID_122474 SeqID_122498 SeqID_121342 SeqID_122780 | Proteasome A-type and B-type |

TABLE 1-continued

SCN GENE FAMILIES and ANNOTATIONS
SCN gene families

| Gene name | SCN gene family members | Protein annotation |
|---|---|---|
| | SeqID_122803 SeqID_123336 | |
| | SeqID_123362 SeqID_123419 | |
| | SeqID_119278 SeqID_119909 | |
| | SeqID_121468 SeqID_120588 | |
| | SeqID_120924 SeqID_123604 | |
| | SeqID_123611 SeqID_123646 | |
| | SeqID_123681 SeqID_123825 | |
| | SeqID_124136 SeqID_124227 | |
| | SeqID_121889 | |
| GMC_oxred_N | SeqID_122311 SeqID_124037 | GMC oxidoreductase |
| PHF5 | SeqID_122542 SeqID_120850 | PHF5-like protein |
| | SeqID_123639 | |
| DNA_gyraseB | SeqID_120500 | DNA gyrase B |
| Cullin | SeqID_122420 SeqID_119796 | Cullin family |
| | SeqID_119797 SeqID_120045 | |
| | SeqID_123756 SeqID_120756 | |
| | SeqID_120773 SeqID_121682 | |
| | SeqID_121780 SeqID_121941 | |
| DUF572 | SeqID_119715 SeqID_120330 | Family of unknown function (DUF572) |
| FAA_hydrolase | SeqID_122355 SeqID_124011 | Fumarylacetoacetate (FAA) hydrolase fam |
| cNMP_binding | SeqID_119563 SeqID_121604 | Cyclic nucleotide-binding domain |
| V-ATPase_G | SeqID_122706 SeqID_123291 | Vacuolar (H+)-ATPase G subunit |
| | SeqID_119894 SeqID_119927 | |
| | SeqID_123872 | |
| V-ATPase_H | SeqID_120190 | V-ATPase subunit H |
| Epimerase | SeqID_119815 SeqID_120284 | NAD dependent epimerase/dehydratase family |
| | SeqID_121143 | |
| Lipase_2 | SeqID_119177 | Lipase (class 2) |
| Ribosomal_L39 | SeqID_122520 SeqID_122799 | Ribosomal L39 protein |
| HCNGP | SeqID_120697 SeqID_120698 | HCNGP-like protein |
| POP1 | SeqID_123216 | Ribonucleases P/MRP protein subunit POP1 |
| SMN | SeqID_122580 SeqID_124165 | Survival motor neuron protein (SMN) |
| ACPS | SeqID_122149 SeqID_124163 | 4'-phosphopantetheinyl transferase superfami |
| Lamp | SeqID_122690 SeqID_123937 | Lysosome-associated membrane glycoprotein (L |
| FragX_IP | SeqID_120422 | Cytoplasmic Fragile-X interacting family |
| Aminotran_1_2 | SeqID_122344 | Aminotransferase class I and II |
| ABC_tran | SeqID_122402 SeqID_119524 | ABC transporter |
| | SeqID_119625 SeqID_120769 | |
| | SeqID_123949 | |
| GRP | SeqID_119747 SeqID_120570 | Glycine rich protein family |
| Vps54 | SeqID_122919 SeqID_119956 | Vps54-like protein |
| Aph-1 | SeqID_122155 SeqID_123059 | Aph-1 protein |
| | SeqID_124013 | |
| Radical_SAM | SeqID_120962 | Radical SAM superfamily |
| Josephin | SeqID_122683 SeqID_123774 | Josephin |
| | SeqID_123928 | |
| EF1G | SeqID_122057 SeqID_123454 | Elongation factor 1 gamma, conserved domain |
| | SeqID_120547 SeqID_123557 | |
| Monooxygenase | SeqID_122333 SeqID_123771 | Monooxygenase |
| EXS | SeqID_120654 | EXS family |
| PCNA_C | SeqID_122062 SeqID_122819 | Proliferating cell nuclear antigen, C-termin |
| | SeqID_120167 | |
| Sad1_UNC | SeqID_119813 SeqID_120250 | Sad1/UNC-like C-terminal |
| AMP-binding | SeqID_123152 SeqID_120233 | AMP-binding enzyme |
| DIM1 | SeqID_123449 SeqID_124285 | Mitosis protein DIM1 |
| ATP_bind_1 | SeqID_122375 SeqID_122533 | Conserved hypothetical ATP binding protein |
| | SeqID_122872 SeqID_119782 | |
| | SeqID_123655 SeqID_123983 | |
| DUF652 | SeqID_122800 SeqID_119259 | Protein of unknown function, DUF652 |
| | SeqID_123553 SeqID_124216 | |
| PCNA_N | SeqID_122062 SeqID_122819 | Proliferating cell nuclear antigen, N-termin |
| | SeqID_122829 SeqID_121061 | |
| | SeqID_124283 | |
| DUF727 | SeqID_122615 SeqID_119316 | Protein of unknown function (DUF727) |
| | SeqID_121702 SeqID_124046 | |

TABLE 1-continued

SCN GENE FAMILIES and ANNOTATIONS
SCN gene families

| Gene name | SCN gene family members | Protein annotation |
|---|---|---|
| Utp11 | SeqID_122295 SeqID_121156 | Utp11 protein |
| ThiF | SeqID_121273 SeqID_122346 SeqID_119266 SeqID_121104 SeqID_124189 | ThiF family |
| MMR_HSR1 | SeqID_121288 SeqID_122204 SeqID_122360 SeqID_122375 SeqID_122392 SeqID_122397 SeqID_122560 SeqID_122575 SeqID_122579 SeqID_122600 SeqID_122619 SeqID_122657 SeqID_122671 SeqID_121329 SeqID_122792 SeqID_122872 SeqID_123422 SeqID_119204 SeqID_121430 SeqID_119311 SeqID_119332 SeqID_119352 SeqID_119367 SeqID_119492 SeqID_119523 SeqID_119645 SeqID_119791 SeqID_120413 SeqID_120523 SeqID_120766 SeqID_121613 SeqID_120900 SeqID_121038 SeqID_121093 SeqID_123568 SeqID_123726 SeqID_123740 SeqID_123754 SeqID_121709 SeqID_123960 SeqID_123950 SeqID_123988 SeqID_123991 SeqID_124180 SeqID_121717 SeqID_121740 | GTPase of unknown function |
| zf-C2H2 | SeqID_122179 SeqID_122249 SeqID_122267 SeqID_123033 SeqID_123091 SeqID_123110 SeqID_123191 SeqID_119156 SeqID_119250 SeqID_119283 SeqID_119315 SeqID_119326 SeqID_119455 SeqID_119515 SeqID_119638 SeqID_119674 SeqID_119915 SeqID_119925 SeqID_120046 SeqID_120117 SeqID_120617 SeqID_120707 SeqID_121133 SeqID_121172 SeqID_123906 SeqID_123914 SeqID_124145 SeqID_121781 SeqID_121822 | Zinc finger, C2H2 type |
| HEAT | SeqID_122200 SeqID_122532 SeqID_121374 SeqID_121380 SeqID_122870 SeqID_119166 SeqID_121402 SeqID_119389 SeqID_119427 SeqID_119658 SeqID_124126 SeqID_119790 SeqID_119852 SeqID_119929 SeqID_121537 SeqID_119998 SeqID_120055 SeqID_120163 SeqID_120538 SeqID_120549 SeqID_120581 SeqID_120656 SeqID_121550 SeqID_121614 SeqID_121006 SeqID_121175 SeqID_121201 SeqID_123600 SeqID_121708 | HEAT repeat |
| PWI | SeqID_122736 SeqID_122749 SeqID_120835 SeqID_124267 SeqID_124270 | PWI domain |
| Syja_N | SeqID_119649 SeqID_120216 | Sac1 homology domain |
| zf-Sec23_Sec24 | SeqID_120593 | Sec23/Sec24 zinc finger |
| Gcd10p | SeqID_122163 SeqID_119505 SeqID_124154 | Gcd10p family |
| Gelsolin | SeqID_119286 SeqID_121187 | Gelsolin repeat |
| FUN14 | SeqID_122589 | FUN14 family |
| UcrQ | SeqID_122007 SeqID_122808 SeqID_119696 SeqID_124290 | UcrQ family |
| Ribosomal_L31e | SeqID_122378 SeqID_123337 SeqID_123982 | Ribosomal protein L31e |
| Ribosomal_L24e | SeqID_122132 SeqID_123616 SeqID_123617 SeqID_124161 | Ribosomal protein L24e |
| Calreticulin | SeqID_122265 SeqID_122837 SeqID_119911 SeqID_123897 | Calreticulin family |

TABLE 1-continued

SCN GENE FAMILIES and ANNOTATIONS
SCN gene families

| Gene name | SCN gene family members | Protein annotation |
|---|---|---|
| eIF-5a | SeqID_122554 SeqID_123204 SeqID_120378 SeqID_123582 | Eukaryotic initiation factor 5A hypusine, DN |
| Pex14_N | SeqID_122174 SeqID_123766 | Peroxisomal membrane anchor protein (Pex14p) |
| DUF663 | SeqID_123123 SeqID_120018 | Protein of unknown function (DUF663) |
| UIM | SeqID_122683 SeqID_123389 SeqID_123774 | Ubiquitin interaction motif |
| COX5A | SeqID_122529 SeqID_120371 SeqID_123670 | Cytochrome c oxidase subunit Va |
| COX5B | SeqID_121281 SeqID_122395 SeqID_122479 SeqID_121428 SeqID_119688 SeqID_123743 SeqID_124156 | Cytochrome c oxidase subunit Vb |
| Ribosomal_L23eN | SeqID_122038 SeqID_123046 SeqID_119380 SeqID_119408 SeqID_123694 | Ribosomal protein L23, N-terminal dom |
| PH | SeqID_121274 SeqID_123067 SeqID_119258 SeqID_119463 SeqID_120842 SeqID_120929 SeqID_121878 | PH domain |
| GTP_EFTU_D2 | SeqID_122391 SeqID_122657 SeqID_121299 SeqID_122792 SeqID_123334 SeqID_123345 SeqID_119311 SeqID_119352 SeqID_121538 SeqID_121551 SeqID_120413 SeqID_120540 SeqID_123754 SeqID_123950 SeqID_123967 SeqID_121805 SeqID_121825 SeqID_121826 | Elongation factor Tu domain 2 |
| Sas10_Utp3 | SeqID_120054 | Sas10/Utp3 family |
| Prp18 | SeqID_123355 SeqID_120394 | Prp18 domain |
| GTP_EFTU_D3 | SeqID_122729 SeqID_122792 SeqID_123334 SeqID_123345 SeqID_121538 SeqID_121551 SeqID_120413 SeqID_123754 SeqID_121664 SeqID_121825 SeqID_121826 SeqID_121939 | Elongation factor Tu C-terminal domain |
| GATA | SeqID_121080 | GATA zinc finger |
| Spectrin | SeqID_119246 SeqID_119482 SeqID_119575 SeqID_120539 SeqID_120627 | Spectrin repeat |
| V-SNARE | SeqID_122066 SeqID_121095 SeqID_123939 | Vesicle transport v-SNARE protein |
| Ribosomal_S5_C | SeqID_122366 SeqID_123632 SeqID_121839 | Ribosomal protein S5, C-terminal domai |
| PX | SeqID_120853 | PX domain |
| KID | SeqID_120763 | KID repeat |
| GSH_synth_ATP | SeqID_122183 SeqID_121436 SeqID_120021 SeqID_120101 SeqID_120121 SeqID_120409 SeqID_120622 SeqID_120666 SeqID_120719 SeqID_120782 SeqID_120886 SeqID_120895 SeqID_121074 SeqID_123719 | Eukaryotic glutathione synthase, ATP bi |
| MCM | SeqID_119742 SeqID_119912 SeqID_120936 | MCM2/3/5 family |
| ETF_alpha | SeqID_121607 | Electron transfer flavoprotein alpha subuni |
| L51_S25_CI-B8 | SeqID_122048 SeqID_123231 SeqID_121114 SeqID_123645 | Mitochondrial ribosomal protein L51/S |
| CBS | SeqID_120735 SeqID_121213 | CBS domain |
| Ribosomal_L18e | SeqID_122342 SeqID_122374 SeqID_123713 SeqID_123753 SeqID_121703 SeqID_124289 | Eukaryotic ribosomal protein L18 |
| OTCace | SeqID_119435 | Aspartate/ornithine carbamoyltransferase, A |
| GRAM | SeqID_122481 SeqID_123794 SeqID_121636 | GRAM domain |
| Rad21_Rec8 | SeqID_122963 | Conserved region of Rad21/Rec8 like prot |
| DUF676 | SeqID_120421 | Putative serine esterase (DUF676) |
| Ribosomal_L18p | SeqID_120495 SeqID_121687 | Ribosomal L18p/L5e family |

TABLE 1-continued

SCN GENE FAMILIES and ANNOTATIONS
SCN gene families

| Gene name | SCN gene family members | Protein annotation |
| --- | --- | --- |
| Metallophos | SeqID_122191 SeqID_122213 SeqID_122289 SeqID_123311 SeqID_123307 SeqID_121426 SeqID_119337 SeqID_119448 SeqID_119502 SeqID_119572 SeqID_119659 SeqID_119751 SeqID_119860 SeqID_121540 SeqID_120128 SeqID_120238 SeqID_120434 SeqID_120484 SeqID_120553 SeqID_120710 SeqID_120825 SeqID_120824 SeqID_120834 SeqID_120873 SeqID_121046 SeqID_121142 SeqID_121188 SeqID_121700 SeqID_124029 SeqID_124030 SeqID_124061 SeqID_121738 SeqID_121746 SeqID_121770 SeqID_121899 SeqID_121900 SeqID_121915 | Calcineurin-like phosphoesterase |
| HECT | SeqID_121283 SeqID_121316 SeqID_119865 SeqID_120854 SeqID_121657 SeqID_121712 | HECT-domain (ubiquitin-transferase) |
| Hormone_recep | SeqID_120699 SeqID_121758 | Ligand-binding domain of nuclear hormon |
| NAC | SeqID_122153 SeqID_122689 SeqID_123502 SeqID_120888 SeqID_123742 | NAC domain |
| C1_1 | SeqID_120222 SeqID_120526 | Phorbol esters/diacylglycerol binding domain |
| Calponin | SeqID_121222 SeqID_122248 SeqID_122936 SeqID_123005 SeqID_123171 SeqID_123188 SeqID_123400 SeqID_120392 SeqID_120928 SeqID_120927 SeqID_123804 SeqID_123842 SeqID_123853 SeqID_124187 | Calponin family repeat |
| RmaAD | SeqID_122723 SeqID_119487 SeqID_123996 | Ribosomal RNA adenine dimethylase |
| SPX | SeqID_120654 | SPX domain |
| C1_3 | SeqID_119379 SeqID_120217 SeqID_120788 | C1-like domain |
| GST_C | SeqID_122057 SeqID_122407 SeqID_122628 SeqID_122642 SeqID_121383 SeqID_123011 SeqID_121623 SeqID_121132 SeqID_123557 SeqID_123625 SeqID_123709 SeqID_123708 SeqID_124298 SeqID_121838 | Glutathione S-transferase, C-terminal domain |
| Na_Ca_ex | SeqID_120053 | Sodium/calcium exchanger protein |
| B3_4 | SeqID_120243 | B3/4 domain |
| Sec23_helical | SeqID_119286 | Sec23/Sec24 helical domain |
| Ribosomal_L40e | SeqID_122033 SeqID_121408 SeqID_119857 SeqID_123721 | Ribosomal L40e family |
| ICIn_channel | SeqID_121998 SeqID_123531 | Nucleotide-sensitive chloride conductanc |
| Histone | SeqID_121234 SeqID_122039 SeqID_122046 SeqID_122096 SeqID_122119 SeqID_122455 SeqID_122483 SeqID_122582 SeqID_122688 SeqID_122744 SeqID_122766 SeqID_122771 SeqID_121314 SeqID_122884 SeqID_122955 SeqID_123003 SeqID_123317 SeqID_123463 SeqID_123466 SeqID_123473 SeqID_121448 SeqID_121446 SeqID_119330 SeqID_119493 SeqID_119512 SeqID_119521 SeqID_119609 SeqID_119776 SeqID_119983 SeqID_121479 SeqID_121482 SeqID_120068 SeqID_120077 SeqID_120480 SeqID_120534 SeqID_120790 SeqID_121570 SeqID_121594 SeqID_121601 SeqID_120813 | Core histone H2A/H2B/H3/H4 |

TABLE 1-continued

SCN GENE FAMILIES and ANNOTATIONS
SCN gene families

| Gene name | SCN gene family members | Protein annotation |
|---|---|---|
| | SeqID_121054 SeqID_123744 | |
| | SeqID_121645 SeqID_121663 | |
| | SeqID_121675 SeqID_121683 | |
| | SeqID_121684 SeqID_121688 | |
| | SeqID_121706 SeqID_121705 | |
| | SeqID_124105 SeqID_124164 | |
| | SeqID_124258 SeqID_124262 | |
| | SeqID_124276 SeqID_124314 | |
| | SeqID_121771 SeqID_121809 | |
| | SeqID_121819 SeqID_121828 | |
| | SeqID_121823 SeqID_121905 | |
| Disintegrin | SeqID_120481 | Disintegrin |
| 3HCDH | SeqID_120447 | 3-hydroxyacyl-CoA dehydrogenase, C-terminal |
| NAP | SeqID_122303 SeqID_119982 SeqID_124050 | Nucleosome assembly protein (NAP) |
| Tubulin | SeqID_122269 SeqID_122332 SeqID_122440 SeqID_121336 SeqID_123013 SeqID_119381 SeqID_119720 SeqID_124114 SeqID_121499 SeqID_121506 SeqID_121543 SeqID_120775 SeqID_121555 SeqID_123545 SeqID_123884 SeqID_124069 SeqID_121761 SeqID_121820 SeqID_121849 SeqID_121893 | Tubulin/FtsZ family, GTPase domain |
| GST_N | SeqID_122057 SeqID_122407 SeqID_122628 SeqID_122642 SeqID_121383 SeqID_123011 SeqID_123274 SeqID_119360 SeqID_121496 SeqID_120438 SeqID_121623 SeqID_123557 SeqID_123625 SeqID_123709 SeqID_123708 SeqID_124297 SeqID_121838 | Glutathione S-transferase, N-terminal domain |
| ETC_C1_NDUFA5 | SeqID_122406 SeqID_123873 | ETC complex I subunit conserved region |
| 2-Hacid_dh | SeqID_120275 | D-isomer specific 2-hydroxyacid dehydrogen |
| Adenylsucc_synt | SeqID_122272 SeqID_121355 SeqID_119162 SeqID_119650 SeqID_120090 SeqID_120822 SeqID_124006 | Adenylosuccinate synthetase |
| RTC | SeqID_122518 SeqID_123729 | RNA 3'-terminal phosphate cyclase |
| Ribosomal_L19e | SeqID_122613 SeqID_122869 SeqID_123303 SeqID_120779 | Ribosomal protein L19e |
| TRAPP_Bet3 | SeqID_122875 | Transport protein particle (TRAPP) compone |
| SMC_C | SeqID_119625 | SMC family, C-terminal domain |
| CDP-OH_P_transf | SeqID_123356 | CDP-alcohol phosphatidyltransferase |
| Frataxin_Cyay | SeqID_122075 SeqID_123508 SeqID_120847 SeqID_124330 | Frataxin-like domain |
| VHS | SeqID_120912 | VHS domain |
| DUF689 | SeqID_122204 | Protein of unknown function (DUF689) |
| SMC_N | SeqID_119887 SeqID_119966 SeqID_120574 SeqID_120702 | RecF/RecN/SMC N terminal domain |
| PTPLA | SeqID_120767 | Protein tyrosine phosphatase-like protein, P |
| PfkB | SeqID_122553 SeqID_123583 | pfkB family carbohydrate kinase |
| DSPc | SeqID_122616 SeqID_122746 SeqID_124323 SeqID_119299 SeqID_119527 SeqID_120116 SeqID_123836 SeqID_124056 | Dual specificity phosphatase, catalytic doma |
| Biotin_lipoyl | SeqID_120976 | Biotin-requiring enzyme |
| Pkinase_C | SeqID_122758 SeqID_122978 SeqID_119365 SeqID_121625 SeqID_120796 | Protein kinase C terminal domain |
| DAD | SeqID_119716 | DAD family |
| Alpha_adaptin_C | SeqID_120950 | Alpha adaptin AP2, C-terminal domain |
| Ribosomal_L6e | SeqID_122489 SeqID_122949 SeqID_121011 SeqID_123683 | Ribosomal protein L6e |

TABLE 1-continued

SCN GENE FAMILIES and ANNOTATIONS
SCN gene families

| Gene name | SCN gene family members | Protein annotation |
| --- | --- | --- |
| S1 | SeqID_122067 SeqID_123689 SeqID_123690 | S1 RNA binding domain |
| Oxidored_q6 | SeqID_121980 SeqID_122154 SeqID_119667 SeqID_124082 | NADH ubiquinone oxidoreductase, 20 Kd sub |
| Extensin_2 | SeqID_120572 SeqID_120593 SeqID_120713 | Extensin-like region |
| Gar1 | SeqID_119747 | Gar1 protein RNA binding region |
| S4 | SeqID_122623 SeqID_121533 SeqID_121546 SeqID_120098 SeqID_124001 | S4 domain |
| Bromodomain | SeqID_119794 | Bromodomain |
| Laminin_N | SeqID_119297 SeqID_119335 | Laminin N-terminal (Domain VI) |
| CDI | SeqID_122878 | Cyclin-dependent kinase inhibitor |
| Mago_nashi | SeqID_123521 SeqID_120904 | Mago nashi protein |
| SNF7 | SeqID_122586 SeqID_119719 SeqID_119746 SeqID_120690 SeqID_121136 SeqID_124098 | SNF7 |
| ShTK | SeqID_122581 SeqID_119601 SeqID_120015 SeqID_120669 | ShTK domain |
| tRNA_anti | SeqID_122633 SeqID_120602 SeqID_124327 | OB-fold nucleic acid binding domain |
| Linker_histone | SeqID_122931 SeqID_120058 | linker histone H1 and H5 family |
| DAO | SeqID_122333 SeqID_122338 SeqID_122411 SeqID_120662 SeqID_121620 SeqID_123933 | FAD dependent oxidoreductase |
| NDUF_B7 | SeqID_120001 SeqID_122009 SeqID_122777 SeqID_123519 SeqID_123938 SeqID_124080 | NADH-ubiquinone oxidoreductase B18 subunit ( |
| Ribosomal_L34e | SeqID_122631 SeqID_123111 SeqID_123332 SeqID_119760 SeqID_123896 | Ribosomal protein L34e |
| DUF906 | SeqID_119497 | Domain of Unknown Function (DUF906) |
| SPC12 | SeqID_122753 SeqID_121566 SeqID_121590 SeqID_124248 | Microsomal signal peptidase 12 kDa subunit ( |
| CLN3 | SeqID_123346 SeqID_120607 SeqID_120681 | CLN3 protein |
| RVT_1 | SeqID_119187 SeqID_119374 SeqID_119417 SeqID_119451 SeqID_119461 SeqID_119462 SeqID_119508 SeqID_119566 SeqID_119662 SeqID_119663 SeqID_119834 SeqID_119855 SeqID_119943 SeqID_120004 SeqID_120103 SeqID_120138 SeqID_120352 SeqID_120433 SeqID_120465 SeqID_120471 SeqID_120546 SeqID_120566 SeqID_120586 SeqID_120687 SeqID_120716 SeqID_120852 SeqID_120935 SeqID_121043 SeqID_121058 SeqID_121128 SeqID_121129 SeqID_121179 | Reverse transcriptase (RNA-dependent DNA pol |
| Gp_dh_C | SeqID_121978 SeqID_122147 SeqID_121379 SeqID_121400 SeqID_121457 SeqID_119718 SeqID_123607 | Glyceraldehyde 3-phosphate dehydrogenase, C- |
| Ldi_recept_b | SeqID_119985 SeqID_120019 | Low-density lipoprotein receptor repeat |
| F_actin_cap_B | SeqID_122095 SeqID_123254 SeqID_123555 | F-actin capping protein, beta subunit |
| Methyltransf_8 | SeqID_122377 SeqID_119368 SeqID_123981 | Hypothetical methyltransferase |
| Mt_ATP-synt_B | SeqID_122761 SeqID_120653 SeqID_124245 SeqID_121789 | Mitochondrial ATP synthase B chain prec |
| KAP_NTPase | SeqID_120368 | KAP family P-loop domain |
| Mt_ATP-synt_D | SeqID_122314 SeqID_123912 | ATP synthase D chain, mitochondrial (AT |

TABLE 1-continued

SCN GENE FAMILIES and ANNOTATIONS
SCN gene families

| Gene name | SCN gene family members | Protein annotation |
|---|---|---|
| SAC3_GANP | SeqID_121169 | SAC3/GANP family |
| Gp_dh_N | SeqID_121986 SeqID_122098 SeqID_122147 SeqID_123064 SeqID_123079 SeqID_123357 SeqID_123457 SeqID_121379 SeqID_121457 SeqID_123840 SeqID_123607 SeqID_123870 SeqID_124339 SeqID_121930 | Glyceraldehyde 3-phosphate dehydrogenase, NA |
| An_peroxidase | SeqID_120092 SeqID_120241 SeqID_120906 | Animal haem peroxidase |
| Ephrin | SeqID_119824 | Ephrin |
| polyprenyl_synt | SeqID_120635 | Polyprenyl synthetase |
| Neur_chan_memb | SeqID_121005 SeqID_121087 | Neurotransmitter-gated ion-channel tra |
| zf-NPL4 | SeqID_123465 SeqID_119522 | NPL4 family, putative zinc binding region |
| XAP5 | SeqID_122814 SeqID_122850 SeqID_121167 | XAP5 protein |
| RNA_pol | SeqID_120255 | DNA-dependent RNA polymerase |
| NMT_C | SeqID_121407 SeqID_120382 | Myristoyl-CoA: protein N-myristoyltransferase |
| Aldose_epim | SeqID_122507 SeqID_120204 SeqID_123603 | Aldose 1-epimerase |
| DUF841 | SeqID_120243 | Eukaryotic protein of unknown function (DUF8 |
| Mov34 | SeqID_121290 SeqID_121294 SeqID_122120 SeqID_122260 SeqID_122735 SeqID_121344 SeqID_122844 SeqID_123535 SeqID_121382 SeqID_121417 SeqID_119999 SeqID_120711 SeqID_123682 SeqID_121693 SeqID_124040 SeqID_124087 SeqID_121736 | Mov34/MPN/PAD-1 family |
| NAD_binding_1 | SeqID_122444 SeqID_123823 | Oxidoreductase NAD-binding domain |
| Ribosomal_L28e | SeqID_122648 SeqID_120682 SeqID_123720 | Ribosomal L28e protein family |
| LIM | SeqID_122321 SeqID_123039 SeqID_123158 SeqID_123185 SeqID_119388 SeqID_119555 SeqID_119701 SeqID_120218 SeqID_123816 SeqID_121638 SeqID_124168 | LIM domain |
| SPC25 | SeqID_122737 SeqID_124254 | Microsomal signal peptidase 25 kDa subunit ( |
| WGR | SeqID_121544 | WGR domain |
| STT3 | SeqID_120152 | Oligosaccharyl transferase STT3 subun |
| WH2 | SeqID_119377 | WH2 motif |
| 14-3-3 | SeqID_122166 SeqID_122862 SeqID_123514 SeqID_119268 SeqID_119536 SeqID_119605 | 14-3-3 protein |
| Alpha_adaptinC2 | SeqID_120950 | Adaptin C-terminal domain |
| CbiA | SeqID_122680 | CobQ/CobB/MinD/ParA nucleotide binding do |
| zf-MIZ | SeqID_120096 | MIZ zinc finger |
| Lipocalin | SeqID_122101 SeqID_122172 SeqID_123222 SeqID_119931 SeqID_120164 SeqID_123572 SeqID_123598 SeqID_121698 | Lipocalin/cytosolic fatty-acid binding pr |
| DLIC | SeqID_122981 | Dynein light intermediate chain (DLIC) |
| tRNA-synt_1c_C | SeqID_120890 | tRNA synthetases class I (E and Q), an |
| Bestrophin | SeqID_119636 | Bestrophin |
| eIF-3_zeta | SeqID_122685 SeqID_120237 SeqID_123560 | Eukaryotic translation initiation factor 3 |
| Porin_3 | SeqID_122330 SeqID_121328 SeqID_119190 SeqID_121557 SeqID_121575 SeqID_123999 | Eukaryotic porin |
| ARID | SeqID_120573 | ARID/BRIGHT DNA binding domain |

TABLE 1-continued

SCN GENE FAMILIES and ANNOTATIONS
SCN gene families

| Gene name | SCN gene family members | Protein annotation |
|---|---|---|
| CybS | SeqID_122786 SeqID_124202 | CybS |
| BCAS2 | SeqID_122510 SeqID_123556 | Breast carcinoma amplified sequence 2 (BCAS2 |
| Motile_Sperm | SeqID_122721 SeqID_123310 SeqID_119174 SeqID_119175 SeqID_119281 SeqID_119604 SeqID_119641 SeqID_119724 SeqID_120035 SeqID_120095 SeqID_120327 SeqID_120441 SeqID_120517 SeqID_120563 SeqID_120632 SeqID_120633 SeqID_120910 SeqID_124175 SeqID_121850 | MSP (Major sperm protein) domain |
| Transket_pyr | SeqID_122651 SeqID_119346 SeqID_120804 SeqID_120844 SeqID_123846 | Transketolase, pyridine binding domai |
| Fibrillarin | SeqID_123301 SeqID_119795 | Fibrillarin |
| PABP | SeqID_122526 SeqID_121469 SeqID_123820 SeqID_121869 | Poly-adenylate binding protein, unique domai |
| BRCT | SeqID_121491 SeqID_120459 SeqID_121621 | BRCA1 C Terminus (BRCT) domain |
| Psf2 | SeqID_119632 | Partner of SLD five, PSF2 |
| tRNA-synt_1 | SeqID_123431 SeqID_119678 SeqID_121502 | tRNA synthetases class I (I, L, M and V) |
| Psf3 | SeqID_122668 SeqID_123586 | Partner of SLD five, PSF3 |
| tRNA-synt_2 | SeqID_122301 SeqID_124123 SeqID_119833 SeqID_124052 SeqID_121567 SeqID_121591 SeqID_121045 | tRNA synthetases class II (D, K and N) |
| NDK | SeqID_121977 SeqID_122294 SeqID_121345 SeqID_123201 SeqID_123452 SeqID_123451 SeqID_121388 SeqID_123559 | Nucleoside diphosphate kinase |
| ATP-synt_DE_N | SeqID_122751 SeqID_121401 SeqID_124264 SeqID_123752 | ATP synthase, Delta/Epsilon chain, beta |
| zf-C4 | SeqID_122310 SeqID_122617 SeqID_122812 SeqID_123080 SeqID_123445 SeqID_119666 SeqID_120699 SeqID_120820 SeqID_124333 | Zinc-finger, C4 type (two domains) |
| DIRP | SeqID_119217 | DIRP |
| Ribosomal_L36e | SeqID_122112 SeqID_123552 | Ribosomal protein L36e |
| Filament | SeqID_121260 SeqID_122400 SeqID_122546 SeqID_123386 SeqID_119327 SeqID_121473 SeqID_120922 SeqID_123579 SeqID_123618 SeqID_123953 | Intermediate filament protein |
| TFIID_30kDa | SeqID_120863 | Transcription initiation factor TFIID 23- |
| DUF926 | SeqID_120692 | Domain of Unknown Function (DUF926) |
| DUF854 | SeqID_119289 SeqID_120777 | *Caenorhabditis elegans* repeat of unknown fun |
| TPP_enzyme_M | SeqID_120595 | Thiamine pyrophosphate enzyme, central d |
| PPI_Ypi1 | SeqID_122389 SeqID_120052 SeqID_123885 | Protein phosphatase inhibitor |
| Myosin_head | SeqID_119861 | Myosin head (motor domain) |
| MH1 | SeqID_122197 SeqID_123448 SeqID_121021 | MH1 domain |
| RWD | SeqID_122537 SeqID_120442 | RWD domain |
| DUF858 | SeqID_122961 | Eukaryotic protein of unknown function (DUF8 |
| 3Beta_HSD | SeqID_123272 SeqID_121396 SeqID_119630 SeqID_121143 | 3-beta hydroxysteroid dehydrogenase/isomera |
| BIR | SeqID_123175 SeqID_119442 SeqID_121665 | Inhibitor of Apoptosis domain |
| MTHFR | SeqID_122188 SeqID_120829 SeqID_124115 | Methylenetetrahydrofolate reductase |
| GYF | SeqID_121994 | GYF domain |
| E1_dh | SeqID_122564 SeqID_122651 SeqID_123263 SeqID_123821 SeqID_123846 | Dehydrogenase E1 component |

TABLE 1-continued

SCN GENE FAMILIES and ANNOTATIONS
SCN gene families

| Gene name | SCN gene family members | Protein annotation |
| --- | --- | --- |
| Fork_head | SeqID_120305 | Fork head domain |
| DUF1604 | SeqID_119654 | Protein of unknown function (DUF1604) |
| OST3_OST6 | SeqID_123025 | OST3/OST6 family |
| Cadherin | SeqID_119235 SeqID_119705 | Cadherin domain |
| PPTA | SeqID_122418 SeqID_123390 SeqID_121057 SeqID_123924 | Protein prenyltransferase alpha subunit repe |
| GCV_H | SeqID_122462 SeqID_123213 SeqID_119530 | Glycine cleavage H-protein |
| Aldolase_II | SeqID_121238 SeqID_122401 SeqID_122499 SeqID_121462 SeqID_121475 SeqID_123767 SeqID_121689 SeqID_123952 SeqID_121934 | Class II Aldolase and Adducin N-terminal |
| AIG1 | SeqID_119367 | AIG1 family |
| RNase_PH | SeqID_122716 SeqID_122887 SeqID_120679 SeqID_124199 | 3' exoribonuclease family, domain 1 |
| Ribosomal_L18ae | SeqID_122646 SeqID_122664 SeqID_122858 SeqID_123114 SeqID_123121 SeqID_120878 SeqID_123624 SeqID_123886 SeqID_124236 SeqID_121791 SeqID_121797 SeqID_121925 | Ribosomal L18ae protein family |
| Nucleoside_tran | SeqID_123441 SeqID_124095 | Nucleoside transporter |
| Ribosomal_L37e | SeqID_122591 SeqID_121170 SeqID_123963 | Ribosomal protein L37e |
| Prefoldin | SeqID_120211 SeqID_123679 | Prefoldin subunit |
| Beta-lactamase | SeqID_122907 SeqID_120056 | Beta-lactamase |
| PC_rep | SeqID_122969 | Proteasome/cyclosome repeat |
| DEAD | SeqID_122207 SeqID_122277 SeqID_122318 SeqID_122319 SeqID_122381 SeqID_123007 SeqID_123018 SeqID_119170 SeqID_121414 SeqID_121443 SeqID_119233 SeqID_119256 SeqID_119300 SeqID_119324 SeqID_119657 SeqID_119712 SeqID_119766 SeqID_120168 SeqID_120342 SeqID_120509 SeqID_120575 SeqID_121032 SeqID_121200 SeqID_123835 SeqID_123976 SeqID_124021 SeqID_124074 SeqID_124119 | DEAD/DEAH box helicase |
| SURF4 | SeqID_120816 | SURF4 family |
| NCD3G | SeqID_120999 | Nine Cysteines Domain of family 3 GPCR |
| SURF6 | SeqID_122863 | Surfeit locus protein 6 |
| Sec10 | SeqID_120206 | Exocyst complex component Sec10 |
| Oxidored_molyb | SeqID_122426 SeqID_123908 | Oxidoreductase molybdopterin binding d |
| Cation_efflux | SeqID_119547 SeqID_119854 | Cation efflux family |
| HisKA_2 | SeqID_121848 | Histidine kinase |
| RNA_pol_Rpb5_C | SeqID_122441 SeqID_123528 SeqID_123883 | RNA polymerase Rpb5, C-terminal domain |
| dUTPase | SeqID_120762 | dUTPase |
| Calx-beta | SeqID_120919 | Calx-beta domain |
| FA_desaturase | SeqID_122220 SeqID_122258 | Fatty acid desaturase |
| BRF1 | SeqID_119280 | Brf1-like TBP-binding domain |
| W2 | SeqID_119265 SeqID_121487 | eIF4-gamma/eIF5/eIF2-epsilon |
| PIP5K | SeqID_123028 | Phosphatidylinositol-4-phosphate 5-Kinase |
| Ribosomal_L35Ae | SeqID_122114 SeqID_122827 SeqID_123435 SeqID_123889 SeqID_124288 | Ribosomal protein L35Ae |
| RTC_insert | SeqID_122518 SeqID_120776 SeqID_123973 | RNA 3'-terminal phosphate cyclase (RTC), i |
| SKIP_SNW | SeqID_121033 | SKIP/SNW domain |
| PAP_assoc | SeqID_122124 SeqID_123088 SeqID_120195 | PAP/25A associated domain |
| DNA_pol_E_B | SeqID_122568 SeqID_124351 | DNA polymerase epsilon subunit B |
| RNA_pol_Rpb5_N | SeqID_122441 SeqID_123137 SeqID_123528 SeqID_119977 SeqID_123883 | RNA polymerase Rpb5, N-terminal domain |

TABLE 1-continued

SCN GENE FAMILIES and ANNOTATIONS
SCN gene families

| Gene name | SCN gene family members | Protein annotation |
| --- | --- | --- |
| Vicilin_N | SeqID_121108 | Vicilin N terminal region |
| DEP | SeqID_120527 | Domain found in Dishevelled, Egl-10, and Ple |
| Cytochrom_C | SeqID_122036 SeqID_123651 | Cytochrome c |
| Ribosomal_L38e | SeqID_122040 SeqID_119735 SeqID_123834 | Ribosomal L38e protein family |
| GRIM-19 | SeqID_123149 SeqID_119221 SeqID_121885 | GRIM-19 protein |
| DUF947 | SeqID_120569 | Domain of unknown function (DUF947) |
| DnaJ | SeqID_121245 SeqID_122232 SeqID_122521 SeqID_122541 SeqID_122667 SeqID_122722 SeqID_119277 SeqID_119288 SeqID_119644 SeqID_120879 SeqID_120983 SeqID_121206 SeqID_123640 SeqID_123715 SeqID_123882 SeqID_124112 SeqID_124311 | DnaJ domain |
| G6PD_C | SeqID_122743 SeqID_124271 | Glucose-6-phosphate dehydrogenase, C-termina |
| PHO4 | SeqID_122752 SeqID_120810 SeqID_124256 | Phosphate transporter family |
| Reprolysin | SeqID_120801 | Reprolysin (M12B) family zinc metalloprote |
| MIT | SeqID_120407 | MIT domain |
| LRR_1 | SeqID_122148 SeqID_122601 SeqID_119275 SeqID_119350 SeqID_120299 SeqID_120639 SeqID_121187 SeqID_123576 SeqID_123887 | Leucine Rich Repeat |
| Ribosomal_S21e | SeqID_123512 SeqID_119578 SeqID_123570 | Ribosomal protein S21e |
| tRNA-synt_1d_C | SeqID_122724 | DALR anticodon binding domain |
| RNA_pol_A_bac | SeqID_120230 SeqID_121039 | RNA polymerase Rpb3/RpoA insert domain |
| KOW | SeqID_122127 SeqID_122516 SeqID_122554 SeqID_122701 SeqID_122710 SeqID_123295 SeqID_123458 SeqID_119904 SeqID_123548 SeqID_123582 SeqID_123634 SeqID_123734 | KOW motif |
| ECH | SeqID_122281 SeqID_122454 SeqID_119372 SeqID_123865 SeqID_124071 SeqID_121747 | Enoyl-CoA hydratase/isomerase family |
| IF_tail | SeqID_121260 SeqID_122400 SeqID_120920 SeqID_123579 | Intermediate filament tail domain |
| PAN | SeqID_120695 | PAN domain |
| zf-C3HC4 | SeqID_122347 SeqID_122496 SeqID_123384 SeqID_123511 SeqID_119241 SeqID_119357 SeqID_120644 SeqID_123692 SeqID_124075 | Zinc finger, C3HC4 type (RING finger) |
| WW | SeqID_122257 SeqID_122416 SeqID_119608 SeqID_120846 SeqID_120854 SeqID_123538 | WW domain |
| PB1 | SeqID_120217 | PB1 domain |
| NOG1 | SeqID_119367 | Nucleolar GTP-binding protein 1 (NOG1) |
| PAS | SeqID_122206 | PAS domain |
| EI24 | SeqID_121718 | Etoposide-induced protein 2.4 (EI24) |
| MIF4G | SeqID_120041 | MIF4G domain |
| PI3_PI4_kinase | SeqID_119291 SeqID_119922 SeqID_120521 SeqID_121582 SeqID_120853 SeqID_121831 | Phosphatidylinositol 3- and 4-kinase |
| PAZ | SeqID_121243 SeqID_119347 SeqID_119944 SeqID_121539 SeqID_120129 SeqID_121552 SeqID_121086 SeqID_121913 | PAZ domain |
| Cpn60_TCP1 | SeqID_122080 SeqID_122245 SeqID_123243 SeqID_123369 SeqID_119577 SeqID_119896 SeqID_121517 SeqID_120191 SeqID_120292 SeqID_120613 | TCP-1/cpn60 chaperonin family |

TABLE 1-continued

SCN GENE FAMILIES and ANNOTATIONS
SCN gene families

| Gene name | SCN gene family members | Protein annotation |
|---|---|---|
| Tim17 | SeqID_120876 SeqID_121091 SeqID_123615 SeqID_123735 SeqID_121655 SeqID_123955 SeqID_122097 SeqID_124320 SeqID_121063 | Tim17/Tim22/Tim23 family |
| Ligase_CoA | SeqID_122725 SeqID_124060 | CoA-ligase |
| Trehalase | SeqID_121616 | Trehalase |
| PQ-loop | SeqID_122891 SeqID_123245 SeqID_123591 | PQ loop repeat |
| TTL | SeqID_119185 | Tubulin-tyrosine ligase family |
| Myb_DNA-binding | SeqID_119288 SeqID_119345 SeqID_120201 SeqID_121080 SeqID_121197 | Myb-like DNA-binding domain |
| Ribonuclease_3 | SeqID_121044 | RNase3 domain |
| Ribophorin_I | SeqID_121320 SeqID_120333 SeqID_121666 | Ribophorin I |
| CAS_CSE1 | SeqID_119961 | CAS/CSE protein, C-terminus |
| Pex2_Pex12 | SeqID_122740 SeqID_123980 | Pex2/Pex12 amino terminal region |

Table 1 Legend:
Column 1 - pfam name or designation
Column 2 - gene family member listed by SEQ ID NO corresponding to amino acid sequence translation from vcDNA SEQ ID NO identified in feature field of peptide sequence
Column 3 - Protein annotation based on BLASTP comparisons In order to construct a dsRNA sequence, or concatamers or chimeras of dsRNA sequences from various genes either within SCN, from other pest nucleotide sequences, or a combination thereof, nucleotide sequences corresponding to the SCN genome sequences were BLASTed against known vertebrate, soybean, and *Rhizobium* nucleotide sequences to first eliminate contiguous sequences in SCN that matched sequences in known vertebrate, soybean, and *Rhozobium* sequences that are at least about 21 nucleotides in length. This redacted set of SCN sequences was then compared to known nucleotide sequences in parasitic nematodes, insects, and fungi to identify sequences of substantial identity that could be useful in constructing sequences that, when expressed as a dsRNA sequence, are capable of effecting gene suppression in SCN as well as in another parasitic nematode, or insect, or fungal pest. The results of comparisons to other parasitic nematode sequences are shown in Table 2.

TABLE 2

| Diverse Parasitic Nematode Nucleotide Coding Sequences Matching *H. glycines* vcDNA sequences | | | | |
|---|---|---|---|---|
| *H. glycines* Sequence[1] | Position[2] | GeneID[3] | Position[4] | % identity[5] |
| Seq ID NO: 50950 | 21-138 | gi\|28916076 | 1-119 | 91% |
| Seq ID NO: 50950 | 14-41 | gi\|159473 | 34-61 | 100% |
| Seq ID NO: 50950 | 14-41 | gi\|2454547 | 227-200 | 100% |
| Seq ID NO: 50950 | 14-41 | gi\|551594 | 194-221 | 100% |
| Seq ID NO: 50950 | 14-41 | gi\|551595 | 669-696 | 100% |
| Seq ID NO: 50950 | 14-41 | gi\|18032254 | 34-61 | 100% |
| Seq ID NO: 50950 | 18-41 | gi\|18477256 | 279-256 | 100% |
| Seq ID NO: 50950 | 18-41 | gi\|18477260 | 325-302 | 100% |
| Seq ID NO: 50950 | 18-41 | gi\|18477262 | 634-611 | 100% |
| Seq ID NO: 50950 | 14-35 | gi\|18477259 | 22-1 | 100% |
| Seq ID NO: 50950 | 14-35 | gi\|18477261 | 22-1 | 100% |
| Seq ID NO: 50950 | 14-35 | gi\|37780968 | 22-1 | 100% |
| Seq ID NO: 50973 | 88-108 | gi\|19267657 | 465-445 | 100% |
| Seq ID NO: 51012 | 302-411 | gi\|18080245 | 178-69 | 84% |
| Seq ID NO: 51132 | 182-360 | gi\|32323955 | 5-183 | 96% |
| Seq ID NO: 51132 | 184-359 | gi\|33139778 | 6-182 | 96% |
| Seq ID NO: 51132 | 182-351 | gi\|33140274 | 5-174 | 95% |
| Seq ID NO: 51132 | 195-360 | gi\|32324510 | 1-166 | 95% |

TABLE 2-continued

| Diverse Parasitic Nematode Nucleotide Coding Sequences Matching *H. glycines* vcDNA sequences | | | | |
|---|---|---|---|---|
| *H. glycines* Sequence[1] | Position[2] | GeneID[3] | Position[4] | % identity[5] |
| Seq ID NO: 51132 | 218-354 | gi\|33140264 | 1-137 | 95% |
| Seq ID NO: 51132 | 182-284 | gi\|32324219 | 5-107 | 94% |
| Seq ID NO: 51164 | 117-137 | gi\|22543645 | 32-12 | 100% |
| Seq ID NO: 51169 | 1-236 | gi\|47118285 | 740-975 | 97% |
| Seq ID NO: 51169 | 1-236 | gi\|47118286 | 753-988 | 97% |
| Seq ID NO: 51169 | 1-219 | gi\|16797830 | 731-950 | 97% |
| Seq ID NO: 51169 | 1-219 | gi\|21885260 | 751-969 | 97% |
| Seq ID NO: 51169 | 1-219 | gi\|26000759 | 727-945 | 97% |
| Seq ID NO: 51169 | 1-219 | gi\|31442322 | 728-946 | 97% |
| Seq ID NO: 51169 | 1-219 | gi\|31442320 | 728-946 | 96% |
| Seq ID NO: 51169 | 4-219 | gi\|16797831 | 732-947 | 96% |
| Seq ID NO: 51169 | 1-219 | gi\|38096133 | 730-948 | 94% |
| Seq ID NO: 51169 | 1-33 | gi\|16797827 | 776-807 | 96% |
| Seq ID NO: 51169 | 131-159 | gi\|16797844 | 862-890 | 96% |
| Seq ID NO: 51169 | 216-236 | gi\|48479719 | 1112-1132 | 100% |
| Seq ID NO: 51184 | 16-47 | gi\|32324419 | 271-302 | 100% |
| Seq ID NO: 51378 | 184-459 | gi\|32325335 | 36-311 | 97% |
| Seq ID NO: 51378 | 504-626 | gi\|32325335 | 311-433 | 100% |
| Seq ID NO: 51378 | 753-841 | gi\|32325335 | 453-541 | 97% |
| Seq ID NO: 51378 | 101-139 | gi\|32325335 | 1-39 | 100% |
| Seq ID NO: 51378 | 676-702 | gi\|32325335 | 430-456 | 100% |
| Seq ID NO: 51561 | 402-476 | gi\|33139584 | 80-6 | 100% |
| Seq ID NO: 51561 | 192-229 | gi\|33139584 | 115-78 | 100% |
| Seq ID NO: 51561 | 192-215 | gi\|6969910 | 34-11 | 100% |
| Seq ID NO: 51579 | 1-138 | gi\|33139914 | 209-346 | 97% |
| Seq ID NO: 51823 | 55-187 | gi\|18081060 | 80-212 | 86% |
| Seq ID NO: 51824 | 3-97 | gi\|54548889 | 100-194 | 87% |
| Seq ID NO: 51824 | 3-97 | gi\|18089540 | 421-515 | 85% |
| Seq ID NO: 51824 | 3-79 | gi\|18081060 | 404-480 | 87% |
| Seq ID NO: 51978 | 1-314 | gi\|33139071 | 85-397 | 96% |
| Seq ID NO: 51978 | 307-395 | gi\|33139071 | 406-494 | 97% |
| Seq ID NO: 51978 | 406-452 | gi\|33139071 | 505-551 | 97% |
| Seq ID NO: 51978 | 406-475 | gi\|32325389 | 507-576 | 97% |
| Seq ID NO: 51978 | 1-237 | gi\|33140521 | 87-323 | 94% |
| Seq ID NO: 51991 | 239-260 | gi\|30028357 | 64-85 | 100% |
| Seq ID NO: 52051 | 1-78 | gi\|33140098 | 496-573 | 100% |
| Seq ID NO: 52051 | 1-74 | gi\|32324423 | 496-569 | 100% |
| Seq ID NO: 52051 | 1-61 | gi\|33139933 | 499-559 | 100% |
| Seq ID NO: 52051 | 1-58 | gi\|33139533 | 495-552 | 100% |
| Seq ID NO: 52051 | 56-168 | gi\|18082418 | 136-248 | 85% |

TABLE 2-continued Diverse Parasitic Nematode Nucleotide Coding Sequences Matching *H. glycines* vcDNA sequences

| H. glycines Sequence[1] | Position[2] | Gene

TABLE 2-continued

Diverse Parasitic Nematode Nucleotide Coding Sequences Matching *H. glycines* vcDNA sequences

| *H. glycines* Sequence[1] | Position[2] | GeneID[3] | Position[4] | % identity[5] |
|---|---|---|---|---|
| Seq ID NO: 54847 | 3-101 | gi\|28916076 | 176-79 | 89% |
| Seq ID NO: 54865 | 54-202 | gi\|33140673 | 199-51 | 88% |
| Seq ID NO: 54865 | 61-202 | gi\|33139639 | 245-386 | 88% |
| Seq ID NO: 54865 | 59-199 | gi\|33139131 | 99-239 | 86% |
| Seq ID NO: 45847 | 183-308 | gi\|18080348 | 231-356 | 85% |
| Seq ID NO: 45847 | 190-308 | gi\|7144294 | 198-316 | 85% |
| Seq ID NO: 54946 | 128-285 | gi\|54546846 | 415-257 | 85% |
| Seq ID NO: 54981 | 83-126 | gi\|551594 | 1028-1070 | 93% |
| Seq ID NO: 54981 | 83-126 | gi\|551595 | 267-309 | 93% |
| Seq ID NO: 54999 | 328-498 | gi\|18382277 | 801-971 | 82% |
| Seq ID NO: 55025 | 372-395 | gi\|33138439 | 263-286 | 100% |
| Seq ID NO: 55025 | 419-439 | gi\|33952838 | 448-428 | 100% |
| Seq ID NO: 55106 | 21-138 | gi\|28916076 | 1-119 | 91% |
| Seq ID NO: 55106 | 14-41 | gi\|159473 | 34-61 | 100% |
| Seq ID NO: 55106 | 14-41 | gi\|2454547 | 227-200 | 100% |
| Seq ID NO: 55106 | 14-41 | gi\|551594 | 194-221 | 100% |
| Seq ID NO: 55106 | 14-41 | gi\|551595 | 669-696 | 100% |
| Seq ID NO: 55106 | 14-41 | gi\|18032254 | 34-81 | 100% |
| Seq ID NO: 55106 | 18-41 | gi\|18477256 | 279-256 | 100% |
| Seq ID NO: 55106 | 18-41 | gi\|18477260 | 325-302 | 100% |
| Seq ID NO: 55106 | 18-41 | gi\|18477262 | 634-611 | 100% |
| Seq ID NO: 55106 | 14-35 | gi\|18477259 | 22-1 | 100% |
| Seq ID NO: 55106 | 14-35 | gi\|18477261 | 22-1 | 100% |
| Seq ID NO: 55106 | 14-35 | gi\|37780968 | 22-1 | 100% |
| Seq ID NO: 55108 | 1-93 | gi\|7143864 | 42-134 | 82% |
| Seq ID NO: 55117 | 35-57 | gi\|7144284 | 325-303 | 100% |
| Seq ID NO: 55119 | 36-155 | gi\|28916076 | 140-20 | 90% |
| Seq ID NO: 55175 | 1-160 | gi\|5107411 | 189-30 | 100% |
| Seq ID NO: 55175 | 1-160 | gi\|2149587 | 189-30 | 95% |
| Seq ID NO: 55175 | 47-160 | gi\|34105813 | 1719-1606 | 100% |
| Seq ID NO: 55175 | 1-160 | gi\|2149585 | 189-30 | 92% |
| Seq ID NO: 55175 | 1-160 | gi\|2738785 | 190-30 | 92% |
| Seq ID NO: 55175 | 1-160 | gi\|2738792 | 190-30 | 92% |
| Seq ID NO: 55175 | 1-160 | gi\|2738799 | 190-30 | 92% |
| Seq ID NO: 55175 | 1-160 | gi\|2738800 | 190-30 | 92% |
| Seq ID NO: 55175 | 2-160 | gi\|2707748 | 1766-1607 | 90% |
| Seq ID NO: 55175 | 1-80 | gi\|48479719 | 191-112 | 98% |
| Seq ID NO: 55175 | 1-80 | gi\|37674501 | 194-115 | 98% |
| Seq ID NO: 55175 | 115-160 | gi\|37674501 | 75-30 | 95% |
| Seq ID NO: 55175 | 1-78 | gi\|1147729 | 2525-2448 | 98% |
| Seq ID NO: 55175 | 115-160 | gi\|1147729 | 2413-2368 | 97% |
| Seq ID NO: 55175 | 1-78 | gi\|2232021 | 87-10 | 98% |
| Seq ID NO: 55226 | 1-24 | gi\|33139696 | 554-577 | 100% |
| Seq ID NO: 55245 | 1-25 | gi\|32324959 | 40-64 | 96% |
| Seq ID NO: 55392 | 173-276 | gi\|35504550 | 57-160 | 99% |
| Seq ID NO: 55392 | 326-425 | gi\|35504550 | 164-263 | 97% |
| Seq ID NO: 55392 | 1-66 | gi\|35504862 | 10-74 | 89% |
| Seq ID NO: 55425 | 57-187 | gi\|54545475 | 93-224 | 92% |
| Seq ID NO: 55425 | 231-321 | gi\|54545475 | 220-310 | 90% |
| Seq ID NO: 55468 | 1-141 | gi\|32325191 | 449-589 | 94% |
| Seq ID NO: 55545 | 75-99 | gi\|32325459 | 266-290 | 100% |
| Seq ID NO: 55553 | 1-116 | gi\|33139587 | 121-6 | 94% |
| Seq ID NO: 55566 | 167-228 | gi\|18083080 | 182-243 | 88% |
| Seq ID NO: 55640 | 887-1044 | gi\|33139586 | 1-158 | 96% |
| Seq ID NO: 55660 | 21-138 | gi\|28916076 | 1-119 | 91% |
| Seq ID NO: 55660 | 14-41 | gi\|159473 | 34-61 | 100% |
| Seq ID NO: 55660 | 14-41 | gi\|2454547 | 227-200 | 100% |
| Seq ID NO: 55660 | 14-41 | gi\|551594 | 194-221 | 100% |
| Seq ID NO: 55660 | 14-41 | gi\|551595 | 669-696 | 100% |
| Seq ID NO: 55660 | 14-41 | gi\|18032254 | 34-61 | 100% |
| Seq ID NO: 55660 | 18-41 | gi\|18477256 | 279-256 | 100% |
| Seq ID NO: 55660 | 18-41 | gi\|18477260 | 325-302 | 100% |
| Seq ID NO: 55660 | 18-41 | gi\|18477262 | 634-611 | 100% |
| Seq ID NO: 55660 | 14-35 | gi\|18477259 | 22-1 | 100% |
| Seq ID NO: 55660 | 14-35 | gi\|18477261 | 22-1 | 100% |
| Seq ID NO: 55660 | 14-35 | gi\|37780968 | 22-1 | 100% |
| Seq ID NO: 55719 | 1-146 | gi\|18080802 | 354-209 | 97% |
| Seq ID NO: 55719 | 1-131 | gi\|7144157 | 137-7 | 97% |
| Seq ID NO: 55719 | 1-130 | gi\|18088100 | 130-1 | 97% |
| Seq ID NO: 55719 | 1-124 | gi\|54549688 | 124-1 | 96% |
| Seq ID NO: 55719 | 1-118 | gi\|18089409 | 118-1 | 97% |
| Seq ID NO: 55719 | 1-117 | gi\|18090782 | 117-1 | 97% |
| Seq ID NO: 55719 | 25-146 | gi\|52128973 | 94-215 | 88% |
| Seq ID NO: 55719 | 1-78 | gi\|18083086 | 537-614 | 96% |

TABLE 2-continued

Diverse Parasitic Nematode Nucleotide Coding Sequences Matching *H. glycines* vcDNA sequences

| *H. glycines* Sequence[1] | Position[2] | GeneID[3] | Position[4] | % identity[5] |
|---|---|---|---|---|
| Seq ID NO: 55719 | 1-75 | gi\|18090403 | 75-1 | 96% |
| Seq ID NO: 55719 | 25-121 | gi\|52129301 | 319-415 | 86% |
| Seq ID NO: 55719 | 100-146 | gi\|52129005 | 1-47 | 95% |
| Seq ID NO: 55719 | 83-146 | gi\|9033884 | 441-503 | 90% |
| Seq ID NO: 55719 | 83-146 | gi\|15768080 | 331-393 | 90% |
| Seq ID NO: 55719 | 71-146 | gi\|19383550 | 397-471 | 88% |
| Seq ID NO: 55719 | 83-146 | gi\|39747546 | 344-406 | 90% |
| Seq ID NO: 55719 | 100-146 | gi\|39747568 | 266-312 | 95% |
| Seq ID NO: 55719 | 100-146 | gi\|46984679 | 145-99 | 95% |
| Seq ID NO: 55719 | 105-146 | gi\|15769768 | 391-432 | 97% |
| Seq ID NO: 55719 | 105-146 | gi\|40669510 | 255-296 | 97% |
| Seq ID NO: 55719 | 100-140 | gi\|46986671 | 175-135 | 97% |
| Seq ID NO: 55719 | 108-146 | gi\|31326272 | 1-39 | 97% |
| Seq ID NO: 55719 | 105-146 | gi\|159682 | 379-420 | 92% |
| Seq ID NO: 55759 | 302-322 | gi\|46984484 | 89-109 | 100% |
| Seq ID NO: 55808 | 1-74 | gi\|54545841 | 238-311 | 91% |
| Seq ID NO: 55827 | 140-161 | gi\|46983788 | 125-146 | 100% |
| Seq ID NO: 55849 | 95-269 | gi\|54548527 | 231-405 | 87% |
| Seq ID NO: 55849 | 138-269 | gi\|54545989 | 2-133 | 88% |
| Seq ID NO: 55931 | 140-268 | gi\|33139063 | 130-258 | 96% |
| Seq ID NO: 55931 | 1-60 | gi\|33139063 | 71-130 | 98% |
| Seq ID NO: 56068 | 123-187 | gi\|21432594 | 122-186 | 86% |
| Seq ID NO: 56211 | 1-101 | gi\|7144157 | 39-139 | 97% |
| Seq ID NO: 56211 | 1-101 | gi\|54549688 | 26-126 | 96% |
| Seq ID NO: 56211 | 22-101 | gi\|18083086 | 614-535 | 96% |
| Seq ID NO: 56211 | 25-101 | gi\|18090403 | 1-77 | 96% |
| Seq ID NO: 56211 | 54-75 | gi\|52129301 | 340-319 | 100% |
| Seq ID NO: 56333 | 36-56 | gi\|33140432 | 264-284 | 100% |
| Seq ID NO: 56402 | 639-718 | gi\|33139730 | 156-76 | 93% |
| Seq ID NO: 56411 | 1-73 | gi\|16797830 | 749-821 | 100% |
| Seq ID NO: 56411 | 1-73 | gi\|16797832 | 747-819 | 100% |
| Seq ID NO: 56411 | 1-73 | gi\|26000759 | 745-817 | 100% |
| Seq ID NO: 56411 | 1-73 | gi\|31442320 | 746-818 | 100% |
| Seq ID NO: 56411 | 1-73 | gi\|31442322 | 746-818 | 98% |
| Seq ID NO: 56411 | 8-73 | gi\|21885259 | 776-841 | 98% |
| Seq ID NO: 45947 | 974-995 | gi\|46988291 | 426-405 | 100% |
| Seq ID NO: 56551 | 187-242 | gi\|18381363 | 1139-1194 | 91% |
| Seq ID NO: 56640 | 1-65 | gi\|33140765 | 16-80 | 98% |
| Seq ID NO: 56699 | 36-174 | gi\|28916076 | 140-1 | 92% |
| Seq ID NO: 56699 | 154-181 | gi\|159473 | 61-34 | 100% |
| Seq ID NO: 56699 | 154-181 | gi\|2454547 | 200-227 | 100% |
| Seq ID NO: 56699 | 154-181 | gi\|551594 | 221-194 | 100% |
| Seq ID NO: 56699 | 154-181 | gi\|551595 | 696-669 | 100% |
| Seq ID NO: 56699 | 154-181 | gi\|18032254 | 61-34 | 100% |
| Seq ID NO: 56699 | 154-177 | gi\|18477256 | 256-279 | 100% |
| Seq ID NO: 56699 | 154-177 | gi\|18477260 | 302-325 | 100% |
| Seq ID NO: 56699 | 154-177 | gi\|18477262 | 611-634 | 100% |
| Seq ID NO: 56699 | 160-181 | gi\|18477259 | 1-22 | 100% |
| Seq ID NO: 56699 | 160-181 | gi\|18477261 | 1-22 | 100% |
| Seq ID NO: 56699 | 160-181 | gi\|37780968 | 1-22 | 100% |
| Seq ID NO: 56752 | 348-369 | gi\|7235459 | 41-20 | 100% |
| Seq ID NO: 45973 | 404-544 | gi\|54546305 | 483-623 | 88% |
| Seq ID NO: 45973 | 181-293 | gi\|54546305 | 345-457 | 83% |
| Seq ID NO: 45973 | 434-544 | gi\|54544886 | 269-379 | 90% |
| Seq ID NO: 56872 | 764-956 | gi\|33140201 | 149-341 | 99% |
| Seq ID NO: 56872 | 569-719 | gi\|33140201 | 1-151 | 98% |
| Seq ID NO: 56889 | 189-333 | gi\|54544976 | 245-389 | 89% |
| Seq ID NO: 56927 | 75-226 | gi\|33139131 | 99-250 | 87% |
| Seq ID NO: 56927 | 81-221 | gi\|32324211 | 1-141 | 87% |
| Seq ID NO: 56972 | 1-101 | gi\|35504916 | 448-548 | 96% |
| Seq ID NO: 56972 | 1-85 | gi\|35504725 | 448-533 | 94% |
| Seq ID NO: 57065 | 168-188 | gi\|33952655 | 9-29 | 100% |
| Seq ID NO: 57065 | 168-188 | gi\|46422144 | 284-304 | 100% |
| Seq ID NO: 57084 | 62-214 | gi\|33140673 | 201-49 | 92% |
| Seq ID NO: 57084 | 71-214 | gi\|33139639 | 245-388 | 93% |
| Seq ID NO: 57086 | 190-217 | gi\|54547991 | 157-184 | 96% |
| Seq ID NO: 57220 | 1-66 | gi\|37517244 | 1816-1881 | 96% |
| Seq ID NO: 57351 | 5-196 | gi\|32323971 | 353-544 | 98% |
| Seq ID NO: 57416 | 412-434 | gi\|551595 | 853-875 | 100% |
| Seq ID NO: 57422 | 783-808 | gi\|46986223 | 315-290 | 100% |
| Seq ID NO: 57468 | 1-221 | gi\|2239108 | 36-256 | 100% |
| Seq ID NO: 57539 | 18-223 | gi\|32325381 | 184-389 | 92% |
| Seq ID NO: 57539 | 415-498 | gi\|32325381 | 398-481 | 97% |
| Seq ID NO: 57539 | 174-223 | gi\|33139814 | 8-57 | 100% |

TABLE 2-continued

Diverse Parasitic Nematode Nucleotide Coding Sequences Matching *H. glycines* vcDNA sequences

| *H. glycines* Sequence[1] | Position[2] | GeneID[3] | Position[4] | % identity[5] |
|---|---|---|---|---|
| Seq ID NO: 57713 | 253-552 | gi\|33139068 | 28-327 | 97% |
| Seq ID NO: 57713 | 633-701 | gi\|33139068 | 334-402 | 98% |
| Seq ID NO: 57713 | 169-198 | gi\|33139068 | 1-30 | 100% |
| Seq ID NO: 57713 | 750-877 | gi\|33139557 | 441-568 | 93% |
| Seq ID NO: 57713 | 176-198 | gi\|33139557 | 1-23 | 100% |
| Seq ID NO: 57713 | 750-892 | gi\|33140099 | 424-566 | 92% |
| Seq ID NO: 57713 | 255-552 | gi\|33139079 | 16-313 | 97% |
| Seq ID NO: 57713 | 750-849 | gi\|33139079 | 434-533 | 94% |
| Seq ID NO: 57713 | 1-198 | gi\|32324666 | 26-223 | 96% |
| Seq ID NO: 57713 | 633-661 | gi\|32324666 | 527-555 | 100% |
| Seq ID NO: 57713 | 271-552 | gi\|33139103 | 1-282 | 97% |
| Seq ID NO: 57713 | 287-554 | gi\|33139308 | 38-306 | 97% |
| Seq ID NO: 57713 | 637-864 | gi\|33139308 | 315-545 | 90% |
| Seq ID NO: 57713 | 1232-1423 | gi\|33139521 | 162-353 | 96% |
| Seq ID NO: 57713 | 811-966 | gi\|33139521 | 1-159 | 89% |
| Seq ID NO: 57713 | 750-878 | gi\|33140185 | 112-240 | 93% |
| Seq ID NO: 57713 | 636-701 | gi\|33140185 | 1-66 | 98% |
| Seq ID NO: 57713 | 300-551 | gi\|32325329 | 51-302 | 90% |
| Seq ID NO: 57713 | 1229-1384 | gi\|32325562 | 408-563 | 99% |
| Seq ID NO: 57713 | 750-966 | gi\|32325562 | 189-408 | 89% |
| Seq ID NO: 57713 | 598-701 | gi\|32325562 | 40-143 | 96% |
| Seq ID NO: 57713 | 300-534 | gi\|32324015 | 367-601 | 90% |
| Seq ID NO: 57713 | 1229-1374 | gi\|33140373 | 408-553 | 100% |
| Seq ID NO: 57713 | 655-698 | gi\|32325327 | 481-524 | 90% |
| Seq ID NO: 57713 | 655-776 | gi\|32325443 | 481-599 | 83% |
| Seq ID NO: 57713 | 300-533 | gi\|33140304 | 225-458 | 89% |
| Seq ID NO: 57713 | 300-517 | gi\|33140764 | 367-584 | 89% |
| Seq ID NO: 57713 | 1229-1347 | gi\|32324619 | 408-526 | 100% |
| Seq ID NO: 57713 | 300-490 | gi\|32325078 | 367-557 | 90% |
| Seq ID NO: 57713 | 1254-1423 | gi\|33139825 | 258-427 | 90% |
| Seq ID NO: 57713 | 300-453 | gi\|33139892 | 410-563 | 90% |
| Seq ID NO: 57713 | 300-452 | gi\|33140637 | 410-562 | 90% |
| Seq ID NO: 57713 | 1288-1423 | gi\|32324536 | 247-382 | 91% |
| Seq ID NO: 57713 | 414-551 | gi\|32324536 | 10-147 | 89% |
| Seq ID NO: 57713 | 384-551 | gi\|33140589 | 1-168 | 88% |
| Seq ID NO: 57713 | 393-551 | gi\|33140074 | 4-162 | 88% |
| Seq ID NO: 57713 | 655-896 | gi\|32325371 | 173-411 | 83% |
| Seq ID NO: 57713 | 300-401 | gi\|32324162 | 476-577 | 92% |
| Seq ID NO: 57713 | 428-551 | gi\|32324623 | 225-348 | 88% |
| Seq ID NO: 57713 | 300-375 | gi\|32324623 | 103-178 | 93% |
| Seq ID NO: 57713 | 300-353 | gi\|33139035 | 491-544 | 94% |
| Seq ID NO: 57793 | 1-189 | gi\|33139897 | 347-535 | 91% |
| Seq ID NO: 57824 | 6-146 | gi\|32324211 | 1-141 | 88% |
| Seq ID NO: 57824 | 17-151 | gi\|33139131 | 116-250 | 88% |
| Seq ID NO: 57824 | 1-145 | gi\|33140673 | 193-49 | 83% |
| Seq ID NO: 57824 | 13-145 | gi\|33139639 | 256-388 | 82% |
| Seq ID NO: 57824 | 152-172 | gi\|45563795 | 521-501 | 100% |
| Seq ID NO: 57907 | 1213-1367 | gi\|18081696 | 127-281 | 85% |
| Seq ID NO: 57996 | 664-684 | gi\|39747573 | 93-113 | 100% |
| Seq ID NO: 58001 | 4-65 | gi\|27541441 | 265-326 | 84% |
| Seq ID NO: 46037 | 415-488 | gi\|21393234 | 329-402 | 91% |
| Seq ID NO: 46037 | 117-143 | gi\|21393234 | 148-174 | 100% |
| Seq ID NO: 46037 | 377-488 | gi\|18080246 | 261-372 | 85% |
| Seq ID NO: 46037 | 418-488 | gi\|18381808 | 299-229 | 90% |
| Seq ID NO: 46037 | 427-488 | gi\|52128281 | 271-332 | 91% |
| Seq ID NO: 58171 | 85-106 | gi\|22139607 | 133-112 | 100% |
| Seq ID NO: 58223 | 117-138 | gi\|16746280 | 49-70 | 100% |
| Seq ID NO: 58237 | 123-269 | gi\|33139639 | 245-388 | 89% |
| Seq ID NO: 58237 | 114-269 | gi\|33140673 | 201-49 | 87% |
| Seq ID NO: 58237 | 121-246 | gi\|33139131 | 99-224 | 82% |
| Seq ID NO: 58237 | 333-378 | gi\|32324211 | 211-256 | 91% |
| Seq ID NO: 58264 | 869-1010 | gi\|18082514 | 100-241 | 90% |
| Seq ID NO: 58264 | 1203-1298 | gi\|18082514 | 245-340 | 92% |
| Seq ID NO: 58357 | 136-238 | gi\|54549492 | 497-599 | 88% |
| Seq ID NO: 58357 | 369-416 | gi\|54549492 | 633-680 | 91% |
| Seq ID NO: 58382 | 12-159 | gi\|18383012 | 1144-1291 | 84% |
| Seq ID NO: 58427 | 1-143 | gi\|16797830 | 62-204 | 97% |
| Seq ID NO: 58427 | 1-143 | gi\|16797831 | 62-202 | 97% |
| Seq ID NO: 58427 | 1-143 | gi\|16797832 | 63-203 | 97% |
| Seq ID NO: 58427 | 1-143 | gi\|47118285 | 74-214 | 96% |
| Seq ID NO: 58427 | 1-142 | gi\|26000762 | 62-201 | 95% |
| Seq ID NO: 58427 | 1-143 | gi\|31442322 | 62-202 | 95% |
| Seq ID NO: 58427 | 1-143 | gi\|38096133 | 62-202 | 93% |
| Seq ID NO: 58438 | 319-443 | gi\|32324393 | 180-307 | 96% |
| Seq ID NO: 58438 | 1-83 | gi\|32324393 | 25-108 | 98% |
| Seq ID NO: 58438 | 154-195 | gi\|32324393 | 107-148 | 100% |
| Seq ID NO: 58438 | 239-273 | gi\|32324393 | 147-181 | 100% |
| Seq ID NO: 58438 | 319-383 | gi\|33140257 | 413-477 | 98% |
| Seq ID NO: 58438 | 154-191 | gi\|33140257 | 345-382 | 100% |
| Seq ID NO: 58478 | 192-238 | gi\|18089268 | 22-68 | 89% |
| Seq ID NO: 58670 | 81-148 | gi\|18090251 | 452-519 | 88% |
| Seq ID NO: 58722 | 346-432 | gi\|19266104 | 21-107 | 84% |
| Seq ID NO: 46083 | 1-119 | gi\|33139765 | 458-576 | 99% |
| Seq ID NO: 46083 | 265-305 | gi\|52128426 | 396-436 | 95% |
| Seq ID NO: 46084 | 295-415 | gi\|33139765 | 576-456 | 99% |
| Seq ID NO: 46084 | 479-528 | gi\|33139765 | 454-405 | 100% |
| Seq ID NO: 46084 | 109-149 | gi\|52128426 | 436-396 | 95% |
| Seq ID NO: 58765 | 150-170 | gi\|18081306 | 417-437 | 100% |
| Seq ID NO: 58768 | 2-66 | gi\|7143917 | 219-283 | 90% |
| Seq ID NO: 58912 | 483-676 | gi\|7144233 | 308-501 | 87% |
| Seq ID NO: 58912 | 483-667 | gi\|7144339 | 311-495 | 86% |
| Seq ID NO: 58913 | 201-271 | gi\|52128794 | 102-172 | 90% |
| Seq ID NO: 58913 | 187-272 | gi\|46985091 | 319-234 | 85% |
| Seq ID NO: 58913 | 85-121 | gi\|18080422 | 365-401 | 94% |
| Seq ID NO: 58913 | 249-272 | gi\|46985022 | 259-236 | 100% |
| Seq ID NO: 59048 | 23-135 | gi\|33139660 | 491-603 | 98% |
| Seq ID NO: 59083 | 221-245 | gi\|46987193 | 49-25 | 96% |
| Seq ID NO: 59131 | 1-107 | gi\|18082168 | 3-109 | 94% |
| Seq ID NO: 59131 | 16-108 | gi\|51334509 | 37-129 | 88% |
| Seq ID NO: 59131 | 70-108 | gi\|52129549 | 138-176 | 89% |
| Seq ID NO: 59132 | 1-56 | gi\|7641359 | 475-420 | 91% |
| Seq ID NO: 59132 | 1-59 | gi\|14085900 | 55-113 | 90% |
| Seq ID NO: 59132 | 1-47 | gi\|14086110 | 51-97 | 93% |
| Seq ID NO: 59132 | 1-56 | gi\|15767660 | 65-120 | 89% |
| Seq ID NO: 59132 | 1-56 | gi\|18495580 | 501-446 | 89% |
| Seq ID NO: 59132 | 19-59 | gi\|39747527 | 61-101 | 92% |
| Seq ID NO: 59201 | 21-138 | gi\|28916076 | 1-119 | 91% |
| Seq ID NO: 59201 | 14-41 | gi\|159473 | 34-61 | 100% |
| Seq ID NO: 59201 | 14-41 | gi\|2454547 | 227-200 | 100% |
| Seq ID NO: 59201 | 14-41 | gi\|551594 | 194-221 | 100% |
| Seq ID NO: 59201 | 14-41 | gi\|551595 | 669-696 | 100% |
| Seq ID NO: 59201 | 14-41 | gi\|18032254 | 34-61 | 100% |
| Seq ID NO: 59201 | 18-41 | gi\|18477256 | 279-256 | 100% |
| Seq ID NO: 59201 | 18-41 | gi\|18477260 | 325-302 | 100% |
| Seq ID NO: 59201 | 18-41 | gi\|18477262 | 634-611 | 100% |
| Seq ID NO: 59201 | 14-35 | gi\|18477259 | 22-1 | 100% |
| Seq ID NO: 59201 | 14-35 | gi\|18477261 | 22-1 | 100% |
| Seq ID NO: 59201 | 14-35 | gi\|37780968 | 22-1 | 100% |
| Seq ID NO: 59268 | 131-256 | gi\|33139189 | 152-277 | 99% |
| Seq ID NO: 59268 | 1-56 | gi\|33139189 | 96-151 | 98% |
| Seq ID NO: 59269 | 3-85 | gi\|7143543 | 482-564 | 88% |
| Seq ID NO: 59311 | 1-81 | gi\|7144052 | 441-521 | 90% |
| Seq ID NO: 59484 | 1-118 | gi\|18080802 | 329-209 | 95% |
| Seq ID NO: 59484 | 1-103 | gi\|7144157 | 112-7 | 95% |
| Seq ID NO: 59484 | 1-102 | gi\|18088100 | 105-1 | 95% |
| Seq ID NO: 59484 | 1-96 | gi\|54549688 | 99-1 | 93% |
| Seq ID NO: 59484 | 1-90 | gi\|18089409 | 93-1 | 94% |
| Seq ID NO: 59484 | 1-89 | gi\|18090782 | 92-1 | 94% |
| Seq ID NO: 59484 | 56-118 | gi\|9033884 | 441-503 | 90% |
| Seq ID NO: 59484 | 56-118 | gi\|15768080 | 331-393 | 90% |
| Seq ID NO: 59484 | 56-118 | gi\|39747546 | 344-406 | 90% |
| Seq ID NO: 59484 | 77-118 | gi\|15769768 | 391-432 | 97% |
| Seq ID NO: 59484 | 77-118 | gi\|19383550 | 430-471 | 97% |
| Seq ID NO: 59484 | 77-118 | gi\|39747568 | 271-312 | 97% |
| Seq ID NO: 59484 | 77-112 | gi\|46986671 | 170-135 | 100% |
| Seq ID NO: 59484 | 80-118 | gi\|31326272 | 1-39 | 97% |
| Seq ID NO: 59484 | 77-118 | gi\|159682 | 379-420 | 92% |
| Seq ID NO: 59484 | 77-118 | gi\|15784370 | 177-218 | 92% |
| Seq ID NO: 59530 | 1-129 | gi\|33139697 | 192-63 | 97% |
| Seq ID NO: 59558 | 15-54 | gi\|28916076 | 1-40 | 97% |
| Seq ID NO: 59558 | 8-35 | gi\|159473 | 34-61 | 100% |
| Seq ID NO: 59558 | 8-35 | gi\|2454547 | 227-200 | 100% |
| Seq ID NO: 59558 | 8-35 | gi\|551594 | 194-221 | 100% |
| Seq ID NO: 59558 | 8-35 | gi\|551595 | 669-696 | 100% |
| Seq ID NO: 59558 | 8-35 | gi\|18032254 | 34-61 | 100% |
| Seq ID NO: 59558 | 12-35 | gi\|18477256 | 279-256 | 100% |
| Seq ID NO: 59558 | 12-35 | gi\|18477260 | 325-302 | 100% |
| Seq ID NO: 59558 | 12-35 | gi\|18477262 | 634-611 | 100% |

TABLE 2-continued

Diverse Parasitic Nematode Nucleotide Coding Sequences Matching *H. glycines* vcDNA sequences

| *H. glycines* Sequence[1] | Position[2] | GeneID[3] | Position[4] | % identity[5] |
|---|---|---|---|---|
| Seq ID NO: 59558 | 8-29 | gi\|18477259 | 22-1 | 100% |
| Seq ID NO: 59558 | 8-29 | gi\|18477261 | 22-1 | 100% |
| Seq ID NO: 59558 | 8-29 | gi\|37780968 | 22-1 | 100% |
| Seq ID NO: 59597 | 141-230 | gi\|33139639 | 297-386 | 85% |
| Seq ID NO: 59597 | 141-193 | gi\|33140673 | 140-88 | 90% |
| Seq ID NO: 59652 | 7-89 | gi\|33140014 | 182-264 | 100% |
| Seq ID NO: 59901 | 94-114 | gi\|7798143 | 245-225 | 100% |
| Seq ID NO: 59911 | 1-141 | gi\|2239106 | 1166-1307 | 98% |
| Seq ID NO: 59911 | 1-141 | gi\|37517243 | 1166-1307 | 98% |
| Seq ID NO: 59944 | 178-340 | gi\|33139639 | 257-419 | 89% |
| Seq ID NO: 59944 | 159-310 | gi\|33140673 | 199-48 | 87% |
| Seq ID NO: 60099 | 81-221 | gi\|32324211 | 1-141 | 90% |
| Seq ID NO: 60099 | 92-226 | gi\|33139131 | 116-250 | 89% |
| Seq ID NO: 60099 | 305-349 | gi\|33139131 | 293-337 | 93% |
| Seq ID NO: 60099 | 70-220 | gi\|33140673 | 199-49 | 86% |
| Seq ID NO: 60099 | 89-264 | gi\|33139639 | 257-429 | 84% |
| Seq ID NO: 60155 | 1-67 | gi\|7144157 | 200-134 | 91% |
| Seq ID NO: 60155 | 1-67 | gi\|54549688 | 187-121 | 91% |
| Seq ID NO: 60206 | 46-72 | gi\|159473 | 61-35 | 100% |
| Seq ID NO: 60206 | 46-72 | gi\|2454547 | 200-226 | 100% |
| Seq ID NO: 60206 | 46-72 | gi\|551594 | 221-195 | 100% |
| Seq ID NO: 60206 | 46-72 | gi\|551595 | 696-670 | 100% |
| Seq ID NO: 60206 | 46-72 | gi\|18032254 | 61-35 | 100% |
| Seq ID NO: 60206 | 46-69 | gi\|18477256 | 256-279 | 100% |
| Seq ID NO: 60206 | 46-69 | gi\|18477260 | 302-325 | 100% |
| Seq ID NO: 60206 | 46-69 | gi\|18477262 | 611-634 | 100% |
| Seq ID NO: 60206 | 52-72 | gi\|18477259 | 1-21 | 100% |
| Seq ID NO: 60206 | 52-72 | gi\|18477261 | 1-21 | 100% |
| Seq ID NO: 60206 | 52-72 | gi\|37780968 | 1-21 | 100% |
| Seq ID NO: 60211 | 305-361 | gi\|18081798 | 206-262 | 91% |
| Seq ID NO: 60211 | 305-361 | gi\|54547765 | 204-260 | 89% |
| Seq ID NO: 60211 | 52-77 | gi\|9829211 | 55-80 | 100% |
| Seq ID NO: 60211 | 52-77 | gi\|21652727 | 26-51 | 100% |
| Seq ID NO: 60220 | 1-95 | gi\|33140348 | 161-255 | 96% |
| Seq ID NO: 60378 | 15-74 | gi\|28916076 | 1-60 | 93% |
| Seq ID NO: 60378 | 8-35 | gi\|159473 | 34-61 | 100% |
| Seq ID NO: 60378 | 8-35 | gi\|2454547 | 227-200 | 100% |
| Seq ID NO: 60378 | 8-35 | gi\|551594 | 194-221 | 100% |
| Seq ID NO: 60378 | 8-35 | gi\|551595 | 669-696 | 100% |
| Seq ID NO: 60378 | 8-35 | gi\|18032254 | 34-61 | 100% |
| Seq ID NO: 60378 | 12-35 | gi\|18477256 | 279-256 | 100% |
| Seq ID NO: 60378 | 12-35 | gi\|18477260 | 325-302 | 100% |
| Seq ID NO: 60378 | 12-35 | gi\|18477262 | 634-611 | 100% |
| Seq ID NO: 60378 | 8-29 | gi\|18477259 | 22-1 | 100% |
| Seq ID NO: 60378 | 8-29 | gi\|18477261 | 22-1 | 100% |
| Seq ID NO: 60378 | 8-29 | gi\|37780968 | 22-1 | 100% |
| Seq ID NO: 60409 | 273-620 | gi\|32324347 | 2-350 | 96% |
| Seq ID NO: 60409 | 680-806 | gi\|32324347 | 351-477 | 98% |
| Seq ID NO: 60409 | 680-784 | gi\|33139657 | 351-455 | 98% |
| Seq ID NO: 60409 | 289-615 | gi\|33140241 | 13-338 | 97% |
| Seq ID NO: 60409 | 677-806 | gi\|33140241 | 341-470 | 98% |
| Seq ID NO: 60409 | 272-619 | gi\|33139259 | 1-348 | 95% |
| Seq ID NO: 60409 | 278-620 | gi\|33139000 | 12-355 | 96% |
| Seq ID NO: 60409 | 272-615 | gi\|33139478 | 1-339 | 96% |
| Seq ID NO: 60409 | 268-620 | gi\|32324919 | 1-354 | 95% |
| Seq ID NO: 60409 | 273-609 | gi\|33139390 | 2-339 | 95% |
| Seq ID NO: 60409 | 391-620 | gi\|33140350 | 66-296 | 96% |
| Seq ID NO: 60409 | 273-337 | gi\|33140350 | 2-66 | 93% |
| Seq ID NO: 60409 | 498-615 | gi\|33139683 | 1-118 | 98% |
| Seq ID NO: 60495 | 1-88 | gi\|5107411 | 569-656 | 100% |
| Seq ID NO: 60495 | 1-88 | gi\|16797830 | 379-466 | 100% |
| Seq ID NO: 60495 | 1-88 | gi\|16797831 | 377-464 | 98% |
| Seq ID NO: 60495 | 1-88 | gi\|16797832 | 378-465 | 98% |
| Seq ID NO: 60495 | 1-88 | gi\|31442322 | 377-464 | 98% |
| Seq ID NO: 60495 | 5-88 | gi\|26000760 | 381-464 | 98% |
| Seq ID NO: 60495 | 1-88 | gi\|38096135 | 377-465 | 95% |
| Seq ID NO: 60495 | 12-86 | gi\|31442314 | 392-467 | 93% |
| Seq ID NO: 60495 | 4-86 | gi\|38096138 | 386-468 | 90% |
| Seq ID NO: 60495 | 3-86 | gi\|16797838 | 399-482 | 89% |
| Seq ID NO: 60532 | 243-263 | gi\|46986928 | 44-64 | 100% |
| Seq ID NO: 60533 | 237-257 | gi\|46986928 | 64-44 | 100% |
| Seq ID NO: 60534 | 122-248 | gi\|33139568 | 363-489 | 99% |
| Seq ID NO: 60534 | 1-75 | gi\|33139568 | 293-367 | 98% |
| Seq ID NO: 60596 | 1-99 | gi\|33139131 | 122-220 | 89% |

TABLE 2-continued

Diverse Parasitic Nematode Nucleotide Coding Sequences Matching *H. glycines* vcDNA sequences

| *H. glycines* Sequence[1] | Position[2] | GeneID[3] | Position[4] | % identity[5] |
|---|---|---|---|---|
| Seq ID NO: 60596 | 29-92 | gi\|33140673 | 143-80 | 87% |
| Seq ID NO: 60782 | 367-405 | gi\|54547981 | 61-24 | 94% |
| Seq ID NO: 60782 | 792-812 | gi\|19435901 | 24-4 | 100% |
| Seq ID NO: 60783 | 218-256 | gi\|54547981 | 24-61 | 94% |
| Seq ID NO: 60788 | 36-165 | gi\|28916076 | 140-10 | 92% |
| Seq ID NO: 60644 | 26-217 | gi\|18080216 | 20-211 | 86% |
| Seq ID NO: 60947 | 1-85 | gi\|33140348 | 171-255 | 97% |
| Seq ID NO: 61051 | 73-95 | gi\|39746742 | 647-625 | 100% |
| Seq ID NO: 61179 | 139-160 | gi\|34316675 | 229-208 | 100% |
| Seq ID NO: 61217 | 76-324 | gi\|33139639 | 245-493 | 87% |
| Seq ID NO: 61217 | 71-219 | gi\|33140673 | 197-49 | 89% |
| Seq ID NO: 61217 | 115-219 | gi\|32324211 | 36-140 | 88% |
| Seq ID NO: 61303 | 36-174 | gi\|28916076 | 140-1 | 92% |
| Seq ID NO: 61303 | 154-181 | gi\|159473 | 61-34 | 100% |
| Seq ID NO: 61303 | 154-181 | gi\|2454547 | 200-227 | 100% |
| Seq ID NO: 61303 | 154-181 | gi\|551594 | 221-194 | 100% |
| Seq ID NO: 61303 | 154-181 | gi\|551595 | 696-669 | 100% |
| Seq ID NO: 61303 | 154-181 | gi\|18032254 | 61-34 | 100% |
| Seq ID NO: 61303 | 154-177 | gi\|18477256 | 256-279 | 100% |
| Seq ID NO: 61303 | 154-177 | gi\|18477260 | 302-325 | 100% |
| Seq ID NO: 61303 | 154-177 | gi\|18477262 | 611-634 | 100% |
| Seq ID NO: 61303 | 160-181 | gi\|18477259 | 1-22 | 100% |
| Seq ID NO: 61303 | 160-181 | gi\|18477261 | 1-22 | 100% |
| Seq ID NO: 61303 | 160-181 | gi\|37780968 | 1-22 | 100% |
| Seq ID NO: 61351 | 4-140 | gi\|18080057 | 229-93 | 85% |
| Seq ID NO: 61351 | 4-140 | gi\|54547707 | 233-97 | 84% |
| Seq ID NO: 61352 | 186-312 | gi\|18080057 | 303-429 | 90% |
| Seq ID NO: 61352 | 1-134 | gi\|18080057 | 159-292 | 88% |
| Seq ID NO: 61352 | 1-139 | gi\|54547707 | 163-300 | 88% |
| Seq ID NO: 61352 | 186-312 | gi\|54547707 | 307-433 | 89% |
| Seq ID NO: 61352 | 363-405 | gi\|54547707 | 443-485 | 90% |
| Seq ID NO: 61526 | 29-138 | gi\|28916076 | 9-119 | 91% |
| Seq ID NO: 61553 | 31-90 | gi\|51237572 | 280-339 | 86% |
| Seq ID NO: 46246 | 1-165 | gi\|33139608 | 404-567 | 98% |
| Seq ID NO: 46246 | 1-62 | gi\|32323997 | 404-464 | 98% |
| Seq ID NO: 61561 | 480-500 | gi\|54546754 | 60-40 | 100% |
| Seq ID NO: 61600 | 3-49 | gi\|32324211 | 94-140 | 93% |
| Seq ID NO: 61643 | 680-700 | gi\|23260226 | 280-260 | 100% |
| Seq ID NO: 61686 | 1-73 | gi\|16797830 | 749-821 | 100% |
| Seq ID NO: 61686 | 1-73 | gi\|16797832 | 747-819 | 100% |
| Seq ID NO: 61686 | 1-73 | gi\|26000759 | 745-817 | 100% |
| Seq ID NO: 61686 | 1-73 | gi\|31442320 | 746-818 | 100% |
| Seq ID NO: 61686 | 1-73 | gi\|31442322 | 746-818 | 98% |
| Seq ID NO: 61686 | 8-73 | gi\|21885259 | 776-841 | 98% |
| Seq ID NO: 61688 | 97-117 | gi\|52128725 | 61-81 | 100% |
| Seq ID NO: 61719 | 701-721 | gi\|32185118 | 164-144 | 100% |
| Seq ID NO: 61810 | 13-290 | gi\|33140136 | 39-317 | 85% |
| Seq ID NO: 61937 | 5-25 | gi\|19267937 | 180-160 | 100% |
| Seq ID NO: 61955 | 1-89 | gi\|33139270 | 471-383 | 100% |
| Seq ID NO: 61980 | 1-78 | gi\|33140673 | 126-49 | 92% |
| Seq ID NO: 61980 | 19-84 | gi\|33139131 | 185-250 | 92% |
| Seq ID NO: 61980 | 250-309 | gi\|33139639 | 521-580 | 91% |
| Seq ID NO: 46268 | 777-960 | gi\|33140770 | 55-237 | 99% |
| Seq ID NO: 46268 | 639-695 | gi\|33140770 | 1-57 | 98% |
| Seq ID NO: 62170 | 207-227 | gi\|46422740 | 369-349 | 100% |
| Seq ID NO: 62176 | 200-225 | gi\|30028086 | 358-383 | 100% |
| Seq ID NO: 62176 | 198-218 | gi\|16005270 | 477-497 | 100% |
| Seq ID NO: 46279 | 5-190 | gi\|35504456 | 365-180 | 96% |
| Seq ID NO: 46279 | 63-188 | gi\|7143616 | 133-258 | 91% |
| Seq ID NO: 46279 | 63-188 | gi\|18381740 | 382-507 | 91% |
| Seq ID NO: 46279 | 63-184 | gi\|18381740 | 131-252 | 91% |
| Seq ID NO: 46279 | 76-188 | gi\|18381923 | 603-491 | 92% |
| Seq ID NO: 46279 | 73-188 | gi\|21493480 | 425-310 | 85% |
| Seq ID NO: 62414 | 1-128 | gi\|32323987 | 182-309 | 100% |
| Seq ID NO: 62414 | 173-246 | gi\|32323987 | 309-382 | 100% |
| Seq ID NO: 62414 | 173-222 | gi\|33140527 | 311-360 | 98% |
| Seq ID NO: 62539 | 200-225 | gi\|54547695 | 79-104 | 96% |
| Seq ID NO: 62576 | 170-298 | gi\|33139556 | 85-213 | 94% |
| Seq ID NO: 62576 | 42-126 | gi\|33139556 | 1-85 | 98% |
| Seq ID NO: 46293 | 154-303 | gi\|18080373 | 337-486 | 91% |
| Seq ID NO: 62611 | 1-45 | gi\|33139645 | 197-241 | 97% |
| Seq ID NO: 62636 | 254-285 | gi\|18382597 | 630-661 | 96% |
| Seq ID NO: 46302 | 262-359 | gi\|18381117 | 806-709 | 92% |
| Seq ID NO: 46302 | 262-362 | gi\|7144103 | 148-248 | 91% |

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 46305 | 314-411 | gi|54548221 | 329-232 | 88% |
| Seq ID NO: 62776 | 3-93 | gi|33140348 | 248-158 | 89% |
| Seq ID NO: 62899 | 1-140 | gi|32325217 | 127-267 | 96% |
| Seq ID NO: 62904 | 154-306 | gi|18082113 | 218-370 | 89% |
| Seq ID NO: 62904 | 158-306 | gi|54549200 | 528-380 | 87% |
| Seq ID NO: 62904 | 159-306 | gi|54545591 | 457-310 | 87% |
| Seq ID NO: 62904 | 179-306 | gi|7144024 | 503-377 | 87% |
| Seq ID NO: 62986 | 504-558 | gi|32324842 | 158-212 | 92% |
| Seq ID NO: 63015 | 1-98 | gi|32324253 | 114-17 | 94% |
| Seq ID NO: 63100 | 554-708 | gi|32324459 | 81-235 | 95% |
| Seq ID NO: 63107 | 36-174 | gi|28916076 | 140-1 | 92% |
| Seq ID NO: 63107 | 154-181 | gi|159473 | 61-34 | 100% |
| Seq ID NO: 63107 | 154-181 | gi|2454547 | 200-227 | 100% |
| Seq ID NO: 63107 | 154-181 | gi|551594 | 221-194 | 100% |
| Seq ID NO: 63107 | 154-181 | gi|551595 | 696-669 | 100% |
| Seq ID NO: 63107 | 154-181 | gi|18032254 | 61-34 | 100% |
| Seq ID NO: 63107 | 154-177 | gi|18477256 | 256-279 | 100% |
| Seq ID NO: 63107 | 154-177 | gi|18477260 | 302-325 | 100% |
| Seq ID NO: 63107 | 154-177 | gi|18477262 | 611-634 | 100% |
| Seq ID NO: 63107 | 160-181 | gi|18477259 | 1-22 | 100% |
| Seq ID NO: 63107 | 160-181 | gi|18477261 | 1-22 | 100% |
| Seq ID NO: 63107 | 160-181 | gi|37780968 | 1-22 | 100% |
| Seq ID NO: 63189 | 13-47 | gi|7143962 | 302-269 | 94% |
| Seq ID NO: 63384 | 576-772 | gi|32325427 | 297-493 | 97% |
| Seq ID NO: 63384 | 217-381 | gi|32325427 | 50-214 | 98% |
| Seq ID NO: 63384 | 428-514 | gi|32325427 | 213-299 | 100% |
| Seq ID NO: 63384 | 110-159 | gi|32325427 | 1-50 | 94% |
| Seq ID NO: 63384 | 629-772 | gi|18089917 | 1-144 | 88% |
| Seq ID NO: 63450 | 15-54 | gi|28916076 | 1-40 | 97% |
| Seq ID NO: 63450 | 8-35 | gi|159473 | 34-61 | 100% |
| Seq ID NO: 63450 | 8-35 | gi|2454547 | 227-200 | 100% |
| Seq ID NO: 63450 | 8-35 | gi|551594 | 194-221 | 100% |
| Seq ID NO: 63450 | 8-35 | gi|551595 | 669-696 | 100% |
| Seq ID NO: 63450 | 8-35 | gi|18032254 | 34-61 | 100% |
| Seq ID NO: 63450 | 12-35 | gi|18477256 | 279-256 | 100% |
| Seq ID NO: 63450 | 12-35 | gi|18477260 | 325-302 | 100% |
| Seq ID NO: 63450 | 12-35 | gi|18477262 | 634-611 | 100% |
| Seq ID NO: 63450 | 8-29 | gi|18477259 | 22-1 | 100% |
| Seq ID NO: 63450 | 8-29 | gi|18477261 | 22-1 | 100% |
| Seq ID NO: 63450 | 8-29 | gi|37780968 | 22-1 | 100% |
| Seq ID NO: 63508 | 16-41 | gi|30166029 | 39-64 | 96% |
| Seq ID NO: 63529 | 4-111 | gi|33140348 | 148-255 | 93% |
| Seq ID NO: 46344 | 3-176 | gi|54548367 | 26-199 | 85% |
| Seq ID NO: 46344 | 461-533 | gi|54548367 | 299-371 | 90% |
| Seq ID NO: 63626 | 1-138 | gi|18090776 | 20-157 | 88% |
| Seq ID NO: 46358 | 286-423 | gi|7144085 | 453-591 | 91% |
| Seq ID NO: 63905 | 1-73 | gi|16797830 | 749-821 | 100% |
| Seq ID NO: 63905 | 1-73 | gi|16797832 | 747-819 | 100% |
| Seq ID NO: 63905 | 1-73 | gi|26000759 | 745-817 | 100% |
| Seq ID NO: 63905 | 1-73 | gi|31442320 | 746-818 | 100% |
| Seq ID NO: 63905 | 1-73 | gi|31442322 | 746-818 | 98% |
| Seq ID NO: 63905 | 8-73 | gi|21885259 | 776-841 | 98% |
| Seq ID NO: 63930 | 36-103 | gi|18080500 | 393-460 | 86% |
| Seq ID NO: 64030 | 21-138 | gi|28916076 | 1-119 | 91% |
| Seq ID NO: 64030 | 14-41 | gi|159473 | 34-61 | 100% |
| Seq ID NO: 64030 | 14-41 | gi|2454547 | 227-200 | 100% |
| Seq ID NO: 64030 | 14-41 | gi|551594 | 194-221 | 100% |
| Seq ID NO: 64030 | 14-41 | gi|551595 | 669-696 | 100% |
| Seq ID NO: 64030 | 14-41 | gi|18032254 | 34-61 | 100% |
| Seq ID NO: 64030 | 18-41 | gi|18477256 | 279-256 | 100% |
| Seq ID NO: 64030 | 18-41 | gi|18477260 | 325-302 | 100% |
| Seq ID NO: 64030 | 18-41 | gi|18477262 | 634-611 | 100% |
| Seq ID NO: 64030 | 14-35 | gi|18477259 | 22-1 | 100% |
| Seq ID NO: 64030 | 14-35 | gi|18477261 | 22-1 | 100% |
| Seq ID NO: 64030 | 14-35 | gi|37780968 | 22-1 | 100% |
| Seq ID NO: 64057 | 318-354 | gi|33139730 | 82-119 | 97% |
| Seq ID NO: 64082 | 276-364 | gi|32325034 | 20-108 | 96% |
| Seq ID NO: 64082 | 74-140 | gi|32324889 | 134-68 | 100% |
| Seq ID NO: 64082 | 325-364 | gi|33139589 | 1-40 | 97% |
| Seq ID NO: 64082 | 74-147 | gi|21393259 | 27-100 | 85% |
| Seq ID NO: 64082 | 74-147 | gi|20498904 | 25-98 | 85% |
| Seq ID NO: 64106 | 2-35 | gi|20064584 | 1-34 | 97% |
| Seq ID NO: 64146 | 339-442 | gi|33140237 | 332-229 | 100% |
| Seq ID NO: 64146 | 21-109 | gi|33140237 | 419-331 | 97% |
| Seq ID NO: 64146 | 452-518 | gi|33140237 | 219-153 | 98% |
| Seq ID NO: 64146 | 580-617 | gi|33140237 | 151-114 | 100% |
| Seq ID NO: 64148 | 457-691 | gi|32325211 | 200-434 | 98% |
| Seq ID NO: 64148 | 302-406 | gi|32325211 | 96-200 | 96% |
| Seq ID NO: 64148 | 145-221 | gi|32325211 | 24-99 | 96% |
| Seq ID NO: 64148 | 735-788 | gi|32325211 | 434-487 | 100% |
| Seq ID NO: 64148 | 897-948 | gi|32325211 | 540-591 | 100% |
| Seq ID NO: 64148 | 798-842 | gi|32325211 | 497-541 | 100% |
| Seq ID NO: 64148 | 75-101 | gi|32325211 | 1-27 | 100% |
| Seq ID NO: 64148 | 897-1003 | gi|32324168 | 477-583 | 99% |
| Seq ID NO: 64148 | 186-221 | gi|32324168 | 1-36 | 97% |
| Seq ID NO: 64148 | 457-684 | gi|33139272 | 319-546 | 98% |
| Seq ID NO: 64148 | 1-101 | gi|33139272 | 46-146 | 99% |
| Seq ID NO: 64148 | 897-996 | gi|33139975 | 485-584 | 99% |
| Seq ID NO: 64148 | 178-221 | gi|33139735 | 1-44 | 97% |
| Seq ID NO: 64181 | 21-138 | gi|28916076 | 1-119 | 91% |
| Seq ID NO: 64181 | 14-41 | gi|159473 | 34-61 | 100% |
| Seq ID NO: 64181 | 14-41 | gi|2454547 | 227-200 | 100% |
| Seq ID NO: 64181 | 14-41 | gi|551594 | 194-221 | 100% |
| Seq ID NO: 64181 | 14-41 | gi|551595 | 669-696 | 100% |
| Seq ID NO: 64181 | 14-41 | gi|18032254 | 34-61 | 100% |
| Seq ID NO: 64181 | 18-41 | gi|18477256 | 279-256 | 100% |
| Seq ID NO: 64181 | 18-41 | gi|18477260 | 325-302 | 100% |
| Seq ID NO: 64181 | 18-41 | gi|18477262 | 634-611 | 100% |
| Seq ID NO: 64181 | 14-35 | gi|18477259 | 22-1 | 100% |
| Seq ID NO: 64181 | 14-35 | gi|18477261 | 22-1 | 100% |
| Seq ID NO: 64181 | 14-35 | gi|37780968 | 22-1 | 100% |
| Seq ID NO: 64254 | 169-189 | gi|18083118 | 116-136 | 100% |
| Seq ID NO: 64254 | 169-189 | gi|18382418 | 749-769 | 100% |
| Seq ID NO: 64268 | 399-518 | gi|54546846 | 257-382 | 82% |
| Seq ID NO: 64305 | 240-260 | gi|24467850 | 41-21 | 100% |
| Seq ID NO: 64309 | 148-249 | gi|18088268 | 401-300 | 90% |
| Seq ID NO: 46394 | 286-347 | gi|46987704 | 361-300 | 85% |
| Seq ID NO: 64348 | 295-324 | gi|7922575 | 190-218 | 96% |
| Seq ID NO: 64377 | 645-702 | gi|54544818 | 520-577 | 91% |
| Seq ID NO: 64390 | 83-126 | gi|551594 | 1028-1070 | 93% |
| Seq ID NO: 64390 | 83-126 | gi|551595 | 267-309 | 93% |
| Seq ID NO: 64477 | 21-138 | gi|28916076 | 1-119 | 91% |
| Seq ID NO: 64477 | 14-41 | gi|159473 | 34-61 | 100% |
| Seq ID NO: 64477 | 14-41 | gi|2454547 | 227-200 | 100% |
| Seq ID NO: 64477 | 14-41 | gi|551594 | 194-221 | 100% |
| Seq ID NO: 64477 | 14-41 | gi|551595 | 669-696 | 100% |
| Seq ID NO: 64477 | 14-41 | gi|18032254 | 34-61 | 100% |
| Seq ID NO: 64477 | 18-41 | gi|18477256 | 279-256 | 100% |
| Seq ID NO: 64477 | 18-41 | gi|18477260 | 325-302 | 100% |
| Seq ID NO: 64477 | 18-41 | gi|18477262 | 634-611 | 100% |
| Seq ID NO: 64477 | 14-35 | gi|18477259 | 22-1 | 100% |
| Seq ID NO: 64477 | 14-35 | gi|18477261 | 22-1 | 100% |
| Seq ID NO: 64477 | 14-35 | gi|37780968 | 22-1 | 100% |
| Seq ID NO: 64508 | 27-157 | gi|32324692 | 9-139 | 97% |
| Seq ID NO: 64514 | 52-204 | gi|32324211 | 369-521 | 85% |
| Seq ID NO: 64570 | 21-138 | gi|28916076 | 1-119 | 91% |
| Seq ID NO: 64570 | 14-41 | gi|159473 | 34-61 | 100% |
| Seq ID NO: 64570 | 14-41 | gi|2454547 | 227-200 | 100% |
| Seq ID NO: 64570 | 14-41 | gi|551594 | 194-221 | 100% |
| Seq ID NO: 64570 | 14-41 | gi|551595 | 669-696 | 100% |
| Seq ID NO: 64570 | 14-41 | gi|18032254 | 34-61 | 100% |
| Seq ID NO: 64570 | 18-41 | gi|18477256 | 279-256 | 100% |
| Seq ID NO: 64570 | 18-41 | gi|18477260 | 325-302 | 100% |
| Seq ID NO: 64570 | 18-41 | gi|18477262 | 634-611 | 100% |
| Seq ID NO: 64570 | 14-35 | gi|18477259 | 22-1 | 100% |
| Seq ID NO: 64570 | 14-35 | gi|18477261 | 22-1 | 100% |
| Seq ID NO: 64570 | 14-35 | gi|37780968 | 22-1 | 100% |
| Seq ID NO: 64580 | 33-147 | gi|32325191 | 1-115 | 92% |
| Seq ID NO: 64633 | 2-114 | gi|33140530 | 1-113 | 100% |
| Seq ID NO: 64669 | 300-320 | gi|52129537 | 617-637 | 100% |
| Seq ID NO: 64692 | 1-57 | gi|30028941 | 55-111 | 98% |
| Seq ID NO: 64692 | 1-57 | gi|33140204 | 55-111 | 98% |
| Seq ID NO: 64694 | 95-147 | gi|30028941 | 402-454 | 100% |
| Seq ID NO: 64694 | 1-43 | gi|30028941 | 308-350 | 100% |
| Seq ID NO: 64694 | 95-146 | gi|30029072 | 395-446 | 100% |
| Seq ID NO: 64694 | 95-146 | gi|33140204 | 402-453 | 100% |
| Seq ID NO: 64694 | 1-43 | gi|33140204 | 308-350 | 100% |
| Seq ID NO: 64711 | 1-93 | gi|33139524 | 233-141 | 98% |

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 64760 | 19-144 | gi|54546846 | 257-383 | 84% |
| Seq ID NO: 64762 | 174-194 | gi|9829276 | 404-424 | 100% |
| Seq ID NO: 64762 | 174-194 | gi|39747004 | 520-540 | 100% |
| Seq ID NO: 64780 | 1-118 | gi|33140548 | 49-166 | 95% |
| Seq ID NO: 64780 | 151-225 | gi|33140548 | 199-273 | 100% |
| Seq ID NO: 64797 | 33-77 | gi|54549640 | 11-55 | 93% |
| Seq ID NO: 64847 | 42-190 | gi|33140348 | 108-255 | 92% |
| Seq ID NO: 64847 | 1-70 | gi|33140348 | 105-174 | 92% |
| Seq ID NO: 64847 | 1-28 | gi|32324498 | 17-44 | 96% |
| Seq ID NO: 64862 | 7-144 | gi|7144222 | 169-306 | 92% |
| Seq ID NO: 64862 | 7-144 | gi|54547280 | 139-276 | 92% |
| Seq ID NO: 64862 | 32-149 | gi|51334182 | 168-285 | 88% |
| Seq ID NO: 64862 | 27-146 | gi|21494008 | 204-323 | 86% |
| Seq ID NO: 64874 | 205-293 | gi|18082074 | 129-217 | 83% |
| Seq ID NO: 64931 | 21-41 | gi|46984838 | 273-293 | 100% |
| Seq ID NO: 64935 | 1-84 | gi|16797830 | 749-832 | 98% |
| Seq ID NO: 64935 | 1-84 | gi|16797832 | 747-830 | 98% |
| Seq ID NO: 64935 | 1-84 | gi|26000759 | 745-828 | 98% |
| Seq ID NO: 64935 | 1-84 | gi|31442320 | 746-829 | 98% |
| Seq ID NO: 64935 | 1-84 | gi|31442322 | 746-829 | 97% |
| Seq ID NO: 64935 | 1-77 | gi|16797831 | 747-823 | 98% |
| Seq ID NO: 64935 | 8-84 | gi|21885259 | 776-852 | 97% |
| Seq ID NO: 65078 | 15-54 | gi|28916076 | 1-40 | 97% |
| Seq ID NO: 65084 | 1-166 | gi|35504916 | 448-612 | 94% |
| Seq ID NO: 65084 | 1-85 | gi|35504725 | 448-533 | 94% |
| Seq ID NO: 65205 | 338-610 | gi|33140653 | 131-403 | 100% |
| Seq ID NO: 65205 | 160-291 | gi|33140653 | 1-132 | 97% |
| Seq ID NO: 65205 | 663-717 | gi|33140653 | 401-455 | 100% |
| Seq ID NO: 65205 | 725-746 | gi|33140653 | 463-484 | 100% |
| Seq ID NO: 65205 | 338-462 | gi|32325169 | 130-254 | 100% |
| Seq ID NO: 65205 | 161-291 | gi|32325169 | 1-131 | 97% |
| Seq ID NO: 65205 | 500-610 | gi|32325169 | 254-364 | 100% |
| Seq ID NO: 65205 | 162-291 | gi|33139964 | 1-130 | 98% |
| Seq ID NO: 65261 | 1-243 | gi|33140806 | 9-255 | 95% |
| Seq ID NO: 65261 | 62-234 | gi|33139704 | 24-199 | 95% |
| Seq ID NO: 46445 | 556-665 | gi|33139443 | 1-111 | 95% |
| Seq ID NO: 65328 | 1-145 | gi|18090481 | 97-241 | 85% |
| Seq ID NO: 46452 | 1-163 | gi|7143710 | 57-220 | 89% |
| Seq ID NO: 46452 | 1-171 | gi|54549870 | 42-213 | 89% |
| Seq ID NO: 46452 | 16-163 | gi|18089601 | 5-153 | 90% |
| Seq ID NO: 46452 | 29-163 | gi|54547929 | 1-136 | 90% |
| Seq ID NO: 46452 | 1-171 | gi|51237630 | 23-194 | 85% |
| Seq ID NO: 65377 | 274-524 | gi|33140174 | 121-371 | 98% |
| Seq ID NO: 65377 | 109-229 | gi|33140174 | 1-121 | 99% |
| Seq ID NO: 65377 | 578-680 | gi|33140174 | 372-474 | 100% |
| Seq ID NO: 65377 | 274-527 | gi|32324003 | 302-555 | 98% |
| Seq ID NO: 65377 | 1-229 | gi|32324003 | 74-302 | 97% |
| Seq ID NO: 65377 | 579-621 | gi|32324003 | 554-596 | 97% |
| Seq ID NO: 65377 | 42-229 | gi|32324933 | 13-200 | 97% |
| Seq ID NO: 65377 | 579-680 | gi|32324933 | 452-553 | 99% |
| Seq ID NO: 65397 | 90-152 | gi|18081066 | 414-476 | 90% |
| Seq ID NO: 65474 | 2-53 | gi|28916076 | 52-1 | 94% |
| Seq ID NO: 65474 | 33-59 | gi|159473 | 61-35 | 100% |
| Seq ID NO: 65474 | 33-59 | gi|2454547 | 200-226 | 100% |
| Seq ID NO: 65474 | 33-59 | gi|551594 | 221-195 | 100% |
| Seq ID NO: 65474 | 33-59 | gi|551595 | 696-670 | 100% |
| Seq ID NO: 65474 | 33-59 | gi|18032254 | 61-35 | 100% |
| Seq ID NO: 65474 | 33-56 | gi|18477256 | 256-279 | 100% |
| Seq ID NO: 65474 | 33-56 | gi|18477260 | 302-325 | 100% |
| Seq ID NO: 65474 | 33-56 | gi|18477262 | 611-634 | 100% |
| Seq ID NO: 65474 | 39-59 | gi|18477259 | 1-21 | 100% |
| Seq ID NO: 65474 | 39-59 | gi|18477261 | 1-21 | 100% |
| Seq ID NO: 65474 | 39-59 | gi|37780968 | 1-21 | 100% |
| Seq ID NO: 65553 | 1-63 | gi|33140188 | 109-171 | 98% |
| Seq ID NO: 65553 | 2-50 | gi|33140188 | 305-353 | 90% |
| Seq ID NO: 65558 | 14-173 | gi|18383267 | 801-960 | 86% |
| Seq ID NO: 65560 | 480-623 | gi|35504861 | 212-70 | 97% |
| Seq ID NO: 65572 | 411-582 | gi|33139585 | 153-324 | 94% |
| Seq ID NO: 65572 | 135-258 | gi|33139585 | 1-124 | 96% |
| Seq ID NO: 65591 | 217-309 | gi|32324909 | 25-117 | 93% |
| Seq ID NO: 46459 | 203-386 | gi|18081711 | 111-294 | 86% |
| Seq ID NO: 46459 | 1-35 | gi|54549088 | 64-98 | 94% |
| Seq ID NO: 46459 | 14-35 | gi|54549319 | 1-22 | 100% |
| Seq ID NO: 65643 | 1-194 | gi|33140010 | 238-431 | 96% |
| Seq ID NO: 65643 | 121-194 | gi|33139314 | 1-74 | 97% |
| Seq ID NO: 46465 | 159-238 | gi|9829340 | 394-315 | 87% |
| Seq ID NO: 65738 | 166-205 | gi|33140813 | 1-40 | 95% |
| Seq ID NO: 65755 | 83-126 | gi|551594 | 1028-1070 | 93% |
| Seq ID NO: 65755 | 83-126 | gi|551595 | 267-309 | 93% |
| Seq ID NO: 65813 | 1-121 | gi|28916076 | 122-1 | 91% |
| Seq ID NO: 65813 | 101-126 | gi|159473 | 61-36 | 100% |
| Seq ID NO: 65813 | 101-126 | gi|2454547 | 200-225 | 100% |
| Seq ID NO: 65813 | 101-126 | gi|551594 | 221-196 | 100% |
| Seq ID NO: 65813 | 101-126 | gi|551595 | 696-671 | 100% |
| Seq ID NO: 65813 | 101-126 | gi|18032254 | 61-36 | 100% |
| Seq ID NO: 65813 | 101-124 | gi|18477256 | 256-279 | 100% |
| Seq ID NO: 65813 | 101-124 | gi|18477260 | 302-325 | 100% |
| Seq ID NO: 65813 | 101-124 | gi|18477262 | 611-634 | 100% |
| Seq ID NO: 65831 | 80-203 | gi|33140348 | 128-252 | 92% |
| Seq ID NO: 65932 | 77-335 | gi|33139639 | 245-503 | 87% |
| Seq ID NO: 65932 | 70-225 | gi|33140673 | 199-44 | 88% |
| Seq ID NO: 65932 | 245-349 | gi|32324211 | 165-269 | 86% |
| Seq ID NO: 65932 | 293-327 | gi|33139131 | 293-327 | 94% |
| Seq ID NO: 65966 | 1-215 | gi|33140309 | 306-520 | 97% |
| Seq ID NO: 66029 | 1-143 | gi|16797830 | 62-204 | 98% |
| Seq ID NO: 66029 | 1-143 | gi|16797831 | 62-202 | 97% |
| Seq ID NO: 66029 | 1-143 | gi|16797832 | 63-203 | 97% |
| Seq ID NO: 66029 | 1-143 | gi|26000759 | 62-202 | 96% |
| Seq ID NO: 66029 | 1-142 | gi|26000762 | 62-201 | 95% |
| Seq ID NO: 66029 | 1-143 | gi|31442322 | 62-202 | 95% |
| Seq ID NO: 66029 | 1-143 | gi|38096133 | 62-202 | 93% |
| Seq ID NO: 46479 | 143-293 | gi|18090185 | 96-246 | 90% |
| Seq ID NO: 46479 | 412-474 | gi|18090185 | 320-382 | 92% |
| Seq ID NO: 66115 | 83-126 | gi|551594 | 1028-1070 | 93% |
| Seq ID NO: 66115 | 83-126 | gi|551595 | 267-309 | 93% |
| Seq ID NO: 66138 | 21-168 | gi|54546322 | 121-268 | 87% |
| Seq ID NO: 66223 | 311-331 | gi|32184515 | 225-245 | 100% |
| Seq ID NO: 66245 | 118-139 | gi|54544778 | 203-224 | 100% |
| Seq ID NO: 46493 | 113-266 | gi|33139869 | 326-476 | 92% |
| Seq ID NO: 46493 | 115-269 | gi|18080529 | 142-293 | 90% |
| Seq ID NO: 46493 | 113-240 | gi|32325143 | 467-591 | 91% |
| Seq ID NO: 46493 | 113-229 | gi|33139507 | 467-580 | 92% |
| Seq ID NO: 46493 | 113-236 | gi|33139658 | 467-587 | 91% |
| Seq ID NO: 46493 | 113-217 | gi|33139078 | 467-568 | 91% |
| Seq ID NO: 46493 | 171-286 | gi|7143888 | 280-392 | 89% |
| Seq ID NO: 46493 | 113-216 | gi|33140145 | 467-567 | 91% |
| Seq ID NO: 46493 | 186-269 | gi|18080754 | 174-257 | 92% |
| Seq ID NO: 46493 | 144-269 | gi|52129866 | 585-708 | 86% |
| Seq ID NO: 46493 | 192-286 | gi|18080844 | 1-95 | 89% |
| Seq ID NO: 46493 | 144-254 | gi|52129769 | 700-808 | 87% |
| Seq ID NO: 46493 | 113-190 | gi|32324728 | 467-544 | 92% |
| Seq ID NO: 46493 | 113-204 | gi|33140539 | 467-555 | 90% |
| Seq ID NO: 46493 | 118-239 | gi|19264211 | 454-572 | 82% |
| Seq ID NO: 46493 | 211-245 | gi|22140574 | 144-178 | 97% |
| Seq ID NO: 46493 | 220-254 | gi|52129262 | 3-37 | 94% |
| Seq ID NO: 46493 | 113-182 | gi|15784199 | 440-509 | 84% |
| Seq ID NO: 46493 | 113-148 | gi|15785306 | 458-492 | 91% |
| Seq ID NO: 66327 | 1-81 | gi|35504440 | 192-272 | 95% |
| Seq ID NO: 66372 | 317-509 | gi|54546686 | 284-476 | 85% |
| Seq ID NO: 66372 | 454-509 | gi|33139916 | 1-56 | 100% |
| Seq ID NO: 66454 | 23-43 | gi|21285223 | 168-148 | 100% |
| Seq ID NO: 66513 | 28-80 | gi|54545135 | 100-152 | 96% |
| Seq ID NO: 66513 | 154-198 | gi|54549414 | 410-454 | 93% |
| Seq ID NO: 66513 | 38-80 | gi|54548968 | 1-43 | 95% |
| Seq ID NO: 66611 | 1-107 | gi|33140780 | 433-539 | 98% |
| Seq ID NO: 46522 | 1-101 | gi|18382566 | 65-165 | 89% |
| Seq ID NO: 46522 | 6-101 | gi|18089815 | 1-96 | 88% |
| Seq ID NO: 46522 | 64-98 | gi|21493534 | 40-74 | 91% |
| Seq ID NO: 66645 | 80-246 | gi|32324211 | 1-167 | 86% |
| Seq ID NO: 66645 | 69-219 | gi|33140673 | 199-49 | 83% |
| Seq ID NO: 66645 | 87-219 | gi|33139639 | 256-388 | 83% |
| Seq ID NO: 66691 | 1-141 | gi|16797830 | 62-202 | 98% |
| Seq ID NO: 66691 | 1-141 | gi|16797831 | 62-200 | 97% |
| Seq ID NO: 66691 | 1-141 | gi|16797832 | 63-201 | 97% |
| Seq ID NO: 66691 | 1-141 | gi|26000759 | 62-200 | 96% |
| Seq ID NO: 66691 | 1-141 | gi|31442322 | 62-200 | 95% |
| Seq ID NO: 66691 | 1-141 | gi|38096133 | 62-200 | 93% |
| Seq ID NO: 66692 | 1-160 | gi|5107411 | 189-30 | 100% |

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 66692 | 1-160 | gi|2149587 | 189-30 | 95% |
| Seq TABLE 2-continued Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 69089 | 12-35 | gi|18477262 | 634-611 | 100% |
| Seq ID NO: 69089 | 8-29 | gi|18477259 | 22-1 | 100% |
| Seq ID NO: 69089 | 8-29 | gi|18477261 | 22-1 | 100% |
| Seq ID NO: 69089 | 8-29 | gi|37780968 | 22-1 | 100% |
| Seq ID NO: 69170 | 15-54 | gi|28916076 | 1-40 | 97% |
| Seq ID NO: 69170 | 8-35 | gi|159473 | 34-61 | 100% |
| Seq ID NO: 69170 | 8-35 | gi|2454547 | 227-200 | 100% |
| Seq ID NO: 69170 | 8-35 | gi|551594 | 194-221 | 100% |
| Seq ID NO: 69170 | 8-35 | gi|551595 | 669-696 | 100% |
| Seq ID NO: 69170 | 8-35 | gi|18032254 | 34-61 | 100% |
| Seq ID NO: 69170 | 12-35 | gi|18477256 | 279-256 | 100% |
| Seq ID NO: 69170 | 12-35 | gi|18477260 | 325-302 | 100% |
| Seq ID NO: 69170 | 12-35 | gi|18477262 | 634-611 | 100% |
| Seq ID NO: 69170 | 8-29 | gi|18477259 | 22-1 | 100% |
| Seq ID NO: 69170 | 8-29 | gi|18477261 | 22-1 | 100% |
| Seq ID NO: 69170 | 8-29 | gi|37780968 | 22-1 | 100% |
| Seq ID NO: 69314 | 36-174 | gi|28916076 | 140-1 | 92% |
| Seq ID NO: 69314 | 154-181 | gi|159473 | 61-34 | 100% |
| Seq ID NO: 69314 | 154-181 | gi|2454547 | 200-227 | 100% |
| Seq ID NO: 69314 | 154-181 | gi|551594 | 221-194 | 100% |
| Seq ID NO: 69314 | 154-181 | gi|551595 | 696-669 | 100% |
| Seq ID NO: 69314 | 154-181 | gi|18032254 | 61-34 | 100% |
| Seq ID NO: 69314 | 154-177 | gi|18477256 | 256-279 | 100% |
| Seq ID NO: 69314 | 154-177 | gi|18477260 | 302-325 | 100% |
| Seq ID NO: 69314 | 154-177 | gi|18477262 | 611-634 | 100% |
| Seq ID NO: 69314 | 160-181 | gi|18477259 | 1-22 | 100% |
| Seq ID NO: 69314 | 160-181 | gi|18477261 | 1-22 | 100% |
| Seq ID NO: 69314 | 160-181 | gi|37780968 | 1-22 | 100% |
| Seq ID NO: 69324 | 1-369 | gi|51093880 | 722-352 | 84% |
| Seq ID NO: 69324 | 1-369 | gi|51093884 | 722-352 | 83% |
| Seq ID NO: 69324 | 1-252 | gi|51093883 | 723-469 | 85% |
| Seq ID NO: 69324 | 313-369 | gi|51093883 | 407-352 | 91% |
| Seq ID NO: 69324 | 134-369 | gi|51093882 | 587-352 | 84% |
| Seq ID NO: 69324 | 134-369 | gi|54545658 | 621-387 | 83% |
| Seq ID NO: 69327 | 1-128 | gi|33139874 | 74-201 | 90% |
| Seq ID NO: 69351 | 1-124 | gi|33140792 | 30-153 | 98% |
| Seq ID NO: 69351 | 43-124 | gi|45643642 | 1-82 | 98% |
| Seq ID NO: 69351 | 58-124 | gi|45643646 | 1-67 | 92% |
| Seq ID NO: 46651 | 3-78 | gi|18081363 | 236-310 | 96% |
| Seq ID NO: 46651 | 3-76 | gi|54544882 | 242-315 | 95% |
| Seq ID NO: 69410 | 1-141 | gi|16797830 | 62-202 | 98% |
| Seq ID NO: 69410 | 1-141 | gi|16797831 | 62-200 | 97% |
| Seq ID NO: 69410 | 1-141 | gi|16797832 | 63-201 | 97% |
| Seq ID NO: 69410 | 1-141 | gi|26000759 | 62-200 | 96% |
| Seq ID NO: 69410 | 1-141 | gi|31442322 | 62-200 | 95% |
| Seq ID NO: 69410 | 1-141 | gi|38096133 | 62-200 | 93% |
| Seq ID NO: 69440 | 221-245 | gi|46987193 | 49-25 | 96% |
| Seq ID NO: 69448 | 1-53 | gi|18081057 | 88-140 | 94% |
| Seq ID NO: 69449 | 42-186 | gi|35504946 | 49-193 | 97% |
| Seq ID NO: 69463 | 1-156 | gi|54548643 | 39-188 | 87% |
| Seq ID NO: 69463 | 21-156 | gi|18089480 | 9-138 | 86% |
| Seq ID NO: 69489 | 1-118 | gi|16797830 | 147-264 | 99% |
| Seq ID NO: 69489 | 1-118 | gi|26000761 | 147-262 | 95% |
| Seq ID NO: 69489 | 1-118 | gi|16797832 | 148-263 | 94% |
| Seq ID NO: 69489 | 1-118 | gi|47118286 | 171-286 | 94% |
| Seq ID NO: 69489 | 1-118 | gi|31442322 | 147-262 | 94% |
| Seq ID NO: 69489 | 1-118 | gi|21885259 | 169-284 | 91% |
| Seq ID NO: 69494 | 323-427 | gi|33139639 | 245-349 | 90% |
| Seq ID NO: 69494 | 316-441 | gi|33140673 | 199-74 | 86% |
| Seq ID NO: 69501 | 113-190 | gi|54549674 | 422-500 | 94% |
| Seq ID NO: 69501 | 13-53 | gi|54549674 | 321-361 | 95% |
| Seq ID NO: 69570 | 16-153 | gi|7143498 | 58-196 | 85% |
| Seq ID NO: 69592 | 1-136 | gi|16797830 | 686-821 | 100% |
| Seq ID NO: 69592 | 1-136 | gi|16797832 | 684-819 | 100% |
| Seq ID NO: 69592 | 1-136 | gi|31442320 | 683-818 | 100% |
| Seq ID NO: 69592 | 1-136 | gi|26000759 | 682-817 | 99% |
| Seq ID NO: 69592 | 1-136 | gi|31442322 | 683-818 | 99% |
| Seq ID NO: 69592 | 1-136 | gi|38096133 | 685-820 | 97% |
| Seq ID NO: 69592 | 1-120 | gi|16797846 | 702-824 | 90% |
| Seq ID NO: 69592 | 1-120 | gi|16797847 | 692-814 | 90% |
| Seq ID NO: 69592 | 1-120 | gi|14600264 | 704-826 | 90% |
| Seq ID NO: 69592 | 1-80 | gi|16797841 | 691-769 | 97% |
| Seq ID NO: 69592 | 1-80 | gi|16797843 | 725-803 | 97% |
| Seq ID NO: 69592 | 1-114 | gi|16797848 | 691-807 | 90% |
| Seq ID NO: 69592 | 1-80 | gi|16797849 | 692-770 | 97% |
| Seq ID NO: 69593 | 1-68 | gi|5107411 | 156-89 | 100% |
| Seq ID NO: 69593 | 14-68 | gi|34105813 | 1719-1665 | 100% |
| Seq ID NO: 69593 | 1-51 | gi|2149587 | 156-106 | 100% |
| Seq ID NO: 69593 | 1-48 | gi|2738785 | 157-110 | 100% |
| Seq ID NO: 69593 | 1-48 | gi|2738792 | 157-110 | 100% |
| Seq ID NO: 69593 | 1-48 | gi|2738799 | 157-110 | 100% |
| Seq ID NO: 69593 | 1-48 | gi|2738800 | 157-110 | 100% |
| Seq ID NO: 69593 | 1-54 | gi|2149585 | 156-103 | 96% |
| Seq ID NO: 69593 | 1-47 | gi|31074278 | 1741-1695 | 97% |
| Seq ID NO: 69593 | 1-47 | gi|31074279 | 1741-1695 | 97% |
| Seq ID NO: 69593 | 1-47 | gi|48479719 | 158-112 | 97% |
| Seq ID NO: 69593 | 1-47 | gi|37674501 | 161-115 | 97% |
| Seq ID NO: 69593 | 1-45 | gi|30844179 | 1735-1691 | 97% |
| Seq ID NO: 69716 | 1-121 | gi|28916076 | 122-1 | 91% |
| Seq ID NO: 69716 | 101-128 | gi|159473 | 61-34 | 100% |
| Seq ID NO: 69716 | 101-128 | gi|2454547 | 200-227 | 100% |
| Seq ID NO: 69716 | 101-128 | gi|551594 | 221-194 | 100% |
| Seq ID NO: 69716 | 101-128 | gi|551595 | 696-669 | 100% |
| Seq ID NO: 69716 | 101-128 | gi|18032254 | 61-34 | 100% |
| Seq ID NO: 69716 | 101-124 | gi|18477256 | 256-279 | 100% |
| Seq ID NO: 69716 | 101-124 | gi|18477260 | 302-325 | 100% |
| Seq ID NO: 69716 | 101-124 | gi|18477262 | 611-634 | 100% |
| Seq ID NO: 69716 | 107-128 | gi|18477259 | 1-22 | 100% |
| Seq ID NO: 69716 | 107-128 | gi|18477261 | 1-22 | 100% |
| Seq ID NO: 69716 | 107-128 | gi|37780968 | 1-22 | 100% |
| Seq ID NO: 69747 | 6-258 | gi|51093884 | 252-7 | 91% |
| Seq ID NO: 69747 | 6-258 | gi|18080808 | 295-50 | 89% |
| Seq ID NO: 69747 | 207-258 | gi|18032252 | 2936-2885 | 92% |
| Seq ID NO: 69747 | 219-252 | gi|30049837 | 62-29 | 97% |
| Seq ID NO: 69747 | 219-252 | gi|20064115 | 400-367 | 94% |
| Seq ID NO: 69747 | 219-251 | gi|19267510 | 33-1 | 94% |
| Seq ID NO: 69747 | 219-241 | gi|19268366 | 27-5 | 100% |
| Seq ID NO: 69795 | 145-251 | gi|52129366 | 202-308 | 85% |
| Seq ID NO: 69795 | 50-74 | gi|52129366 | 161-185 | 100% |
| Seq ID NO: 69821 | 1-101 | gi|32324237 | 442-541 | 98% |
| Seq ID NO: 46679 | 448-820 | gi|33139644 | 1-373 | 93% |
| Seq ID NO: 46679 | 1053-1213 | gi|33139644 | 387-546 | 95% |
| Seq ID NO: 69829 | 21-138 | gi|28916076 | 1-119 | 91% |
| Seq ID NO: 69829 | 14-41 | gi|159473 | 34-61 | 100% |
| Seq ID NO: 69829 | 14-41 | gi|2454547 | 227-200 | 100% |
| Seq ID NO: 69829 | 14-41 | gi|551594 | 194-221 | 100% |
| Seq ID NO: 69829 | 14-41 | gi|551595 | 669-696 | 100% |
| Seq ID NO: 69829 | 14-41 | gi|18032254 | 34-61 | 100% |
| Seq ID NO: 69829 | 18-41 | gi|18477256 | 279-256 | 100% |
| Seq ID NO: 69829 | 18-41 | gi|18477260 | 325-302 | 100% |
| Seq ID NO: 69829 | 18-41 | gi|18477262 | 634-611 | 100% |
| Seq ID NO: 69829 | 14-35 | gi|18477259 | 22-1 | 100% |
| Seq ID NO: 69829 | 14-35 | gi|18477261 | 22-1 | 100% |
| Seq ID NO: 69829 | 14-35 | gi|37780968 | 22-1 | 100% |
| Seq ID NO: 69838 | 1-98 | gi|18382603 | 1075-978 | 89% |
| Seq ID NO: 69838 | 25-98 | gi|18382603 | 520-447 | 91% |
| Seq ID NO: 69893 | 21-138 | gi|28916076 | 1-119 | 91% |
| Seq ID NO: 69893 | 14-41 | gi|159473 | 34-61 | 100% |
| Seq ID NO: 69893 | 14-41 | gi|2454547 | 227-200 | 100% |
| Seq ID NO: 69893 | 14-41 | gi|551594 | 194-221 | 100% |
| Seq ID NO: 69893 | 14-41 | gi|551595 | 669-696 | 100% |
| Seq ID NO: 69893 | 14-41 | gi|18032254 | 34-61 | 100% |
| Seq ID NO: 69893 | 18-41 | gi|18477256 | 279-256 | 100% |
| Seq ID NO: 69893 | 18-41 | gi|18477260 | 325-302 | 100% |
| Seq ID NO: 69893 | 18-41 | gi|18477262 | 634-611 | 100% |
| Seq ID NO: 69893 | 14-35 | gi|18477259 | 22-1 | 100% |
| Seq ID NO: 69893 | 14-35 | gi|18477261 | 22-1 | 100% |
| Seq ID NO: 69893 | 14-35 | gi|37780968 | 22-1 | 100% |
| Seq ID NO: 69930 | 1-65 | gi|14280572 | 7058-7122 | 100% |
| Seq ID NO: 69972 | 1-247 | gi|47118286 | 742-988 | 97% |
| Seq ID NO: 69972 | 1-247 | gi|47118285 | 729-975 | 96% |
| Seq ID NO: 69972 | 1-230 | gi|16797830 | 720-950 | 96% |
| Seq ID NO: 69972 | 1-230 | gi|21885260 | 740-969 | 96% |
| Seq ID NO: 69972 | 1-230 | gi|31442322 | 717-946 | 96% |
| Seq ID NO: 69972 | 1-230 | gi|26000759 | 716-945 | 96% |
| Seq ID NO: 69972 | 1-230 | gi|31442320 | 717-946 | 96% |
| Seq ID NO: 69972 | 1-230 | gi|38096133 | 719-948 | 94% |
| Seq ID NO: 69972 | 1-44 | gi|16797827 | 765-807 | 95% |

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 69972 | 142-170 | gi\|16797844 | 862-890 | 96% |
| Seq ID NO: 69972 | 227-247 | gi\|48479719 | 1112-1132 | 100% |
| Seq ID NO: 69978 | 1-157 | gi\|33139812 | 208-364 | 98% |
| Seq ID NO: 69998 | 1-79 | gi\|28916077 | 109-31 | 87% |
| Seq ID NO: 70006 | 213-380 | gi\|33139204 | 1-168 | 98% |
| Seq ID NO: 70006 | 96-177 | gi\|33139204 | 462-542 | 97% |
| Seq ID NO: 70006 | 96-214 | gi\|33139268 | 461-579 | 98% |
| Seq ID NO: 70072 | 1-107 | gi\|18087923 | 4-110 | 87% |
| Seq ID NO: 70072 | 34-68 | gi\|51237696 | 40-74 | 91% |
| Seq ID NO: 70096 | 21-138 | gi\|28916076 | 1-119 | 91% |
| Seq ID NO: 70096 | 14-41 | gi\|159473 | 34-61 | 100% |
| Seq ID NO: 70096 | 14-41 | gi\|2454547 | 227-200 | 100% |
| Seq ID NO: 70096 | 14-41 | gi\|551594 | 194-221 | 100% |
| Seq ID NO: 70096 | 14-41 | gi\|551595 | 669-696 | 100% |
| Seq ID NO: 70096 | 14-41 | gi\|18032254 | 34-61 |

TABLE 2-continued

Diverse Parasitic Nematode Nucleotide Coding Sequences Matching *H. glycines* vcDNA sequences

| *H. glycines* Sequence[1] | Position[2] | GeneID[3] | Position[4] | % identity[5] |
|---|---|---|---|---|
| Seq ID NO: 71227 | 18-127 | gi|31442313 | 354-246 | 85% |
| Seq ID NO: 71249 | 1-138 | gi|33140698 | 375-512 | 97% |
| Seq ID NO: 71249 | 147-190 | gi|33140698 | 521-564 | 97% |
| Seq ID NO: 71288 | 1-134 | gi|16797830 | 935-802 | 97% |
| Seq ID NO: 71288 | 1-134 | gi|26000759 | 931-798 | 97% |
| Seq ID NO: 71288 | 1-134 | gi|31442322 | 932-799 | 97% |
| Seq ID NO: 71288 | 1-134 | gi|16797832 | 933-800 | 96% |
| Seq ID NO: 71288 | 1-134 | gi|47118286 | 957-824 | 96% |
| Seq ID NO: 71288 | 1-122 | gi|26000763 | 930-809 | 97% |
| Seq ID NO: 71288 | 1-133 | gi|16797831 | 933-801 | 95% |
| Seq ID NO: 71288 |

TABLE 2-continued

Diverse Parasitic Nematode Nucleotide Coding Sequences Matching *H. glycines* vcDNA sequences

| H. glycines Sequence[1] |

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 77038 | 17-123 | gi|30844179 | 1550-1444 | 95% |
| Seq ID NO: 77038 | 17-123 | gi|34105807 | 1434-1328 | 95% |
| Seq ID NO: 77038 | 17-123 | gi|34105808 | 1545-1439 | 95% |
| Seq ID NO: 77038 | 17-123 | gi|34105810 | 1561-1455 | 95% |
| Seq ID NO: 77038 | 17-123 | gi|31376322 | 1492-1386 | 94% |
| Seq ID NO: 77038 | 17-123 | gi|31376323 | 1488-1382 | 94% |
| Seq ID NO: 77038 | 17-123 | gi|34105806 | 1558-1452 | 93% |
| Seq ID NO: 77038 | 17-123 | gi|51093982 | 386-280 | 93% |
| Seq ID NO: 77038 | 17-123 | gi|6983959 | 1511-1405 | 92% |
| Seq ID NO: 77038 | 17-123 | gi|22544385 | 274-168 | 92% |
| Seq ID NO: 77038 | 17-123 | gi|30169951 | 41-147 | 92% |
| Seq ID NO: 77038 | 17-123 | gi|31376325 | 1503-1397 | 92% |
| Seq ID NO: 77198 | 308-501 | gi|33140188 | 263-70 | 96% |
| Seq ID NO: 77198 | 302-469 | gi|33140188 | 464-297 | 87% |
| Seq ID NO: 77198 | 4-91 | gi|33140188 | 353-266 | 97% |
| Seq ID NO: 77198 | 1-88 | gi|33140188 | 551-464 | 90% |
| Seq ID NO: 77198 | 389-469 | gi|33140188 | 572-492 | 91% |
|

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 81813 | 664-822 | gi|32323963 | 132-290 | 98% |
| Seq ID NO: 81813 | 877-972 | gi|32323963 | 290-385 | 98% |
| Seq ID NO: 81813 | 877-971 | gi|32325615 | 290-384 | 98% |
| Seq ID NO: 81813 | 427-539 | gi|33139274 | 1-113 | 97% |
| Seq ID NO: 81813 | 429-606 | gi|33140556 | 1-181 | 92% |
| Seq ID NO: 81813 | 666-822 | gi|32324994 | 135-291 | 98% |
| Seq ID NO: 81813 | 428-539 | gi|32324994 | 1-112 | 99% |
| Seq ID NO: 81813 | 877-947 | gi|33139381 | 232-302 | 98% |
| Seq ID NO: 81813 | 487-539 | gi|33139381 | 1-53 | 100% |
| Seq ID NO: 81813 | 427-523 | gi|33140583 | 1-97 | 96% |
| Seq ID NO: 81817 | 452-473 | gi|33952321 | 139-160 | 100% |
| Seq ID NO: 81839 | 16-77 | gi|7143651 | 36-97 | 90% |
| Seq ID NO: 81895 | 515-875 | gi|32325036 | 211-571 | 95% |
| Seq ID NO: 81895 | 472-827 | gi|32325036 | 216-571 | 94% |
| Seq ID NO: 81895 | 563-897 | gi|32325036 | 211-545 | 94% |
| Seq ID NO: 81895 | 514-693 | gi|32325036 | 18-197 | 93% |
| Seq ID NO: 81895 | 482-645 | gi|32325036 | 34-197 | 94% |
| Seq ID NO: 81895 | 610-789 | gi|32325036 | 18-197 | 92% |
| Seq ID NO: 81895 | 562-741 | gi|32325036 | 18-197 | 92% |
| Seq ID NO: 81895 | 658-837 | gi|32325036 | 18-197 | 92% |
| Seq ID NO: 81895 | 706-885 | gi|32325036 | 18-197 | 92% |
| Seq ID NO: 81895 | 754-897 | gi|32325036 | 18-161 | 93% |
| Seq ID NO: 81895 | 472-597 | gi|32325036 | 72-197 | 93% |
| Seq ID NO: 81895 | 48-246 | gi|32325036 | 231-428 | 86% |
| Seq ID NO: 81895 | 1-246 | gi|32325036 | 232-476 | 83% |
| Seq ID NO: 81895 | 137-270 | gi|32325036 | 224-356 | 87% |
| Seq ID NO: 81895 | 48-207 | gi|32325036 | 39-197 | 83% |
| Seq ID NO: 81895 | 138-253 | gi|32325036 | 33-147 | 86% |
| Seq ID NO: 81895 | 1-157 | gi|32325036 | 40-196 | 80% |
| Seq ID NO: 81895 | 470-716 | gi|33140561 | 167-413 | 96% |
| Seq ID NO: 81895 | 520-764 | gi|33140561 | 169-413 | 95% |
| Seq ID NO: 81895 | 568-812 | gi|33140561 | 169-413 | 95% |
| Seq ID NO: 81895 | 616-860 | gi|33140561 | 169-413 | 95% |
| Seq ID NO: 81895 | 664-897 | gi|33140561 | 169-402 | 95% |
| Seq ID NO: 81895 | 457-668 | gi|33140561 | 202-413 | 95% |
| Seq ID NO: 81895 | 1-230 | gi|33140561 | 185-413 | 83% |
| Seq ID NO: 81895 | 691-712 | gi|33140561 | 412-433 | 100% |
| Seq ID NO: 81895 | 835-856 | gi|33140561 | 412-433 | 100% |
| Seq ID NO: 81895 | 547-568 | gi|33140561 | 412-433 | 100% |
| Seq ID NO: 81895 | 787-808 | gi|33140561 | 412-433 | 100% |
| Seq ID NO: 81895 | 643-664 | gi|33140561 | 412-433 | 100% |
| Seq ID NO: 81895 | 739-760 | gi|33140561 | 412-433 | 100% |
| Seq ID NO: 81895 | 595-616 | gi|33140561 | 412-433 | 100% |
| Seq ID NO: 81895 | 499-520 | gi|33140561 | 412-433 | 100% |
| Seq ID NO: 81895 | 534-896 | gi|7143587 | 175-537 | 83% |
| Seq ID NO: 81895 | 486-848 | gi|7143587 | 175-537 | 83% |
| Seq ID NO: 81895 | 484-752 | gi|7143944 | 428-699 | 82% |
| Seq ID NO: 81895 | 724-896 | gi|7143944 | 332-504 | 84% |
| Seq ID NO: 81895 | 630-728 | gi|7143944 | 133-231 | 88% |
| Seq ID NO: 81895 | 582-671 | gi|7143944 | 133-222 | 89% |
| Seq ID NO: 81895 | 534-623 | gi|7143944 | 133-222 | 89% |
| Seq ID NO: 81895 | 774-863 | gi|7143944 | 133-222 | 89% |
| Seq ID NO: 81895 | 486-575 | gi|7143944 | 133-222 | 89% |
| Seq ID NO: 81895 | 822-896 | gi|7143944 | 133-207 | 90% |
| Seq ID NO: 81895 | 678-767 | gi|7143944 | 133-222 | 86% |
| Seq ID NO: 81895 | 470-569 | gi|33139222 | 297-396 | 97% |
| Seq ID NO: 81895 | 520-617 | gi|33139222 | 299-396 | 95% |
| Seq ID NO: 81895 | 760-857 | gi|33139222 | 299-396 | 95% |
| Seq ID NO: 81895 | 616-713 | gi|33139222 | 299-396 | 95% |
| Seq ID NO: 81895 | 568-665 | gi|33139222 | 299-396 | 95% |
| Seq ID NO: 81895 | 712-809 | gi|33139222 | 299-396 | 93% |
| Seq ID NO: 81895 | 664-761 | gi|33139222 | 299-396 | 93% |
| Seq ID NO: 81895 | 808-897 | gi|33139222 | 299-388 | 95% |
| Seq ID NO: 81895 | 457-521 | gi|33139222 | 332-396 | 92% |
| Seq ID NO: 82088 | 73-93 | gi|33140421 | 13-33 | 100% |
| Seq ID NO: 82094 | 18-129 | gi|33139131 | 139-250 | 90% |
| Seq ID NO: 82094 | 31-123 | gi|32324211 | 48-140 | 90% |
| Seq ID NO: 82094 | 1-152 | gi|33139639 | 266-417 | 80% |
| Seq ID NO: 82109 | 19-196 | gi|18087933 | 464-287 | 90% |
| Seq ID NO: 82109 | 19-184 | gi|54547517 | 403-568 | 88% |
| Seq ID NO: 82109 | 19-166 | gi|18081843 | 491-638 | 89% |
| Seq ID NO: 82109 | 19-139 | gi|18083082 | 505-625 | 90% |
| Seq ID NO: 82109 | 66-191 | gi|51334233 | 404-529 | 81% |
| Seq ID NO: 82142 | 1-79 | gi|33140136 | 402-480 | 93% |
| Seq ID NO: 82163 | 122-267 | gi|33139131 | 99-244 | 87% |
| Seq ID NO: 82163 | 128-267 | gi|32324211 | 1-140 | 87% |
| Seq ID NO: 82166 | 2-106 | gi|33139639 | 245-349 | 90% |
| Seq ID NO: 82166 | 1-120 | gi|33140673 | 193-74 | 84% |
| Seq ID NO: 82199 | 66-470 | gi|33140136 | 92-496 | 89% |
| Seq ID NO: 82221 | 1-87 | gi|18090662 | 244-330 | 88% |
| Seq ID NO: 82256 | 59-122 | gi|14280572 | 6490-6553 | 92% |
| Seq ID NO: 82260 | 698-718 | gi|37972243 | 197-217 | 100% |
| Seq ID NO: 82260 | 698-718 | gi|45566049 | 213-233 | 100% |
| Seq ID NO: 47476 | 3-211 | gi|18089811 | 280-488 | 87% |
| Seq ID NO: 47476 | 3-167 | gi|18080518 | 317-481 | 88% |
| Seq ID NO: 82506 | 1-174 | gi|33140348 | 248-75 | 89% |
| Seq ID NO: 82506 | 117-155 | gi|32324498 | 44-5 | 92% |
| Seq ID NO: 82529 | 1-86 | gi|32324692 | 54-139 | 97% |
| Seq ID NO: 82529 | 7-86 | gi|18082298 | 52-131 | 90% |
| Seq ID NO: 82799 | 1-40 | gi|33140348 | 254-215 | 100% |
| Seq ID NO: 82799 | 78-135 | gi|33140348 | 181-123 | 90% |
| Seq ID NO: 82849 | 599-663 | gi|18080145 | 213-277 | 87% |
| Seq ID NO: 82849 | 358-380 | gi|40670113 | 439-417 | 100% |
| Seq ID NO: 82865 | 1-127 | gi|33140348 | 255-128 | 93% |
| Seq ID NO: 82865 | 185-227 | gi|33140348 | 70-27 | 97% |
| Seq ID NO: 82929 | 772-793 | gi|8930759 | 49-28 | 100% |
| Seq ID NO: 82929 | 772-793 | gi|34026216 | 41-20 | 100% |
| Seq ID NO: 82965 | 302-322 | gi|46984484 | 89-109 | 100% |
| Seq ID NO: 83225 | 316-338 | gi|27540675 | 36-58 | 100% |
| Seq ID NO: 83226 | 299-358 | gi|32325383 | 584-525 | 98% |
| Seq ID NO: 83249 | 3-237 | gi|33139581 | 1-235 | 99% |
| Seq ID NO: 83274 | 1-55 | gi|21393574 | 296-350 | 89% |
| Seq ID NO: 83339 | 1-268 | gi|51093880 | 722-452 | 86% |
| Seq ID NO: 83339 | 1-252 | gi|51093883 | 723-469 | 85% |
| Seq ID NO: 83339 | 134-268 | gi|51093882 | 587-452 | 87% |
| Seq ID NO: 83339 | 134-252 | gi|54545658 | 621-503 | 87% |
| Seq ID NO: 83379 | 40-139 | gi|18081804 | 201-300 | 89% |
| Seq ID NO: 83379 | 40-130 | gi|18088266 | 516-606 | 90% |
| Seq ID NO: 83382 | 42-429 | gi|32325123 | 663-276 | 87% |
| Seq ID NO: 83382 | 132-519 | gi|32325123 | 663-276 | 87% |
| Seq ID NO: 83382 | 1-384 | gi|32325123 | 659-276 | 87% |
| Seq ID NO: 83382 | 90-474 | gi|32325123 | 660-276 | 86% |
| Seq ID NO: 83382 | 3-294 | gi|32325123 | 567-276 | 89% |
| Seq ID NO: 83382 | 177-526 | gi|32325123 | 663-314 | 86% |
| Seq ID NO: 83382 | 1-204 | gi|32325123 | 479-276 | 90% |
| Seq ID NO: 83382 | 312-530 | gi|32325123 | 663-445 | 84% |
| Seq ID NO: 83382 | 1-87 | gi|32325123 | 344-258 | 94% |
| Seq ID NO: 83382 | 17-165 | gi|32325123 | 236-84 | 83% |
| Seq ID NO: 83382 | 308-435 | gi|32325123 | 214-84 | 83% |
| Seq ID NO: 83382 | 332-384 | gi|32325123 | 236-183 | 90% |
| Seq ID NO: 83382 | 377-429 | gi|32325123 | 236-183 | 90% |
| Seq ID NO: 83382 | 219-345 | gi|32325123 | 213-84 | 81% |
| Seq ID NO: 83382 | 489-519 | gi|32325123 | 213-183 | 100% |
| Seq ID NO: 83382 | 129-159 | gi|32325123 | 213-183 | 100% |
| Seq ID NO: 83382 | 17-75 | gi|32325123 | 143-84 | 88% |
| Seq ID NO: 83382 | 242-294 | gi|32325123 | 236-183 | 88% |
| Seq ID NO: 83382 | 197-255 | gi|32325123 | 143-84 | 87% |
| Seq ID NO: 83382 | 467-525 | gi|32325123 | 143-84 | 87% |
| Seq ID NO: 83382 | 1-24 | gi|32325123 | 206-183 | 100% |
| Seq ID NO: 83382 | 9-30 | gi|32325123 | 105-84 | 100% |
| Seq ID NO: 83382 | 129-519 | gi|33139983 | 660-271 | 87% |
| Seq ID NO: 83382 | 38-519 | gi|33139983 | 661-178 | 84% |
| Seq ID NO: 83382 | 78-474 | gi|33139983 | 666-271 | 86% |
| Seq ID NO: 83382 | 173-526 | gi|33139983 | 661-309 | 87% |
| Seq ID NO: 83382 | 308-530 | gi|33139983 | 661-440 | 87% |
| Seq ID NO: 83382 | 351-519 | gi|33139983 | 663-495 | 88% |
| Seq ID NO: 83382 | 1-337 | gi|33139983 | 429-87 | 82% |
| Seq ID NO: 83382 | 129-513 | gi|33139225 | 635-252 | 87% |
| Seq ID NO: 83382 | 1-378 | gi|33139225 | 628-252 | 87% |
| Seq ID NO: 83382 | 38-423 | gi|33139225 | 636-252 | 86% |
| Seq ID NO: 83382 | 82-464 | gi|33139225 | 637-256 | 86% |
| Seq ID NO: 83382 | 352-519 | gi|33139225 | 637-470 | 88% |
| Seq ID NO: 83382 | 3-159 | gi|33139225 | 312-153 | 82% |
| Seq ID NO: 83382 | 28-384 | gi|32324170 | 684-328 | 87% |
| Seq ID NO: 83382 | 129-474 | gi|32324170 | 673-328 | 87% |
| Seq ID NO: 83382 | 163-519 | gi|32324170 | 684-328 | 87% |
| Seq ID NO: 83382 | 81-519 | gi|32324170 | 676-235 | 84% |
| Seq ID NO: 83382 | 219-528 | gi|32324170 | 673

TABLE 2-continued

Diverse Parasitic Nematode Nucleotide Coding Sequences Matching *H. glycines* vcDNA sequences

| H. glycines Sequence[1] | Position[2] | GeneID[3] | Position[4] | % identity[5] |
|---|---|---|---|---|
| Seq ID NO: 83382 | 3-439 | gi\|32324170 | 574-132 | 83% |
| Seq ID NO: 83382 | 253-526 | gi\|32324170 | 684-411 | 87% |
| Seq ID NO: 83382 | 1-357 | gi\|32324170 | 486-124 | 82% |
| Seq ID NO: 83382 | 350-530 | gi\|32324170 | 677-497 | 87% |
| Seq ID NO: 83382 | 1-78 | gi\|32324170 | 666-589 | 96% |
| Seq ID NO: 83382 | 433-528 | gi\|32324170 | 684-589 | 90% |
| Seq ID NO: 83382 | 222-519 | gi\|33140346 | 602-302 | 86% |
| Seq ID NO: 83382 | 132-429 | gi\|33140346 | 602-302 | 86% |
| Seq ID NO: 83382 | 42-428 | gi\|33140346 | 602-210 | 83% |
| Seq ID NO: 83382 | 1-338 | gi\|33140346 | 553-210 | 83% |
| Seq ID NO: 83382 | 357-526 | gi\|33140346 | 602-433 | 90% |
| Seq ID NO: 83382 | 17-87 | gi\|33140346 | 168-97 | 91% |
| Seq ID NO: 83382 | 377-439 | gi\|33140346 | 168-105 | 90% |
| Seq ID NO: 83382 | 492-528 | gi\|33140346 | 602-566 | 100% |
| Seq ID NO: 83382 | 467-529 | gi\|33140346 | 168-105 | 89% |
| Seq ID NO: 83382 | 332-394 | gi\|33140346 | 168-105 | 89% |
| Seq ID NO: 83382 | 107-169 | gi\|33140346 | 168-105 | 89% |
| Seq ID NO: 83382 | 197-259 | gi\|33140346 | 168-105 | 89% |
| Seq ID NO: 83382 | 377-434 | gi\|33140346 | 75-17 | 90% |
| Seq ID NO: 83382 | 17-74 | gi\|33140346 | 75-17 | 90% |
| Seq ID NO: 83382 | 1-114 | gi\|33140346 | 418-302 | 82% |
| Seq ID NO: 83382 | 1-34 | gi\|33140346 | 138-105 | 97% |
| Seq ID NO: 83382 | 332-389 | gi\|33140346 | 75-17 | 88% |
| Seq ID NO: 83382 | 107-164 | gi\|33140346 | 75-17 | 88% |
| Seq ID NO: 83382 | 467-524 | gi\|33140346 | 75-17 | 88% |
| Seq ID NO: 83382 | 197-254 | gi\|33140346 | 75-17 | 88% |
| Seq ID NO: 83382 | 1-29 | gi\|33140346 | 45-17 | 96% |
| Seq ID NO: 83382 | 197-384 | gi\|33140426 | 442-254 | 88% |
| Seq ID NO: 83382 | 332-519 | gi\|33140426 | 442-254 | 88% |
| Seq ID NO: 83382 | 287-474 | gi\|33140426 | 442-254 | 87% |
| Seq ID NO: 83382 | 242-429 | gi\|33140426 | 442-254 | 88% |
| Seq ID NO: 83382 | 107-294 | gi\|33140426 | 442-254 | 87% |
| Seq ID NO: 83382 | 1-159 | gi\|33140426 | 412-254 | 89% |
| Seq ID NO: 83382 | 17-204 | gi\|33140426 | 442-254 | 86% |
| Seq ID NO: 83382 | 377-528 | gi\|33140426 | 442-290 | 88% |
| Seq ID NO: 83382 | 62-249 | gi\|33140426 | 442-254 | 86% |
| Seq ID NO: 83382 | 3-87 | gi\|33140426 | 320-236 | 91% |
| Seq ID NO: 83382 | 28-169 | gi\|32325556 | 222-78 | 83% |
| Seq ID NO: 83382 | 298-439 | gi\|32325556 | 222-78 | 82% |
| Seq ID NO: 83382 | 208-357 | gi\|32325556 | 222-70 | 80% |
| Seq ID NO: 83382 | 478-519 | gi\|32325556 | 222-181 | 92% |
| Seq ID NO: 83382 | 17-153 | gi\|32324836 | 149-10 | 83% |
| Seq ID NO: 83382 | 377-513 | gi\|32324836 | 149-10 | 82% |
| Seq ID NO: 83382 | 197-329 | gi\|32324836 | 149-14 | 81% |
| Seq ID NO: 83382 | 107-243 | gi\|32324836 | 149-10 | 81% |
| Seq ID NO: 83382 | 467-519 | gi\|32324836 | 149-97 | 90% |
| Seq ID NO: 83382 | 1-104 | gi\|32324836 | 120-14 | 81% |
| Seq ID NO: 83382 | 38-161 | gi\|33139487 | 219-93 | 83% |
| Seq ID NO: 83382 | 350-384 | gi\|33139487 | 222-188 | 97% |
| Seq ID NO: 83382 | 219-339 | gi\|33139487 | 218-95 | 81% |
| Seq ID NO: 83382 | 398-429 | gi\|33139487 | 219-188 | 96% |
| Seq ID NO: 83382 | 43-153 | gi\|33139115 | 124-11 | 83% |
| Seq ID NO: 83382 | 133-243 | gi\|33139115 | 124-11 | 82% |
| Seq ID NO: 83382 | 403-513 | gi\|33139115 | 124-11 | 82% |
| Seq ID NO: 83382 | 223-329 | gi\|33139115 | 124-15 | 82% |
| Seq ID NO: 83382 | 493-519 | gi\|33139115 | 124-98 | 100% |
| Seq ID NO: 83382 | 358-384 | gi\|33139115 | 124-98 | 100% |
| Seq ID NO: 83407 | 61-104 | gi\|54546446 | 55-98 | 90% |
| Seq ID NO: 83502 | 3-97 | gi\|18090256 | 296-390 | 90% |
| Seq ID NO: 83531 | 1-55 | gi\|33140348 | 201-255 | 98% |
| Seq ID NO: 83556 | 31-110 | gi\|54547037 | 1-80 | 86% |
| Seq ID NO: 83556 | 32-110 | gi\|54547033 | 1-79 | 86% |
| Seq ID NO: 83658 | 281-303 | gi\|33138709 | 165-143 | 100% |
| Seq ID NO: 83658 | 337-357 | gi\|28916076 | 280-260 | 100% |
| Seq ID NO: 83678 | 289-309 | gi\|37853736 | 373-393 | 100% |
| Seq ID NO: 83731 | 1-134 | gi\|32324631 | 49-182 | 94% |
| Seq ID NO: 83731 | 1-107 | gi\|33139363 | 49-152 | 92% |
| Seq ID NO: 83737 | 18-39 | gi\|31326189 | 232-211 | 100% |
| Seq ID NO: 83765 | 226-357 | gi\|7144169 | 364-495 | 87% |
| Seq ID NO: 83765 | 274-335 | gi\|18081294 | 455-516 | 91% |
| Seq ID NO: 83765 | 274-358 | gi\|18089822 | 443-527 | 91% |
| Seq ID NO: 83781 | 408-429 | gi\|17971089 | 242-221 | 100% |
| Seq ID NO: 83828 | 539-605 | gi\|33139668 | 557-491 | 92% |
| Seq ID NO: 83828 | 386-419 | gi\|33139668 | 530-497 | 94% |
| Seq ID NO: 83828 | 347-368 | gi\|33139668 | 530-509 | 100% |
| Seq ID NO: 83828 | 35-56 | gi\|33139668 | 530-509 | 100% |
| Seq ID NO: 83828 | 230-251 | gi\|33139668 | 530-509 | 100% |
| Seq ID NO: 83828 | 566-605 | gi\|33139848 | 530-491 | 97% |
| Seq ID NO: 83855 | 27-51 | gi\|33140021 | 1-25 | 100% |
| Seq ID NO: 47578 | 1-101 | gi\|18382566 | 65-165 | 88% |
| Seq ID NO: 47578 | 7-101 | gi\|18089815 | 2-96 | 88% |
| Seq ID NO: 47578 | 64-98 | gi\|21493534 | 40-74 | 91% |
| Seq ID NO: 84076 | 75-164 | gi\|18081616 | 391-302 | 87% |
| Seq ID NO: 84205 | 295-402 | gi\|18079959 | 358-465 | 82% |
| Seq ID NO: 84241 | 159-179 | gi\|52127565 | 269-249 | 100% |
| Seq ID NO: 84390 | 75-97 | gi\|34028088 | 28-50 | 100% |
| Seq ID NO: 84419 | 109-281 | gi\|33139639 | 255-428 | 88% |
| Seq ID NO: 84419 | 96-242 | gi\|33140673 | 195-49 | 89% |
| Seq ID NO: 84522 | 1-73 | gi\|33140257 | 196-268 | 98% |
| Seq ID NO: 84522 | 44-73 | gi\|32324393 | 1-30 | 100% |
| Seq ID NO: 84576 | 73-112 | gi\|21393592 | 395-434 | 90% |
| Seq ID NO: 84645 | 275-323 | gi\|7143520 | 433-385 | 91% |
| Seq ID NO: 84648 | 6-28 | gi\|35504845 | 119-97 | 100% |
| Seq ID NO: 84664 | 125-168 | gi\|33139131 | 293-336 | 93% |
| Seq ID NO: 84696 | 527-650 | gi\|35504896 | 483-606 | 96% |
| Seq ID NO: 84696 | 1-127 | gi\|35504896 | 213-339 | 96% |
| Seq ID NO: 84696 | 189-267 | gi\|35504896 | 337-415 | 97% |
| Seq ID NO: 84696 | 473-526 | gi\|35504896 | 413-466 | 98% |
| Seq ID NO: 84696 | 40-98 | gi\|7143674 | 296-354 | 93% |
| Seq ID NO: 84696 | 42-98 | gi\|7144456 | 296-352 | 92% |
| Seq ID NO: 84696 | 40-92 | gi\|18382222 | 454-506 | 94% |
| Seq ID NO: 84696 | 40-89 | gi\|18090122 | 491-540 | 94% |
| Seq ID NO: 84696 | 55-92 | gi\|18381283 | 389-426 | 94% |
| Seq ID NO: 84779 | 145-167 | gi\|46985397 | 123-101 | 100% |
| Seq ID NO: 84814 | 20-58 | gi\|28916076 | 1-41 | 92% |
| Seq ID NO: 47631 | 473-497 | gi\|54549558 | 143-167 | 100% |
| Seq ID NO: 84950 | 15-54 | gi\|28916076 | 1-40 | 97% |
| Seq ID NO: 84950 | 8-35 | gi\|159473 | 34-61 | 100% |
| Seq ID NO: 84950 | 8-35 | gi\|2454547 | 227-200 | 100% |
| Seq ID NO: 84950 | 8-35 | gi\|551594 | 194-221 | 100% |
| Seq ID NO: 84950 | 8-35 | gi\|551595 | 669-696 | 100% |
| Seq ID NO: 84950 | 8-35 | gi\|18032254 | 34-61 | 100% |
| Seq ID NO: 84950 | 12-35 | gi\|18477256 | 279-256 | 100% |
| Seq ID NO: 84950 | 12-35 | gi\|18477260 | 325-302 | 100% |
| Seq ID NO: 84950 | 12-35 | gi\|18477262 | 634-611 | 100% |
| Seq ID NO: 84950 | 8-29 | gi\|18477259 | 22-1 | 100% |
| Seq ID NO: 84950 | 8-29 | gi\|18477261 | 22-1 | 100% |
| Seq ID NO: 84950 | 8-29 | gi\|37780968 | 22-1 | 100% |
| Seq ID NO: 84996 | 246-365 | gi\|32324211 | 375-494 | 84% |

Table 2 Legend:
[1]*H. glycines* Clone ID No as set forth in Sequence Listing feature fields; searching the *H. glycines* sequence identifier in column 1 identifies the corresponding SEQ ID NO for that sequence
[2]nucleotide position in SEQ ID NO corresponding to Clone ID No in column 1 that matches with position of sequence of GeneID in adjacent cell on same row of table 2
[3]GeneID number of corresponding matching sequence hit from public database that matches with position of Clone ID No from column 1; derivative organism information is associated with the GeneID No.
[4]nucleotide position in GeneID that matches with nucleotides specified on same row corresponding to sequence of Clone ID SEQ ID NO
[5]percent identity between the two sequences in Clone ID and GeneID Surprisingly the inventors have also discovered that some polynucleotides of the present invention exhibit homology with various insect pests of plants and animals, as illustrated in Table 3. This provides an opportunity to express in plant cells polynucleotides exemplified in Table 3 as double stranded RNA sequences, providing control of many of these insect pests of plants and animals. Mosquitoes, for example, are well known as vectors for spreading malaria, yellow fever, encephalitis, filarial parasites and other serious diseases. Male mosquitoes feed exclusively on plant nectar and on plant cell exudates, and female mosquitoes feed on plants when a blood meal is not available. The present invention therefore provides a means for applying the exemplary sequences as dsRNA molecules expressed in plant cells as a means for controlling nematode and insect pests by expression of sequences identified as representative of common sequences between the two species.

TABLE 3

SCN vcDNA Sequences and Insect Nucleotide Sequence Homologous

| SEQ ID NO[1] | Position[2] | Gene ID[3] | Position[4] | % identity[5] | Genus species[6] |
|---|---|---|---|---|---|
| Seq ID NO: 68821 | 138-159 | CRA\|agCT42044 | 945-966 | 100% | *Anopheles gambiae* |
| Seq ID NO: 79019 | 537-557 | CRA\|agCT43147 | 1437-1457 | 100% | *Anopheles gambiae* |
| Seq ID NO: 47443 | 622-642 | CRA\|agCT43876 | 833-853 | 100% | *Anopheles gambiae* |
| Seq ID NO: 73243 | 46-69 | CRA\|agCT44110 | 215-238 | 100% | *Anopheles gambiae* |
| Seq ID NO: 54820 | 116-136 | CRA\|agCT44330 | 197-177 | 100% | *Anopheles gambiae* |
| Seq ID NO: 65924 | 13-33 | CRA\|agCT44378 | 3440-3460 | 100% | *Anopheles gambiae* |
| Seq ID NO: 53889 | 589-609 | CRA\|agCT44871 | 13437-13457 | 100% | *Anopheles gambiae* |
| Seq ID NO: 66729 | 38-59 | CRA\|agCT45079 | 733-754 | 100% | *Anopheles gambiae* |
| Seq ID NO: 60455 | 259-279 | CRA\|agCT45391 | 1624-1644 | 100% | *Anopheles gambiae* |
| Seq ID NO: 69523 | 121-145 | CRA\|agCT45432 | 192-216 | 96% | *Anopheles gambiae* |
| Seq ID NO: 80670 | 47-67 | CRA\|agCT46846 | 1180-1160 | 100% | *Anopheles gambiae* |
| Seq ID NO: 81791 | 47-69 | CRA\|agCT46968 | 1752-1730 | 100% | *Anopheles gambiae* |
| Seq ID NO: 67053 | 313-339 | CRA\|agCT47874 | 1073-1098 | 96% | *Anopheles gambiae* |
| Seq ID NO: 59568 | 697-718 | CRA\|agCT48203 | 192-171 | 100% | *Anopheles gambiae* |
| Seq ID NO: 72334 | 238-258 | CRA\|agCT49436 | 729-749 | 100% | *Anopheles gambiae* |
| Seq ID NO: 63951 | 103-123 | CRA\|agCT49483 | 652-672 | 100% | *Anopheles gambiae* |
| Seq ID NO: 62555 | 130-150 | CRA\|agCT51096 | 2549-2569 | 100% | *Anopheles gambiae* |
| Seq ID NO: 46459 | 342-364 | CRA\|agCT51427 | 215-237 | 100% | *Anopheles gambiae* |
| Seq ID NO: 66786 | 307-327 | CRA\|agCT52597 | 1900-1920 | 100% | *Anopheles gambiae* |
| Seq ID NO: 68784 | 4-24 | CRA\|agCT55082 | 20600-20620 | 100% | *Anopheles gambiae* |
| Seq ID NO: 53634 | 761-804 | CRA\|agCT55207 | 620-577 | 89% | *Anopheles gambiae* |
| Seq ID NO: 53634 | 754-774 | CRA\|agCT55207 | 597-577 | 100% | *Anopheles gambiae* |
| Seq ID NO: 53635 | 58-101 | CRA\|agCT55207 | 577-620 | 89% | *Anopheles gambiae* |
| Seq ID NO: 53635 | 88-108 | CRA\|agCT55207 | 577-597 | 100% | *Anopheles gambiae* |
| Seq ID NO: 73360 | 270-291 | CRA\|agCT55621 | 744-723 | 100% | *Anopheles gambiae* |
| Seq ID NO: 82401 | 107-127 | CRA\|agCT55677 | 848-868 | 100% | *Anopheles gambiae* |
| Seq ID NO: 55012 | 650-670 | EBI\|221 | 281-261 | 100% | *Anopheles gambiae* |
| Seq ID NO: 78551 | 90-110 | EBI\|2300 | 624-644 | 100% | *Anopheles gambiae* |
| Seq ID NO: 68299 | 84-105 | EBI\|2307 | 2080-2101 | 100% | *Anopheles gambiae* |
| Seq ID NO: 47206 | 84-105 | EBI\|2307 | 2080-2101 | 100% | *Anopheles gambiae* |
| Seq ID NO: 68556 | 241-262 | EBI\|4053 | 3009-3030 | 100% | *Anopheles gambiae* |
| Seq ID NO: 70190 | 174-194 | EBI\|4283 | 5460-5440 | 100% | *Anopheles gambiae* |
| Seq ID NO: 53886 | 405-425 | EBI\|5326 | 2105-2085 | 100% | *Anopheles gambiae* |
| Seq ID NO: 70190 | 243-266 | EBI\|8982 | 1366-1389 | 100% | *Anopheles gambiae* |
| Seq ID NO: 51267 | 164-184 | EBI\|9090 | 121-141 | 100% | *Anopheles gambiae* |
| Seq ID NO: 55175 | 12-41 | gi\|11119314 | 36-7 | 100% | *Andrya cuniculi* |
| Seq ID NO: 66692 | 12-41 | gi\|11119314 | 36-7 | 100% | *Andrya cuniculi* |
| Seq ID NO: 55175 | 12-41 | gi\|11119315 | 36-7 | 100% | *Paranoplocephala* sp. |
| Seq ID NO: 66692 | 12-41 | gi\|11119315 | 36-7 | 100% | *Paranoplocephala* sp. |
| Seq ID NO: 55175 | 12-41 | gi\|11119317 | 36-7 | 100% | *Paranoplocephala arctica* |
| Seq ID NO: 66692 | 12-41 | gi\|11119317 | 36-7 | 100% | *Paranoplocephala arctica* |
| Seq ID NO: 55175 | 12-41 | gi\|11119319 | 36-7 | 100% | *Paranoplocephala serrata* |
| Seq ID NO: 66692 | 12-41 | gi\|11119319 | 36-7 | 100% | *Paranoplocephala serrata* |
| Seq ID NO: 47304 | 674-696 | gi\|23186984 | 477-499 | 100% | *Echinococcus granulosus* |
| Seq ID NO: 77038 | 16-43 | gi\|2463301 | 112-85 | 96% | *Neogryporhynchus cheilancristrotus* |
| Seq ID NO: 59901 | 75-96 | gi\|31365321 | 176-155 | 100% | *Toxoptera citricida* |
| Seq ID NO: 51042 | 482-505 | gi\|31365444 | 320-297 | 100% | *Toxoptera citricida* |
| Seq ID NO: 77354 | 97-117 | gi\|31365580 | 644-664 | 100% | *Toxoptera citricida* |
| Seq ID NO: 82622 | 494-514 | gi\|37804570 | 57-77 | 100% | *Rhopalosiphum padi* |
| Seq ID NO: 66861 | 73-95 | gi\|46996593 | 400-378 | 100% | *Acyrthosiphon pisum* |
| Seq ID NO: 64007 | 76-96 | gi\|46996721 | 468-448 | 100% | *Acyrthosiphon pisum* |
| Seq ID NO: 60081 | 70-96 | gi\|46998065 | 535-562 | 96% | *Acyrthosiphon pisum* |
| Seq ID NO: 54610 | 316-337 | gi\|46998427 | 300-279 | 100% | *Acyrthosiphon pisum* |
| Seq ID NO: 47304 | 674-695 | gi\|47163116 | 387-408 | 100% | *Echinococcus granulosus* |
| Seq ID NO: 62977 | 216-237 | gi\|47514887 | 260-281 | 100% | *Acyrthosiphon pisum* |
| Seq ID NO: 58768 | 293-314 | gi\|47517134 | 76-55 | 100% | *Acyrthosiphon pisum* |
| Seq ID NO: 63826 | 72-92 | gi\|47522032 | 581-561 | 100% | *Acyrthosiphon pisum* |
| Seq ID NO: 82094 | 183-203 | gi\|47533062 | 209-189 | 100% | *Acyrthosiphon pisum* |
| Seq ID NO: 72433 | 558-578 | gi\|47536611 | 364-384 | 100% | *Acyrthosiphon pisum* |
| Seq ID NO: 57774 | 203-223 | gi\|47536768 | 381-401 | 100% | *Acyrthosi TABLE 3-continued SCN vcDNA Sequences and Insect Nucleotide Sequence Homologous

| SEQ ID NO[1] | Position[2] | Gene ID[3] | Position[4] | % identity[5] | Genus species[6] |
|---|---|---|---|---|---|
| Seq ID NO: 66692 | 12-41 | gi\|54306320 | 36-7 | 100% | Moniezia sp. |
| Seq ID NO: 55175 | 12-41 | gi\|54306321 | 36-7 | 100% | Monoecocestus americanus |
| Seq ID NO: 66692 | 12-41 | gi\|54306321 | 36-7 | 100% | Monoecocestus americanus |
| Seq ID NO: 55175 | 12-41 | gi\|54306322 | 36-7 | 100% | Paranoplocephala blanchardi |
| Seq ID NO: 66692 | 12-41 | gi\|54306322 | 36-7 | 100% | Paranoplocephala blanchardi |
| Seq ID NO: 55175 | 12-41 | gi\|54306323 | 36-7 | 100% | Paranoplocephala etholeni |
| Seq ID NO: 66692 | 12-41 | gi\|54306323 | 36-7 | 100% | Paranoplocephala etholeni |
| Seq ID NO: 55175 | 12-41 | gi\|54306324 | 36-7 | 100% | Paranoplocephala fellmani |
| Seq ID NO: 66692 | 12-41 | gi\|54306324 | 36-7 | 100% | Paranoplocephala fellmani |
| Seq ID NO: 55175 | 12-41 | gi\|54306325 | 36-7 | 100% | Paranoplocephala gracilis |
| Seq ID NO: 66692 | 12-41 | gi\|54306325 | 36-7 | 100% | Paranoplocephala gracilis |
| Seq ID NO: 55175 | 12-41 | gi\|54306326 | 36-7 | 100% | Paranoplocephala longivaginata |
| Seq ID NO: 66692 | 12-41 | gi\|54306326 | 36-7 | 100% | Paranoplocephala longivaginata |
| Seq ID NO: 55175 | 12-41 | gi\|54306327 | 36-7 | 100% | Paranoplocephala macrocephala |
| Seq ID NO: 66692 | 12-41 | gi\|54306327 | 36-7 | 100% | Paranoplocephala macrocephala |
| Seq ID NO: 55175 | 12-41 | gi\|54306328 | 36-7 | 100% | Paranoplocephala cf. |
| Seq ID NO: 66692 | 12-41 | gi\|54306328 | 36-7 | 100% | Paranoplocephala cf. |
| Seq ID NO: 55175 | 12-41 | gi\|54306329 | 36-7 | 100% | Paranoplocephala kalelai |
| Seq ID NO: 66692 | 12-41 | gi\|54306329 | 36-7 | 100% | Paranoplocephala kalelai |
| Seq ID NO: 55175 | 12-41 | gi\|54306331 | 36-7 | 100% | Paranoplocephala primordialis |
| Seq ID NO: 66692 | 12-41 | gi\|54306331 | 36-7 | 100% | Paranoplocephala primordialis |
| Seq ID NO: 55175 | 12-41 | gi\|54306332 | 36-7 | 100% | Schizorchis sp. |
| Seq ID NO: 66692 | 12-41 | gi\|54306332 | 36-7 | 100% | Schizorchis sp. |
| Seq ID NO: 60083 | 406-426 | gi\|55794409 | 449-429 | 100% | Acyrthosiphon pisum |
| Seq ID NO: 62688 | 3-23 | gi\|55802365 | 769-789 | 100% | Acyrthosiphon pisum |
| Seq ID NO: 82614 | 269-290 | gi\|55803329 | 472-493 | 100% | Acyrthosiphon pisum |
| Seq ID NO: 54865 | 19-41 | gi\|55806106 | 709-731 | 100% | Acyrthosiphon pisum |
| Seq ID NO: 65500 | 126-146 | gi\|55810448 | 308-328 | 100% | Acyrthosiphon pisum |
| Seq ID NO: 80198 | 225-245 | gi\|55810583 | 245-265 | 100% | Acyrthosiphon pisum |
| Seq ID NO: 51184 | 74-94 | gi\|55814836 | 337-317 | 100% | Acyrthosiphon pisum |
| Seq ID NO: 52762 | 1-36 | gi\|6467344 | 700-665 | 91% | Duplicibothrium paulum |

Table 3 Legend:
[1]H. glycines Clone ID No as set forth in Sequence Listing feature fields; searching the H. glycines sequence identifier in column 1 identifies the corresponding SEQ ID NO for that sequence
[2]nucleotide position in SEQ ID NO corresponding to Clone ID No in column 1 that matches with position of sequence of Gene ID in column 3 on same row
[3]Gene ID number of corresponding matching sequence hit from public database that matches with position of Clone ID No from column 1; information in table is sorted by column 3
[4]Gene ID nucleotide position in column 3 that matches with nucleotides specified on same row corresponding to sequence of SCN Clone ID
[5]percent identity between the two sequences in Clone ID and Gene ID (comparison of identity between column 2 and column 4 sequences)
[6]Genus and species of organism corresponding to gene sequence set forth in Column 3

Example 6

This example illustrates the suppression of one or more genes in a soybean cyst nematode by providing in the diet of the nematode a double stranded RNA consisting of a nucleotide sequence that is complementary to the messenger RNA sequence expressed from the one or more soybean cyst nematode genes.

Soybean cyst nematode J2 larvae are treated with a double stranded RNA derived from a nucleotide sequence selected from the group consisting of SEQ ID NO:1-SEQ ID NO:97729 in a soaking assay as described in WO 03052110. Briefly, freshly hatched nematode larvae are treated in a soaking buffer (10 mM octopamine in M9 salts, 1 mg/ml FITC in DMF) with or without 2 microgram/microliter of dsRNA for four hours at room temperature. Larvae ingesting the solution are fluorescent. The fluorescent larvae are separated from non-fluorescent larvae, then inoculated into soil containing a germinated soybean seedling. The number of cysts on each plant are counted about 35 days after inoculation. The tested dsRNA molecules that demonstrate significant reduction in the number of cysts counted are then made into plant expression cassettes contained in DNA constructs designed for plant cell transformation. DNA constructs generally comprise constitutive promoters that cause transcription of a linked DNA that transcribes a dsRNA. Promoters that may exhibit enhanced expression in root tissue may be particularly useful for expressing dsRNA effective against soybean cyst nematodes.

These DNA constructs are transformed into soybean plant cells and the cells regenerated into plants. The plants are tested either as Ro plants for nematode resistance or seed is collected and the R1 seed is germinated and the R1 plant roots tested for nematode resistance. Resistance is demonstrated if the transgenic plants have a significant reduction in cyst number or cyst development.

Example 7

This example describes DNA constructs and the expression of a chimeric RNA molecule of the present invention in a transgenic soybean plant cell. The DNA constructs described herein comprise a promoter that causes transcription of an operably linked DNA into an RNA in a soybean cell, the DNA and the transcribed RNA of one or more segments exhibiting homology or complementarity to a soybean cyst nematode contiguous at least about 21-mer nucleotide sequence (DNA or RNA). Exemplary soybean cyst nematode DNA segments were previously described in Table 1 and are further identified in the Sequence Listing as SEQ ID NO:1-SEQ ID NO:45568. When expressed in a plant cell, the DNA construct provides an RNA transcript molecule comprising a self-complimentary segment, a portion of which folds into a double stranded RNA (dsRNA). Detection of the RNA transcript expressed in a cell or tissue of a transgenic plant is diagnostic for the DNA construct(s) that comprises a region of a soybean cyst nematode DNA molecule, and demonstrates that the DNA segment from which the dsRNA molecule is derived is transcribed/expressed in the transgenic soybean cells. Therefore, the transcribed RNA becomes available in the diet of the nematode as it feeds on a plant root cell. The RNA comprises a region that is double stranded and is complementary to a naturally occurring polynucleic acid molecule contained in a soybean cyst nematode cell, and when ingested by the nematode results in suppression of the normal level of the naturally occurring molecule.

Exemplary DNA constructs of the present invention have various regulatory elements that provide transcription or enhance expression or stability of an RNA molecule transcribed from a transgene in a plant cell. For example, a promoter element of a DNA construct of the present invention provides expression of an RNA transcript in a plant cell. Promoters, which can cause the transcription of a linked heterologous DNA are generally known in the art, for example, DNA plant virus promoters (P-CaMV35S, U.S. Pat. Nos. 5,352,605 and 5,196,525, comprising a duplicated enhancer region herein referred to as P-e35S; P-FMV35S, U.S. Pat. Nos. 5,378,619 and 5,018,100, herein incorporated by reference in their entirety), and various plant derived promoters, for example, plant actin promoters (P-Os.Act, U.S. Pat. Nos. 5,641,876 and 6,429,357, herein incorporated by reference in their entirety), and chimeric promoters, for example, P-FMV-Elf1α (U.S. Pat. No. 6,660,911 and other chimeric promoters disclosed therein, herein incorporated by reference in their entirety). Additionally, promoters that provide enhanced expression in root cells relative to other plant cells, may be tested and selected to express the RNA molecules of the present invention. The DNA constructs described in this example utilize the P-e35S and P-FMV promoters to drive the transcription of a DNA and expression of a dsRNA that exhibits homology to a portion of a soybean cyst nematode nucleotide sequence. For example, a nucleotide sequence was assembled consisting of two segments, the forward and reverse nucleotide sequence of SEQ ID NO:22219 from nucleotide position 552-699, linked by an amorphous 20-200 nucleotide segment that did not exhibit any known complementarity to the SCN genome sequences. Bioinformatics analysis indicates that the nucleotide sequence of SEQ ID NO:22219 corresponds to an open reading frame encoding an SCN specific proteasome A-type subunit peptide referred to herein as Pas-4. This chimeric sequence was incorporated into plant expression vectors for use in testing dsRNA mediated suppression of the pas-4 target gene. The DNA constructs 5749 (P-FMV/Pas-4-dsRNA/E6 3' UTR) was thus assembled and comprises the necessary transfer molecules and regulatory molecules to provide integration into the genome of plant cells and expression of the dsRNA molecule therein.

The DNA constructs comprise a T-DNA region that is transferred into the genome of a plant cell by an *Agrobacterium*- or *Rhizobium*-mediated plant cell transformation method, and additional regulatory elements, for example, a 3' untranslated region (3' UTR) of the SIE6-3B gene from *Gossypium barbadense*, herein referred to as E6 3' UTR (John Plant Mol Biol 30:297-306, 1996, NCBI accession U30508, nucleotide position from about 992-1304). The DNA construct 5749 (P-FMV/Pas-4-dsRNA/E6 3' UTR) was transferred into *Agrobacterium rhizogenes* strain.

A transgenic root culture of soybean has been shown to support soybean cyst nematode infection and is useful for the expression of transgenes (Narayanan, et al., Crop Sci. 39:1680-1686, 1999 and Cho et al., Planta (2000) 210:195-204). *Agrobacterium rhizogenes* transformed to contain the described DNA construct 5749 was used to transformed soybean cells and create independent transgenic root cultures, referred to herein as events 5749-1, etc. Tissues from the transgenic root cultures were assayed for expression of the chimeric SCN gene suppression RNA molecule. Transgenic root tissues were selected using appropriate selection pressures. Transgenic root tissues from each event were screened for the presence of the fluorescence marker expression that was integrated into and adjacent to the dsRNA expression construct. The transgenic root tissues were also screened for the presence of siRNA segments produced from exposure to the root tissue cells' endogenous DICER molecules. siRNA segments were screened for identity to segments of the corresponding dsRNA coding sequences expressed from the plasmid construct expression cassettes. Methods for detecting the presence of an expressed RNA in a cell are known in the art. For example, in this example, the presence of the 3' UTR was detected using primers that functioned to amplify the UTR sequence from the expressed RNA sequence. A TAQMAN method was then used along with a 3' UTR specific fluorescence probe to detect the UTR as well as provide information on the relative level of expression from the construct. The data is shown in Table 4.

TABLE 4

Levels of Pas-4-dsRNA in Transgenic Soybean Root Cells.

| Event | Ave fluorescense | St Dev | siRNA Northern |
|---|---|---|---|
| Vector control | 0.00 | 0.00 | ND |
| 5749-1 | 2.30 | 1.05 | + |
| 5749-3 | 3.83 | 1.39 | + |
| 5749-4 | 5.47 | 2.44 | + |
| 5749-5 | 3.73 | 0.64 | + |
| 5749-8 | 0.45 | 0.14 | ND |
| 5749-10 | 0.16 | 0.02 | ND |
| 5749-11 | 0.24 | 0.04 | + |
| 5749-12 | 0.33 | 0.17 | ND |
| 5749-A | 3.14 | 0.70 | + |
| 5749-B | 2.91 | 0.27 | + |

ND — not detected

The data in Table 4 indicates that ten events comprising the Pas-4-dsRNA contained detectable levels of the RNA molecule. Northern blot analysis of these events showed detectable levels of siRNA that specifically hybridizes to DNA probes made from a homologous fragment of the Pas-4 coding region. These results demonstrate that soybean cells can be transformed with DNA constructs for expression of dsRNA molecules specific for gene suppression of SCN target genes, and that the transformed plant cells recognize the RNA molecules and dice them into detectable siRNA molecules that may be useful for specific gene suppression of the target gene(s) when provided in the diet of soybean cyst nematodes.

All patent publications cited in this specification are incorporated herein by reference to the same extent as if each individual publication or patent application was specifically and individually indicated to be incorporated by reference.

The Sequence Listing is submitted along with this specification on two compact discs. One disc is labeled 'Sequence Listing' according to 37 CFR §1.52(e)(4), and the other disc is labeled 'CRF' (computer readable form) according to 37 CFR §1.821(e). Each disc contains a single 271,645 kilo-byte text file labeled 'SCN_seqListing.txt', created on Feb. 22, 2005, in IBM-PC format and is compatible with IBM-PC, MS-Windows, Macintosh, and UNIX operating systems. The sequence listing information recorded in computer readable form is identical to the written compact disc sequence listing. The Sequence Listing text file is incorporated herein by reference.

SEQUENCE LISTING (171306 sequences)

SEQ ID NO: 1 - DNA, 1475 bp, Heterodera glycines
tattttatttttattttattttattttggtttattttcttttaatttattttattttaatttattttattttattttattttaatttattttattttatttaaatttaatttattttaatttattttattttatttaaatttaatttattttaattaaatttattttattttattttattttaatttattttaatttattttattttattttattttaatttattttaatttattttattttattttattttattttaatttatttaattttattttattttttattttcagaacaattctgacgttttccagaattttcagaactgttctggtgtgtttcagaattagcagaactattcggacgcttaccagaattttcagaattattctggtctgtaacagaattatcagaattattctgaagcattccggaacaatcagaaaaattctggtgtttaaattgtaaaaattgaatgcaaaaacacaaagtaaaacacaaggcaaaaagttgaaaaaatactcgaaaacacatgctaacatattgaaacacacgtttttgtattgaaaacacacgtgaaatgtttaaaacgcatgcaaacgtgtcgaaaacacacgtaaacctaaagaaaacacgtgaaaaaccggaaccggtttaaagaacgcacgccgaaaacacacgtaaaccggttgaaaacacatgcaaaaacgcaaaatccatccggtcggtcgaaattccggacattccggatgaatttgcaattgtaaacggattgtaaaccggaaggcgaaaacacaaaaaaaatgggcttttttcgacctttgccggggtataactttgttcgaatttgtcgtagagctacgaaatttttttctcacccttcctctcgacgagctctacaaattgttcgcttaccgcaaaagtgtagctcttgcggttcccgagaaataaggtgaaaacacacattttacaacccatttttggccaattgtaaaaagccgggtttttttcgttcgaacgcgattttctcgaaaaaaatgtatcgcgacattttcatccactcggatagatcgctagagaatcgatagctctttcgaatggtaccggtctcggtgctcaactctcgatattcgcttgccgccaaatcgttttatggttagccccccccttatttttatatatagataactaggcgtcccggtagatggctgcgctttatagaaagccgagcctatcccgtcgagttgtagccagtaacggggtagatgcgtcaggttgttagtgcagtagcagctcaggcgcagatgcgtatctggatgttcgtgcagcagcagctaccggaagacagctgagcctagccgttcaccccatgcccgctaagtgacatctaaaagaattgatcaggttcgtattgactcggtacactcgctcgtcgctccgcttcgctcctcgctcgcgcacctctaggggcaggga

SEQ ID NO: 2 - DNA, 19969 bp, Heterodera glycines
aaatattaatatattgtaacagaataaataaatcctgcaaatacaaatattatttgattaataaataaatacacttcttccaaattatatgacattttacaaatattttagtctatttaaataaattgtctataaagtaattttatttatttttattatattatcccagtaaatttgagaagttaaacaaacaaaagaaaaaacgtttgaaattttgcttataataccaaaaaaattataatataaaatatatcaaacgtgaaaaaaggtgtaaagcaaagaataaaaaaataataatttatggatttaaaattaaagctattcaaaagttcataaattagtattaatttttaattacaagaatcacaaaatgaaagaaaaataatgccgaaaatggcaagtaaaaatgatagataataaaagggttcaaaaaatagtttttattattttaaaaaataatgcttagccaatgaatggggaccaacggtgaaagcgaccaagaaaaaatatataaatatactttagaatagaagaaacatttcttttaatgcaaaacttttaattatttataaaagatgcattgcgatcaatttcttattattattttactttaatccttttacccatttattatacaactgtttttaattaaatgatattaaatttgagataatttaaataaattataagacaaaacaaattgaacatgaaaacagtgtagtcataaaccaagactaaaacaaactacgttattttactaattactttctttaaaatttaattgaaaagcacaagctatcatggataaagataaataaaatccattgataaaatgatcattaaaaaagtaatatccaagatataaaaaatgcttttactaataagaacggttaagccttcaatttcaacataatatactcataaataaggaacagtaattttgcaaataacacttctaaaatttaaaattaattacttaattatatgctctgatcagttgtctaaattaatcaattatagaagcaaataacaataattttattaaaaaatcgtatatacatcttcccgcatcgatgcgttggacatcgctagggataagctgataagtgcgagaaaaacgcgataaaaatgattatattcatagcaaaaaacatttctaattttgttgattagataaaattttaacaaaaaacaataatataatttattttttagttaaaataaagaaacattttatttaacagataagaaaagtattgacagaatgattaaaaaaggaactaaaaaaattatatttattaaattttaaatgaacttatttgctaatgtatagcgacagccgaaatgttgccggaacatttcgttcacagcgtttaattaataaaaaattaaattcaaattatctctatcttattaaaaataatatatggcgatgataaaaaaaaggttaaaatagtaaagtaaacatctacgaataaacgccaattaattaaaaaataaatcattaaataaatttataaataaaatcaaatcaaaaaagcataaaaagttgaatctaacaaagcaatatgatattattaattgtattaatatttatactaatacttttttgaaaagtttatttcttttaaatgaatatcaaatgcagatttttaatatttgtaataagtaaattaattttaatattttgataatttgatgaagcagacaatgtttatcgaataatattattatatatataaatcgaaaataatttttaaaaaatcataccgcccctttgtcatgagcagcacgaggggtagaagtgtgaggtgtgcacagtcgcggttgttagtgcagtagcagctcaggcgcagatgcgtggctggatgttcgtgcagcagcagctgccgatagatgtgatacatatttaggatgccgagcctagccgtttattatttttgttccaccaatctttgtagagctcgatttgctacgaagcgagtcccactatataaaaaacacaaaaagttattaaggaaaaagaaaaaatgtatttttaaaattagtggttctttaaaaaaaccgggaatttcaaaaaatttttgctggtacgaattttttccacacgtgccattttgtagagaattgggtctatttttatttactttaattaatataattgttttttaaattatttattttttggccaattttgccatttaattatttttattcagcttttataacacaaatcacaaaaattctgattattcggatcagaactgaataattagaaatattgctggtagtttccgcaacgtttcaggattgttccttaaccggatttattcatgtgcaaaacagtaccggaagcacaactggagttgaaatttaagaattagtcaaaaaccgaattagccgcgtgaaaaaattgcaaaaacttgaaattgttaaaaactttaaggttcggaaaggggtttaaatttgtcgaaatggaactttttttaatttgccttatggggggtcccaaaaaatatatttattttccaattgctttagaatatttttttcaatacttttggctaatttttattgatttaatttatttaaatatttttaaaaatttttaaggttgtaaaatgttgctcatgtggatggaattagttcaaaagtaataaaattatttttagttaatatttgtccggtgcttatgagcagtgtttacattcattcataaaaattttttatattaagatttggaaattaaattcttgtatatgattaagtttttagtttctttttttacaaaattaaaaaaatcgtcaacctggtccacaattattcattgaattctaaaaatttggctatgctttttaataaagcttttcattttaattaagtgatattgaatgtaataaacagataaaaaacaatgaataattaataaaatggaaggaaacagtccgaaaaaatagtgccaattctgagtttctaccaaactgttttgcgaaaaagacgcattccatgacatcgaaaacatggcttgtggcagaatgcaggagccacaataacatccaatttacggagaattattggagctcctgataaaaaaaatagtaaaattaaattttaaaaggttaagattgataaatgtttttagtataaatattgatcaggttaaacaaagtgccatttttgagacctgcaattagcaaacgatgaagtaaaattgttgcgcgtaagttaaactgacgtttggcaaatgtagcagatcaccgctagagtacacttggtcaccgatcgattgagaatatttgaaggtgctaaaaacggatagaaaagtcataaaaacggatgtgcgactgcttttaaaaccgctatattgatagaattttgttaaaaatttattaaatcttttagcttgtaatataatgtcttaagttcgtttaggtaggttaaaaatcttggccttgcatatattttaagatacaattgcttttgttttattatgcatgttctacccatgcatttttaaattcctaaatttaatgattttctccttcttttatcaagcagacaacaatttttaatcctttattttcataatcatgtccttgaatttgaaaattaatgacaaattctgtattgtttcttctgcagcagactcaaaacccaacgtcttattggcgcaactgcagaacgttttgcttatgaattcattgagtagttaattaattaattgagtggcggtggtaaaatgtggacaaactcatattggatattgatcatttttaaattattgtaacaaaaattgctaaagaaattttaaaaggaaaaaatttgctctcaatagaaacattttaaaaaaatcggatactccagacgcacgaataactgaaaaatcatttttcggtgtacatttataaaatgccaagacatatttctcacgttccaagctcggcataactccaaattccaatcgatatgagacggcggttgtgccaacgaataagtacaaattttgccaaagcattggcacactgtgcattcaaagggaaaacaatctgaaggggagggttaaataagtttgctttaatattagaaatgcaaatatttatttgcaagttaaagttaaatttaaatgcaatcctttaggaaattgaatattaacataaattaaaaaagcaaaaaatttatttggaaagtcagttttgttgcacagaaaagaatgataagaataaggattcataaaaatatataaaatatcatttaacagataaaagtgaaaacagaactaatggaaaaattaataaattaaaagatacattaaccggttattttttttaaaaaaggtttaagtaaactaattatttgccaaaaaaaatgtttcacgagactcgagaatttgtacagaaattgagattaagtaccattaaccgaggaattttttgaatttagaccgggaatcttggaaatagcactctctattttgtgtgccaagccgttaaattttatatatgtgttgagcgaacacgaagagaaagcctgtaacagcaacaaaatgtaatatttgagaaacttaattttaaaaaatcaaatttttaaataataaaagtaagtcttcacccgttgaaaataaatataaaaaaaatttttagcaaatttaaaaacatttgaaaaatggaaaaaaggaggaaaattataatcatctaaaaaatcgatttaattggccgaaaatcttcatcaaataaatttttttaaaattacgaattcatctcaattttaaactcaaattgttgccgtttatcacttcaggcaatttcttagtcacttgaagcatatgatgcagtaattatttgaacaatattaaaattttttagttatttcaatgtgagtaaattatgtaaatttaaaaataaaaattatataaaaaatgaatgaccattgctggtgtcgccgttgttgaacactttctcccgtcaaattgtggatggaattcgtccgcaatttgtgtttaatgccgagttggtgccctcagaaaattttacaaaagttgcgccaacatcaaccgtcaaaatgttgagcaaaatgtctgtaaaatgaaaaagtagtccaacggagcatgttattaattttaaaaaatgtaaagaagacgaattttttacaaaaccgtaaacaatacttataggataagttaagaaataacttaaaggaagtgaaagtcttttaaaatgctcctttttatattttgtttgaaattgatgtttgaaacaaattctaaaccccttaaagcatcgcgtcaaaatgggaaaatttaaatcccattttagggtttaacaaatgccaaatatgacaaaatgggattaaataaaggaaaaaacaaaatttagtggggtagcgcaacaaatggtcacaaatttacaacgtttattaaaaatgtgcattcgaaaaataaaacagagcaataaaaaaaagttgcctaccattgcgcaacaccaattttttgcttcttctacaaagtgacggcgtactgaaaaacagggaaaaatttgcaattaaaataaaataggaaaatgcatttgctttctgttttagttaatttaaaatcaaaatgtcagaatcaccgtacttatttaagagaattttgatttatcagccagtaaaatttgcataaaatattagttttaattgataaatttacagtcattcctcattgcactaccttgaatgaccaagcgtatgaaagaattggccaatttaaagctgggaaatggtcacagatatggctgaggcattttgatcaatttggcgccaaaatgatcatttgctcttggataaattagtcagtgtaggcgtttgcatttgacgcctttttttttgttgtggttcagcggcataggcaacggcggaatgtccgagtaatcgcgcacaccgaacggtctcggcaaaatttgagaaatttcctaaaaattaaaaaaaaataaaggctaaaaaaatatttattttatgatatttaaatatatgtaatttaattaaaaagcattaaattttggtgaacaaaaaaagtattcggatttcccttactatattttccggttgtgttttgcaaatataatttattaaccggaaagcacttttttaaatttagtaataacagggaacacattccatttagttgttttccggatagtttaaacggtttaagtaaaacccggaagctgtttaagtacaaaacctaaaaaaatacataaaaaatacaaaacatgtcgtctgttttaaaaataacgcggaaaactccggttaattctaaaataaataaaaaatgctgtaaggaaaattttaaaaaaatcattaattaattattcctgtttttccatcaacaccaatttttcaattttttgattttaatagctgagttgctaaagttaagtggcattgagcgtctgctgttgtaccgtcgattcgccgcctatttttttgaaaaaaaacaaaggggtttaggagtcataatctcgaatatgacatccaatctgagttaattggtttaaagtgtgttggaggctttgacgcattgacctcatgattaggaattttatcaagcataaagacatttgtaattaataaatattttttttttttctttaaattttgatccaaaaagttcaatttaaatgagttcatgttaatagtttgttgctgtagaaaagctataaaagtcacaaattaatgttctcagttttacccaacaatttgggcaatcaattggattaactttgcagcatttgcagcagttttcaaaatcatagtgaaatgttattttagccatttttatagagatttatattgaattccgatgcaaaatttctattgcttaataattagaaaaattttgagtaaaaactaaaaggagaatttcgattaaacaatgaacactttcccaacttcatttgaagacccatccaaggtgggaacagttccaaaatttggtgctatatttatagtgcccaatttataaaaaataattatttgtaggtattcaataaactttttattggactctcaaaacacttttttataaagaaacatttcaaagttttccgtcttcagaatttattcaaaaaagaaataatgcataattaagttagcattgttaagcatttgttaaatttcaaagttgattaaaaaattataaagatgcaaaaaataataagaaattaattaaaggtcagattttaagacggaatacgtatgaagagtaaagaattaattgaaatatgagttaaaataaggcatgcaaaccaacaacaaatgtcaaacaaatgatggatattaacttggttaattaaaagtttaaaaaaatgctgatcgagttaaaaattgattaaatatgaaagaagaaccaacaatcgagtatgaatttgattaattataaaagtataaaaataaagaccgaaaaaagtgattgcgctgaaatgaattaaatataaaaagcaaaaatgatcgatttaatgaaatataaggctgaaaaacaataaaatgtaaaaaaaagcaattttaatttaaaatttttttattttttaataataaaataaccattatatgattaatttattatgctttcatttttttaattttttaagataacaaaaaacattgtttagtccgaaaattttaaattaaataatttttggaggtgtgcgacgagacaaaacaataggacaagctaggccatagccattatgccaaatcaaaataggattttggaccgtgtaggtcgttttttgaatgttcatttgaaaagtccaaaacagctcttcaattgctcgctgtggctttttattttttgggtgatgcaacgtggattccttaaaatttgaaaaaataattaaaatttatttggaacttttagtattaaggcagcaacttttacttatgaaaatctcgaaataattaactaaaatagtgaaaaaacagtgccaaaaatagtgaaaaaaatgcgataaattatatatgctggcataattttcagtcaattaagcaaaaaaaattttcaatctcttaactcaaatttagggtgtaaaaatgacaaaatctgtgcaattaaataacaaaattaagccaaatctgtattgtgattaaattatttttaaaaccaaaaatgtcaacagaataaaatgataaatttttgaaatgaatttttgagaaagtttttcatttttaaagggtgtattttgtaaaatttgtaagtgacagatagtgacactgaaatttaaaaatttaagcgcggaaatacttttttgtgctcatttcttaaattaattttgacaaaattgtttaatcaataaagctccccatatttactattaatccataaaggaaaatttatgaaaagattaatatattcatatattaccattattttcccatttggcaaataataggacactgtttttggccggctctgatcatcccattgaggaagaagtcttttggcatcctcgcgcgacattctgacaatgcttcctggttttgctgatggctcaatccaaatgattgggcgtttgaatgcaatggccaaaataagtgcgcaaaatttgttggagtaatttgattgaaccatttttgtggcatggtcaaaaagagtttctggggctttcacgcaaaggccaaactcaattttctccaaaaacttttctttagattcgcacagttccaaattgacgcctgcagaagcgggatcggagcataagatgtgaatggtttcggcgtaaacggtacgcaaattggcgcaatgcttttcagaacatgcattgtaaaaaaccaaactgagtgaactaaaatgtaatggcttttaatcataaaattcgccaaaaattgtatataaaatcagaaaaaagctcaaacttttaaattcccaaaaaattcatccttaggggggggggggggtgtgtttttaacgttttcatttttctatgaaaatttacaaaaatggccgaaattttttctaaaaatgcaaaatatgaattaattcttaaaactcccaaaatatgcttttatgcactaagaccttcaccaaactgaaaccggtaaaaattttcgtcaaaaatacttccttttttaatttatgctttactctaaattgtaccggtaccggtcttattttagtcaaaattattcatttaattatttaaatggttttcttaatttttaaaatatttcatacagacctgaacaatggatcgtttccgataacatcggtcaataaattggcaaagacaggtttaaaatgttggccatttctttcacaatatttccgctcggcctcaatgagtttcggactcaatggagctgacacacagcaagattggctaaataataataattttttatttctttattttaccaatttaaataaaaacccaattaaatttcattatatttactcggaatggatagaattcggctttgttaatcatgaatcaaattgaatttttaaaacttttgtttttcctctaatttatattttatttaatatgacatcgttattgacaaaatctcttttttctatgtgtttttgaaaaaaaagccgctctaacaaatcaatgcataacaaatcattgaaaagtatatttcataagtataaaaaatttattttttaataattgaatttcattttttatatttttgtcataaaatgtttacattttcaatttacaatttctaaaataaaaaaaaaaattctgtgagaatgttaaaaactcttttctggacggaaaacccattctatattttaaaaattcaattaaattccgtcccgaatttttgctttcaatatttaatattttaattaaatatattttacttatccagcaatacatcatatccttcccaaggattttcgcaatcgaatggacaacaatcttttggttcgggcgtaaacctaaatatttgtccattaagggaattatttttaaatcttattgaaattataaaaccaatacaaaatttataaactatttttaaaaaatcataaaagatagtaaaatgagcttttattttatgcttattcaattttgttttttgaaatttattttttgttgtaaattataactaaacatagaccaaatcattataaaaataaactttaaacttttttaaataaataactgaccagcaagaatagtggaaacgtgttgcgcaacaatatagataaaccgtctttggcattgaaccggtattgtgatcaaatgaaaaaaaattgttgcaaattttgcaataatctgagtagggcttgttgcaaaattggcatcttccatttgtttcccacaatctgtaatcattttctacattaatttccatttaaacccattattttttgcaataaaaattcaaatgtactattgcatattaagcattattatttacattcgatgttgatcagatgtgcataatagagtagcagcagattccttgcaatcacagcgcacatgaagtgttgtgccatttcccaaacccgttctgcatttaacgcactttttgtatgcagcttttcggcaagtcgattttgggcatcgcttaaaccctccatcggcgacccttaaatgttaaaaatataatttacatagcaatagttgatcagggatgagtcttaatgtcgattgttgactttcgattgtcaaactttttgatgaaaatacaattttttggcaatttgttggaaattgacattttcccaaatgatttattttacacaaaaagccactggcccttctttaggacaaaatctgttaacaaattaataaaaattcctcaaatttgccggcagcagtcgcttacagacaaattaacttttttatttgatttaacaaatttaaaatgcctcatttaggactaaatctaatggcaaccaaaaaatctcgaatggtaagtttattgtaaagtgaaaaatattttaataatattttttttgttcaataaaaaaattctctgaaatactgaaatttaaatttctttaaaagaactgatttaattgaataaatttaccaatcataatatggcttttgtgcatgaaaatagtgcccacagtccaatacgccacgttcgtcatttactttcaattgttgagcacaaaaaacgcaaattttttttgcaacaaactgctgagttcgctgatcacgtggctgcttgtttgttgaggctagagatcattctgattagacgaatacgaaaaacaattcataattataaaattttggcgagaccattttggttttaaaaatcattagcattaacgggtgttttaactgtgctactttaaaattttgaaaaaatttgaatattatttaagctaatcggataagtctaatagtcaagaaaaagtcaaattattgggttgtctttctttaaaccattttaattcacagttaattatttcactcacattccgacaaatccataacatttgtgaatttttcaagcaacgacggcattttctcaaaaagtggctgtgagaattccgctaaaatatttttaaaatgtttttgtaatgttttttgattcatacgtgctctcacaattcccaaatcgttgtcatgttcacgagaactgtaaattggctcatcgaaagcggcataatcgtcaaagcaaattgattcgtccgatacgttgccgtccaaaatcccttttccataaggatcaaaggcgggataatcgtcatggcaaaacgattcctcagatgaataatcgaccaaaacgcctcaaaattaattgaaatataaataaagttgttatttatataaattaattgaaatatgaattcaaagcaattaagaattttaaacctctttttaaattaatttattattaaattcaattatttgttggaaaagctgttaaatgcagaattgaagtgatcagccgtttttaatttaatgcattctcaattttaatgttcaatttaaaagttcccaaaacaaaataagtaatatccattttcactttgaagtttaaaattttttaaaattaaatcaattttatgtactattagcctttataattaattttttaattttaagtcaaataattgttttgccttttccatatgaagacgtaggcgtattttttagagttgtgccttaaaacgtgatttttaatattgttgataagcattatttaatattgcttgaatgaattaaattattttaaatacatttttctcgagcatttcgcgctggagaaggactcggagttggctctaagtattataatgtttttttaatttattttttttaaattaattaattcattatacatacttccacggtctgaaaaaaacgtaaaatcgccgcgctcaaagtaattccaccaacgaaaatattgctttctgtgtgtagttgctgacccaaatttttctttcaatttttcaaaagccgaaaatttgtcctcgtcattttcgtgtttctcgaggaaacacaaaagaagaaattggtgctgtttctcattatccattttttttctaaaataaggaaataatttttaaattaaaacgggtagggtaccagcgaattttataaggtgccatttcaccctttttgaccaaaaattggcacaagtatgtttaaaagcaataaaattaattattctttttagccagtaaatttcaaaaaagttacaagaaaaaaaatcataattttttggataatctcctttaaattaattaatttatcaatttagtgcgctaattgaaaatctttattgccaatttttgattcttgaaaaacggcgaaatttatacaaaaaaacaggctaaaaatattcaaaaatggaaattaattatatcatattttttaatatttaattatatttgaaagaaaaataaatattgctcaaatatctttgcctaacagcgacaaaatctctgtggccgcaataatttatgtgtgaaccaaaggatcgttcgattcacatttcatttttgcgttaatgttgctagttgaatttacattttcctcacatcgtaaatgcaaatcaaatttctgcttattgttagagtaaaaaaaagttcaaatattttttattgtgagtataaaaatatttaaaaaatttacaaaaatctttctttataaaattaattgaaattagtggttaattgtataaatgttttcaagtcaaagttcagttttgtgccggttttatgcagaacaattcagagagcattgcaacaaagcgacaaacaactgcagatgttcaacagcaattgaattaaaaaacgcaaaaaagtgaaaaggcaaccgcacaaaaattatgcagattttgttggcgaagagagtcggctactgcaaagacttatttgcttaaaaaattgcaaaaaccattagttatgagtgtaaaattatttaaaaaatagtatttctaatatgaatcataaaaaacagaattattcattacacctttatctgcacgacaggggccgtaaattaattttcttttgttcaaaatttaattttaataaaaaaaattatttattgttagcaaaatgaattaataaatcaacaaaaaatgttaatcttcataatatttcattttttttttgaaaattctctcatgtttttcttttttatttttgttaaccctctcaaactaatttaaaattaatttacaaattttttttcggcagtagttaatatattttttttataaattcttctagcaaattttagccatgcataattttttaaaaaacataaaagtttgaaaacataagtaagttttaaccacctatttattcagttgtttttgcactgattgaaggtatttgcatttatccattcgcggactctgtacgccacagactaattaaaaccttaatagtcaaaaagcagatacaaatcttaaaaaaataaatttgaaaatttaaaaacattttaatatcaatatcgtcaaggtatttaatttttttaagctcaatttttaattataaattttttaaaaataaatgcatttaaaatttttccgcaaaataaactgataattgtgattaacatcgatccgttaaaaaatgctgctcatgtggataaattctaagtaaattattttaagttatattgtcggttgcttctgattgtgagcaatttttaactcattcattcatacaattttttattaggttttggcaataaaattcgtgtacacgattaacctaattaattatagttttttaaatcggcaacgtgatccgcaattacgcattaaagtttcgcaaaatttgactattaattaaaaagaaagtttttcatttttattaagtgctaattgaatgtaataaaatggataaaaagtgaataattaaaaacagagggaaacaaaaactactcggaaaatcagttggtggaatttgttgatttaatttatttacgtttaaacacattttttctggatgtgttttacaatttaatttaataaccggaaaatgcgcactttccggttgtgtttttgttttgaattttatttacttttaaacccaattttttccggttgtgttttacaaatgttagttaataaccggaaaacacttttttgcgtgcattttttaaaggttatatagtaaccggaaagcacttttttaaaatttattaataaccggaacacatttccatttagttttttccggatagtttcaacggtttaagtaaaatgcggaacctgtttaagtacaaaacctaaaaaaaatacatacaaaaatacaaaagcatgccgtcttaggaatttgatcaaacatattgacactttttattccttttaaatctttggcattttgttttttaagcaaacaattttctcctcttttttaaccgtcgatgactgaacttcaaacatttatccttttgcaatttaatagtttttcatgtttcaaaacagggattgcacagaattccgacttcagacattttggggtcgaaattcagatttcaaattgaaaaaatgtgggaatttttttaatgttttctgaattttttgccatatattttttaatttttgtgtatagtttttactttattcacagttattttagttcaatttcaattctttttatttcgttttcgcgcactttcgcaaatggcaaattcgaagcgtgacagagttggtcagaatttattattcttcagccaaatttgtcgataattgtttcattttgttttttctttcagtttctctcacaaaaatgaagaagagccgcgagggcaaacaaaacactttgaaagaagcaagaaaaaaaaatgcattttttgtttgaaaattttaacaaaaattttcagggcagagaatgcgttgagcagtacaaacattatttgtcttctcgacgaagagtttgggctctgcaagactggtggaggttaaaaaattgcatttttggtccataagttttgggattgacaggcataaatgtcaccagggaaattcttgcgcaaaaaagaatttcgacattctctttagcactatttttatatttggtaataaattgaaatttgctaacaatcaatatgagtgatttttgaatggtaaaaaaataatatgaattttcataaatcccttgccccctcctttggaagtgaatttaagtttttaagaaaataacgcaaccatctttaggcaaacgaattgcacaaagtgagcgcactattgttaggtcaaaatggactgatgttcaccaatgcaaaagcaaaaaaagtgcaaaggtcggcggtgaataattccaattttttcgtacatttatttcttttcgtttttggcggggctcagccgtggagtttggcaaatttgcacaagaagaacaggtaggagagtgataccaacccataaacagtgacgtttacgagccatggcaaaacgcccaatttcacccaaccccggacacactgacaaaaagaaattcgaattttttttggggttgaacgcctcataatttgggagtcaattttatgcagccaatatgacttttctatttgcagtttttttgggttttttaactgacaatgagatatggacatttgaaatgagacaaatgccagaaaaaaggaatgatttttgaatgataaaaaaaaataatagtaattttcataaatttcctttcccccccttccccttccaatgtaaatttaatttttttttaaaataacacgtcccattttaggcgaacgcattgcgcaaaatgagcgcactttttagaggccaaaacggactgacgttcaccaatgcgaaagcaaacgaagtgcaaaggtcggcgggggaaaattccaattccttttcgtacatttatttctttctgtttttggtgggggcgcattttggtggaacatttttttaaaggtttctacgaattcgaagcacttcccttttttacatttttgtttgtttttcccgttccaatttttaaaacagaaagtttatcaacttttttctttattttttttcaaattttttaattttccaatttcggcccggcaaatggaatgttttttactcacaaagcgacagaaattttaaaaaaatcctaaagttttgaaggtgttcaattgcaatttgttgctctattttttgcagtttggcgtccaatcgatgccggattttcattttggttggccataccctttctttttcctatttggtcaatccataccaacggtacaccccaaaatacagctgtgacataacactgccgggtctaatttttttaaaaatttatccaaatttttttttcaaaaattccttgaattcatcattaaatttagaaaaaagcacgtgcaatttttttaaaatttattccgggctgtgttttgtcattttccgccataacaggcccgtagcctggttaattcaaaaaaaaactgtttttttaaatcttaagcaattttcttaacaaatgttttaaaatttcataaaaaattgacctgtgggcaccgcacttaaagacactaccggacctccattttacttttttttaaatttagatgcaaaaacgaaaatattttggtgaagaaaagttctttggattcgcccctctgaaattttcttttttctgaccgctggtattaaaaaatttaaaattttctaacgatttttcaaaatttcatcatgaattactaataaatattttttgtaaattattctttcatgcaaatggttggcgaataatttcttctgtcatccatcgtcatgccagatttttaaaatttcctgtatttgtgcgtttcgtaataatgtccttcccttttccctgctatcgacaggtaccattgagcttttggaggagttcactgtgtgcaagacggttgaccaactgtccgcggaccagccccgcattttgaagcagttcggccacctgttggcacaattccgcatccgtctggtcgcctggtaaagcaaaaagaagggatttgaacagattgacggaggagcagatcaattgaatgaataattgatgtgtttttttggttggatcaatccacaatttttcttttttttaaatttttttttaattttaattgatttcatgcgattttaatttaaaattaaacagtttggtggttttttagaccgacttctatttaatattccaccaactttggaccaacaaaatctcaaatttaaggctaaatttctcaaaatctaattgaccaaaagcagaaattgtttattgaacaataagaacaaaaaatataattgttttccggaaaaagtaaaaacatgtttcctgtcttgttacagaaatacacctatttttcggttttgacagaaaagacaattgttttccggttactgtcgaaggttttgaatgtgttgaaatacaatttgttgcagtcaaacatccaatccaatccaccactttattttgttatttttttctaatttaaattggttttatgggattttaatttaaaatttagttgctggtggttttgcaagaccgacttctattcataaaactatggtgtattttgatggttttacgaatacattattcattttcttcaataaattgttcttgtcctcagtagtttctcattaatttcccaatacattataaatgacgattttgattacatacaaaatggtaaatagatagcaaaaattggaaaattgagtttttacggctgatcagtagggggtcggaaaaacatttgatataaattcctgaaatattgcaccaacaaaatctcttatttatggctaaatttgcacgaaatctcttcaaaatcattaaatttcagttaaaagcctacggaatggtaaaatatttaaaattgaaatgcgttttttggtaatagtttagatgctatccccttttttaaaaaaataaattcaacttttaaataagtcataaagaaatgagtgtctttgattttttacagaaagcaactacaatagttttccggtttttgttgccttttaaaggattgtttccggatatgcgaaatctaatgtattttttctgtttttttattcaattaaccaaaagcagaaagtgttttccggtaaatgtaaagtcaaaaacttgaaatgttttccggaacaatagaaatagttttttggaaaagtaaaaatcgcaaacaaaaagtgttttccggaaaagtaaaaaccacaaacagaaagtgttttccggaaaagtaaaaaccacaaacagaaagcgttttccggaaaagtataaaccacaaacaaagagtgtttccggaaaagtaataatcacaaacagaaagcgttttccggaaaagtaaaaaccacaaacagaaagcgttttccggaaaagtaaaaaccacaaacaaaaagtgtttccggaaaagtaataatcacaaacagaaagcgttttccggaaaagtaaaaaccacaaacaaaaagtgttttccggaaaaggaactaaaatatgattaaattcataattttttttgctgtttattaactaaaaagtgttctatttttttaattgacaaaaaaaaatttgtgaaaaaggtttgcatggttgtttaacaaatgttatttaagtgccggaaatgcgcaatttcaggttgtaaatccacattttccggttgtaaatgcatatttaccggttgtgttttacaaattaaatttatgtgccggaaatgcacattttccggttggaaatggacattttccggttgtgttatacaaatgtaatttaagtgccggaaatgcacattttccggttggaaatgcacattttccggttgtgtaacctttattttccggttgtataaagaaaagacaattgttttccggttttgtaacagaaatgacaattgttttccggtttaaaaagaaaagacaattgttttccagtttaataacagtaaatacatttattttccggtttaaaaagaaaggacaattattttcggtttatcaacggtttattaacagaaatgacatttgttttccggtttttaacagaaaatacatttattttccggtttataaagaaaaggcaattgttttccgttttgttaacagaaaatacactattttccgggtttattaacagaaatgacaattgttttccggtttaataacagaaaatacatttaattccggtttataaagaaatgacaatagttttccggtttaataacagaaaatacctttttccggtttataaagaaaagacaattgttttccgttttattaacagaaaatgcatgtattttctggtatataaagaaattaaaattgttttccggtttattaacagaaaaaacatttgttttccggtttaataacagaaaattttattttccggtttataaagtaaaagcaaatgttttccggtttttaaaagaaaatacctttttttcggtttataaagaaattgcaattgttttccggttttgtaacagaaatgacaattgttttccggtttaatagcagcaaaaacatttatttttcgattttgtgggacggggaggcgggtgcggggagg

SEQ ID NO: 3 - DNA, 1181 bp, Heterodera glycines
ccccccccggtgcgccgcccgtaccaggcccgtggagcactcttatgtcgttaaatagctccgtgcactcgcttgctcgcggctcgctacgctcgcaccgctcgctcgctcgcgcacgtcgtgtcgctcgcttcgctcgctcgaatgctatggaaaacacatttaaagttgtcgaaagcgcacgtgaaattgtagaaaacacacgcaaaatgtcgaagccacatgcaaaagcggtatacaaaccgatattaaatacatgcaaaaacacaaagataaaacgtcagtttaaaccgccgttaatgttgggtttaaaccgaaaatacaaaaaaatttggctgaaaacaggctaaaccggtgctggtttagaagaaaatgtgtcgaaaacacatgtaaaccggtcgaaaacacatgcgaaaacacaaaatccatccggtcggtcgaaattccggacattccggatacatttacaattgtaaacggattgtaaaccggaagaggaaaacacaaaaaaaatcggcttttttcgacctttgccggggtataactttgttcgaatttgtcgtagagctacaaaatttttttctcacccttcagctcgacgagctctacaaattgttcgcttaccgcaaaagcgtagctcttacgattcctgagaaataaggtgaaaacacacattttacaacccatttttggccaattgtaaaaagccgggttttttttgttcaaacgcgattttctcgaaaaaaaagtgttgtgacattttacaatccgcggctcaaaatgtgcagaaaagatagagctttcgaatggtaccggtctcgttactcaactctcgatattcgcttgccaacaaacccgaaagcagttagcccccccgttatttttatatatagataactaggcgtcccggtagatggctgcgctttatagaaagccgagcctatcccgtcgagttgtagccagtaacggggtagatgcgtcaggttgttagtgcagtagcagctcaggcgcagatgcgtatctggatgttcgtgcagcagcagctaccggaagacagctgagcctagccgttcaccccatgcccgctaagtgacatctaaaagaattgatcaggttcgtattgactcggtacactcgctcgtcgctccgcttcgctcctcgctcgcgcacctctaggggca

SEQ ID NO: 4 - DNA, 1939 bp, Heterodera glycines
  misc_feature (52)..(52): n is a, c, g, or t
  misc_feature (63)..(63): n is a, c, g, or t
  misc_feature (67)..(67): n is a, c, g, or t
catactagtcgtcgtcgtggcattttttggtcataccattataggtcgtggnattttttagtnatantagtggtggtcctggtattttttggttgtgcgagtcgtcgtcgttgcattttttggttgtgcgagtcgtcgtcgtggcattttttagtcatactagtcgtcgtcgtggcattttttagtcatactagtcgtcgtcgtggcatttttggttgtgcgagtcgtcgtcgtggcattttttagtcatactagtcgtcgtcgtggcattttttagtcatactagtcgtcgtcgtggcattttttagtcatacgagtcgtcgtcgtggcattttttggttgtgcgagtcgtcgtcgtggcattttttagtcatactagtcgtcgtcgtggcattttttggtcatacgagtcgtcgtcgtggcattgtgaagcgattttgtgtgtaaaatgtgaattttttaaaaaacggattttgacttttttgttcgaattccgggttcggggttcgaattgggcgaaaatagatgccggaatcggtttttccgaccctaatcactttggttggattttagaatttttccgttgtccagcactgactatctgtgtataaaagggatgaaacttttcactttatctcataccaaataatttttttcgcgaacaccaccggacatatttaccaaattcttgccgttatgccgctgagcacctccgaatgtattttgttttccgctattctgttcggcatctgcttatttgttagtcatacaattccatttttctgaataacactgtcttcctcttcaggtggtggattattatgccctgactgttgcgacctgttcattcctcttgggaattatggtagttgttatgtaattttcactttagcacaaaatatttcttttttaagttcggtgcactctggccggtgatttgttctactttttacggctctgtcaaaacttcgaagaagaccacttccgcttcaaagcaatcggcatctgccaatgcatctggaactgcgaacaccaaatcatcatctgaccattcctctggcacttccaaagacaagtcggcatctgccaatggatctggagcgaacaccaaatcgtcatctgaccattcctctggcacttccaaagacaagtcggcatctgccaaggcatctggagcgaacaccaaatcgtcatctgaccattcctctggcacttccaaagacaagtcggcatctgccactgccgcgggcacttccaatgacaattcgtcttccatggcaaaatcggattacgttgaacgccagaaggaccgctccagccgcgtatgtttactcactataccttaaacaaaaatacgcatttctttttttagtgcggtgagcagcagaagaaaaagtgatggaagaaaagaagaagcggatagaagcaacaaagatgtcgtctgattaagtgtatggaaatgaatattattgtatttgagaaatgatcgatctcaattgttgtgcttattttctctcagaaatgcttgttaattcattccttctataatatacatactcatttatttttctcgattttttttgttggccaattggtttaggataattgaaagattgtctaaagaatttggtagtagttaaagtggttccccccccccccaaaaaaaaattcccatgacatacataagagacaattaatttatttatttgcttgcttttatgtggtcccttttttcgtttcctcctcctcatttcattcgttctccctaaatttttctcattttgttgctgcacttttctgctgttggtcgattgggccatcactctttgggttattttttggccatgtcaaaaaacgacgacgcccccaacaaaaaaaaaatgtaaaaattcaacaaaaaattttaaatattttcttcaatttttcagctttatctgcg

SEQ ID NO: 5 - DNA, 3888 bp, Heterodera glycines
ttttaatatttcttcaatttttcagctttatctgcgccgattgttggcttttggtgtttgattttcttacgccttcccaatttggccccgaaattgcattgatcaaccgctgctttgacatttacgtggacgaacatttcaagacacgcaaatggaaattgggcgaaattcgaatttgctacaaaattgaagaaaatggcactaagcaaatgcatattcacaatgccgatgcaaatccattgccaatccccaaaatccgtttccgaacaaaatcatcggattcagacacatcaaaagcatgtaaagattgattaatttgcaatttttcgtcttaatttctgcttttcagttacatcgatcaaaatgtcatcgcatttctccgccgttttcaccgttgtattttcgccgtttgtttaacggatttgttcattttcacgggcaatgttagccttttggacaacatttggccaatgttccgcaattctatgtgtgcgatgattttgaataccatcgcttttcgtcgtttgcgtcaattggccccgtcacttctcaacgattgttcattcaattgaaccacaaaaatggaccgacggtaagaaaggatttaaaaaattgcaagttttcatttacccaattttcttatgtttcagttggatttgtggcgacgtgtggatggacattctcccatcttttgaccatgctcaactcggactcaaaatggcattgctttccgaccgtttcgatgttttggtggacaaacatttcgatggaaaaagcgaattgacaatttggagacgtatcagaattcgcaaggacaaaggaccaaaagcgaaactgtctgtggcgatcgatggcaaatttgtgggatttccattgccggaccattcgctgccaaacaaaatccgttttcgtttccttcagattcagtagatcaaaaactatacagaaaccaattaatatggttggtcatcttcatcattgttcccccttttcagctacattgaccattctgtgctcacatttatccgttcaaacaagccaatttgggacagaatgggcaccaaatttgagttttttgcgaaaagcattcgccagttgggctttaccagtggcgatgcctttgacaatttgcgtcgtctgatctcgccgacaattctcactggtcttgaccaattgaattcaattgattccaatgaactgttccccgatggaattgctgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagacatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaataattaaattgattaattgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaccccgatcagagagtccgcctcagtttcctagcaattaacaatttttcaatcatcgatattagcagggaacggatttttaggttttcacctacttttttggggggataacatatgctgagataagcgcaaaaaacacattttcttcgatcacttttcgatttagagcgacttttaaacaattattatgacttgtgaaatttttaaaaaacttttaaaatatttctgctttaacagaaacattattatgaaaaagcaataaaaaaacaaaacaaaaaattggcgttactttttttcaaaaaatgcacccctcagaatcgatttttcaaaaagcaaagatcctggacccatgatttggcggacgatcgaacatttttacgcttgaatactacatatcttcaaatttcagtacttcttgaaagggaaaagtgtgctctaaaattgcagcaaacaatgaacagacggtaaggaaaatttttaaaaattacaaattttccatgtttcagttggatttgtgcggatgtttggatggacattctcccatcttttgaccatgcccaactcggcctcaaaatggcattgctttccgaccgtttcgatgttttggtggacaaacattttgatggaaaaagcgaattgacaatttggagagcaatcgaaattcgcaaggacaaaggaccaaaagcgaaactgtctgtatggaccgatgacaaatttgtggattttccgatgccggaccattcgctgcccaacaaaatccgctttaaagaccttcagattcagtaaatcaaaaattatatagaaaccaattacttaatattagggttgcaaccccgaaccccgacatttttggccattttcggggaaaaccccgaaccccgacgcttccaaccccgaaccccgatcggggtcggggttaaatatacactcctaagaacggaatttttgtgggggaaaaagcaaaacatttatacaaaaattgatttttttaaccatcttgacaaatttttatgaaatatagtaaattttgcttttttaaaccaaaaatacctattaaaatcaatcatccatggcataatttatacggtcggggtcgttttcgcgtggccattttcgcgtggccgttttcgcgtggggacgttttcgcgtggccgttttcgcgtggggtacgttttcgcgtgagtacctgtttaggactgaaattggtcggatttgtgcaaaacatctatgtttcgaatcccgaacccgaattcggacaaatttcttaacttttttatttcttgcggctagtatcttctacaataatttgtcagtttggtcggatgtgcgtcaaacggaaaaaataattaaaattggttctagtcggttttacgcgtcccatgacattttacgcgtcccataacattttacgcgtcccatcacattttacgagtcccaacaacactttacgcgtcccatgacattttgtgtccatggcagggatggcattccgaggccccaaaaattttcggaaatcggaattccgtgccatccctggtctcatggtattatagttgtcctaataactaagagaaaaactatttttttttgttaggtattcagtaaagtttttaactataaatttcgttgttaaacctaaggttatcatgacaactcatacacaggcaactcgaacaatggcttattgt

SEQ ID NO: 6 - DNA, 12997 bp, Heterodera glycines
gttacacaattcaactgttttttcttttggacacaatgccaattgaatcatttgaattggtgaacaaacggacgaaagaaaagctgacactgaaacaggagatcgaagcattatccaacggaataatttataattggctgttgaaacggtgcccaattggggagacggcgacggtgccagcaattaaatggaaagacagcgtaaatccgagtgccaatttgaacaatgtcacttttgatctgtggagtttcgataaatccattgggtgagcagcaattaggatacggagaatccaggaaaaaaatatatgcatttacaaaaataaggaagccgtgtaaattatgtatgtattgaacaaaatcagcaaaacacccttccccattactctctctttatatacgcataaattaatgcgttatggccattattttggccaacaaatcattttaatctccccccatccgttcatccgttttcaaatctctcacttttattttggtagatatataaagaggtcgaaaagacatttttgatgcagaatagagaaaaaatgaacagacggtaagcaatttcttttgaaaaacagcatgggtaaatgaaaatgaaattcctcaccgtctgtgcatccaaaaagtctttttgacccctttatatattcagtagttcttaattgttgtgcgtaagaaagcattttggtaacctttcaaaaagacgaagaagaagcggataaaagcaacggaaatgtcgtctgctgattaagtgtacggaaatgaataattaaattgattaattgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaccccgatcagagagtccgcctcagtttcctagcaattaacaatttttcaatcatcgatattagcagggaacggatttttaggttttcacctacttttttggggggataacatatgctgagataagcgcaaaaaacacattttcttcgatcacttttcgatttagagcgacttttaaacaattattatgacttgtgaaatttttaaaaaacttttaaaatatttctgctttaacagaaacattattatgaaaaagcaataaaaaaacaaaacaaaaaattggcgttactttttttcaaaaaatgcacccctcagaatcgatttttcaaaaagcaaagatcctggacccatgatttggcggacgatcgaacatttttacgcttgaatactacatatcttcaaatttcagtacttcttgaaagggaaaagtgtgctctaaaattgcagcaaacaatgaacagacggtaaggaaaatttttaaaaattacaaattttccatgtttcagttggatttcggtcggggtcgttttcgcgtggccattttcgcgtggccgttttcgcgtggggacgttttcgcgtggccgttttcgcgtggggtacgttttcgcgtgagtacctgtttaggactgaaattggtcggatttgtgcaaaacatctatgtttcgaatcccgaacccgaattcggacaaatttcttaacttttttatttcttgcggctagtatcttctacaataatttgtcagtttggtcggatgtgcgtcaaacggaaaaaataattaaaattggttctagtcggttttacgcgtcccatgacattttacgcgtcccataacattttacgcgtcccatcacattttacgagtcccaacaacactttacgcgtcccatgacattttgtgtccatggcagggatggcattccgaggccccaaaaattttcggaaatcggaattccgtgccatccctggtctcatggtattatagttgtcctaataactaagagaaaaactatttttttttgttaggtattcagtaaagtttttaactataaatttcgttgttaaacctaaggttatcatgacaactcatacacaggcaactcgaacaatggcttattgttagactaggcctaagtttaggcttttgtaaatttttttttcttatagttgaatttctgttgacatcaataagtgtgcttagagttgcttttgcacttctcttttatatgcaaccacgcgaaaacggccacgcgaaaacgtcctgtcccgtaatttatagacgtattgaacccaattttattttctttgaataaaaattcaattttttgactaaatcatgaaaatttacaaaaaaaagaaaaaaaataaaaatttaccagaaattcataaatttttggtgaaaatatgttacaaaatagaccttaaatttcaaaattcacccggcgctgcctatcggcatcgccggcgccacaaaaaaacctattttttcttaaaaaaaattggcccaaaatcgaaaaaatctatcattttttggacaaaatctgttaacaggcccatccaaattttcaaaatttttcacggcggcgcctatcggcaccgccgaacccatttctcctaaacgtctttagataaagagcgccgcaaaaaaaagaccaaaaaaaaaagatttatacagattttcgctgaaaattggccattttaaatgctttaggtatgtgtttttaattaattctatacaaaatatttatgataaaaaaaatataaaaagcacataaaattattattacgaaatttaaatatttttaagcaaaaatttataaagttttttgactatttggcataaggcaaaaattgaaaaaccccgaccccgaaccccgaacgatttggcaaccccgaccccgacacttccaaccccgacgtcggggttgcaaccctacttaatatggttggtcatcttcttcatttttccccttttcagttacattgaccattctgtactcacatttatccgtgtcaacaaacaaatttgggacagaagtggcaccaatttggagttgtctatttcaaatgaacaaccaatttgggatgttttcgcccatgaaatttggccaatttttgcggcaaacattcgccagttgggctttaccagtggcgatgcctttgacaatttgcgtcgtctgatctcgccgacaattctcactggtcttgaccaattgaattcaattgattccaatgaactgttccccgatggaattgctgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttaacatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagttttgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaatgattgaataattctatttgagaaatgatctatctcaatttgttgtgcttttttctctcagaaatgcttttgttaattgtttcgttccaattatataaaacatttattttattggcttttttgttgaacatttattaattatcaatgaaacgattatttatagaatgtggaaatacagtagtttttgtttccttcctcctcgcttagaaaaaaattcactagggtaataaatagggcttccaaaaatatggacataaatcgcgaaatatggaaaaaatggatatagaaattcatactagaagcttcaaaccaagctaaaaagatggttttcgtgcgtttcaggcctcccacagtccatgaaaaaaaatggatttccatatacataattggaagccctagtaataagtagggttgcgattttttaatgacgaagaatctcgaaatagttattgttttttattcatacgagtcgtcgttgcattttttgttcatacgagtcgtcgtcgtggcattttttggtcatacgagtcgtcgtcgtggcattttttggtcatacgagtcgtcgtcgtggcattttttggttgtgcgagtcgtcgtcgttgcattttttggtcatacgagtcgtcgtcgtggcattttttggtcatacgagtcgtcgtcgtggcattttttggttgtgcgagtcgtcgtcgttgcattttttggtcatacgagtcgtcgtcgtggcattttttggtcatacgagtcgtcgtcgtggcattttttggttgtgcgagtcgtcgtcgttgcattttttggtcatacgagtcgtcgtcgtggcattttttggtcatacgagtcgtcgtcgtggcattttttggttgtgcgagtcgtcgtcgttgcattttttggtcatacgagtcgtcgtcgtggcattttttggtcatacgagtcgtcgtcgtggcattttttggttgtgcgagtcgtcgtcgttgcattttttggtcatacgagtcgtcgtcgtggcattttttggtcatacgagtcgtcgtcgtggcattttttggttgtgcgagtcgtcgtcgttgcattttttgttcatacgagtcgtcgtcgtggcattttttggttgtgcgagtcgtcgtcgtggcattttttagtcatactagtcgtcgtcgtggcattttttagtcatactagtcgtcgtcgtggcattttttagtcatacgagtcgtcgtcgtggcattttttggttgtgcgagtcgtcgtcgttgcattttttggtcatactagtcgtcgtcgtggcattttttagtcatacgagtcgtcgtcgtggcattttttggtcatacgagtcgtcgtcgtggcattgtgaagcgattttgtgtgtaaaatgtgaattttttaaaaaacggattttgacttttttgttcgaattccgggttcggggttcgaattgggcgaaaatagatgccggaatcggtttttccgaccctaatcactttggttggattttagaatttttccgttgtccagcactgactatctgtgtataaaagggatgaaacttttcactttatctcataccaaataatttttttcgcgaacaccaccggacatatttaccaaattcttgccgttatgccgctgagcacctccgaatgtattttgttttccgctattctgttcggcatctgcttatttgttagtcatacaattccatttttctgaataacactgtcttcctcttcaggtggtggattattatgccctgactgttgcgaccttttcattcctcattggaattatggtagttgttatgtaattttcactttagcacaaaatatttcttttttaagttcggtgcactctggccggtgatttgttctactttttacggctctgtcaaaacttcgaagaagaccacttccgcttcaaagcaatcggcatctgccaatgcatctggaactgcgaacaccaaatcatcatctgaccattcctctggcacttccaaagacaagtcggcatctgccaatggatctggagcgaacaccaaatcgtcatctgaccattcctctggcacttccaaagacaagtcggcatctgccaaggcatctggagcgaacaccaaatcgtcatctgaccattcctctggcacttccaaagacaagtcggcatctgccaaggcatctggagcgaacaccaaatcgtcatctgaccattcctctggcacttccaaagacaagtcggcatctgccactgccgcgggcacttccaatgacaattcgtcttccatggcaaaatcggattacgttgaacgccagaaggaccgctccagccgcgtatgtttactcactataccttaaacaaaaatacgcatttctttttttagtgcggtgagcagcagaagaaaaagtgatggaagaaaagaagaagcggatagaagcaacaaagatgtcgtctgattaagtgtatggaaatgaatattattgtatttgagaaatgatcgatctcaattgttgtgcttattttctctcagaaatgcttgttaattcattccttctataatatacatactcatttatttttctcgattttttttgttggccaattggtttaggataattgaaagattgtctaaagaatttggtagtagttaaagtggttccccccccccccaaaaaaaaattcccatgacatacataagagacaattaatttatttatttgcttgcttttatgtggtcccttttttcgtttcctcctcctcatttcattcgttctccctaaatttttctcattttgttgctgcacttttctgctgttggtcgattgtgccatcactctttggttattttttggccatgtcaaaaaacgacgacgccccaacaaaaaagaaatgtaaaaattcaacaaaaaattttaaatatttcttcaatttttcagctttatctgcgccgattgttggcttttggtgtttgattttcttacgccttcccaatttggccccgaaattgcattgatcaaccgctgctttgacatttacgtggacgaacatttcaagacacgcaaatggaaattgggcgaaattcgaatttgctacaaaattgaagaaaatggcactaagcaaatgcatattcacaatgccgatgcaaatccattgccaatccccaaaatccgtttccgaacaaaatcatcggattcagacacatcaaaagcatgtaaagattgattaatttgcaatttttcgtcttaatttctgcttttcagttacatcgatcaaaatgtcatcgcatttctccgccgttttcaccgttgtattttcgccgtttgtttaacggatttgttcattttcacgggcaatgttagccttttggacaacatttggccaatgttccgcaattctatgtgtgcgatgattttgaataccatcgcttttcgtcgtttgcgtcaattggccccgtcacttctcaacgattgttcattcaattgaaccacaaaaatggaccgacggtaagaaaggatttaaaaaattgcaagttttcatttacccaattttcttatgtttcagttggatttgtggcgacgtgtggatggacattctcccatcttttgaccatgctcaactcggactcaaaatggcattgctttccgaccgtttcgatgttttggtggacaaacatttcgatggaaaaagcgaattgacaatttggagacgtatcaaaataagcgaaactgtctgtggcgatcgatggcaaatttgtgggatttccattgccggaccattcgctgccaaacaaaatccgttttcgtttccttcagattcagtaaatcaaaaactatacagaaaccaattaatatggttggtcatcttcttcattgttcccccttttcagctacattgaccattctgtgctcacatttatccgttcaaacaagccaatttgggacagaatgggcaccaaatttgagttttttgcgaaaagcattcgtcatttgggctttcacgatgccgatgctttgaacaacttgcgcagtcgcatttcaccaacgattctcactgatcttgatcaattgatttcaatcgattctggtgctctgttacgcgatggaattgctgacgatgggcaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagccatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaatgattgaataattctatttgagaaatgatctatctcaatttgttgtgcttttttctctcagaaatgcttttgttaattgtttcgttccaattatataaaacatttattttattggcttttttgttgaacatttattaattatcaatgaaacgattatttatagaatgtggaaatacagtagtttttgtttccttcctcctcgcttagaaaaaaattcactagggtaataaatagggcttccaaaaatatggacataaatcgcgaaatatggaaaaaatggatatagaaattcatactagaagcttcaaaccaagctaaaaagatggttttcgtgcgtttcaggcctcccacagtccatgaaaaaaaatggatttccatatacataattggaagccctagtaataagtagggttgcgattttttaatgacgaagaatctcgaaatagttattgttttttattcatacgagtcgtcgttgcattttttgttcatacgagtcgtcgtcgtggcattttttggtcatacgagtcgtcgtcgtggcattttttggtcatacgagtcgtcgtcgttgcattttttgttcatacgagtcgtcgtcgtggcattttttggtcatacgagtcgtcgtcgtggcattttttggttgtgcgagtcgtcgtcgttgcattttttgttcatacgagtcgtcgtcgttgcattttttgttcatacgagtcgtcgtcgtggcattttttggtcatacgagtcgtcgtcgtggcattttttggttgtgcgagtcgtcgtcgttgcattttttggtcatacgagtcgtcgtcgttgcattttttggtcatacgagtcgtcgtcgtggcattttttggtcatacgagtcgtcgtcgtggcattttttggttgtgcgagtcgtcgtcgtggcattttttggttgtgcgagtcgtcgtcgttgcattttttggtcatacgagtcgtcgtcgtggcattttttggttgtgcgagtcgtcgtcgttgcattttttggtcatacgagtcgtcgtcgtggcatttttggttgtgcgagtcgtcgtcgttgcattttttggtcatacgagtcgtcgtcgttgcattttttagtcatactagtcgtcgtcgtggcattttttggtcatacgattggtcgtcgtggcattttttagtcatactagtcgtcgtcgtggcattttttggttgtgcgagtcgtcgtcgttgcattttttggttgtgcgagtcgtcgtcgtggcattttttagtcatactagtcgtcgtcgtggcattttttagtcatactagtcgtcgtcgtggcatttttggttgtgcgagtcgtcgtcgtggcattttttagtcatactagtcgtcgtcgtggcattttttagtcatactagtcgtcgtcgtggcattttttagtcatacgagtcgtcgtcgtggcattttttggttgtgcgagtcgtcgtcgtggcattttttagtcatactagtcgtcgtcgtggcattttttagtcatactagtcgtcgtcgtggcattttttggtcatacgagtcgtcgtcgtggcattgtgaagcgattttgtgtgtaaaatgtgaattttttaaaaaacggattttgacttttttgttcgaattccgggttcggggttcgaattgggcgaaaatagatgccggaatcggtttttccgaccctaatcactttggttggattttagaatttttccgttgtccagcactgactatctgtgtataaaagggatgaaacttttcactttatctcataccaaataatttttttcgcgaacaccaccggacatatttaccaaattcttgccgttatgccgctgagcacctccgaatgtattttgttttccgctattctgttcggcatctgcttatttgttagtcatacaattccatttttctgaataacactgtcttcctcttcaggtggtggattattatgccctgactgttgcgacctgttcattcctcttgggaattatggtagttgttatgtaattttcactttagcacaaaatatttcttttttaagttcggtgcactctggccggtgatttgttctactttttacggctctgtcaaaacttcgaagaagaccacttccgcttcaaagcaatcggcatctgccaatggatctggagcgaacaccaaatcatcatctgaccattcctctggcacttccaaagacaagtcggcatctgccaaggcatctggagcgaacaccaaatcgtcatctgaccattcctctggcacttccaaagacaagtcggcatctgccaaggcatctggagcgaacaccaaatcgtcatctgaccattcctctggcacttccaaagacaagtcggcatctgccactgccgcgggcacttccaatgacaattcgtcttccatggcaaaatcggattacgttgaacgccagaaggaccgctccagccgcgtatgtttactcactataccttaaacaaaaatacgcatttctttttttagtgcggtgagcagcagaagaaaaagtgatggaagaaaagaagaagcggatagaagcaacaaagatgtcgtctgattaagtgtatggaaatgaatattattgtatttgagaaatgatcgatctcaattgttgtgcttattttctctcagaaatgcttgttaattcattccttctataatatacatactcatttatttttctcgattttttttgttggccaattggtttaggataattgaaagattgtctaaagaatttggtagtagttaaagtggttcccccccccccccccccaaaaaaaaattcccatgacatacataagagacaattaatttatttatttgcttgcttttatgtggtcccttttttcgtttcctcctcctcatttcattcgttctccctaaatttttctcattttgttgctgcacttttctgctgttggtcgattgtgccatcactctttggttattttttggccatgtcaaaaaacgacgacgccccaacaaaaaagaaatgtaaaaattcaacaaaaaattttaaatatttcttcaatttttcagctttatctgcgccgattgttggcttttggtgtttgattttcttacgccttcccaatttggccccgaaattgcattgatcaaccgctgctttgacatttacgtggacgaacatttcaagacacgcaaatggaaattgagcgaaattactatttgctacaaagttgaaaataagagcatttccccaacatctgtattctatgtcctcttcgcatctcttcatgttatcactctaaaatgttgattctaatcttgatatcatgtcagcttctatctcatagaaattataatgattaattcaagtctcgtatcccatatggcgcggcgcaaatttccgcggcgcaattgtattttttgctgagcggcgcaaatggtgcggcgcaaaagtcggctaaccctacatcagatagaattaatttaattatcagttagttaaattttacaatgaatatattacgtataattttgtttttgttattcttttttttactctacctttttcatctaacttgatatttattttatttatttctttattactttaggaggcataaatagaattcattattaaagcataacacacaaccattcatttatagttagcttttttattatttaatgtgaaaaatttatataaacattaattaagataatataataatatataaaatttccctcgagctataaaattctaattgccaagataaaatattccaactataccgaacgatgccttgttataattttttaataatggataatttttttccgtaaatacataatagttatcataaataaaaccataaacataaagtattaagtacaataattaatattgtaataaactgatataaattatacaatgactctatcaataaagaaagaaaatataatcttatatttttgtgcgtagcatcaagttagataaaaattaaattcatgatgtttaagtttgcgagattatataaaaatagaaaaaatcaaatactaataattttatcccagctagaaaatttaattttttaattagttttccaaattttctaataagcattcatttttctcgtatattaaaaacgtaagaaactgtgattaacattcataaataaaaggataaaaagttatttcctataaataatgcaggaggaatattaatatttatttagacaactaaatatgatttacat

SEQ ID NO: 7 - DNA, 3498 bp, Heterodera glycines
actaacataacataccatatcataccatatcataccataccataccatatcataccataccataccataccccccttttttttgttatttcactttgttaacctttaaaaaactaataaaaattattccaatagaaattaatcttttttacttcgtcccatttattttattttatgattttttttacatttaattttaattttattagcatcactaaaaccttaatactattttccttttattaatccagagttattaaactattattccaataaaaaagaattttgattttttacttcattccattttattttatgaattcattaataataataataatttatttttatttttataagaattagtgaacttaccatttaaatttttctccatggcaaactccaatcataatcaacttcagcaaggacagtcagcacttggaaatgtatattttggcacatttaatattaatatatcattaaaaaaaatgggttgttttactcaattgatctgactagccaacatagatttgtcatttatattaatttccataattgttcaagaatgtattctgcaccgatggaacgcacaatattcagttcttgaatggatgcgttacccaaattggccaacctttaccgtatgtttttttgatggtgaagactttaaatttgtgttccaagaccgctctgcctgatcgttgtttcaattgatcaccggcccgaacaacagactcccgcaggattgctttctgtgactaatgttgtgttgcgcaatgccgatggtcatcggattgaagcttcgggatggcaaactcaagcgggtgttttggcgtcattgtccattggaactgcttactggttcatgaactgtatggcacgttcacggtatcagcgactggattgttggtaccgaattggcgttgatggtagaaatgctaccataattcctcacccaatacgccaggtaatttttattattattattattattatttaaaaaaatcactgattagcaaacaaccaatgctcgtcctaatgaatcagttggacttcgtcactcaatcgcatctattttgggggaacaaattcaagtttttaaaaattaactaaagttgtgtataatttaattaaggctcaaccggttcaaattcagacgggaagtggtcgcaatgaagtggtctgattttattaaaaaaaaatttaaaaaaaattatataggtaaatggaaatttgaatggttcacgtaatcagctccgttttaaccaaaccaatgaagaggatgtgaacaataacaacgtgaggaaatgatatttcttctcagcatttttataatttctgtggaataaaaattatattagacacttcatcaccgttttggcataccaatccgtacgcgacctcccgagagaagggtgggtgaaagtgttcgtttattttattgtaactgatttgctcttaaaacaaaggccaggatcagagatcattgtttacaaattagtccaacgatattttaaaaggtgaatcgttcgattgatgactccttcgtaattgaacgtacaacaccaatgagaaacacactgagaaacacgagaggggaagtgtgtgaaatcaggttcttgcctttggaggacaatgagcgtcccgaccttgtgatggagatcctcattcaacaccttctcgaccgtgtcttagatgggcacccgagtccaatcctagttggactgcagctccaaccgccggggtttgatcgaccctacgtgatccgacttcggccacctgaacaaaacaacgcggcagcacttgctgcagctatcgaaagactcaatgagcaatcggccgctggaatagacttgctttctggaacgaccgtcaccaaagttctcgctgtgtggcctttggaatccgttcgtgtcgatgctcagcgagggggttgataaaaaatttaaaattttgataaaataaaatataggtgcgtgcgatttggataacgaacatcacttatcacacaacgtgcagtcaatagttcgtgttgtgaaccccaacgatcgttactgcctcgcgcgtgctgttcttcttggactttgtgatcgtgagacacaaatgccaaatggaggtggtcgtggagcgttcaacacatacgcaagtcgtcaataccaacatgggactcaggccgttcatttgcttacaagagccggtgtttctgttgacaaacacatgtacacactggaggatgttgcgcaactccaacaatatatcaataatgagaatggggtaggacaaattcgccttgtaatcttcgaaaaggagcaagaataccgtattgtcttcaagggagaggggtaatatttttttgtttatctaaattaaaaaaaaaacatttgaagaactgcagcgcaattcaatttatgtatcctgctagaacgaggacacttcaactatattggacgaattgcacagctcttcaaggttcctggatactgcattgactgtgaacggagagcagatgcgcgttaccatgcgattggttgcaaggcggcatgtcgtctttgttttcgattcgggggtggatacccgtgtcaacgagaacgggttttaatttgagcttatttttttcagttataaaatttttttagttgtctgatggtcagatcagttcacgaaaatgtaccgaatgtggtttcattttcccaaatgacaactgttatgaatatcatttggcgaatgatgcccctgctccaattgatgggcgcggacatagacaacggcgttcactttgtcaatggcgacgtttttgtcccacatgcggtcgtgttgcctattttggaatccatcaatgcccctcgatacgtcgtgctattgggccagttgattgctttcgttgcaaaggtccacatatgttggatgaaccttgctacatccaaccgattggtgttgcaccacctttaccaatgcttggtcctgttcacaacaacgacgacgacaacaacaacaacaacaacaacaacaacaacaatgaggatgaaaatgatattgatttcataatcaacaatctgggaggagaaggtgatgaagatgaagatgatgttgaaaacggggatgatattaatgatgatgatgatgatgagcgagatgaactgctaccacttcgtctttgcttcttcgatgccgaaacatcccaggagcgcccactacagctcaacaaccaagtcgcccataaacatgtacctttgctaatagttgctgaattcatttgtgaaccttgcattcgagctggaatcaacatcaacgatgggcaaggtcagcgcgcacccggttgcgtttgcctatgtggaagagtgagaggtcaacagatgcgtcaatggatgtcaccaccttttgtaaatgctcctggggataatactcttcagccggaaggagctcctgtattcaacaaccgtcgtttattttttcattctttagagaacgaagcttctgaccccgtagaccaatttctcga

SEQ ID NO: 8 - DNA, 12920 bp, Heterodera glycines
  misc_feature (93)..(93): n is a, c, g, or t
  misc_feature (99)..(99): n is a, c, g, or t
  misc_feature (12813)..(12813): n is a, c, g, or t
aaggacgatgcggcgactctttgaactcgacactaacccattggatggagcttcacgtcgtatgggggtgtgagtggaaagaacggctccgancgcganttggagctcaagcagcgtttcgaagcagtatttgtcccgtgtccattggatccacgaaacgatgccactccgtggtggtcgtacggagcccttcaaacttcatcatgtgtgctcagacgatgaagagatattgtgcattgatatagttagcctatatccctacgtcatggtgctttttctcaataaatttgaatttgaatttgaatttagaaggtgaatcctttcccagtggggaatccacgtgttctcacgcgtgaggtattgcttcatccaaccacggccccacttccctggacatgttcgtcaaataacatgttccggggacttttacttgtacgagtgctcgcaccgcgcctaattcgtgtcccgttgctgggctatcgcaccaaagatggacgtttcacctttccactctgtgcttggtgtgcggacagacgccagcaacgtccatgtcaacatggtgacgaaaagcgttcttgggtgtgcgcatacacgcacatggaattgaacaaggcacttcaactcggctatattgtcgttgatctctttgaggtacattaaaaataacgaaaaaaaaaatataaaaaaaaggtttggaactatgacgagtgggacgacgacttgttcagcaaatatgtcaatacattcgttggtctcaaagtccaagcgactgggtggccggaagggtgtgagacagatgaacaacgtaaagaattcgtggataatttcatgcgcacggaaggcatccaattagactcaacgaaaatgacacccaacccagggctccgcctcattgccaaaacattggcaaattctctgtggtatacgtttttaaacttctatttgaacaaaaaaaaaatgtttaggggaaaaatggcacagcgcgtgggtttcacgcagataaagtacacgcgcactccagcggaattccatcaactcttggacgatccaacattagacaaactggactttgtccacgtctccgagcatatggaccgagttgttgtcaggaagcgtcccgagtttgcaaaggcacccctcacaaactgtcttccagtcgcaatatacgtcacatcgtacgcgagacttcatctctattcatacatggaaaaagtgattgcactggaaggggctgagcttctttattgtggtttgcgaatacaatagaaaaaaaaatgttagataattttagacactgactcaatctactacgtgaacaagatgggtgggcggtgtgttccggaaggcgaggcacttggacaaatgaagcgtgagcatgttgatcgtcgaattgtggaatttgtagctggtggtccaaaaaattatggaattcggcacacagcacgagacggaactgatgagcgggccaacctaaaaatacgaagcttcagattatcgtacgccactcaacaattactgaattttgaagcaatgaaggatctgacactggctacatataacattgacggacctatgtcagtttttttttaattttcacaactaataattttaaattttagtgatgacgtcatcgacaacgatgatctctacgtgtacggaggaggtggagcccatcgttgcatccgagtaactttcccgcaaattgaccgaaatgtccgttctgacgtatacacctgcgaggcccacaaagactacagacctttctacgccaagggccgtgttcgaccgggaatgcaaacacgaccatttggatatgtggaggatgtatcacatccaccaatacaacctacggctgaacgaagaaagagaacattgattgaccctgacccaactcgaccgggttattctggatggttttgaaaatttattatcaatgaataaaaaattataatctcaacgaaaaaatttgggaatcacacttgagagatattgaaataaattgtgtaaattatcaattgaattgacaccagttataatgatttttcccgagatatagatgagacacgttgcatcattttccaatttgcatcgaagtgctgggaaaatacttggatcgtaaacaccacccagtcttgttacgaggcgctccacatagattcgttgtggaaaggttttcacacccacaatgttgaccacacgcatctcatggatatcgaagatggtgttttgtgtatgttgtattcttcgcaaaactcgtttcgcaaacactcttgctctgtctgggtggggtacgccggttaggacgacacgtgccgactgaaaaattagagcagccactgtttttttgtttgatgaacggattcgcatgatgatggcgtggaaacggcgtgggttgtactcagtattggctccatgttgtgcaatagtcaaaaattgttcaattgttagtggttgagcatttattttaaaaacaacagtacaatttgatacagaaaacatctaaataacaatattcaaagcttctaatgggaagaaagtcttatgatctccaccgccaaattcaacaacacaaggcaaatttgaatgacgcaatcgaataccgtgtttgatgtaatagtgcattcgaacctaaaatattttgagaaataaaaaaaataaaaagaataaacaccgtgattccgaggtaaccacggtatgcagggactgagtgagcatccaaaatggagagatcgttgcagcgaactgggaaattccgtatcgatggacgcaggtgggaggtgcacaattgagaagagcgtaggtgttcaacgatggcgcgacgcttccccaagtctttgaagagtacgtgtaactcgtgggcggaacactcaaatttcttgcacaagtggtcaacaagcggaataaagcaacgacgcttctctcgacagtcgcaatttccgggaggatctaaattttaattaaaaaaaataacactaaaagacaaactttttctttgtttctcctcttcctcatcgatttgcacaatagctataggctcccgcttttcctcttcatcaatgagactaatccaactagggtcttcctttggtgacatgttagccttgtcctgttccatttccgggtaagcgttattcatccaatcagtggcgagaattaaatccattttttttaaattaacagaattaaaagttatatatagagttttaaatctaaatgtaattaaaaatggaggaaacttttgatcatacggatgtacagtttcgtcatccattcacaatgattgtgtcaggaagtacgggaagtggaaagtcggaatggataatgagattattacgtaacttggacaaaattatttcagtaccaattgagcgtgtattgtattgttacggggagctgaatccgaatattttaaatttacaacgcaatgggagaattgacaatataacagtcactgttcacaatggagttcctgctgaagactacattaaaggaaatgccaaaaaggaaaaattgttgctggtgttggacgatttattggttggtatgagacagcaatatttagacacactctttactcgcggttcacataattggggagttagcataattctagttactcaacacctctttaataaagagttgcgtgtcgcgcgtggaaattcacattatttggtgttaatgcggaacccagccggtgagcttcaaattcgtactttagccacacatctttttccttcaaggacagctcattttatggagtcataccgtaacgcatgttcaaaaaattttggttatctcctagttgacatgcatccagaaagtcttgaaattttacggttgagaacacatatatatgatgaaaagataattgtttacgttcaaaaatgaatgtttccaatttaattacaaagaatacaaattttttagagagtatttgtaatgcaaaaaattccaaacaacttatacagagagcatcagatgaacagcttttatgtatcgtagagatttgtcttaatattttaaaaggacgggttcctctaaagcctgaacatttaaaaaaattgaaaacacatgctcagattttgcgtcatctagccagaacacgttgttctcgttccgcaaaacgaatattattgcaacacggtgcgggaattcccgccatagctggattgctctcttcaattgttttgcccttggtttcaaatttaattgcaaattataaataacgccacaaaaaacaataaataattttaaaaatgcaatacacaaagcggtatttgctcgttccagaggagatttatcagagtctgacgtcacctcaagatggaagtcctcttggattagttagatcacgaattaagcaaattaaaaatgatgatgaaattaacgatgatgagagggcatttaaatatgaacaagaatttaaacgcctcaaaaaattaaataaagatgaggaggaacgccctgttgatgttaaattgcaaaacctacaggaaatgacagaggctatgccaaaaccttttaatctggtaagaagaccggttgctcgtagacgtcgtaatatcaaacttggtaaaacaagaaaagatgaagaaaatgaagtttttgaagatgcagaaacatttgaccaaggggatattataaattacatttataaaaactctgaggccttgggaatcaatgaggatggacagattatcaaaacaaatggccatgttcttagaacgagtaatatagaagatattgttgcgcatttgttaaacaaagacaagcgtgcaaataccaaagaaccaacagcactcaaagagtttgttgctagagccaaacaaaatccgcttttgagtaaacgtctcttttctgaaggtcaaattggcacgggagtttataaaaaggctatgataaaatttaagccttcgttatggatttgaagaaacagcgattactcgagtttttgtataaagacataaattcaccagtcgcattcacgagccttgaaccattgttgagagaggcgaaaaaacggcaaagaaaaatcacgagagcagatgttcaaaatttcttgtacacacaacgaacttatacgttacatcggcaagccaagcgtcgctacagacacttaccaacattagctcctggattacataccgaatggcaggcagatttggccattcttgatagacttgcaaaacataatcgtggattcaaatatttgttagtttgcattgacactctaagtagacaaatatttgttgagcctgtaaagtcaaaaacaagtataaacataattaaagcatttgataatatctttatgagaagcaagtacattccatggaaaattttgactgatcaagggaaagaatttacagctcattcagtaaaaaaatattttgatacaaaagatgttgaacatttttgcatgctgacttcccctcaattccacgctggtatggctgagcgtgccaatcgtagtataaaagaacgtttatatcgttacttcaccgaaagagacacttacaaatggattgaggtagttcaggacattgttaagggcattaatcagtctataaactcctccattggaatgcgacctgctgacgtaaattttgaaaatgcagaggaactgagacaaaagttatataatgaagcgaaaaaatttccaaaaaagagtcctaaattcaaagtgggcgaccgtgtgagaatagaaaaatacaaacatgtattccaaaagggttatttaccacgatttaccgatgaaatatttacggtagcagaagtacatacagaacgctcgcccgttgtctacagattaagtgacgatagcaacgaaattataaagggatggttttattccaatgatttatgcaaaattctcaaaaacaaagaatcactatatgatattgaacaaattttgaagaagaaaaaacaaaatggtattgaatacgttctggtaaaatggaaaggatacagtattaaattcaatagctgggttccattgagttctatctccgagaaaaatatataaaaactttattgcgctttatcttttaaaaaaaatgccatccaattctttttacattgttcttccttcaaatacaaatgttgaaggtaacaagacaaattcattccgggttcgtttaccacgaaaactacaattcaactccgaatgggaagttggactcgctgttattgtatatcctcatacttggccttcgattggtactgttgaacagcaatttgtagaagttgaatggcaaacaggaaatacggtgcgtattgaagtaccaccatcgaatgtcacaaatccaattgacttgggtaaaactctgtataggctcttgggcgaaggaagtgaaccgttagcaaaaaaggtacgaaccgcacagaattctttttcgcatgctacaaactctgctcgtcgtggggctagagaagaatacataaaacgaaaaacgagagagaaacgaagtattcgagatgaagaaaaacttctagaagccttattgacggacattgaaacaatggttgacctttttggtgtgactcaaggtcttttagcgcgtgagaagcgcgcggagacgagcaaaattccgttgagaatgtctgctgatgacaatgaatcataccaacataaattggatgaatatttttcaaatttaagtggtcccgatttggacatactcgaagaaatgatcagagcaaaattgaacgaagaaattaaaaatatggtagaggaggaccgtacaattcttgatgcaacgaaagaaatgggaatggaagcgtgggttcaagcgtaccgtaaagttaggctcgtttgccgatttatttttgatatcaacaaaaatcgtttcgagttaatatttgatcagcgatatgtaaggagggttaaaatttcttcacaacttgcgtatatcttaggctttgacagtacagattttacgacatcggaaaatgaagcaaaatttatgccagatatgaatggtggcgtatcatcttttcaagtttatactcccgatctcattgaaccaatgatgattggtgatgtcacagcaccagtgttacgcatcgtcacaattcgaggaaaacctgatgaaatagttgaagaacaatttttagcaatacaatatcacaaaattttaattaaggaaatttctgaactcctgatcgaaattcgtacaaatagcgggagcctaatgccattccaatatggaatatgtacattaactttacatttccgaaaactgtcctacttctgaagatgaataccttggaaattgataaaattttatcgacaagcccactcacaaaacagacttatatcggctgttttgcggctgaccagataccaaatatggaaatggtaaaatttccaaattgtctggtaatgaatattgacccaatcacctctaaaggatcacattgggtttgtgcttacagtccttctccgtcacacattgaatactatgactcgttgggcatttggccaccacctagcatacacattgcaaattatttgtcaagattcaaacaaattcgttatagtataattctacttcaatctcccaattcaagtgtgtgtggtcgtcatgtgctcttctttttgtttaatagatgtctgggaactccctttgaaaagattgtaagatttttgcattttggaaaaacaacacctgacacacttgtcagttcttttgttacaagaataataaatataaatagttgaaaaaatatagttttttcacaaaaatgcatgtcgattttgatccccaccaagtggattggtctacattctcgcacgaatttattcaatatggaggttacaatatttttcgtggtgtaccatatcagcgcggtgctggtatcggttcagtatttagaagcttaatgagatttcttttaccgatagggaaacaaattggatcgtcaattgcacgtcaggggcttgaaagcgggaatcgagtgttaacaaatgtattagaaggtaaagatttgaaggagtctctcgtcagcgagggtaaaacaggacttaaaaaccttttggaaacggcagcaaataacattgaaaaccaaaaaggacagggatttgattttaaaaaatacaagaaagaaaccataccacggtatggaaaaattagaagaaaaaatataaataagctccaatcttcaattggaccacctatggttgttaagaccaaaaacaaacgtttacgtgttgactcattgggagcttactaaaaaatgacttgccctcaaaagattagtgaaaacagtcctttggcaataaacagtggtttaaacattttctcaatacctccaacaaatgtggcggtcgttcgttcattctttcgtcaagttcttcccttggcgacaatcactcaggaatcaccatatctctttaggttatacagtgataatttgtggactgatttgtcacgaatctatctctatcttgaattgtccattgaaaaaccgggagctattgacaaatggatagctatagaggacactgatgtcagcgtgtcagcaattcaaggaattgggcaaacgtttgttcagcaattaaaagtgaccgttggaaacactgaagtttacgatagcggaaatttatatccatacaaagcctacattaccaatgaattgagctttccagtaaatgcaaaaaagaactttctcggctcaacgggatattatcacacggaacgtcacgatgatccaacggatgatggatttaaagaacgttgtaaagtttttaaaggtggtaataatgcacagttcctctctcgccttgactttgacttgggaaaccaagaactctacctgttaaataatttggatttgttgttcacaatttacaaagcgaaagacgcatttcttttgcaaacacttaaagctaatgacgacacaaagtaccgtttgaccgtgcacgatgttaaaatttacgctaaaatgattgaggttcagccctcactcaacatgaatctttacaagacactagaaaagcagcctgctacttatgctgttcgtaaaaccgaaatcaaatcttcatacattagcagtgggcgctacgaatttgaatacaacgtgttcagctcgacaatacctcgtcgtgtaacaatagcgttggtcagtaactcggcttttaatggtgattacaaattgacgcccttcaagttcgatccatttgatttgcgagaaatttcagtacatgctgggggcatggtctatcccgttgtaccacataaattaaatttttcaaagaattactatgtaagagcattcgtggagatgtatgaagcgttgggcatggctaattcagaacgttcatttgacgtttcaatgaatcaattcaaaaatggatgggccttttttgtcatctctttgaattcaaccttagacgatagctgtggatttgagctgttgagaagcggtacaaccagtattagggccacatttgattcaccaattccaaagggaggagtggaaatgattgttctcggagaatttgaccaaatgattatgattgattataatcgacacattgtctccgactcgaagcttgggtaaatttataaataaagctcaaaattatattagagaaaaatgaataacacgacgaaagaaggaattgaggtgttacgttcatcagatgagactaatgacactctttttcatcttttgctcctttcacattatgcatttgccttccctgtttttctactctgttggttcataataattaaattcctcaagaggagaggtcatatatccccaagcgaagcggaaaccatgattgaagaaatgaaaaatattcaaagacaaccaccaatattttttcaatcaaagtagtgtaacttactttttttacaatgcattatttttttcttataagaatttggtataattttaattgttattggaattttttttgttaaagacaaatttttaaacatttaactgtttaaaaataataaattattgtttataataaaacttaattcctgttattaaaaaaaagtttggtctctcgccgccacacgcccgcctccgcagcgcttgtggtgaagcaaaggggaaaatttttcaccatttagtcaacaattatcccattcctttcaactcaccctgtggccaagtggttaagctcctcgcttccactctcaacggttcgagtccactaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcggaaaaagtcgcgcagctctcgctcatttaaattaattaatttaaatttaaattaattaaattctcgcgcacaagtccatccaataggtttcggctgaagggatcaaagatcatccaataggtatggggcggggggggggggggggggaccaaaaatatggattgaaaaaaatcgataatcaaagtacatcgtaactttagctggttccacgcatatttacatatattaatctattttggtgcattccgactagcttaggatctcacatgttcaatgcttggacggcacgaccgcagcgtgtcaactatggctgtctgattggcaacatgtccaccggagaagagtgtatgtctcccgatttgggcatacgatgaaaaccaaaacggcggatgaggacgagggcgatattatgagagggaacagtgtggacgacacgccttaccttgtctagaaggcaattatgagcaccctaccgtatccaacacaattagcacactaccgtatccaacatattttcaagtgaatactgtattttgtaatttatagctttttgcactccttttctcattcatgtgatcatttaaaattttcgagcctatctattctattgcaatatgcaaataataaataaagtatatcacaatacatcaatttgttcgtcgattgtgcatttaaaacttggcattttggtcaatgaaacagactttaaaaaaataattcgctggtttgagtccgcaaggattctttttaatttaaataaaaacggctttttatcaaccatgatcgaaaatttcctaaaacaagagcattgccagtcaaaaataaggagattttaagccttcaattaaaaacctgcatttctttttttgatataactttgctcaaaagcaaccaaattttaaaataatgatatttttcgatagcactaagtgtttactataaatttgcaaaattcatgaaaaatggttaagtttcaagaaagttatgacaaaaatgtttaaaaaaacttaattttttaggcttctcagttcaaaactgttttgaagcttaacgaattgcatagaaagcacttagggctaccgaaaaatatcaagattttaaaatttggttgcttttgtgcaaaattatgattaattttctgccaaaaattttcttccaagtcatttttcgtcagtctgcattttcctagattgttttgttcaggaaatctagacccaatggtcagattaaaaaaaaaacttcaggcataggtccggttttagcaggaaaaaccttgatttcagggatagaaattttagaatttgtagtaactagtttaatggtatgcagttagctgaaatttttggactgtcatcggactaacatttgcagaccgacttttgaggactgacatttgcggaccgacatttgcagaccgacttttgaggactgacatttgcggaccgacatttgcagaccgacttttgaggactgacatttgcggaccgacatttgcaggccgacctttgaggaccgacttttgcggaccgacatttgcagaccaacttttgagaaccgacaatggaccgacaatttacatatgctgactgaaaattacccaatttccgctaaaaattacatttttttttgctatattgaatttgcatatatacttcctttttgttaattgctaaaaatcctaaattatatttacgtgaaaagcattcatacgtatgtaaatatatgcttaatatttttaataatgccacataaatgactgagaactgcccaatttccactataaattatcaaaattattattgcagttgatttattcataaattcgaataataattcacatgtacatgagcacaaaatatgcatataaaaggcggttgtcaattaatgaaaaccttacaaaatattttaaaaatttccttttaggaggtattctcaatgaaaaccccaaatttcctcgccatttccattttcatttccatcggatttggaattgcaactccatctaatgaagatgaatgtaagattaatcatataaattaataaatttatataaattaatcccgttataaatatataattcatataaatttatataaattaatcccattataaatatatataaacttaataaatttatataaattaatcccattataaatatatataaacttaataaatttatataaattaagccgcgatgatgacaatcagcagcagaagcaatattgtgtgtccgacattgagcaggacccccaaattttgcatgagcaatgcttggatgccaaagagtggtccttgtccaacggattggtcaaatttattcaacaaaaaatgtgaaggatttcaaaagaaaactaaaaaagtagcaaaaatgcattaaaaaatatgtatacaatccggaaatactatattgtttcttttttgtcacatgttcttctctttttctgtctctttttcaaatgttttccaaaagattanatcacaaatagagaataaaagctagaaagtacaaaaaaaaagtgaaaaatgattagatgtaaatgcaattttttaattcgcatttaataatttaaatttgaaaaaaa

SEQ ID NO: 9 - DNA, 1655 bp, Heterodera glycines
gagactaatgacacttttttcatcttttgttcctttcacattaagcatttccttccctgtttgtctcctctgttggttcataataattaattcctcaagaggagaggtcatatatccccaagcgaagcggaaaccatgattgaagaaatgaaaaatattcaaagacaaccaccaatattttttcaatcaaagtagtgtaacttactttttttacaatgcattatttttttcttataagaatttggtataattttaattgttattggaattttttttgttaaagacaaatttttaaacatttaactgtttaaaaataataaattattgtttataataaaacttaattcctgttattaaaaaaaagtttggtctctcgccgccacacgcccgcctccgcagcgcttgtggtgaagcaaaggggaaaatttttcaccatatagtcaacaattatcccattcctttcaactcaccctgtggccaagtggttaagctcctcgcttccactctcaacggttcgagtccgctaccatgtttttgatttttcacaatttttcggaattttcatcataaagtcaacaattatcccatacctttcaactgcccctgtggccaagtggttaagctcctcgcttccactctcaacggttcgagaccgcgaccatgtttttgattttccacaatttatcggaaaaagtcgcgcagctctcgctcatttaaattaattaatttaaatttaaattaatttaaattaattaaattctcgcgcacaagtccatccaataggtttcggttgaagggatcaaagatcatccaataggtatggggcgggggggggggggtccgaaaatatggattgaaaaaaatcgataatcaaagtactcgtacattgtagtggaataatatgctttttaaacagacagaaatttttgtttttaagggtatttttgagaaactattaatccgatttttatctcacagattgacgcaaatttataatagaattaaatataaataatttttaggaataatatgctttttaaacagacagaaatttttatttttaagtttatttttgagaaactattaatccgatttttgtctcacagattgacgcaaatttataatagaattaaatataaataatttttaggaataatatgctttttaaacagacagaaatttttatttttaagggtatttttgagaaactattaatcccgatttttatctcacagattgacgcaaatttataatagaattaaatataaataatttttaggaataatatgctttttaaacagacagaaatttttatttttaagggtatttttgagaaactattaatcccgatttttatctcacagattgacgcaaatttataatagaattaaatataaataatttttaggaataatatgctttttaaacagacagaaatttttatttttaagggtatttttgagaaactattaatccgatttttatctcacagattgacgcaaatttataatagaattaaatataaataatttttaggaataatatgctttttaaacagacagaaatttttatttttaagggtatttttgagaaactattaatccgatttttatctcacagattgacgcaaatttataatagaattaaatataaat

SEQ ID NO: 10 - DNA, 1179 bp, Heterodera glycines
  misc_feature (1114)..(1114): n is a, c, g, or t
  misc_feature (1123)..(1124): n is a, c, g, or t
  misc_feature (1161)..(1161): n is a, c, g, or t
  misc_feature (1167)..(1167): n is a, c, g, or t
tcaaaaatgttggcacatttaattgcgtgaaagggtataatttcccaaacgattaaatgtaagcgcatatttattaagaaacaattgggcaaaattcaaaaattttttaaagattttgccaatttaaatttacggtttttgagatcaattttggcattttctccgaaaaatttataactaaaaagtgtttgggtgtctgtagccctaaaataaatgaattaatcaaaccattaaactaaaattgataggcatattttgccccctaccaattaataccaattttaattaaatttttagtgaattcttttttaagctaaaaatttcaccatgaaaagcgatgaaaaaagaagacaaaaacgaatggacaacaacaataataacaatggggtacggtgagaatgaaatccggcaacaagcaaaacgaataagaagcgaagagagatggccaaccgcgaggcacgggacatttgtagagctattatatttttttgagtagagcgggaccgggaattttgggcttaaccgggaccgggaccttttcgggttgaaaaaccgggaatttttggctgggaaaaccgggaaaaaacccgggactggtcccggtcaaaaccgggacctcggtactcagttttactcagttgtccgtgttttggtcccggtcccgctctactctaatatttttcatactgtgctttctttgagaattgccttatgtgtgccatatatgcctaaccatatgtttgcagcactgattctaatcatatctttttcatctgcgactttgtatttgatgatattctttttccacgaatgtcgctatgctttttccaattctgaaccgattttgccgctgtaagtgatcataagactgaattctgtgcgaattgttgttgctgtatttgttgttgaacaaaagcatgcataaaaatgtttttcttgcattctaaactcagttgagcctgatgaaatgggtccattcagtctgaggcatatttttctggccatatcttttttttacgtgataagccgaagtgacataagtatgaataatcgtaatatttaaaatttatttatttgaattttatttgataaataataaatcataacttagctncaggcttannagtattttaatggcattttgttaagaaaattgcttanaatttncaaaaaatactg

SEQ ID NO: 11 - DNA, 18686 bp, Heterodera glycines
tctgttatacattctatgctgtgtaattttctatatctttatatttatccactcttaattactctcctattctagccctttaaatgccatcaccatttaaagatacttcgcaagaaaagcttaaataccaaaaattcgaatctgttatacaattctatgctgtgtaattttctataaaatacatatttatccactcttaattactctgctattctagcccattaaatgccatcaccctttaaagatacttcgcaagaaaagcttaaataacaaaaaattcgaatctgttatacaattccatgctgtgtagttttctataaagcaaatattcatccactcttaattactctcctattctagccaattaaatgccatcaccatttaaagatacttcgcaagaaaagcttaaataacaaaaaattcgaatctgttatacaattccatgctgtgtaattttctataaaacaaatattcatccactcttaattactcacctattctagcccattaaatgccatcaccctttaaagatacttcgcaagaaaagcttaaataccaaaaattcgaatctgttatacaattctatgctgtgtaattttctataaaatttctagcccattaaatgccatcaccctttaaagatacttcgcaagaaaagcttaaataacaaaaattcgaatctgttatacaattccatgctgtgtagttttctataaagcagaagtagaatatattcatacataaattatcgattttttgccaatcaagtcaatcgatctgattggcaaaccagaagatgtgggttttgtccaaaagcctattgctacatgcgggtgccgtgcctcacacgctgactccgccccctttatcatgatgcaatcaactgactccgcccccttagcataacgcaatcaactgtctccacctcatgacgtcattaactgacccccccccctatctcatgacgtcatcaactgactccgcccccttattatgacgcaatcaactgactccgccccctttagcatgacgtaatcaactgactccgccccctttatggtgacgcaatcaattgaccccgccctttgctatgtttattattttttaatgattttttgagcactctatatcaaatcgctctgtaaggtcctggctataaaagtgcctccccttgtgcttctaaatcattcaacttttgcaaatgcccccaagcgaaaatctttttaatatctcgttaaatgttaatgatctggaagcgcggccgctgcctgagccccaacaacccgaacagcaacaacaaccgcaacaacaacaagcagaattattgattcagattggggatgttgaggatgcattgcttctcaacgttcatgagggagaagaaagaggagaggaagcagaacaagaagaggaagaacataatgttgagcaaattgaagaattgatgcgtttacatgccgagtatgtagcgcaaattttcaatgaaattgctgatgatgaaataaacaatgaatgatttttttgaataatcgataatgatgaaaaaatttccaatgtgtggcaggataaaaaactatggattgatctttgagttttcagcagggtaatcaattgtattgatcacgggcgtcgctttggcaatataaattgctgttccctagtcccgtttgtccagttatttcatttttgttaaatatccaatgcgtcaaaaatcttctccccgaaaaattgtcaatcccgacaacaacaacaacaacaacaacaacaacaatgttgcttctagttattctgaccgcctaaaaaagtttgcaaatgacgaagtaaagaaagcgctcattgagatcgaagaagagagaaacaagaagaagcaaaaacaacgccaagaaaagcaataatgtggcaaaaaatccttactaatgattattgtttttcacattgatcatttttcaatatctttcatatttctaaatcaataaataaattgtcagatttaatggctggacgtaatccattttctattgaatcggtacacgaaatgcggaacagaccaaggaacacacggggcgaggtggctcaagttcgttttgtcccgcttgagcaagtgcagcgtccagaccgcgttctggaacaactggttgaacaactgtttgcccgtgtgttgcaaggccgaccacctccatcattgataggattacaattgcacccgcccacgtttgaaagtccgtttacgattgcacttcgtcctccagaacaaaacaaccctgctgcaatagctgactttattcaacgcttgaatgaccaatctgcggcaggcatcgacttaaccgcaggaacaacacttaccaaggttttggctgtttggccaatggaaggtgatcgaacggaaaatggtcgtgaaggtggagaaaaatatgatttttttgtcattgtcaccatttatcaataggtggttgtttgtgggacgaagagcacgctgttatccatacagtgagttcactggtcagaattcgaaatccaaacgaccgactgtgtttggcaagagctgttttgattggtctaaaggattatcgttctcgcatgtttcatgacctacaagaaggtcaatgtgtgttcaatgattacgtggcacgtcaacgtttccacgggccagaagcaagtcatttgttgcgaagagccggaatcgacgtgaataaatacatgtacactttggaagacgttggacggctacaacaatgggttgatgaacattacggagaagggcagattcgtctaacagtttttgagaaggaacaacagtaccggattgttttcaaaggtagtgatttgtaatggaaaaaaaacttttctaaaaaaaggagactctggtagggctgcaagatttaacttgtgtttattgctggagaacgcgcactttcattatgttggacgtattgagcaactgtttcgttgtgcaggctattgtgttgattgtgaacggagagtgactcgaaagtaccatccgcaagaatgtaaagttgtttgtcgactctgcctacgtttcggcgttgattatccttgtcaacaacaacaatttcctgatggatcaaacagcaaacgtcagtgtttgcaatgtcaattcgtttttcctaatttggattgttataactaccatttgttaaatcgcgcacctgcaaccttggatggacgaagtggacgacgattcagcccaatctgtgaatggagacgtatttgtcggatatgtggtggtatcatttatgccactttcgagcacatatgtctgcgaggaattcgacaacagcaacaacaacaacaacaatgcctacagtgctggggagaacatggtcaagcggagccctgctttattcaaccgttggacgagtttcgagcaccaagaaggtccaaccagcagctacaacaacaacaacacgaacaacgccaagaacgaacgattgaaaatgatgttgatgctgatgaagatgaagacgacagtgaatgtgatgatagtgaagaaaacaaccggggccctattaatggtcggcgttctcgtaaactcaaaccgataagatattgtttctttgatgccgaaacctctcaagaccaaccattgcaacttcgaacccaagttgctcaaaagcatgttccacttcttatcattgcggaagtgatttgcgagcgttgcattgctgccggaattacggttcacgctggcgttggacagaaagcgaatggttgtgtctgtggcacgccaacggggcctagaggacgacagtggtgcagccccccgtttcgcaacgcgcccggcgacaacaccgaaatgcctatccatattacatacaaccagcggcgccttttcttccactgttttgatgacgcaaccaaaaatcccgtggatcagttacttgacttcctaatctcaacggggccccggaaatcgcacacgatttgtctgtcgcacaatggcgggaaatacgatatgcaccttgtattggaggcactccatcaacggaatttaccacccaaacggatctgcacaacgggcctgaagatttactcaatgacgctcaaaggcaatcttcaacggcaagtaaccttcaaagacacgctcaattttttcttctgtgaactcgatgctcttccgaggaccttcagtttgccaaacaacattgcaacgtcgaagccattctttccatatttgtacattcgtcatcaaaatttgaatgttcgcctgcaagggctacccggtattgaattttatcagcccgatcacatgaagacggctaaacgtgaacaattcttgcgatggtatgcagttgaacgcaccgccgccaaatttcagctcagagaacaactgataacctattgtgcaaacgatgtggcaattctacgcgagagcgtgctgaagtttcgcgaattaatcatggaaaatacgagaggattggacccatttgtaattgcgtcaacgggtgctggtttggcgttggccacgtttcgacgttgttttcttgctcgcaacaagcttgtcaacacacctgagggcggatatttacgcggaagacgagcatcagcagaatctgcacgatacattcgcatgtatgagttgatgaatcctggtgtgcatgtccagtctgcacagtggagcgtgggagaagcgcacgttgatgacactggttaccgattggatggcctccatgttcgttcgcctccacagcgaaatgtggcgatagagtacatgggttgttattaccatggtaattgcgtagtgaggggccgagttaagctttaaaatttatcaggttgccccaaatgctatccaaacgaacgtcagcgccatttggctggtggaaggactgctgaagagctgtatgagcagacacagcggcgtttatgggagttggagcacacgcatgggcttgaactccatgttatatggggttgtgagttgaagaaaaatttgcgcacaaatccgatgcttcggcaactatacaatgatgcgtttgtccctcgcccgctggatccacgtgaagatgccctacgtggaggtcgcacagagccatttacactgcagcacgtttgcacccaaaacgaggaaatcattctcatcgacattgtaagtggatggtacattatgcttttttaagatgtattacgttttgaggtgagcctttacccctatgtgatgaaagcatttgagtttccggttggaaatccacatgtaataacgcgagaggttctcttatgtcctccaacggccccgttaccctggcaaaattcaaattgcaacacttttcgcggacttttgtttgtttgtgttttaccaccaaatccggatgttcgccctctacgaattcctctgcttccgtaccggaccaatgatggacgactgacttttcctctctgtgcacgatgcgctgattttcgccaacagcgcccatgcacacacacggaccgtttacgctcatggaactcagcgtatgctgtttttttctttaaagtctatgccaaaaaattcaggtatactcatgtcgaattgaacaaagcactcgaacttggatacacagtcacggatctatttgaagtaatctaatcaaatgaagatatatttcatcaaaaaaaaataggtttggcattatgatgcttgggatggtgaaatgtttcgtggatacatgaacacatttgtcggtatgaaagttcaagcgagtgggtggcctgcgggctgtgaaaatgagcaacaacgggctgagtacattgttgatttcgaacgtgtcgaaggttttcggcttgcgcgtgaaaagataggaaataatcccggtctgaggatggtcgctgtgagttgaattgctcaaatttatttttgaatcaatcaataaattaagaaactactagccaattctctttggggcaaatttgcacaaagggttggacgaaccgaagttcgttataccagaacacctgctgaattccattctttgctcgaggatcccacagttgaggttatcgattttcatcatgtttcgccttacatggaccgggttgtggtgaaaacaaaaactgaatttgctttggcaccacaaacgaactgtttgccaatcgccatttttgttacttcatacgctagacttcatctttatcgctatattgagcaagtgggccaactcggccataaaatactctattgcggtcagttaaataaaagttttttttaaaattatttattaaagacactgactcaatttattatgttgcaaaaaatgggagacgattggttcccgaaggagaagggctcggacaaatgaaacgtgagcacactgaccgacgaatttttgaattcatcagtggtggcccaaaaaactatggctttcggcactgtgatcgtcttacgcgggcagatgaaaaggcggagctaaaagttcgaagctttcgactctcttatgccaccaatcagctactaaatttcgaatcgatgaaacaacttgttctggaacattacaactttgatggagaaatgttctttttaaaaaatttttacgtaaaaaatacatttaaaaatttcagtgatcccgctctctatatgaacgacgaatgttatgtctgccccggatcatcccgttctatccgtgttacttttccacaaattgggcgctccccttgctcagatttatatacctatcaagcgcataaggattatcgcccccattacgtgaaaggccgcgtaaggccaggaatggagacactgccttttggctatcgcaacgggtttacacgtgccaacacacaacaacaacaacaacaacaaccgcaaatcaacgaaatgcatggaagaaatgtcaatgatggtgatgatgctgcattccgtgatttgccgggctgttcacattggcaacccactcattatcgcaatcgatataattatcaatagttttaataaagttcttcatttggagtcaaaaaactagataagtgaagaatgaaaatcgacaaaactgaaagacaaagtttaaaatcagcaggtacaaaaacattctcttccaacttgtttcctcaacaaatatgggtaactgacagggctcattgtgtgcacattgttgttgagtgtgacttgctcatttcctttctgacgattgtttagctccatatattgcggggggcgggggtgaaatttatcgttggcaataggtcttcgtcctcgcccttgttcttctttgcctctctgacggtttctgtttcgacctcctcctcctcctcctcttcttcttccttgtctatgaataatggccgaacccaaagctaatctttctccccctcgttggttatcactaattcgtgtttcaacgacacttcttggacctccgcttgcttcagcttttgcacgggcgtcttcacctccacgtgccattacgacgacttgctggtgcgcgccatcatgataatcattatcatcatcactcgtcttttgggtttgccctttgttggctgcagcaactgcaacaccgccttcacgttcactcaacgcttccgctcttacaatatggctgtcctcctcctcctccataccactgccttcctctcgattgacaccggtttcagctttagccctggagccttccccggttgcggcgactgctgcccatgtacccttttcgtgtcggtcaggccatttgaaatctctggcattgtcgtcaatcgatttcagggtatccccccatggttcaggacttctctttgacgctattgagcagacaacagaataaaattggaatagaaaaaacgaaaaaagcatttttttattcaatgttatcagtgatgaatgaagacaatagtgaaaaggccttatttatatgctcaacagaggcgagtccagtgataattgctttgccagaatgataaacaatacaagttgcatgaacatcattatcagtcagtgagagtttgcatcgaagtgctgggaatattgttgggtcataacggacagaaaaaaattctttacgagtgtacaggacaggcaacaggtgaacaatgggtattcggtgtgggaatgtgtgagaacatacaatgttgaccactcgcaaatttatcaaagaaaatttttctgctttgttggtagcatgattataagcatgttgtatacgtcgaaggacacggtgggcaactatctttgcaaaacttggtttccttacaccagtcaaaacaactcgtcctgattgaaaaataaggcacgcaactgttctcccagcgtagcgaagccgcataattattgagtgaaaacggcgtgtgttcaattcaacatttgctccattacgagcaatttttaaaaattcgtctttgctcaggcgtcgccttattattttgaaagtaacggtgcagttttgaatgtttagcataattttatggctaaaaatttgttacaacagtaataatcaatgaaaaaaaaagaattatccgtcattgacatgtaattaaaatcaattcatcaatcaatctttctgttatccttctcttaacactctctctctctctcaattctgcttcacaacattcaaacactcgagcgggaacaggtcgtaatgttcacctccacccaaacgcactacacatggaaggtttgggtgccgtaggcggagtccgtgtttaacgtaataatagattcgcacctttaatttttctatttatacagccaccaaatgcatgagcaaacaaaccgtaattcccaaataaccacgcattgcaaaagcatcagttgctgaaagagtcgacaaatcactacattgtacgacaaagttgcggatggccggtctgagatagtttgtacgcaggcgtacattgaaacgcatatattgtagtatctggcggcgtgtcttcaaattttgcaataacacttgaagttccttggctgagcacttgtagcgctcacacaaatgctcaatcaatggcatttcaatttcttgcgcttcatgctgttgttgctgctggctgtatggcccgctgcgcccacagtgacatttattggatgtcgaattggagttgtttgtcttaaaaaaatctatatagtaacagaaaagcattcaccacttccggcgccgctgcctcctcatcgcttttcattgtgtttccattgcgtcttttgttctgctcctcttcatcctcctcgtcaatgactcttagccagttgatgccatcagcaatggcagcgtcgttcgactcgttgttttcctctcctcctcctcctcctcctccagactgttcatattcagggtaggcattgtgaatccaatcagttgccataatgcgctccattgagcagtacaataagcaatatataatgaattgtcctaaacctaaattgtttttttattgatttgctataaatggagcaaaattttcaatcattcaatgtgacggacacaaaatttcggcatccatttacattgacgatttccggtagcacaggaagtggaaaatcagaatgggttatacgttttttgagaaatgtggatgcccgggtatctaatgggccaatcaatatgatattttattgttatggtgagtttaaccacaacattgcttctctccaaaaaatgggttcgattggaggggtgccagtgaacacccatgcaggggctcccggtgaagaaatagtaaagcaaaaggctcgggatgttggaggaaaattgttaatggtattggatgatctaatgattggaattggccaaaattttttggacacaattttcacacgaggctcacacaattggggggtcagcgttgttttggtgactcagcacatgttcacgaaggagttgcgtatcgccaggaataattcgcactacctagtgttaatgcgtaatccagcaggagctttacaggtacgtaccttagccacccaattattccctggacgtgctgagcattttatggaggcatacagggacgcgactgggaaacagtttggctatcttgttgttgatatgcatccagaaagtgaggatttgttacgactgaaaaccaatatatacggagaaaatatgggcggagcatccacaatttatgtggcaaaatgagaaagggcagcagcagcagctcaaataacagtggcgttcctatacaaataggcccgctaatacacaaaaatattgattttctaagcaaatttaacgcaaaaacacgtgcttttcagacacaacgacgaatgttacagggggcgacaaacgaacaattattatgttttgttgagatatgtctgaacatattgaaaggaaaacttccaataaggcgaaagtcgcatttgcgtaaattgggcgcaataaagcattggttaagaggtctgtcacgcactagatgcgcaaaaagcgcaagaagaatattgttaaatgctccgtcacaagtcgggtctggagctcctgctattgcgggactattagcaagtattttggtgccaatgttgatagaaaacataataaataaataaacgattaattgaaataagaatgagtaattaataataataataataatgcggcacacaatgcgtatgttcctcgtccctgaggatttgtttaattcagtgataaattcttcaaaggcaccggcagatggaacagcacttggtcttgtccgccagcgtctgcaccaaattgagcgaaacagaaatatggatgagaatgaacgcttagcgaactatcaccaagagtttaaaagactgaacaaaattgtacgagaacaagaggaacgtccaatggatgtccgattacaaaacataaatgaaattatgagcgccattcctccccctccttcacctaatctatctgggcctctacagacttttcatcctcctcaaaacacgggaaccaaaacaaaatcggtagcatctactaagccgtttaggatcgtaaataaaaggaaaagcataaaagagaagttgttgagaaaaaaagcaaaaaaaagttattttaatactaaaaatggtgatgagaatgaagatgatgatgatggtgaagatgatgaatggggacgtaattcagcagaaaaagaggatcaaacgatgcgacaacaacaacaaacatcatcatcagcctttccttataaattaaggtcgggttccgccgctgagggtgaagaaccacaaaaaggcactaaaaaaagcaaaaacgcaccgaaccaaaaactcgtcgcaatattagagcatattaaaaagaatgcggaagccctaggtgttactgcggatgggaagattttgagaagggtttcaaccagtgaggtagggtcacaaacaccgtcaacatacaaaacaagtaatattgaacaaattgtgtcctatctattgaaccagaacatcagcacgggtatcgctcgctttaaaaattttccagttggattaaaagattttttggatagagcataccaggatgattatcttaaaacaaatttggtttccgacagaccttatcagtttgggagtggagttgggagtttaattggtttcaaagagaataaaaagtgtgaaaaggggataaagagttttgtcaattttaagccatcattatggtattagaaaaaaagaagcgaaccattttggaccacctttacaaagatataaattcgccggtcagctatacaagcatggttccattgttgaatgaggcgcggaaaacaaacagttcgatcaagcgcagggatgtggaagaatatttggctgaacagcccagctacactctgcatcgtcaagctattagacgattcaaacgtttgcctacgcttgcttcgggtttgcataccgattggcaagccgatcttgcagtttttgaccgtttagccccacaaaataaggggttccgttatttgttggtttgtgttgatactctgagcagacagttgtttgttgagccagtaaaaagtaaaaaaagtgaggacatggttcatgcatttgataggctgtttgcccattccaaatatattccatggaagttggtaacggaccaaggcctcgagttcaccgccaaacgcatgcaaacatatttcgattcaaagaatgtcaagcatttttgcatgtacacgtccccacaatttcatgctggtatagcagaaagagcaaatcgaacaattaaggaacgattatttcgttattttacggcgcgtcaaacccaacgatggttggatgtcatccaggatattgtgaatggaattaaccattcatacaattcatcaattcaaatgcgcccagttgacgttacatttcggaatgcggacacgctaagagagaaattagccaatgaggcagctatgagtagaccaaaacgtctgcctcgtttccatgtaggggatctggttcgcattgaaaaacataaacatgtgttccagaagggttatgttggccgttttacgagcgaaatattcaaggttgacagtgcggatgaaggccgttcacctgtcacataccgaatcagagatgcggataatgaactgatcaaaggtcgtttttatgcttcggatctatgtcgcgtccgcaaaaacacccaccaggatggtgaaaaattatatgacattgagaaagtgttgaggaaaaagaaaaaggatggggtagagtatgcatatgtgaagtggaaaggttataacaaacagcataacagctggattccaatcagttcaatcacccataaaaatatataaatatatagggaaaaatgataaatcaaaaaacaaatgtccaccatttcgtcaaattctttttatgttgttgttccctcgaacacgaacgttgaagggaaccggacgaactctttccgtgtgcgactaccacgaaaaatacaatttaattcggaatgggatgtgggcctagctaccataatataccctcactcatggccatcattgggcaccactgaagaccagtttatagagcttgaatggaaaaccggaaatgtggtgaccatcccagtcccatcatcaaacattatacgcccctatgagttgagcaaaagtttgtacagccttttggatattagtagtgagcatttgtctaaccaggttcacgatgctcagcaaagctacaaaagagcaatgaacgcggcgcgaaaacatgcacagagagagtatttgaacatgaaaagtgatcttgatagagctaggccgaaaaggagcaaaattagcgctggtgatgacgctatcccattgttgacttcacttctggtcgctgtcgatacaattgcagatgcactcatatacaatgaagacgggacggcaaactctatgctaactgctgacgcattgcttgatcgagagaagcgtgcagcaaccagcaatgtcccactgcgaagagacagtgatagcgatgaggaatatcaaaaaaaattggataactattttatgaaaatacgagacactgatgatcttcagctttatcgagagttagttgccaagcatttggagctggagttgaacaaattgactaaagatcagctctcgctcaacaactcaatcaaggaccttggaatggatgcttggattcaggcctacaggaaagtgagcagcgtattacaattcatttttgacgttcaacaaaataggttcacattgtcaatcaataccaaatttattaaacgagttaagctttcggaacaattggcctacattcttggttttgctccccaaaccgagttcaagcgaagtaaaaatccagcaaaatttatgccagatatgagtgggggagtttccacacttcatgtttacgtccccgacctaattgtgccaatgatgattggaaacgttatagcacctataatgcgcattacaacaatacgtggtaatccggatgaaatggttgaggaacaattttattcaatacaatatcaccgtgtgttgcaaaaagaaatttctgaaattttggtagaaattaggacttcaagcggtgcgcttatgccttttcagtatggaacgtgtacattaacacttcattttcgaaagtcatcatatttttgattgcgaaaaaatatgaacactgtggagcttaataaaattctgacaagaaacccggccactaggtatgcctatcgtggctgctttccagcggataaaattatgttcagtccacgctcaagtttattgccacagtgttttgtggctaacattgataccagtgatatgattggaactcattgggtagcattctattgtgaccggattggtcgtatcgagtattacgattctagtggtgtttggccaccgatcagtgagcatataagtaattttttatcaaaattcccatcagttcgctacaaccgggtccccctgcaatcaccatacgctcgctcttgtggtaaacatgttatttttttcctacaccatcggtgtcttcagtgctcatttgatgaaattgttcaacaattatggctcgcaaagcaatcacctgacactattgttaacacctttgcacgagaaaagatctttagaatataaatagcatgaaaaaaatatatccaaatacagcttttttggccccaactaataaaagcaaaaaaatgcatatcgattttgacccattaaaggttgaatggtctactttcccatttcaaaattcatcgtcatcagaattggtattcttcaatcaatatggtggagcaggggttggtacttataatatttttcacggccaaccataccagcgcggtaatggaataggggcagtgttccgcagcctaatgcgttatctggtcccaattggaaaggaaattggtgcaacaattgggcgtcaagggctcgagtcgggcaaccgtgtcctatccaatgttctggagggcaaagaccttaaagagtcgttgataagtgagggcaaggtaggactcaaaaatttgcttgagaaggcggccaacaatgtgcagacccaaaagggaaaggggtttgatttcaagcgatacgtcaaacctgaagaggaagatgctttcaaaaaaaggattggtatcatgaaaaagggcaataaatctcgtaaaaaagatataaataagctacaatcgagcattgggcctcctcaattgctaccagcaccatctagcgtaaaaaaaaaggaaaagcgcaaaaaagacgcattcgcaaagacatttttggcacatactaaactaattgtcgccgtgactaacccatagatgagttgcccgcaaaaaataaatgaacagagcccattggcagtaaacagtgccctcaatattttttccacccctcccacaaatgtgtcggtagttcgttcatttttccgtgaagttctaccgcttgttacaatcacacaggagtcaccctatttgttcaggctgtacagtgacaacctttggtgtgacctttcccgtatctacctgcatcttgaactttcaatcgaaaaaaacaaagacgataattgggtggaaatcagcagcgtagatgaaccactggttggagcaatccagggtgttggccaaacatttactcaacaacttaaagtttcggtaggcagcactgaaatatatgatagcggaaatttgtatccctacaagacatatctgacaaatgtgttgtctttttcgaaaaatgtgaaaagtcattttttaacatccaccggcttttaccatagcgaaaagcatgacagtgagaaggacaaaggcttcaaagaacgttgtagtcaatttgaaggcggaaaaaaggcacagtttctctctcggttggattttgatttgggcaaccaagaattgtatctgttgaacaaccttgatctgttgttttcaatttataaggcaaaagatagtttcctcattcataccctgaaggataaagacacccaggaataccgactgcgcgttcatgatgtcaaaatttatgccaagatggttgaagtccaaccatcactaaacatgaacatacacaaaatgctcgaaaagcaaccagctacctacgcggtgagaaaaacggaagtcaaatctacgtatattagtggggggcgctatgaggtcgaatacaatgtgttcagttcaacgatacctcgacgtgtaacaattgggctggtggaatacggggcgttcaacgggaatccaaaattggacccttttaacttcaagcactttgacataagagacattgcggtgcacgctggcggtttcatatacccaatggtaccgtacaaattggctttcaaaaaggaagcatttatgcgagcgtatgttgatttgtatgaggcgctcggcatggcaaactcagacagatcttgtgatattacgcgccagcaattcaaaaatggatggacattgttcgtcatccccctcacatcaacactggatgacagtgtgggctatgaactgttgcgaagcggcaccacaaccatacgtgctagcttcaacacagcaataccaggtggtggggttgaaatgattgtgctcggcgaatttgatcaaatgataatgattgactacaaccgtcatattgtttcagactctaaactgggttagtttttgcctatacaaatatataaatatattggtgtgtgtaaatggaagtcgttaaatgacaatgaacattacaaccaacacgacaaaaaaaccccttgtccaaattttgaatggatatgatgttgatggaccatcatcatcacttgaaatgacaaattttgaaaaaattatcttattttttggtctctaccttataatatttccgatgtttcttctctgctggttttcgttaattaattttttaaagcgctttggccatattagtcaaagtgaagcaaacggtatggtcaatggactgcaaaacatacctttaccaagaatacgatagtttacaagggaaaaataattctgaatgttcatttcatcattatcattatcatcatcatcatcatcatcatcatttattagtcagaaagtgtctgctcaaacctgaaggaaaacaatcattagcctgtagaagtggggtggtatttaccccacaaacgcataaggtcccatgctttccaacaaattttcatgaactgatttgagcagtgcctctctatcattgttctcagttgggcatagtgccaagaacgtgacttttcgctgatttcggcatatcatcaatacacattgcagacgctgggtaaaagcttttagaaaaaacaaaattgctgttacatcttccacacattgtagtttatggtggtacatctctgttaattaaatttatctcaaaaatgctacaaaaaataaattgttcacattgaacatttttttttcataatccagaaaagcaaatcactattttttaaaattattcggatcgtgcaatcttctccttcgagcctcccgcaccatcttgatcctcgcccgtttttttcgtcgtcgtcttgtaaaagcggttgaccacccagtcaaagccagtaaaactttgactgtcttcctaagagaaaaaagaatagaggcaaaaaaaaagttttaaaaagactactacctttatcgtcacttttgcagtaatcattgaccctaactttgcttccaaatgtgcgtatagcaccttgtcttccatttctaccacctgggtcgccttcaaacccaggaaagtctccgccacctggtccacgatttatcaaatgtgaaaaaaaacgaggaacccaaaccgcggaaaacatggttgcacgctgcgtgcagtcgctctcatcaatatcttgcagaacaactcgtaggtaaatgttcttgattggcctatcaactttttgcccgccacaagattcacaaatgtggttttcgggtagctttcgacgacagggaaagccccgcattcgcagaggacatgactaatgggccaaaaatgaatgaaacgaaaaaaggggaaaagatgtgcctacatcgtacacttggtactgtaaatcagcaactattgccccaatgtaaaaagtgccagcgcctgcgaagcgaatcacttctcgcaaatttttggcactttccagctcctcttcctcgggcgcggggcgtttggcagggatttgaaagcgggagagagacatttattttaataataataataataaaatatttatttgaagtgacaaaatttgctgaatgcctgttcttttatacaccccccccccccgatcgtagaattagtctttgatttttgcgaataaaaaaccaaaaactaaaggctaaaactttatgcagcactttgtatccatctatcccccccccccgcaaaagtgagaataaagaacaaaaactagactataaaagctttacgcggcggaggattttgtgttcactctacgcctgcggagcctgcgtaggggtctgtacgcggcggaggacttttgtcttcactctacgacagcggagaaacttgttcactctacgcggcggagaacttcactctacgaggcggatgacttcactctacgcttgcggaggacttcactctacgcggcggatatacgcggcggaggatttcactctacgcttgcggaggacttcactctacgcttgcggaggacttcactctacgcggcggagtacttcactctacgcggcggaggacttcattctacgcgacggaggacttcactctacgcggcggaggacttcactctacgcggcggaggacttcattctacgcgacggaggacttcactctacgcggcggaggacttcactctacgcggcggaggacttcactctacgcggcggaggatttcactctacgcttgcggagga

SEQ ID NO: 12 - DNA, 2582 bp, Heterodera glycines
  misc_feature (171)..(171): n is a, c, g, or t
tttttaaagcgctttggccatatagtcaaaagtgaagcaacgggtatggtcaatggactgcaaaacataccttaccaagaatacgatagttacaaggggaaaaataattctgaatgttcatttcatcattatcattattatcatcatcatcatcatcatcatcatcattanttagtcagaaagtgtctgctcaaacctgaaggaaaacaatcattagcctgtagaaggggggtggtatttaccccacaaacgcataaggtcccatgctttccaacaaattttcatgaactgatttgagcagtgcctctctatcattgttctcacttgggcatagtgccaagaacgtgacttttcgctgatttcggcatatcatcaatacacattgcagacgctgggtaaaagcttttagaaaaaacaaaattgctgttacatcttccacacattgtagtttatggtggtacatctctgttaattaaatttatctcaaaaaatgctacaaaaaataaattgttcacattgaacattttttttcataatccagaaaagcaaatcactattttttaaaattattcggatcgtgcaatcttctccttcgagcctcccgcaccatcttgatcctcgcccgtttttttcgtcgtcgtcttgtaaaagcggttgaccacccagtcaaagccagtaaaactttgactgtcttcctaagagaaaaaagaatagaggcaaaaaaaaagttttaaaaagactactacctttatcgtcacttttgcagtaatcattgaccctaactttgcttccaaatgtgcgcatagcaccttgtcttccatttctaccacctgggtcgccttcaaacccaggaaagtctccgccacctggtccacgatttatcaaatgtgaaaaaaacgaggaacccaaaccgcggaaaacatggttgcacgctgcgtgcagtcgctctcatcaatatcttgcagaacaactcgtaggtaaatgttcttgattggcctatcaactttttgcccgccacaagattaacaaatgtggttttcgggtagctttcggcgacagggaaagccccgcattcgcagagggcatgactaatgggccaaaaatgaatgaaacgaaaaaaggggaaaagatgtgcctacatcgtacacttggtactgtaaatcagcaactattgccccaatgtaaaaagtgccagcgcctgcgaagcgaataacttctcgcaaatttttggcactttccagctcctcttcctcgggcgcggggcgtttggcagggattgaaagcgggagagagacatttattttaataataataataataaaatatttatttgaagtgacaaaatttgctgaatgcctgttcttttatacactcccccccccccccccccgatcgtagaattagtctttgatttttgcgaataaaaaaccaaaaactaaaggctaaaactttatgcagcactttgtatccatctatccccccccgcaaaagtgagaataaagaacaaaaactagactataaaagctttacgcggcggaggattttgtgttcactctacgcctgcggagcctgcgtaggggtctgtacgcggcggaggacttttgtcttcactctacgacagcggagaaacttgttcactctacgcggcggaggagacttcactctacgaggcggatgacttcactctacgcttgcggaggacttcactatacgcggcggaggatttcactctacacttgcggaggacttcactctacgcttgcggaggacttcactctacgcttgcggaggacttcactctacgcggcggaagacttcactctacgcggcggaggacttcattctacgcgacggaggacttcactctacgcgacggaggacttcactctacgcggcggaggacttcactctacgcggcggaggacttcactctacgcggcggaggacttcactctacgcggcggaggacttcactctacgcggcggaggacttcactctacgcttgcggaggacttcactctacacttgcggaggacttcactctacgcttgcggaggacttcactctacgcggcggaggactttgtcttcactctacgccagcggaggtacttctctctctctctctctcgacgcggcggaggactttcactctacgcctgcggaggtgtatcagcgtgcccggggattgaacttccactgacaaagtcattatccaatacactacacgggccgctgacaaattgcaatgcaaataatatttcaacataatttattataaaaaataattttccccgtttttttaaatgaaatgggcaccaatttcacaatatgaataaacaattaattagcgtttaagtttgaataagtaacaaattaaaaaaaaatttacacatatattaaaaaaaataaattttttaatagtggaatggatttcaaattcatgatattgaacttttacaaatgatccacccccccccccccccacgaaatctacagcacttgccaacaacaccttttttcttaccccctcttttcgaggccacattcactccacttggggcattaattccattttgact

SEQ ID NO: 13 - DNA, 3302 bp, Heterodera glycines
  misc_feature (3184)..(3184): n is a, c, g, or t
  misc_feature (3274)..(3275): n is a, c, g, or t
agaccagaaaactatgcagaatataatgttttagcaaaactttgcagatatccgattattattcaatacggaaaaaagtgataaattcaatattcacattgttttatagtgataatgacagagtcagtcaaaatggaaatagtgcccacacggagtgactgtggcttccaaagaggtggccacaagatgttcttggcaaatagtgcaaatttcttcagctatcgcctcatcaacttcaacaacgggaaatatttgggttaattcggtgcgcgttagccctggcggcggcggtggtggaggaggagatcgtgcaagatgacgattacccatctcaaaaaaaaacaaacattttctaatgaattcccttttttaacatgagaaatttattcaatttactttcacagaatcattaaaatttacttaaaaaattatcaattcaccacatttggccttccttgccctccctgccctcctcttcctcctcctcctcctcaacctccggaacgtccaccattcctagtaccattgccacgcagaatgtttggacatggggtgggtcgtcgcgtcagctaattgtttttattttttaattatttgtttaaaatctgttttgtacaatttgttgactggtcccctgtaccattgatggatcaagcccattgacgcccccaccaccaccaccaccaccaccaccacttcgaccagaagtcgaaagtatgcccggagcagcttcttcctttattattattattattattattattattattattattattattattaatattattgataatacattttctccaattagcctaaacatatcatccggttgctgagccggttggccctgttgtgtttgaagcacaggtggcggtgcttgtggcatttgaaccaaaaatgactcaaattgtgccgttggcatttgtacattcattggcaaagtttgctgctggacagcgggctgaaccggtggctgtagctgaatttgctgttgctgctgttgatttggcacagtttgctggggaggggggggggggtactcaattcgtacaaaggctagtacatcggcaattctcagtgatcaaataccatacaaatttttttaaaaaatgtctttttaaaaaaaaaattttgaaattggaaaataatcttttttaagaaaataaaaaaactgaaaattatactttaagaaaaaaattaaattaaatttttttttgtgtaagagttgcctttgtacaagttgccacaacattctactacaacaccatctgctgctggtgctgctgctgctgctgaaccggcaatgtgtgattcaacagaataggcattgtgttttgccacaccgtcgcttgctgctgtgttggttgctcctgctgaaccgaaacgggttgcagctgtgttggcatcgtttgctggaccgaaactggttgcagctgagctggcatagcctgctggaccgaaactggttgcagctgagctggcatagcctgctgaaccgaaactggttgcagctgagctggcatagcctgctgaaccgaaactggttgaagctgagctggcatagcctgctgaaccgaaactggttgcagctgagctggcatagcctgctgaaccgaaactggttgcagctgagcaccaatattgcgaatgaacaatggtacctgctgctgcttttttttttaatatcccaaaagttataatccgatttttttgtactgccccaaaccctgtatttttggtgcgaaaaaaagggttaaacaatattacgattgtaattagtttttttactaaaaattttgaaaaccaaagcattagtactgttgaatttttaaaaaaggggggttcaaagggcagtacagtattttaaacagttttactggaggccgctgtactggtgcgtttgcattgacttgatttcgctgtgtttgccttccccgccgccaaaaaaataaaaaatttatttattattatattttttttcttattcaatcatatttttttataagatatgtcagaaaaatattaattgtcttagaatttaaatttaaaaatttttaaacaatttaaaatttttaaattaaaaaaaataaatgaataaaaccaccgtcttgggagaaaatgtccatggcgaggatcaacaagatgaggcggaggtggaggaaattgtactgtccccaaatactgctggtgtacaaatggccatgggacttgaaattaaataaattttaaaaaaatcccgggcctcattaacttttcttagttagacttataattttttcattaattctctttatgggggggggggggataataatttaaaacaccttgcgcacgctggataggacgatgtagacgctgaaatgagtccaaaaatgattattcaagaataaaacaaaactatgaaaagaaacgaaaataatttcaaaattattaattcgatcgagaaattttttaaaaaattaaatttgtgcttttttcacctgttgtgccctccactgccttctgctgatgctatttggcaattcatcacgccaataccatggcatttttaattaggaaaagacagccaatttttttttcattaattgagaattgtttattttttatttttaaattaattttattttcattattattatttttaaattaattttattttcattattataagtctttttttattaatttagaattgtttattttatttttttttcttcattattataagtcatttttttattaattgagaattgtaatgattaaaaattaaaattaaaatatttagcaatacaattataaaattatatttttattatttatttgcttcaattaaaatattattgtgaatcgcctaataataaaattggccagaatgatttcgctcctcaataatataaacaatttctgctgatttcgtttttttaaatttttttttacttgatcattttccatcaatcccccccccctccctttcaccccgaaaattgtttatgccctccaaaaaatatcgtttatgttttcctctccctcatctcaatccccgcatttagtcaaatcaatgtatttaaaacttacgccaataatgaccccatattgccaagtggttagtgcagtggatttgaattttccatcgggatttagccctttagacgcggtggtatttttgaagaatttttanaattcgaagattttttaatttaaataaatttcaaatattttaaaatataaaaaataagacgcttaattcatgaaaaaaaattctcgcgcnnaagtcataatagaatgggataacgaaa

SEQ ID NO: 14 - DNA, 2720 bp, Heterodera glycines
gaagttcccctcggcccactcattttcctcatcctctgacaattccctcgccgtgccgtcggcgttgaagaccaaaattccgcttcgtcctcctctggcactctcgtcggcaccaccgaaattgccgacaaataatgcaacctcctgaatgtagcggcctattggtcatttatatattgaagttgagcaaggcatttaatacgagaaagaaaacttattgcagtctacaacgcaactcaggctgacgtgtaaagaaaaccgaaagtcaaagaaagagctgaaaataattttcataatattttggggttaataaattttaataatgcaaaataaataattaactattgttatgttcttttttaaagctgaaatggttttcaaataaacaataattttaaaacaaaaaacaagcaacttttcccatttgataaaaataaatacacaaaaaataaattaaattttaaatttttgttcatttctaactacttttaatacatatcacatttaataaattcctttaaaattttctaattaaaaaatatttaatccagtatttttcatttttccatcaattaagaggcgcttctcttttccatttctgctccgcagctatttttttattagcggtgacttgtatcaccgtggctggcagaaatggagagaacaaaaaaaactgtttgtaatttgtttattggacaagtcttttttcaaatttaatttaattattaaaaaaatacatttgtattttgtacttgtaattttagtaccggaaaccatgtattttcgctttttccagcatgtttaacaaatgtgatttaataaatgaaaacatacattttctggtaggttttacgattgtacctaaagtactggaatgcacatttaccggttttgttttacaactttgattttgtgcgggaaatgcacattttccgttttgaacttaaattttagtttttttttcggttacgtttttttttgtattttcaacaataattttactccgattgcgttttttttgtaaattaaatttttttaacgttttttcgaaatttcattatgaattactacttttttaacaaaataaattatttttaaaaaattttattgaaaaatttctatgtttgaattatgctcagatgccgccgtcaagcagataaaatattttttgtaaattatttaaattttttcatacgagggttggcgaagaattccctttttttgtcagccagcgccagactaaaatttttgaaattttcctgcattttgtgcgtttcgttgtaatgtgccttcacttttgcctgccattaacaggtaccattgagctgtttgaggagttaactgtgtgcaagacgggtgatcaactgtccgcggaccaggcccgcattaattttaataagtatgccatttattttaaaactcaagaatgataattaaacattcaaaatgagaaaatacttaatctaaattgaaggtcagtaaaaaataattgaactcaaataaatcgttcattgtttttgccattggtttaagtcaattttaattcaccagacaagtgcatgaatttaaactgcttctgcataaatataaaactattagaaaagttgaaaaagaaacatgattcaatcaaaattaagaaatgaaggtcagtaaaaaatataattaaatataaaagaaaaaaataaataaagcaattcatttttcaatgaaattgattaagctcacgaaatgggttaagaaaaatattgttaaaattttacaagttcatttaaatttatatttatattatgtaataaatataaaaacgaaaaattaaacctaaagaatcggcctgaaaatttacataaaaatgcagctctatgaaatgaaaagttttctaaaatttattattttattttcttgacaagaaataattttatttttttaattacagccccctttcttcgggattcaggaggttgtactaaaccttgaaattgtgagctacgattgaatagaaaatgtaatttggatttgcaatttttattttttattaaatgttttttaagtcaattttttcaataaaatatcctttatttaaaatatcattatgtagttatgtaaatttttaatttatatttttttttgataaaaagtgatttggaatgaacaaagatgtaaaaaataatctaaaaaatgcattgagacgtgtgaaacttttgatttttaagctttgataaacaacctttttatttatttcaatattccttttggtttataattttgcttttttaagctttgaaaacggcgttcttgtgccaaaaatgttaccttattatttcagtttctgcattaattagcaaattttgagaattttgcgcttttaagtaactaatgcactgatgattgataaacttattaactagcgggtgtgtgcatgcgagggtggcgcttgggaaagcgctgcgcgcttcttgagcttcgctacctaggcgcgttttagtctgttagggtctttgcgtcagccgacatgcacttggtttcctccaataattggagttgacacatcgcataatgcaatggaaaccggaagtgccctaacgttgcacgtcatggccctcctccctcccttagtccaggcgttggcacgttattgggttgagcgctaaatggcaattcacctgtaggccctaaagagggctgaccggtccatgtcccggatccaagcttctcaccatttt

SEQ ID NO: 15 - DNA, 12641 bp, Heterodera glycines
atcagctcttccttgctcttaacgaggaactgccgagcattccagaagtgctctccggtttctccgagcccaatttggctgcacatttgcaagtacgcttgctgacctttgcccaatctctggttgatggtcaatttcatcgtggtgaattgaccaaacaatggagatgtttgaaaacaggctgtcacctgagcggttaagccttcatgaggcacgaccggcagcgactgtttgaagtcaccgctgaaaatgactgttttccctccgaagaggagatccttgtgctggcgaattgccatctctttgcacactcggtcgatgacctcaatcaccgtgttgtgaagcatggtgatctcatcaatgatgatgagttgggcctcacgaatccgacgggcaaagaagctctccagcggaatgcttgggagcttgtctaatgacacttctctacccagacgaaacgtggaatgggctgttttcccatatggcagcaaaatggctgcacacccagtggatgccgtggcaagcactttgtaggtgtatggggcctttcgcaagcgcctaataatttggccaaacaggaatgtctttcctgtacctccatcgccgtatatgaagaaacggcgggggacagtcggatccctagggttcgactgtattgccaacaaaacagcatcaaagaccttctgttggtcgctgttaagtgacggaggggcatttggctgtggacgaagatttggttgccctggaggcaaattcaaatcatcatcgccaaagaaaaactcttcaattgccgcgtcagtatttttggcaattgagtttggcgggtctggcaggccaaaatgcacacagcttaagttaaagcagctgtgcagccgccaatcaaggtcggctagggcttcaagctctgctgctttatgctgtgccggagtaataatgccttgcggattgtacatttggtctttgtacttgttccacaattctatggcattactcggctggccatagaccatgatgctcacaaaaagccatctcatctgatctggccagcgcgacagagctgcctccgccagagttttgtcccaaattttgccgtcttcaagaagaccatgcattattgcagcctcagtgaatgaggtacaaagcaacccattaaccatcttaagatgatctggatctccaggaaagtgacgcataagtgaatagagcgcgaacctttccgggtccgatgggggtacaggaacaattcggccgataggtggcctttttatttgctgccttttgtacaggacccatttgtcctttgcccatcggaactgctctgggactttttcaaaaagaatgtccttaaactttgggtcattcttccactcattttgccattgtttccaatatgctgaacactgcgtttctggcagttcgccttgctggatttgttgagctttgctcaccagctggaatgccctatatacaatgggctgttggtttggcaaatgaattgccaatttgacaacatgatgcgaaagacgggcaaatggcattgaatgaacaatggcatatgcttccgttgcaccacggaagttcatcttggcatattgagccggctcgtcaattccgattttattgccggactcttctttgcactcgacataacaatgtcctggccctttaaacgggtacttgagtgcgtacttaatattcgctttgttaccatatgcaaacagtacattatggtgtactcggtaacgcagcagaacataaggattatacggcacgacatgtgagttgtcgtatattaggccgtttacctctaattgggcaccaccatcagatggtgaaggccggaaatacatcgcgggcctatccgggcgtaaaacagtacattttgagtaaggggctgggaaccccttcttgcaccgcccgtaaattgggtcgctaggaccacaccaactgtcactgcatctgtgcagttgcatatgcattgtttcgcggatttcgcgatgaattttcgcaatgggcgtgtcgtcatctttatcgggcaaagatggaatgtgcgcccatatgtattcctgaatgacatgtggtactgcgtccaggtcagtttgggcaacaatgtgagcgtgtgggcctcctcgaccttggaactccatggattcaccatatccaaggattgttccaaagaactttttctcataaagttcttctcggaactcggcgatgttgctggtccagacacgcatccacatgtcaaaacggtcagtaaatacttgaccatttttatatatattctctttgaactcaggccattccctgttgttcgtgaatgtgatgaagagacgcgcctttttcgcgtcatggcaccgtgcaaaaacggtgttgcaatcctcatacattttcttccaatattggagagaatttacgttgtgctcggacagccgaacaacactgccaatgtcatcaacagttttctgttgggcattggggttttgccgtgcttgctgcctgttgtattggttgaccaaatactgcagcaaattttttggagtgctgatccgcaggtccatgtctggtctgcgcaaaaatgtggcgacttgccaatcaatttttgcagcctgatcaaggatccagcgttggccaagtcctccaccacatgaaagaatgtggtggtacttcaactccacattttcgtcccttatggcgagacgatacttgcagtaatctcgcaatgagataaatcttttagatttgtcaatgcgtccatacgctgatgaagcagaagctacagattcagcatctgagtctgcgactgacccagcatctgatgatgcaattgactgagtctcgcacgactcattatctgactcggcttcagagtcaaataggccagatgcattctgagcaccttttcgcttacgcgatgatggcttagcatatttaatgccagttgtgtatccatcatctcccaatggtttgattaatgggtacgttaggctgtcagtccacggactgaaaggagcaatttcatttaattgcccttgtttgttctctacccaaattcctttgggcggaggtgcacccgtagggtccgcatgaatagcgaacatcccttcacccgtagaaggggtgattatttggtgtgggtgcaattttgggtctttgaggccagctggagctctgcgctcattcaacaaagtcatacggaagaaacgaagctcttcctgattttgttgttggagaagctcagtgagctgctcatgcgcctgcttatatgcttgcgcagcaggatgatgcgcttggatcatttgctccaagatctcaagggtcttatcattaagttgatgaccttgcacaaactcttcttcgtttgtgattttttcacccgtgaatgtgggatttttccgtcgttgctccatggcttcgactgggtccagaatgtacaactgaccgaagccaggaatctgggttgtgccagcctgcatactgcttatgcggcgatggaactctccattgagaattactgccattggtccgcctgccggacatggcttattgccagccgaaacactcgcaaattggagcaaattgttgtaacgcgacatatgtcgcacaaactccttcccttcacgggattggttttcgtccacaaggagctttgcaagctcttttggatgtgggttaagctttggtaaaacaactcttccctgtcgacagcaaaggctgctgttctcatgcgggaagagtagtgctccacaatgagagcactttttttcgccaagcctaccagaatctgtgtattctggataatgctttgctgctgcggcagcacagcaccaacccttgtgcacaaggtgacaccgtttagtgagcggtgtaacttgtccaggtacattttccgatgtgcgacgcttcggtgcaggtgaagaagaacggctaatcgaagctgattgccgtctacctatgcgcactgatcgccttggaggcgtcttaggtctgacaaatattgcatcgtcagcctgcgcaattggctcttgcggaacgcaagattccgacaccaaaccaagcgtgtcagcttggttttcacctgccacttggcattgggtgagaattgcattagctgcctttccacttgtctgtggttcgatgatcattatgtcatccggctcatctaattccattggctcagcggccttggatgtcgactgcacctcatccgcatgtagatagacaattgggcaaggagttggtaccccctccctcggatggtatggcacattatcagagccatacagctcattgatgtgccacaaaatgcgctttttttcataattgatggataaatctggcagaacaaatgtgcggttgttcataagccaggattcagcatacaggcacacaaagtacccgcagctatttccatcgtgttggaccgtcagatttacggcattaaaaatcccggtcaacactgttgacggcaaaatgtcagaaatgatctttataattttgtccgtcagttgcacatccaatctgccatatggggtaggcaaagagtcggcaaaatgagtaccgcactgaacatcatggacaatgagagtccaatgtccagggaaatgcaatggcaaaagtatgacttctgccgggacattggggtcatacccaaatgtcatatttttatattcaatgacacggtcaatgcccatttgccacacagctggatcaacaacgaccacttttcgctgtgatatgcttgccaagtatgccaaatattcgacaataaaggcgtcattcagaaactgtgccagatcattccagcacgtttcaatgaatcttgggcctgaccttcttgcatcgcattcgtaaagagcagttgctccccatttccaaattttacaggctaaattccgcgtggttgcgaaattaatttgcactgtgctgaaatttattttttcaggcacattgggcaaaaccgccgcatttatgccagcttcagagctctgatccattgaagagctttcgcccatggaatcattagctttgcccctgcctgggccacctcttttcttagccggccgccctccactcctttgcgtggaaaccggtgtcaaagcaattgcctcaagagcagatatgggtcgatcaaaatcgtcgatcttcccttttttgttgcgaggcgatgactcatcattttgagtggccgatgcaatttgtgtgccaacggatgacacactgttttgcgaagccctgaatggctccgctccggctttcggaggcatactccgtcttttacttccaatggaagaggccggggtgcttaattgcaaagcaccaatattgggcgtggtggtgcccgggtgtgatgccaccccattctcatctgcacttccgtctgggacgggtgagcgatctgggctgacagattgctccatctgccgctggtaccgctcttgccttttcgctctcaaatttcgtttatttgaaggcatctgaaaaaacaaaatgactcttccaataaaagatggcaaaaatatgaggcaaactgaaccataaatgcacattttaatcaaacatttattcagattggcaaataaattcaatctgacatcattcttcgtcatggtgtgtagtcgtcccgctgaatccatcagccatggatcggctcacatatcccattcaagagtgcagaaagtgcgacacagcctcgaaggccagtcagcgaaccatgttggtgcgacatatgccccaaagggcctgtcagcgaaccacattggtgcgacatatgccccgaagggcctgtcggcgaaccgcattggtgcgacaatgccccgaagggactgtcagcgaaccacattggtgcgacaatgccccgaagggactgtcagcgaaccacattggtgcgacaaatgccccgaagggcctgtcagcgaaccacattggtgcgacaatgctccgaaggagctgtcagcgaaccaattttattgccctttgttcgcgccaatccctaaatggccaggggcagggaactccgaacaacagacgcgttgctgatgaacagaggacaatcccaccgtagccaacctcctgtttggaaaatgggacctccaaacaattagcattgctaattaatcaaaggacaatccttttcacaaacattcagctgggatacaaggccagaaaatggcgctcgcattggaccgtccagccacatgcatcgcaagggcgagtgcaagtctggccgtcattttcatatcagtcaaatctgactgatatgttgccatggtcgcaaagcagaccggcattgtgtcatggtcgcaaagcagaccgacactactggctatggtcgcaaagcagaccagcctcgccatggtcgcaaagcagaccggcgtttgcactacatatcgtggtcgctaagctgaccgatacgttgccatggtcgctaagcagaccggcacgtgcacaaatctcatcatggtcgcaaagcagaccgatgagatttacaaacaaataaatgtgtgaatttcaaaatgggtataaggacagaagtctttacaattgactaccaatattcaaaaaattattttaatatatcccaagtattaattcaagtgtaaagacttcttaattctatttggggcttatgcgtgccaaagtgtactaaacttatttcctaactaacctcagatttgggttagtaaaactatttaatcagcgtacactttgtcattatttagaatatatgtgctctgaaaatttttgcttgttctattaaattcatgaaaaatagatgaattttattttaaccggccaaacacagcaattgcctgagaatttcttcctttcacaaaaaatttactggatggaattggtatcatcccaacaatgttgagattttcgaaaaatcacaataattgattttcataatttgaaaattttttaaaataaaaggtttttcaacaaagaaaaatgtttccattttccatttttgaattgccgacaaaaatattggagcttagaaaacatttgaccggttaatttgaaaaaaataaacttgcgcagcaatccgcttgacgccattgaaatttgtcaaacagcgaattgaaacgtggcgaaatcagtgccaatttgaggccgggttcaaggccaaaagaggggaaaatgtccatccaaacatcgctagaatactaaaaataggatttgtttttgttaaagtaaagtcgatagagcgataaaagtttaaaaaaacgaaaaaaaaacaaatagtttgtgactctctttgtgagtaaattgtacaaagtttttacatttataggtttaaaatcaaaatcataagaaattcattcaagaaaaaaattgatttaaaatttcagaaattttttactttagttttttgccttaaaaaatttctggaagaaaaatatttttgaaatttttgcgacgagattttgtccggcaagatttctggcggtgagatttcggcggcgagattttgcctggttaccaaattgttaacaaattttgtcaaatgaccaaaattagcgctttttggaaaattttaagaaaaatagtagttttttttgagtgcgggcggcggtgacggtagtgccgcccggaaaattttttgtaccttttaagcaatataagaattcagtacataattgagttttcagatagataccctccaattcaggacaaatctgaaaaatcaggagctgtgaaccttggattagcaataaattgtccttcagcgtgctctttcttgaacttttaaaattttgaggcctagatccaaaaccgataaataccaattatgcacacaatccatcaaaaaaacttgccaaattcagaaaaaatatccgttttgccaccatcaatgcatcgaaagggcaaaagcagtgtcaatttgaggccgagttgagcaaggccaaaaagggtaaaatgtccaccaaacagcgttgtgcatgtgctgaaaaaaatcacaaaaattttataaaattgcaaaaaaaatttaaaaatgatttaccaaaacccaaataccgggcactttttattaaaaaaacgcggaatttgggaaaaatatttttgtcagctattcattgacttttacagaaaaaaacccaaaaattttatcgaatttggaatttcattttagagctatttttgaaaatttgggcctttatggttttggggctataaccaaaagaaaacttgccaaatttaaaaaaaagcaatgtttgtccaccaattcgaaacgtggcgaaagaagtgccaatttgaggccgagtgaaaagccggtcaaaaaagggaaaatgtccatcaaacaaacgattgttaagcagttgctgaaaatgttaagaaataaaattgcaaaaaaaaagcaaaactcctaaaaacgggcacttttacaacaacaaaaaccggatttggtttttaggcaaaaaccctttgaaatttgaggcccattttgccacaaaatccttaaaaatccttaaaaaacaattcacctttttgccatcgaagtgtttgtccaccaaatcgaaacgtggcgaaagaagtgccaatttgaggtcgagttgagtacagtcaaaaacggcaaaatgtccatccaaaagtcatcgcgaaatttctgaaaaaagtcacgaaaaacttataaatcacaaaaagaaacaatgaaaaaacaaaagccttttaggcaagatcctttgaaattgtaggcccttttttggcagaaaatccttaaactattcattgacttttacagaaataaaccaaaaaattttgtcgaatttagaatttcattttagagatatttttgaaaatttgggcctttaaggttttggggctataaccaaaaaaaacttgccaaattttgaaagaagcaatgtttgtccaccaaaagttcgaaacatggcgaaagaagtgccaatttgaggccgagttgaggacagtcaaaaacggcaaaatgtccatcaaatcaatacaaaattgttactgagaaaataaataataaaatataatcgatatttgtcgctgaaaaaagaaattttgttttgctctctagttatttaaaaatgggaaaaaagaatatacgaatttgttgaaatttattacaacgaaaaaacagtgaaattattgaatttattgacgaattgatgaattttaaaaaatatttaaaaaggaaaaccgaaacaatttttacaaaagtgattagaagaggtacaaatgtaatcagaagaggtaatacaacgggaaagaggtcaagatgatttaaaattaaataaataaggaaaagtttttataaaaaattaaaaatcggatgcattttaattcaaatttataataataaaatactcgttttattcattaaaaacaattttgaaaattaataagtgcatatttatttaatttgaaatgaaatgtacgtaagtgataagaagtggtacaacagtgatgataggatgtacaaaagtgattatagaggaaaacaatgatcagaaagggtacaatattgataaaaaaggtaaaaagtgagtagaagaggtacaactgtgattagaagaggtagaaaacgttgaaaattattaattgaatattttttaatttgaaattaattattttttgaccaattcaataaaaataatgaaactatttaatttttcaatgtaaaataattattaattttaaattaaacatttattcatcaaaaaatttttaatttaaaaaatttatttattattaataaaacaaaacaattttaaattaataaaaaccttgaaaataaccctaaaataaatagaaatataatgtgttgccgtccggatttgaacttgcccccacccccctaaaatgatgcctcagaatccccaatcacacggggattctgaggtcttgacgatgtcaaaattaaaatctgatcacttattcgtgatcagcatcataaaatagccctaaagacatgtttttggaagatttttggtgaaaaaattttttcaatcaaaaatcctgtcaccacctttggtccggaatcccaaaatcacttttatttttgtaacttttttcaaaaaggtgataaaaatgtaaaataaaacttataaaatagagcaaaaaattgcgaatttttgtagtattttacttttacagaataactttcccgaagggagttaagattttttttctgaaaattcgaaaatttccaaaatttctggaataacttttttcatattgatgctaaaaatcacaaataaagcccataaaattctcctgatttttctctattttttaggcttaatttcatgaaaattgtaccacagtgaactgatttacgaattttcaaaatttcacccaaaatcccttgggccaaaaaaatgaaaaataatttcgaatttttaaaaaattccaaaaaatctgaaacgtaaaactaacatcatattcgtgctcaggacctcgaaataccccaaaaaaatatttttcacccccattttcaacccaaaaaaaattagaagaggtacaaaagtgattagaacaacagtgatcagaagaggtacaaaagtgattagaagaggtacaatatggtttgaaagtaaataaataaggaaaagtttttattaaaattaaaaatcgaattcatttaaatttaaaaaatttttataataaaaattttttagtaattaaaaacaacattggaaattattaatggaatatttatttaatttgaaattaaattaatttttttacaaattcaaaaagaaataatgaaattctttaattaaaaaaaataaatttaaataattaaaaagaaatcttcaaattaattaaaaacagtgaaaataacgaaaaaattcatagaaaaataatgtgtttccgtccggattcgaacttgccccaccccctcaaaatgatgccccagaatccccaatcacacggggattcagaggtcttaacgatgtcaaaagtaaaatcagatcacgtattcgtgatcagcggtccaaattacccctaaagacatgttttcggaagatttttggcgaaaaaatttcttcactcaaaaatcctgtccaccccctttggtcccgaatcccaaaatcagttttatttttgtatcttttttttaaaatgtgataaaaatgtgaaataaaatttataaaatagggctaaaaattgcggatttttgtagtattttacttttccagagtgacctttcagaaccgagagctgaatttttttctgaaaattcgaaaatttccagtttttctggaataatttttttctaattcatgtagaaaacccaaataaatcccataaaattctccttatttttctctatttttaaagctttatttcatttaaattgaccaactcaatcatatgttatgaattttcaaatattagcccaaatttccttggccaaaaaattggaaaatattttcgaattttgaaaaaattccaaaaattttgaaacggaaaacaaaggtcatattcgtgctcagcaccttaattaacccctgaaaaatatttttcaccccaattttcaacacaaaaaaaaattccgaaaatttctagggggcctagctcggaaatttttgaaaatttccgaccatatatcacaccattcgatagcattttaaaagctctacaatttagctctaaggcattttttcgattaaatcaacccctaacgagttatgggcccgggactcaaatgtcccgctcaggccaaaaaatttttctatttccgggaaaaaactgaaatttttccgaaaaaaataccattcgatagagctcgaaaaactatgtgttggaagtggcctccgttttcccgggaaaaatcgttaaaaaatcctaaaattcaaaaaccccaaaacctacttttaggcctaactcgaaaaattttgaaaattttcgaaattttgaaatttcaaaaaatcgagctttccaagctctacaataagtctgctggggacatttccctcagataaaagcccggcgtgttattcacctggtactgaagtgtactttttgagcacgcttcagttgctcacaactgcagaccaaggggtggctctaataaaaaaataaaaactacaagcatgtagaggaccctttgggggggtgccctcaaagcgggtactttttgattagagttttagaaaaaaagttacgggtcctaaactgcaagcaaaagtgacaaatcgctccctgggactcagttggccgtcggatcaaaaaacctatagttttcccggatgcacctcaaaaagttgtaagacccttccactactttcagggcgctcccggccttcggccgggagattttgtttttggcaacgaaacccctagtcaatataacatatatagtaactagcgggtgcgtgaaccgtcggatctggacctgggaaaaagcgcttcgcgcttcttgagcttcgctacctagactgttacgggggaagaggtacaaccacgggtgggaaggtacaattgtgatcagaagaggtacaactacggtttttttagctctggttgtggagatttggaatttttaaaaaattatctgggacttttaggccgcttcgcgggctcgaacgagcgcttcgcgcccgttttttaaattttgttgggcttatacgggcgcttcgcgccaggttctttatttgttg

SEQ ID NO: 16 - DNA, 2431 bp, Heterodera glycines
ggttcgctgactggccctttgcgtttagtgtctcaccaaagcggttcgctgactggcccttcgggtcatttgtcgcaccatgtggttcgctgactggccctttgaggcacgtgtcgcaccaaagcggttcgctgacggcacttcaaggcacttgtcgtacgtaccaaagcggttcgctgactggcccttcggggcatgtgtcgcaccaaagcggttcgctgactggcccttcggggcatgtgtcgcaccaaagcggttcgctgactggcccttaggggcatgtgtcgcaccaaagcggttcgctgactggcccttcgaggcacgtgtcgcaccaaagcggttcgctgactggcccctcggggcatgtgtcgcaccaatacggttcgctgactggcccctcggggcatgtgtcgcaccaatatggttcgctgactgacccttcgggtttatgtcgcaccaatgtggttagctgactgacccttcgggtttatgtcgcaccaatgtggttagctgactgacccttcgggtttatgtcgcaccaatgaccaacaattgtcgtggacctgccctctgtgggattgtggttctgacaaactatggttgtggacctgcccctctaggggattgtgggccatcaaagtttactcagatttccttatcgtttccggccaacatccggggcgaagctggtcccgcactttgccaagaccagtggactggtgagaggtaacgtaggatatacgcattggtcgtggacctaccccttcggggattgtggaagggtcttaaaactttttgaggcgcatctgggaaaactataggttttttgatccgagggccaactgagtaccagggactgaattctcacttttgtttgcatttgaagggccctaactttttttgtaaaactcgaatcaaaaagtgcccgctgtgagggcactccgccaaagtgtcctctaaatgctggtattttttaaaattttttttgagcaaacccctggcctgcaaaaaatggcaactgaagcgtgctcaaaaagtacacttcagtaccaggtgaataccgcgccagggtttgatctgagcgggggttggccagcgaacttattgtagagctttgaaagctcgattttttgaaattttaaaatttcgaaaattttcaaaatttttcaagttaggcctaaaaaacggttttcgggtttttgaattttatgattttttaacgatttttcccagagaaacggagaccacttccaaaacatagtttttcgagctctatcgactggtaatttttttggaaaaatttcgattttttcccggaaatagaaaaaaattttggcctcagcgggacatttgagtcccgggcccataactcgtcaggggttggttttatcgaaaaaactcctcagggcaaaattgtagagctttttaaatgctatcgaatggtgtactacatgatgtaaaattttcaaaaattttcgagctaggccccctagaaattttcaaaaattttttttaggttgaaaaagggggtcaaaaatatttttctggggtattttgaggtgctgagcacgaatatgatgtttgttttacgtttcagaatttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgggatttaaatgaaatttatatcttcaaatgaaaaaaagttattccagaatttctggaaaaatccgaattttcagaaaaaaattcagaactcggttccgtaaaggtgattttgaaattttaaatactgaaaaaatccgcaattttttgctctaccaaataaattttatttcatatttttatcacatttttaaaaaatgataccaaaataaaagtgattttggggttcgggaccaaaggggggtgaccaggatttttgagtggaaaaattttttcaccaaaaatcttcctgaaacatgtcattagggctattttatgacgctgatcacgaatacgttatcagattttacttttgacatcgtttagacctcagaatccctgtgtgattggggattctgagtcatcttttggggggggggggcggcaggttcgaatccggccggtgtaaattatttttctttgtattttttgggttaattttcattacttttaataaatttaaatgtttggttttattttcaatgattttaattaatttaaaatattttgttgagttaataaataaaaaattatatttaatttaattttttattgataaataaattttataagtttaaattaattatttttttaattgatagaatttcatgtattttttaaattaaatttgttaaaaaatat

SEQ ID NO: 17 - DNA, 1269 bp, Heterodera glycines
cctcttcttctcttccgctttctgttcctcttacctacatagggccacttcgattttgtcttgtgtttgttgttccttttaaactttctcttgaggtttatgttcatcttccactttctcttgccgctttctgttcctcttccactttactttctgttcctcttccactttcagttcctcttccactttctcttccactttctgttcctcttccactttctcttccactttctgttcctcttccactttcagttcctcttccactttctcttccgctttctgttcctcttccacgttctgtttctcttccactttatgatcctcttccactttctcttccgctttctgttcctcttacactttctcttccacgttctgtttctcttccactttcttgtcctcttccactttctgttcctcttccactttctcttccactttctgttcctcttccactttctcttccgctttctgttcctcttccactttctcttccactttctgttcctctcacactttctcttccactttctgttcctcttcttctcttccgctttctgttcctcttccactttctcttccacttccacttcctcttcctctttatctttctcttccactttctgttcctcatccactttctcttccgctttctgttcctcttccactttctcttccgctttctgttcctcttacactttctcttccattttctgttcctcttccactttctcttccactttctgttcctcttccactttcagttcctcttccactttctcttccactttctgttcctcttccactttctcttccactttctgttcctcttccactttcagttcctcttccactttctcttccactttctgttcctcttacactttctcttccacgttctgtttctcttccactttctggtcctcttccactttctgttcctcttccactttctcttccactttctgttcctcttccttctcttccactttctgttcctcttccactttctgtttctcttccactttctgtttctcttccactttctgttcctcttacactttctcttcctcttacactttctcttccgctttctgttcctcttccactttctcttccgctttctgttcctcttccactttctgtttctcttccactttctcgtcctcttccactttctcttccgctttctgttcctctgccactttctgtttctcttccactatctgtttcttccactgtctgttcctcttacactgtctgttcctc

SEQ ID NO: 18 - DNA, 1092 bp, Heterodera glycines
tttctgttcctcttcactttctgtttctcttgctcttccactttctgttcctcttccactttctgtttctcttccactttctcttcctcttccactttttgttcctctcacactttctctttctgtttctgttcctcttcttctcttccgctttctgttcctcttccactttctcttccgctttctgttcctcttacactttctcttccacgttctgtttctcttccactttctggtcctcttccactttctgttcctcttccactttctcttccactttctgttcctcttccactttctcttccgctttctgttcctcttccactttctcttccactttctgttcctcttccactttcagttcctcttccactttctcttccactttctgttcctcttccactttctcttccagttcctcttccactttcagttcctcttccactttctcttccactttctgttcctcttccacgttctgtttctcttccactttatgatcctcttccactttctcttccactttctgttcctcttacactttctgttcctcttacactttctcttccacgttctgtttctcttcaacgttctgttcctcttccactttctcttccactttctgttcctcttccactttctcttccactttctgtttctcttccactttctgtttctcttccactttctgttcctcttcttctcttccgctttctgttcctcttccactttctcttccgctttctgttcctcttacactttctcttccattttctgttcctcttccactttctcttccgctttctgttcctcttccactttctcttccgctttctgttccgcttacactttctcttccacgttctgtttctcttccactttctggtcctcttccactttctgttcctcttccactttctgttcctcttccactttctcttccgctttctgttcctcttccactttctgtttctcttccactttctgtttctcttccactttctgttcctcttcttctcttccgctttctgttcctcttccatttctgttcctcttacactttctgttcctcttcttctcttccgctttctg

SEQ ID NO: 19 - DNA, 11755 bp, Heterodera glycines
  misc_feature (50)..(50): n is a, c, g, or t
tgttcctcttcactttctcttcactttctgttccccttttaatggtctgncctcttacactttctcttccacgttctctttctcttccacgttctgttcctcttccactttctcttccactttctgttcctcttccactttctcttccgctttctgttcctcttccactttctgtttctcttccactttctgtttctcttccactttctgttcctcttcttctcttccgctttctgttcctcttccactttctcttccactttctgttcctcttccactttctgttcctcttcttctcttccgctttctgttcctcttccactttctcttccactttctgttcctcttacactttctgttcctcttacactttctcttccacgttctgtttctcttccacgttctgttcctcttccactttcttttcctcttccacttttgttcctcttccactttctcttccactttctgttcctttccactttctgttcctcttccactttctgttcctcccgtacccggtttaaaaacttggacccggacccggctttgctggacccggaaatatccggacccagttttgcccaaatacccggattcgtctaatcctaaaattaactcattttgagatttataaattatttaaatttttattaatatttgtttatttttaatttttattcgattaattttaatatttaatttagactttattattctattaattaaaaatatttattattttattaattcaaaaaatcattatcattaatttaaaataccataaagttaattaataaaaaaaataaattaaaaaaaacaaaaattagaataatttcaatataatatttgctttaaaataatcagaagaaatgggactctaacccatgggaagccagcaccaaagtaaggcacactaactacttgaccaccggatcgcttgcctccttttaatttccttttcactttccttcttttttggcataaaatatttataattttatgtttaggtaacttattaatttgtctccattttttaaatgattttgcacaaaaaaggtcaaacaatagatttttgggctaaattaggaagaaagaattattatttttaatatttaaaataaattattttaataaacttaattaattttaaaaaaataaaatcattcaaaaaatgtaataaaataatggatgaaaacacccagaataggtgggacccgagccgtcgcccaccaccaccaaaggcaaaaactaaaaatttatgctattaaaacagcaataatttagttggaaatatttattgaataaaagtaggagcagtaaaaaactgatgatgtaaatggaaacaattgataatgaacattttttgcttattgaaaaggcgaggttaaagaccactggcgagcgtgcattacatataaaaaaaggaaagaaaggaaagtaatcaatttttatccaaaagtactttgctccaaatttttgttattatgtctttctcttttataaacccataaaattttttataggaaaaatattaaaaacaaatttaaaaccaaataatttaaatataatatttgacgggaaaatccaataaattaatgggactcgaacccacaacaccccatgaccaaaggcaggcacactaaccacttgaccaccgagtcgcttgcctcctacccgtttaattcccttttccttttccttctttttttgaaaaaatcctgatcaaaagtgcttgaactccctttttagggcacttcccggacccggaccctgacaatttatacatcactagaaagccaagactttaatggaggggataggcatattcaattttttatttgacccattttaagacatgcaaaaagcgttcaaaaataggcaatcccaaaaaagtgctatttttgagtcatttttcgaacacagttcgaacagttctaaaccgatcgaaatggctatagtttttccttatagccattgaaaaactgcgtcgatagaccccactctcgccccgtaaaactcgctagaaagccttaaattagtttttaagtgagttaggggggtagattcttcttatatagggaaccagggccctgcgggccctgtgaaagcgccgggggcgctttcaacaccggggccagcaagaaacagttgaacttttaaatttaataaagtattttttaaattatttgcgaaaactaacacattgtcaaataattagcccatcattatttttcaacaaattctccatttaattgcatttccaccaaagcataccctgataaatgcccggaaaaaaacagggtgcccaacatgggcaagctgtacttgctggaaaggtgataaactgaagttctgatgacggcaaatgaatcaaagtaactattccctaacttctgattcaatagatgtactgatgagtatgcaaattaattaattttcctttaattaacataaaaactgcccccaaaagtagcattcatatggtagaaactctttgagcgacaaatgcaagtgaatcaattaagtaattatttaactcgatgctgatcagtgcatctattgcatcagaagatagggaataattatttagattcatttgccatcatcagagcttcagtttaccacctttccaccaaagtacagcttgcctatgttggccacaatgctttttttcgggcatttatcagggtatgctttgatggcaaatgcaattaaatggagaattttttataaataatgattagctaattattttgcaattttctatcacattacaatttgtaaataatgatcagctaattagttggcaattttttatcacattagattaatgggtgttgggtgatcggaatttaataaaaacccatgatgattttccatggagtttttgaaatttttttaaatgcaattatattgtaatgggatagaaaattgccaaataattaggtgatcataatttacaaacaaattctgcattttattgcatttccaccaaagcataacccgaaaaaaagcatgatgcccaacatgggcaaggtgtactttggtggaatcatgctaaaatgttgcagtcaagtttaaagtttttgataaataacgatcagctaattacttggcaatttgttatcacattagataaatgggcgagtaagaaacggattgttagatgttaaacaggcaaaagcaaaaaatttgggtcatattcgaacccgccgcttaatttttcttgtacatttagaataaaattgacttgatagaaagtcttaacaaaccatatttgttattaaaaagttatttgggcatataatgtcaatttctgaccaacgtaatgtatgcagtacactaataattatgttaaattaaattgaaatgatataagttattaaaagaaagcaaaacataagtttaagcttaaatttttgatatatctttaagtctgaccaagttattctatgttagttaaatttcagtcaactttggaacagctgtgtaaatttgaggtcgtattatatggagtatcaacaaattccataagcagtagttaagaagttccacgatgcttttgaaagtatttatgatttttcgaaataacagcgtttaaaataaaataaattaaatttgtaacaattaaccaatcagtgttcatcaaattcaataatatcatcatcggtttccttttgttccgtacccaccaaatggacatcgttgttttctttgtcttcttcaagcatatgaacgtcgcattggtcggctttttctcgaatcgtacccacctaaaaaaaaaataaaaaagattgtacaatttacgagttaaaccacctgcaaagattttcgggctttattcattgtttgggccaaattttgtaattcacagaaacgtgaattgaaaaattcttttttcgaaccctctaattgctcaatatcagggagaatggccatccaaagttcagtgcgtttctggtggtagcgagcgttctctgccttgatctgcttatcgcacgaaacctccactttcgtaagacagtcaatttgcttctgtattgcttggccaagatcagcaacctcatccagcgcacccgcagatatatttcctacgaaaaattcatattaaaaaatgaaaaaaataccaacctttcgtggtgtaagcatgtttcagagtgctaagattgtttttaagttggatcaagcgcaatttttccggttggagttttagattgatctgttgcacaaacgactcatgtgcaaattgctcatcacgtagagccgcacccgcttcagaaaccaatccgtaaatacgttttgacacttcactttctttatttgcaatttcatccttgattttggattttgcagtcaaaaaagaagcctttgcttcttcgaaaatcaattggactaaaaagattgcgttaactataaaagcctaaaaaccaaacaccaaatactaaccatttttttgttcttctggcttctcgtacccacttgatgcttctgttcctggatttaattgatcagtttgagttgggcgttgatccatcgcaattatttaaagagtataatgctgctaaaatatagattatatgaaaaatcttcgataatgggaggtacttaaagcacaacaaataaatatgttttataaaagtattattaaatataaataaacttcaaatcataataaaataaagttagaagctaacaactacagatgaaaaaatcttataggattggaaaataaaaaaattataaaaacattgtgttataaaacgcacactaaattgatacaaaaccttactgttataacagatcgtgctgacacacgattaaaaaggtgtgtgtttttaaactgtttgtgctctctatgcatagaagaaaagaggttaaaacagacgccaatggaagtgtgtgtgcaggcacgcagggacctcaaacattcaagatactgggacttatgtgcaggcacgcagggacctctaaggacagaaataattccaatgttgtccactttcaacaggtacttgaaaatgtattttgaagctaattattttaaaatcagccgagtgaatacgttaagagtttgaataatagcaaaaaggtggtgtgacttaaaactaaaggttaactaagaattacacataaaatttttcagacaaaaatttattaataataacgcaaaaaaagaaaaaatcagcaaaataaattaaaaaataatcaatcaaaaaaatcatcaaaagaactatcaagatcatttggttcttgatcgttcgcacccgctgcgtttccattatctcgttccacgtccgggtcattgtccacgtccggtactcttgggcccacgtccggtattgctgcgtccgggtcattgtccacgtccatcagtccacgattcggtgtcctcggctgctgcgtctccaagtccaacagctcgtggtaaacgacgttctcgatgtgcgtcccgtacccactttggctgaacggcgcgtacaccctgatgccatccatctgcgtgactctggacatggcgacgtacacctggccatgcgaaaagcactggcgcccgttgagcacgagtgccatccgctgcagtgtctgcccttgcgccttaacaaattgtacacgtatttctttagataattgtatgaattttattctctttcaccttgttgatggtcatggcaaagcaaaggcggaccgggaactgcagacggcggaatcgtagcccacggtggtgccgtgcgcggccgtattcgaattgaatttggggaatggcgatgatgttctgcgcacccgctcgtggtccggtgaggatccggcagaacaggttgttctccgaagtgcgcatcacttgaagtcgggttccgttgcacagtccctgggtgacgtccaaattgcggatcagcatcacaggcgtacccacctggatttatttattaaaaaattatcaaaacaaaaaagagttcactttgatggtcagtttgtgcggcggcattccggacggcatttcattgtgcaccgcctccatgttgaagtcggtgcggaaattgttcatctcttcgttaggctccagaggttcgtcgatggacaggaattcccttccgcacccgctcattctgccaagcgccacctcattgatgtgctgcacgtcgttgttggtcggacagaggatggcattgtgggcaattgcgtccgcgttggccagcgggtcgtcaaacagtgcttctgggaagcagaagtgaatggtgtggtcgaggtcgtccacgagaagttcgggcggaatgcgcagttggttggtgaagccttggctgtccgtacccacgcggtgcattccattgccgatttcctgcagccaatcgcgcaacgattgttctcctggtgcggtccgcatgttgatcgttaggctaataacataaatatgtttgtaaaaaacaaagtagacaaaaaaacctgatttttttgaacagacgaaagagcgctcccatcttgatcgacgtacccacttggtcctcacgagttccatgctcgactacgggagtcagttgccgccagtcgccactcaacaccaccactttgttgccaaacggtgtgacatttgcacaaacgtctcgcaacagccggtcaatgtagtcgagcacggtgttggacaacatactaatctcctaaaaatgttatcatgaacgaaaagcaaacttatgtttttgtttacatcaatgatgatcagttgtgcgtggcgcagttgctccgcttttgccgactcgaagttcagcatcggcggcgtctcctgcgacacgtcgtttggcacgtagaagtgcctgtgtgcagttccaccgcctatcagcaacagagcggcgatgccggtgctggcggcggcaacagctgagttccgcttcagttcttggttgcgtacccactgtgcgttggcgtttccatccaaggagggcttgcctgcgatgcaccactttatcagcgtgttgtaaaagtacgtcttgcctaaattaactttagcaattaattatacttttagaaaaataagtaagccgttattaccgcatccgcccgcgccttcgaggaagaacagcttctggttgcacccgccaagaattgatgttgatatctcatcaaaggcggcccgttgatctgggttgaggcgtccaatctgctcgatggcaacttgctgcggtggtttgcagcgttgccgagcatcctccccatagaagctgtccaagatgttgtcctcctccaggagctgcgcctgatgttgaaagtcgtagcccactggcagtccttgcagcccaacatctcttaaaaataatgattatatggacaatattatgccagctttactcacttggtgttcgtccccatgcagttgaggtaatactcaaggttgagcatcacctcagccgcgcggacttcagctgacttcggcacagctcctgggtggttggcggcaacaggtgggttcatctcgtcgaggaactcgtcgaacagcgcctgagggttggacggatgggcgtgcgcaagcagcattgcaaagtagtgctgtagccgcttgaggttggtcatttcggcacaggcttcttgcatggctcggcggaagacttcatcgctcacttgaagacccaaatgttggcacgtacccacgaatgtgtcaaattggatgccatcaatggtgcgaaggtcggcaaagctcttgggtcccggacggtggaggagcagtgttctatttgatagctttattaacttttcattttaatttattacctcaaggcaaatagctcatgcttgcgcggtgacacggtgtacacacgcacaaacattttggccttgtccgggtcttcttccaggggacgcacccgcttcttccatgaccgcgacctgaagtcccacctaaataccgcaaaacattaactaattaatcaattttatacatttatttcaactcacgagtaacggtaaggcactcggtcataagtcagctccgctgcctccgggtcccttccgcagagtgcgaagaaggccgtaaggcgggtgttctctcgaaccctccaccgtccttcctcttcatgcccttcttccacgacaatcgtttggccgagctcgtcgtgcacgctaagagtgtagatttggtgcgacgtacccacgattttgtacgagttcaggcgcaggtaggcctccatggcggtcatgtagcgcactttgaacgtggcggcaatttcgtcgtagttgtacacttcgtccgcacccgcagtttcgtcgcttctgccctgttgcgccgatcttcgtggctgtgcgacacggacataggccttttcaaaccctgaatgttctggaattattgaaagaaatcgaaattaataaaataacaaccttttaacaggtatttgaagatatacttgcaggccttctgtccgaacacgtactccacattgatgtggcatccgtatttgagcagaagaaacggattgtatgggatgacgcggctgtcgtccatcagaatagcgctccggaccccccttttcttcttgtaatgcgtctggccatgttctcccttaataattatattttaattaagttttaatataaataactggtacatgctgcctctccggaaggcgcccttgatgtggcatgcgctgatagcgcacttcggcccagtcccgttctgggtcagcagcgggatcgtgatggtcgtcgtcatgttggttgtcggatccaccagttcttccaaagaatgcatcactctcgtcgggcggtatgcggacatagttcgtgtaacggacctcttgaaatttttagaaatacatttcatgttttttaaatgacaagatggttacccgagagctctgtcctgtccgagtatggcttcggaaaatgtttgcggcaccgcgaaccctccagacatgccgcattgcagtcgtgcagcatcattgatgttacgttatgccagaggcgacgctgttggtgtgcctccggagattggtccgaagatggcggaagggcagggatgcgcgcgcagacatattcgtccacgtgctgcggagtgtcgatgcggaccccccgttcaagaatcaggagcatgtgtatgtgtggcatgccttaatttatttttcttttcatataatataatttaaattttacctcgcttctggtgttccacactgtaacaccatccggcaactttgcccagcacaccacgctccgtcacgtccttgatgaattcagctgccttgtccatgaagatgcggcatacaatgtcgggccggtgggcatagttttgacgcacccgcaatgcttcgtcgatctcaggccactttggattgccagtgaaggtcacaaacctaaaaaattgatagcatcaattatgaattaaggtaatgcatttatgttaccaagtcggagcccccagtgcaacgctttcaacgtcgcttgtatccacacgttgcagtaaattgtgttgatattcattgttttgcgtacccacatttccattatgacgtgatcttttatttgtagagcctgtcacttgtttaataactataactttaattactcttttgcgtaaattaagacctccaacaatagtcaaagcccgtaatccagtggtggtcggagtcgaaacaacactggtgtccagatccattgccgacgtacccacagcagcttcaacatcacccagtggttgactgcattgtgctcggatattggttgaggttgatggcactacaaataggtattaaattctcatgaaataaaaacaaataatggagaccattgccgaggtcctgaataggactggttgctgctgtgctggccaatgaatcctgtgaaggaatcgaagccgcacccgcaacactgtcagcttttcccagacgtgaatctctcgtcgtccagttaacgttctctttcgaggcatttagtatttttgaaataattgctaaataatctaaagcaaaaaaagtatatgttacgaaacagaaggggagggtgtattgtttctcagcaaatggagcgaatgaaggggatggaacggtgctagcttcttttatataaaaactaaaacaaataaaaaggtcgtaaactgtaacaatgaaaaaattggagcgaacatatatttgtttggtcaaagtgaactgacaaacgcactaaatcatagtccttttatactctttacgtgtttctctgcgtaggaaagaacacgctgaaaagtgaagccagtgaaaaatgcaagcacgcagggacctctaggtctcaatatgctaggacctgtgtgcaggcacgcagggacctctaactttaacgttgactattttatataccaaggagcacagtatcttggtgataactgaagttaaatcagaaatttaaatgtcaaacatctttaaacattgttttaagagtttctgatgtattactttgttctttataaaaaaaaatttttcggattctggacacgattccacatcaagtatcttggtgagtattggacatgtaatgcccaaatgtatatatggcgtatttcactatattttaaatatttccagtataaaaaattctttaaaattccaaaaaaattttcacccccagaattattaaattttttattagtgcaagagtagtgcaagagtagtgcaggagttgttcatcagtggttcattagttgttcgtgagttgttcaaaagttgattattttacataccaagatgcacatgcagtatcttggtgagacttgaagttatatccaaaatttaaacgtcaaacatctttttacactgttttaagactttctgatgtattacttttattacttaacctaattttcaaaattgaattttttcggattctggacacaatttcccatgaagtatcttggtcagtattggacatgtaatgcccaaatgcacgtagggcgtctttacacattattttaagtatttccagtgtaaaaaattcatcataattacccatcaacccctctgaatccctgcgtatcccccctaacaaaaaaagtaggcaaaaaaaattgtcaatcagatccctttttagggtatttcccgaacccggaccaaaacctgccttataccatctgaaagagcaaagtatgtagaagtgtcatcaactcttcttttttcgattgaaccgattttaaggcaggatatgagccatcaaacacaaaaagccaaaaatttttgaaaaaattttcaaaaattttctgaagaaacttttttttacgtgaaaatttcaaaaaacgctttacaccattcgatccgcaatcgaaaagtgccggaaggatgcgcaaaccgcatcccgctatgagcaaccgctcgcttatttttttagcaaacgtcatttcaggctacatttttctcttatagagggaatgatagcacccgaatttctagagagaaggattagttttccaaaaaatatgctggtacccaaccacaggcactaaaggaatatttttatgacggaatttcttttttcccatgagtaattggcattaaaataaggaatattcaatgttttttataagcgttcaaagtcttaaaaacacagacatacattttaagctttacccaaaaactaacttttgaaaccatgttggaaaaattttggcctgtatgacgacctttcactggcatcgccgcgagcacaacgaatttagattcaaaattcggatccaaaaaatggccaattataccaaaaattgagtgggttgtgtcagaggaccacgaatccaccgcaattgtaatgtaat

SEQ ID NO: 20 - DNA, 8112 bp, Heterodera glycines
cgtcacgtgctgcggagtgtcgatgcggaccccccgttcaagaatcaggagcatgtgtatgtgtggcatgccttaatttatttttcttttcatataatataatttaaattttacctcgcttctggtgttccacactgtaacaccatccggcaactttgcccagcacaccacgctccgtcacgtccttgatgaattcagctgccttgtccatgaagatgcggcatacaatgtcgggccggtgggcatagttttgacgcacccgcaatgcttcgtcgatctcaggccactttggattgccagtgaaggtcacaaacctaaaaaattgatagcatcagattataaattaaggtaatgcatttatgttaccaagtcggagcccccaggtgtcgaaccatcgtcatcaggtcggcatatttcccttggtagtattgccgtgacccggcaaatgtttgtggcatgaggaagacacggccgagctttgcatttggtccttgctgtcggacccccttctccatggcggtgatgtactcacgggccataagttgacggtagttcttctttgcctggattgacttcagatggtccagttcgttgcgctcaattcggttgagaaccgaaatggtgaagtactcggcgaggcgacgtgcaaaccacagccaatggaagtcgtatttgccggacccccgaagtgccattcgatagcggtagaactgccgttccgaaatgttgcttcggcctccgcgagtctccacttcatggtcgaagaggacgtcctcattttcatctctttctccgcaaattggttgggccgttgacgtacccactgcatttatttcgggttcctcaagctcctcgggaacatcggcgtccaattcgagttcgggctccggcattacgtcaatttcctcctcattcagctgcgtacccacaatgtcgtcaattgcaatttcatcgcccaattcgtcgtcggaaatttgttcatgttcttgttcctcctggtgcacttcgggtcgggcattctttatcaaaccaatgtattttgagttcattttttattttatacctcggacccacgtttcttcatgtaccacctccatccaagggtgccgagtggatggagcagtgggaagcagcacgggtcgatttgcggcatgccactcttcagctcgcgcatcttcccggccttgtcggacacccagaatgctaatattttaaattagagttcattgtaatgttttttattaccgctaatttggggaggaagaccatcctcttgaacccaaatcacagcgacctgctttgcagtgggagcatccacccgttcaatcactgtgatatcattgcgtccctgaagcggaccccctttcaagtctcgatccgtgagcagtgcaatctttattattaaaaaattattttcatatatatatcctcttattactctgaagtgtgggacttctccagttgcagcacgagtcgcttgtaccttcgtacccactgtttgaaaggtctgtccaaatgggttttcccgcatcagcgcctccagtctctccatgattgtgcgcctgacatgtggtgaaacagcggtttcaaaagcctcttcgcggacagccaaagcgtcttcgggtgacaatgtgtaaacttgagcaaatgacgggcgacggactcccggagcaataaggtcgctgaacaggaatgaaaactgccctgtaaaagtataattaaattgattactaaacgactaattaaccgttatatttgcatgtatccaaccgaccacccatttggtccggtggtgctttttcgccatgtgtggaggcaaaggcgaacaggttgttgaacgccatgttgttgttcagaaaagcatctcgaaccctctcgtcgtcaacatccaccaatccatgtaaataggcaggaggcggctgttggagttcgtgaaattcggccaccatttgtccagtgtgcactgcgccattggcacagcaaggtgtttgccgcccccgcttaatgatttcgttttcgccacgaagaagacgtgcacagcaatgtccacaaaacgcgtcaccgaactgaccactgtcatagtagtcaatctataattctatttttaaacaatataaaactgattatcaactcggtgcccggaagaacgtgcggcacacttcaagaaggtgttccggtgacatcgttcagtcggacggaccccctttatgttacgtgttgcggtaaaaaagattggtgcaggaaaaacgccatgcgtgaactccttcagatacacccaagcagcaatgaaggcagtggcattttttaggcattgtgaatacgacaaacaattgcagccggacccacagcgagtgcatcgtgcatctgtaaattatgtgtttcgtatattataatttaaacagtttaacccgttgagcggcgacgtttttgcgctatcacaggctgctttggccactcccttgacaaataatctcggaccaccttttgcatgcgttcttcgagcaacgtcacattaagttcggccagctaaaaccgttaaaattactatttaactgaaaaagaaataacacaaaaacaatgaatccaaaacctttgcacgcctagcgcttgtgtaacgtggtgtgttcgcacccgcagcaagaagcgttggtgctgatttgcgacgtcgattatctgtaactatttgtagaaaattatgggaaaataaactcaaaaaacctgcaacgctttcagcgtgacttatatcctctcgttgctgtaccgtgtgttcagttgcattgtttgacgtacccacgtttgaactgtgacgggttcttttatttgtagagcctgtcaattgttttatatatattgctttagttgaaatttagcttaaagaaagacctccaataatagataaagcccgtaatccggtggtggtcggagtcgaaacaacactggtgtccagatccattggggacgtacccacagcaggttcaacagcacttcgtggttgtgtttgtgcttggacattggttgaggtagatggttctatatctatttattaaaatttcgtttctaatagaaccaaaaccctgatttagttgaaaagattgttggtcgcttgtgctcggacccaccaaaacattagccacgtctggagtgtttcgtatagcacggcgtcgcaagcgatcagcttcctttcgtctctgttcttttgaaggcataatttaaataatcgcaaaataattaaatattaaagctaaaagaaatagtaataaaaactaaaaaaaataaaaaggtcgtaaactgtaacaatgaaaaaattggagcaacatatatttgtttggtcaaagtgaactgacaaacgcactaaataagagtccttttatactctttacgtgtttctctgcgtaggagagaacacgctgaaaagtgaagccagtgaaaagtgcaagcacgcagggacctctaggcctcaatatgctgggatctgtgtgcaggcacgcagggacctctaactttaacgttgactattttatatacaaaggagcacagtatcttggtgagaattgaagttaaatcagaaatttaaatatcaaacatctttaaacattgttttaagagtttctgatgtattattttgttctttataaaaaaaagttttttcggattctggacacgattccacatcaagtatcttggtgagtattggacatgtaatgcccaaatgtatatatggcgtgtttcactatattttaaatatttccagtgtaaaaaattctttacaattccaaaaaatttttcacccccagaattattaaattttttattagagcaagagtagtgcaagagtagtgcaggagttgtgcatcagtggttcattagttgttcgggagttgttcaaaagttgtctattttacatatccaagatgcacatgcagtatcttggtgagagttgaagttatatccaaaatttaaacgtcaaacatctttttacatcgttttatgagtttctgatgtaatacttttattcttttttaaaaaaaaatttttcggattctggacacaatttcccatgaagtatcttggtgagtatttgacatgtaatgcccaaatgcacgtagggcgtaataatattatattttaagtatttccagtgtaaatttttttttataattactcatcaacccctcagaatccctgcgtatcccccctaattcttgaggcaaaaatttttccaaaaatttttaattcgtgtccagagcaaaactcaattttaaatttatgctagaaagatgtatgatagctcattagaagcgcctgagtgtcgacatttatcctccaaaacatcgctaagccggtttcggcactccccgccaagatacagccctttttctgagagccgttcaaaaaatttcagaaaattttcaaaaattttctgaagaaacttttttttacgtgaaaatttcaaaaatcggtttacgccattcgatgcaaaatccttaaaaaatagttgtgctcttttgtttggagccgatccgagcattttaaaaaaagttatttgcgatttgcgtcgaatcgtgctattttcctcttatatagggaaccagggccccaaggggccctgtgaaagcgccacgggcgctttcaacaccggggccagccggggccattgggttttccccgcgcttaaggtactcgctcggccgcttcgcggcctcgtacgggcacggtaagcgtttgaataatagcaaaaaggtggtgtgacttaaaactaaaggttaactaagaattacacataaaatttttcagacaaaaatttattaataataaagcaaaaaagcaaaaatcagcaaaataaattacaaaataatcaatcaaaaaaatcatcaaaagaactatcaaaatcatttggttcttgatcgtttgcacccgctgcgtttccattatctcgttccacgtccgggtcattgtccacgtccggtactcttgggcccacgtccggtattgctgcgtccgggtcattgtccacgtccatcagtccacgattcggtgtcctcggctgctgcgtctccaagtccaacagctcgtggtaaacgacgttctcgatgtgcgtcccgtacccactttggctgaacggcgcgtacaccctgatgccatccatctgcgtgactctggacatggcgacgtacacctggccatgcgaaaagcactggcggccgttgagcacgagtgccatcctctgcagtgtctgcccttgcgccttaacaaattgtacacgtatttatttagataattgtatgaattttattctctttcaccttgttgatggtcatggcaaagcaaaggcggaccgggaactgcagacggcggaatcgtagcccacggtggtgccgtgcgcggccgtattcgaattgaatttggggaatggcgatgatgttctgcgcacccgctcgtggtccggtgaggatccggcagaacaggttgttctccgaagtgcgcatcacttgaagtcgtgttccattgcacagtccctgggtgacgtccaaattgcggatcagcatcacaggcgtacccacctggatttatttattaaaaaatgatcaaaacaaaaaatagttcactttgatggtcagtttgtgcggcggcattccggatggcatttcattgtgcaccgcctccatgttgaagtcggtgcggaaattgtgcatctcttcgttaggctccagaggttcgtcgatggacaggaattcccttccgcacccgctcattctgccaagtgccacctcattgatgtgctgcacgtcgttgttggtcggacagaggatggcattgtgggcaattgcgtccgcgttggccagcgggtcgtcaaacagtgcttctgggaagcagaagtgaatggtgtggtcgaggtcgtccacgagaagttcgggcggaatgcgcagttggttggtgaagccttggctgtccgtacccacgcggtgcattccattgccgatttcctgcagccaatcgcgcaacgattgttctcctggtgcggtccgcatgttgatcgttaggctaataacataaatatgtttgtaaaaaacaaagttgacaaataacctgatttttttgaacagacgaaagagcgctcccatcttgatcgacgtacccacttggtcctcacgagttccatgctcaactacgggagtcagttgccgccagtcgccgctcaacaccaccactttgttaccgaacggtgtggcatttgcacaaacgtctcgcaacagccggtcgatgtagtcgagcacggtgttggacaacatactgatctcctaaaattgttatcatgaacgaaaagcaaacttatgtttttgtttacatcaataatgatcagttgtgcgtggcgcagttgctccgcttttgccgactcgaagttcagcatcggcggcgtctcctgcgacacgtcgtttggcacgtagaagtgcctgtgtgcagttccaccgcctatcagcaacagagcggcgatgccggtgctggcggcggcaacaactgagttccgctgcagttcttggttgcgtacccactgtgcgttggcgtttccatccaaggagggcttgcctgcgatgcaccatttgatcagcgtgttgtaaaagtacgtcttgcctaaattaactttagcaattaattatacttttattaaaataagtaagccgttattaccgcatccgcccgcgccttcgaggaagaagagcttctggtcgcacccgccatgaattgatgtggagattgcgtcaaaggcagcccgttggtctgggttgaggcgtccaatctgctcgacggcaacttgctgcggtggtttgcagcgttgccgagcatcctccccatagaagctgtccaagatgttgtcctcctccaggagctgcgcctgatgttgaaagtcgtagcccactggcagtccttgcagcccaacatctcttaaaaataattattatatggacaatattatgccagctttactcacttggtgttcgtccccatgcagttgaggtaatactcaaggttgagcatcacctcagccgcgcggacttcagctggcttcggcacagctcctgggtggttggcggcaacaggcgggttcatctcgtcgaggaactcgtcgaacagcgcctgagggttggacggatgggcgtgcgcaagcagcatggcaaagtagtgctgtagccgcttgaggttggtcatttcggcacaggcttcttgcatggctcggcggaagacttcgtcgctcacttgaagacccaaatgttggcacgtacccacgaaagtgtcaaattggatgccatcaatggtgcgaaggtcggcaaagctcttgggtcccggacggtggaggagcaatgttctattttacagctttattaacttttcattttaatttattacctcaaggcaaatagctcatgcttgcgcggtgacacggtatacacacgcacgaacattttcgccttgtgcgggtcttcttccagttgacgcacccgcttcctccatgctcgcgacttgaagtcccaactaaacaccaaaaacattaaatttaataggttctaatttaactcacgtgtagcgatatggcactcggtcgtacgtcaactgagcggcatgcggatctcttgcacaaagtgcaaagaaggccgtaagccgtgtgttttctcgaaccctccaccgtccttcttcttcatgcccttcttcgacgacaattgtttggccgagctcgtcgtggacgctcagagtgtagatctggtgtgacgtacccacgattttgtacgaattcaggcgaaggtatgcttccatggccgtcatgtagcgcactttgaaggtggctgcaatctcgtcgtagtcgtacacttcgtccgcacccgcagtaccatcgtttctacactgttgcgccgatcttcttggctgtgcaacacggacataggccttttcaaaccctgaattttttagaattataaaaaacattaaaagtaataaaataataaccttttaacaggtatttgaagatgtatttgcaggccttttgtccgaacacgtactccacgttgatgtggcatccaaagagagcagaagaaacggattgtatgggatgacgcggct

SEQ ID NO: 21 - DNA, 9000 bp, Heterodera glycines
  misc_feature (8851)..(8851): n is a, c, g, or t
tttttaaaaaataaaaatttttagaaatttgggggggtagggcagaattcgtgctccagtaccggggaaaaaaacaaaaaagaattttgggctttacccgggaccttttcgggttgaaaaaccgggaatttttggctggaaaaacggggaaaaaaccccccgggactggtcccggtcaaaaccgggacctcggtactcagttgtccgtgttttagtcccggtcccgctctactctagtttaaactcaaaattaaaaaagattcacccatcatttaaatttttcccaatgtgtttaatgattattttttgatgactttggcggccaaaattttttgttctgttgtttttggcgatatgcacccctggtgaaatttttcgggtttcttgcattttcttaaggtttttaggaaaattaaggaaaactaaaaaagagcagctgaacaaccgaaacaggtttttaggcgccaaactaataaaaagtaaaacctaaaaacataatccttgtaaattataattaaaacaatgaaaaacggaccgaacgcaacattcactccattcaaatctgggcactcttttgtcgtgatcataaattcggtgcctaaagggaagggtaatacaataattttttttaattaacgaaatttttgaaattttgcaggccaataaagacacataaggttattgattggtaataaatttttattaaaatttgcaaaatttttccggcagttcatataaatactggcaaagccggacgattaaattcccataaatcattaaatattcaaaaattgacccaaaactgctcaaaattatttttggactgaagaggaatcttcgaataccttatccaaaaattttttggttgcgggttgtgtattgcaactttttaaatcaaaatataaaatcacgttcatttttaaatctttaaagacttaatttaaataaattaatgaattaaacaatagaaaactggaagaattaaaataaaatatttattgttacatcaaatttaatcattacaataatgccatacaatcatgagctattattttaaaaaactgggacaggtttaaaaaactagtttttccgggcttggttttgctcttgtctaccaaaatgattattttcaattaataaaacggaataattataatattcataaaaaattagaaaggttaatttttcaaaaaccaatttaaaagcaaattaactggaaagtggcttaccgttatggtctgggattccgtcgttgaacttaaacaacaaattaggaagacaaattttgtgtgaatgctttcaaggcatgccttgtcacgcttcgtaaattcacaaaaaataggttttttcaggcttagactgggtccgagggtggagggtgaataaaccacaccactcccaggcgacgagaccttcttttattagtagcggtaaaattttttttgttttcttttaaaaaataaaaatcaaccggtgatttaaaaacttgtcatgttgtaaaataatcgaatcctttcggaaatttacgaggcgttctacttccatttcattaccattgaaacaattcccggtgcatcgtgtgccaccgaaaaattttcatctgcaaaataatctccgtacagcgatttgcagccaagaacctgaaaaaatagatataataataattgtgagattgttccaattttgacaaaaaaaatttgtcttaaaatgttatctgtaacgcttttatagggctttaaggcattgatcactaataaacgctccattttacgcgcaaggcattaatcaaaaaccaccaaaaaaaaatattttgcattaaatgaaccattttaaagttctcgacaatcaatcattcgaattttttttcccgaaaaattgggtaattttttttgaattttactgttttcttaataaattcggacaaaaattatctaggttttcctttgtggcgcctaatggcaccgccgaccccaatttaaatttcccgttttctatgacgccgaaaatttaagtaaattaaatcggcaaaaaaatccgaagagcaaaaaaaagcccagtgatcaatgatcaatcactatgagaaaaatcctaaacaagagggtcttgttatcgaaactatttttaccataaagaaattgttttttcgttttatttacctcttcaatttttccgccctttatgtatttgtcctaaaagaatgaaattcattagtgaataaaacttgatttttgtttataaaaattaattttattataataattttttcaatcaaaaatttattatttcaaaaaaaaatatcgaaaaaggcaaaaattgaaattatggacggcgacgtcggagaaaataattttaatttttggcattcacggcaaaaaagaataatttaaaaaaatataaagaaaaacataaattgacatgtaaaattagaatttcatcaaaaagtcagggtcggtttataaccaaatatttaaataaatattaaaatatatttttctaaacatttatttataaattaaaatctacgaggccttacttttacaatccggtcaaaattggttcctcggtatccgtattcaatttgtgcgccattgacgggcaatgtcctaaaacagaattgagtttttataagaatttcaagttttaaaaaaccatttttcaacaaaaaaacaaaaaccataatttttaatgcaaaaaaagtcaattatacgattggataggaataccgaaactttaaactatcgattccaaaatgccataaaactgagaaaatttaagatcattttgccagtattcgagataggaattttaaaatggtaaggaacgaaaaagtaacttggaaaatggacttggacttccgtttttccggggttcccggggtatggccaaagaaaccggaaccgggagttccggcaaaacccatgcggggcccaggttttgtccggtttctaatctgtaaaacagcgaacgagaagtgaccgtaaaaactccgagagaaagtttccaaaacttggtaggtttgtaatttattctaatagcatgaaaatttcgaatataatatttaatttataaaattttaataaaatattacaatgctcctgcacacaattgtttgaaattttccgtcgtctgtggcacagcagcaaccatgaggtcaataattatacgtcctgaaattttatacttttttccaaaaaaatttagtattttattttaagcgccgaactggccacgactcattttttcgaaattaattaaacaaaaaattaccgcaagaagccgagtcactttcaatgtccttaaacataataataaaaaataagagagaaaggaaaaaagaaaaaattaccagaaatacgactgggtctgatggatgagccaacgatgcattaaattccatccatttagtgtactgtggtgacatatctatatgtaaataaattaattaggtgcaaatttgctcgaagaaagggattagcgttacatttatttttccaaatatttttgacaatttaatttaaagaaagaatttttagtgaagccaaacgtattataagtaattaaactgatttcttccgcctcctcttcagtgggggcggtgagagaagcatcgccaccacttttggcattggcatcagaatctgctgaggcggcactgcttttgttgttctccttcctcattttctggcaatgatttttgacgtttgaagttgaaagttgaaaatttacaatatttcttcacttaaaatattggtatttaggaaaataagggttaattaaaacaaatgttttaactctattaaactttatgagtccaacacattgtcaaatatggaaatatggacaaaaatctgaaatatggaaaaatatggaagtaaaacaggatcctagaagcatcaaacaaagctaaaaacactatttacgtggtttgtaggcaaaaaaaaaaatggaaatccatacaaatccagtcccaactgataagcgcaaaaaacaaattttcttcgaacacttttcgatatatagcgcctttttagcaactattttcaactacagaattttcgcttatgaaactttttaataactcttttgacttgtgaatttaaaaaaaaactattttttcaaattattatgaaaatgcaataataaaaaaaatttaaaaaatatatacccctaagaatccacataaattttttcaaaaaatgcacccctaagaattgatttttcaaaaagcaaaaatcctggccatgatttggcggacgatcgaaaactttttacgcttgaaaatcttcaaatgtatttgatttacaattgtgcaaccgaaaaggacaaagatgaaaaaattttggaaaattcacatatttattgacatgtttttccaattgttggcaactttttttagcaactattttggcagtttttagcaactatttaggtatctttagctgatgttggctgttctaattagagtagagcgatactaataatatctgtcggtaattaccggttttttggtatcggtacaggttttttcaaaattagaagcactggtaccggtttttccagtaccgttgccagttaccgctctactctagttctaatagaggctttggaaaaatgtcaaaatagtgacaaaaatggacataatcgcgaataggaaatataactataaatagtaatatttaaatacataaaaccgaaaaatcaaaaaataaagcaaaattaatgtgatatggagaagttcattaacaaacagtaaagttttgagataagattaattaagtaaaaggaccagcagaagatgattatgctgacaggccataatataagaaaaacgaatgtgtgaaagagatgctttaattttgtggataagcagaatgactacaaaaaattgttgagtgaagaagagatatagtgaaagttagagggtgagaaaatgcttaagagagagatagagagagaagaagagaaagagagaaagacaagagaaatagagagagcaaagagagagatagagatgagagagaggaaagagagaaagacaagagagatagggagagaaaagatagagagaaggcaagagaatttaatagaaggggagagaatggatcagcagagcagcagatgggtaaatggtaaatgagataaactttgccgttgggcacgcacggaaagtgtgcataggtggaaaggacaaaacatcggtaacaacaaataattttcagggccataatctttttcaagcacaaccaaatcaacaattgtctagtgtattttaggcgtccaatcttcagtttctttggccataactttttttacttggaatacctacattcttggtatcatatgaaaacttaaaagtgtcaggaattcataaatacaagtaagaacaaatactgttactaagaaaaaattgcaactacaaaacgcgaaactcaactttttcaagtatattcatgataattatttatctgtgttagcttctagcccagcatttaggtgaaaaaaaattctatagactttaagctttcgtttgataccaagaaagtaggcattgaccaagtaagaaaaaagttaaggccaaaaaaatgaagattggacgtctaaagtgcactacagtgatgccgcgggttgatcgggtttcgggtcgggcactcgaaaaatttcgagttcgggttgagaaaaacttcgggtctcgggtttcgggttagcatcactggtgcactagcgccaaaaacattcagagagagagaaagcgagatatatatatagagagagagagagcggcgagagagatagagagagagagcgaaagagagagggagagaaagcgagagaaagagagggagagaaaagagagcgtgagagagagagcgagagagagagagcgagagatatagagagcgaagccatttaaaaaatatttgagataagactttaacaataatatttgaatgaaaaagtactataaattggcaatattataaataattatggcaaaaatatacacattttaagaagtatttatttttatttttcattgaatttttttaaattttctaaattttttcctttttcaaaaaatttcacacttataaaaacaactgcaggctgtgccaaagtaaagcaataagcgatgcaaccaaacaacacaaaaacaaagaattcaattataatttattcaaaagttatgaattgggtgggtccggcaccgccggaatgtgccaaaaaaaaatttcaaccgaaaaataaaatggtggacaccaacaaattcacttatcatcaaaattatagtaagaaatcattcctgaattggaaattttgatcttcttggttggctctccctgctcattagtcggaatctatgaaataattcatgtaaattaggtaaaaggtattttttaaaactcaaagggaactgacttttttgttttattctttaggaaaggatcaaatgggattccactttatataagaaaattatgaaatttaaaaataaatatatactgaaactgaaacaattaagaaaaatcgattttcggccgagaatttcaaatttccttttttggactatttctctgaaattaaaaaaaagaatttgtttgaaaattcatatgaaaccaatcaaattttttgttagggagtttcttcaaaattagaaatatatacaaaaataggcgaaatatgtatttaagcaattttgtagaaagtcttgaaacgtgctggtacatcttaaaatatataaatgtttttgttgaagctaagaaaattcttcaagtggattccctaatgatcagcctacacgtgttaagaaaaacaaattgacagaaccctctttgttttttcgcaagaaaaattttaacgcaaaaatttcacttggcaaatcttctccaagacctcgaagcctcgaatgacttttcctgaaaaaattattatcaaggcttggatttaaagtgtgaatcacaaaataataataaaaatattcgaaaagaattggtgtccttaatttaacttttgcattttgagttgtcattgagctggtcatttatgcctcggatataatttttaaataattatattatttgatttaatcttcatttattcttttttaaaattagaaattttttgaatttgaggggtagggcagattcgtgctcagtaccgtggaaataaccaataagaattttgggcttaaccgggaccttttcgggttgaaaaaccgggaatttttggctgggaaaaccgggaaaaaaccccccgggactggtcccggtcaaaaccgggacctcggtactcagttgtccgtgttttagtcccggtcccgctctactctagtttaaactcaaaattaaaaaagattcacccatcatttaaatttttcccaatgtgtttaatgattattttttgatgactttggcggccaaaattttttgttctgttgtttttggcgatatgcacccctggtgaaatttttcgggtttcttgcattttcttaaggtttttaggaaaattaaggaaaactaaaaaagagcagatgaacaaccgaaacaggtttttaggcgccaaactaataaaaagtaaaacctaaaaacataatccttgtaaattataattaaaacaatgaaaaacggaccgaacgcaacattcactccattcaaatctgggcactcttttgtcgtgatcataaattcggtgcctaaagggaagggtaatacaataattttttttaattaacgaaatttttgaaattttgcaggccaataaagacacataaggttattgattggtaataaatttttattaaaatttgcaaaatttttccggcagttcatataaatactggcaaagccggacgattaaattcccataaatcattaaatattcaaaaattgacccaaaactgctcaaaattatttttggactgaagaggaatcttcgaataccttatccaaaaattttttggttgcgggttgtgtattgcaactttttaaatcaaaatataaaatcacgttcatttttaaatctttaaagacttaatttaaataaattaatgaattaaacaatagaaaactggaagaattaaaataaaatatttattgttacatcaaatttaatcattacaataatgccatacaatcatgagctattattttaaaaaactgggacaggtttaaaaaactagttttggtttaaaaaactagtttttccgggcttggttttgctcttgtctaccaaaatgattattttcaattaataaaacggaataattataatattcataaaaaattagaaaggttaatttttcaaaaaccaatttaaaagcaaattaactggaaagtggcttaccgttatggtctgggattccgtcgttgaacttaaacaacaaattaggaagacaaattttgtgtgaatgctttcaaggcatgccttgtcacgcttcgtaaattcacaaaaaataggttttttcaggcttagactgggtccgagggtggagggtgaataaaccacaccactcccaggcgacgagaccttcttttattagtagcggtaaaattttttttgttttcttttaaaaaataaaaatcaaccggtgatttaaaaacttgtcatgttgtaaaataatcgaatcctttcggaaatttacgaggcgttctacttccatttcattaccattgaaacaattcccggtgcatcgtgtgccaccgaaaaattttcatctgcaaaataatctccgtacagcgatttgcagccaagaaacctgaaaaatagatataataataattgtgagattgtcccaattttgacaaaaaaaatttgtcttaaaatggtatctgtaacgcttttatagggctttaangcattgatcactaataaacgctccattttaccgcgcaagccattaatcaaaaaccaccaaaaaaaatattttgcattaaatgaaccattttaaagttctcgacatcaatctttcgaatttttttcccgaaaaattggggaaattttttt

SEQ ID NO: 22 - DNA, 1628 bp, Heterodera glycines
  misc_feature (147)..(147): n is a, c, g, or t
tgcaaaaaaagtcaatatacgattgggataggaataccgaaactttaaactatcgattccaaaatgccataaaactgagaaaatttaagatcatttgcccagtattcgagataggaattttaaaatggtaaggaacgaaaaagtacnttggaaaatggacttggacttccgtttttccggggttcccggggtatggccaaagaaaccggaaccgggagttccggcaaaacccatgcggggcccaggttttgtccggtttctaatctgtaaaacagcgaacgagaagtgaccgtaaaaactccgagagaaagtttccaaaacttggtaggtttgtaatttattctaatagcatgaaaatttcgaatataatatttaatttataaaattttaataaaatattacaatgctcctgcacacaattgtttgaaattttccgtcgtctgtggcacagcagcaaccatgaggtcaataattatacgtcctgaaattttatacttttttccaaaaaaatttagtattttattttaagcgccgaactggccacgactcattttttcgaaattaattaaacaaaaaattaccgcaagaaaccgagtcactttcaatgtccttaaacataataataaaaaataagagagaaaggaaaaaagaaaaaattaccagaaatacgactgggtctgatggatgagccaacgatgcattaaattccatccatttagtgtactgtggtgacatatctatatgtaaataaattaattaggtgcaaatttgctcgaagaaagggattagcgttacatttatttttccaaatatttttgacaatttaatttaaagaaagaatttttagtgaaaccaaacgtattataataattaaactgatttcttccgcctcctcttcagtgggggcggtgagagaagcatcgccaccacttttggcattggcatcagaatctgctgaggcggcactgcttttgttgttctccttcctcattttctggcaatggtttttgacgtttgaagttgaaagttgaaaatttacaatatttcttcacttaaaatattggtatttaggaaaataagggttaattaaaacaaatgttttaactctattaaactttatgagtccaacacattgtcaaatatggaaatatggacaaaaatctgaaatatggaaaaatatgaagtaaaaaaggatcctagaagcatcaaacaaagctaaaaacactatttacgtggtttgtaggcaaaaaaaaaatggaaatccatacaaatccagtcccaactgataagcgcaaaaaacaaattttcttcgaacacttttcgatatatagcgcctttttagcaactattttcaactacagaattttcgcttatgaaactttttaataactcttttgacttgtgaatttaaaaaaaaaactattttttcaaattattatgaaaatgcaataataaaaaaaatttaaaaaatatatacccctaagaatccacataaattttttcaaaaaatgcacccctaagaattgatttttcaaaaagcaaaaatcctggccatgatttggcggacgatcgaaaactttttacgcttgaaaatcttcaaatgtatttgatttacaattgtgcaaccg

SEQ ID NO: 23 - DNA, 2227 bp, Heterodera glycines
  misc_feature (265)..(265): n is a, c, g, or t
ataccataccataccataccataccataccataccatgcgctaccttaccatgctatgagctaccataccatgcgctaccatactctaccatgcgcttaccataccatgcgataccatatcatatcataccatgcgcttccataccataccatgcgctaccataccatgcgcttaccataccatgcgataccataccatgcgctaccataccataccatgcgctaccataccataccataccatgcgctaccatacccccccccnccccccatttttttgtttcaaaattaaatttatttgtcattttttatccattactctgctcatcgatataaattattatgtttttaggtccagaaatgtctaattttaatcaaaatgattttgccattacttcggtgcaccaaatgcgcaaccgacctcggaatacaattggtgaaatagcggaagtgcgctttgctccacttgaagaagtggaacggcccgatcgtgtgctcgagcgtcttgtacagcggctgtttgacagagtgcttgatggacgtccagcaccgatgttaattggtcttcaactgcatccacctacctttgagaacccatttaccattcctcttcgtccacccgagcaaaacaatccggctgctatcgctgatctgatccaaagactcaatgatcaatctgctgccggaattgatctgactggcgggacaacagtcacaaaagtgcttgcagtttggccaatgcaatcggaccacagtgaatcagggagagcaggttgaactttatttttattttcttttcatattttcttttgctgtataggcgcatgcagccttgaggaagagcaccgattggtgaacactgttcgctcgttgatccgcattaagaatccgaatgatcgactctgtttggccagagctgtgttgctaggtcttcacgattggcgttcacggtcaccaggcggaggcggaccgacagcattcaaaagtttcgcaaatcgccagcacacccacgggcctgaggcacgtaacttattgagacgtgccgcaattccccgcaacaaacacatgtacacaattgatgacgtccaaaaagtacaagattggattgatcaacgatacgggccaggagaaattcgaattgcagtttttgagaaggaacgtgagtaccgaattgtgttcaaggcagcatccggcgaggcagccaagttcaacttgtgtcttttgttcgaaaatcaacacttcaactacattggtcgaattgagcaactgtttcgtgtgcaaggatattgtattgattgtgaacgtcgcgtgacacgctggtaccacccgcaggaatgcaaagtcgtctgccgtctgtgtttacgttttggcgcagggtatccatgtaaacaacaacaacaacagcaatcccgagcagatgggtcaactggcaatcgtctttgccgttattgtcaattcgtttttccaaatgacgactgcttcgcctatcatctgagcaatcaggcacccgcaagcatgtataatcagggaggacgcacttttcgcccaatatgtgaatggagaagagcatgccgacaatgtggagccataacctatgcgaattatccacataaatgtccagcccaaattggccaaacggaatgggtgcgctgtgcacgatgctctggaccccatcaaagtggagacccttgttttattcagcctctcaaagatgaaccaatgaggaggagaaggagaagaagagggcaacaacaacaacaacaaaataataataacgatgacgaagacgatgatgatggtaatgatggtaacgaggagggagacgacgatcacggtcatgatgctgataatgaggaagaagaagaagttggaacaaatcggtcggtcagactttgctttttcgacgctgaaacgtcccaagatttgccacttcaactgcgtacaaaggttgtacagaaacatgttccgatgctcattattgccgaaattatctgcgaagcgtgtataaatgaaggaatttcggttcattctggtgttggacaatacgcaaatgggtgtgtgtgtggtcctcctgcgggaccaagggggcgtcgctggtgttctcctccgtttttgaatgcacctggggatgacaatgctctaccagccaatggccactacaacccacgaaaattgttttcccatagttttgaccacttacccaacaatggacccgggggaccatttt

SEQ ID NO: 24 - DNA, 13813 bp, Heterodera glycines
ctgaatcggcacgatacattcgttattatgaaatgactcatccgggggtacatgttcggtctgcccaatggtcaattggtgaggctaacgtcgaagacactggctaccgccttgatggattagtcacacgtgaaccccctcaacgcaaccttgccattgaatatatgggttgcttttatcatggtaaaaaaaaaaggtcgcccttttcaaccgaacaaaaaaaaatgcttaaaggttgccccaagtgttacgctaacgacagacaacaaaaattggcaggtggaaggacagccgaagacctgtatgaacgaaccaagaggcggctatttgaactgcagaatcagcatggctttgagctggaagttgtctggggatgcgaaatgaagcagcgtctgcgtgctgatccagaatttcgccgggtgtacaatgactcattcgttccaagaccgcttgatccaagagaggatgcactacggggtggacgcactgaaccgtttattcttcattacacatgcagtccagacgaagagataattctcattgacattgtaaaaaaaaagttaggagaaacaaaaaatattttttcattgttaaaggtgagcttatatccatatgtgatgaaggcattctcgtttccggttggtaacccacgcgttctcacgcgagagacacttctatgtgcaccgacatcaccgcttccctggtgttctgtcgacgcgaacacattcaaagggctgttgtttgttcgtgttctgcccccagatccagctgtacacccgctaaaagttcctttgcttccctatcgaactaccgacgggcgcctaacttttccgctttgtgcacgctgtgctgacaaccgacaacaacgggcatgcaaacacattgatgcatcaagggcatgggtttccgcgtaattttgtgaaattaatccatgtcaatttactttttttgtcccggtgtttagatacacccatgttgaattgaacaaagcactggagcttggctataaagttattgatttatttgaggtaaaaataacgtatcgtttattgcacataaacttcaaaaaaataaggtatggcattatgaagaatgggataaccaactgtttcgtgactatatgaacacctttgtgggtcttaaagttcaagcaagcggttggccatccggttgtgataccgatgaacagcgcagagcctatgtagatgaatttaggcgggttgaaggcattcagttggaccacaacaaaatttcaaacaaccctggacttcggatggttgcggtaaaaaaaaatacagaattacaattttttaaacttaaaaaaaaaaaacacacacagaaaattcttgcaaactccctctggggaaaacttgcgcaacgagtcggtggaacggaagttcgttatacccgaactccagctgagtttcatgcactgctcgagaatcgcaacatcgacattattgactttcatcacgtctctcaccatatggacagagtggtagtgaggaaaaaggctgaatttgcaaaagcaccgtcaaccaactgcttaccaattgcaatttttgtcacttcatatgctcgtctacacctttatgactatatggaacaagtgctgcgtcttggtcataagctcctttattgcggtgagccaaaaaaaaaattttttttcacctttattgacctattattcaagataccgattcaatttattacgtgacaaacaacgggagacagcaggtgcctgaaggtgaagcgctgggaaagatgaagagggaacattgctcgaggcgaatatacgaatttgtgtccggtggtccaaagaattatggttttcgccattgtgatcgcataaatggagaggatgagcgtgctgaattgaaagtccgaagttttcgtctctcatattctgcgcagcaactgctcaacttcgagtccatgaagcgcattgttttggaacattacaacattgatggacaaatgttaacacatttttctctcacataataatccagaaaaaatacactaaaattctattccacagagatgatgtgctggacatggaaggtgttcatgttgtcccgggaagcaacgcgtcgataagaatcgaatttccacaaattggccgaactccatgttcggatctgtacacctacgacgctcacaaagactaccaacctcattatgtgaaggggcgcattcgccccagcatggaaactgtaccattcggatttcgtgaagcacaaacggatcaagaacaagctgaacatcaccaacgacagctgaatgattttgataacaacttattaattgttaaccttcccggatgctcaaattggaatcaataaaaaaaaaatgtaacacatagtagaagaagaagaagaaacttgcaagcgtttgtcatacagaaagaaattaataatttacaatatctaagaacaatcgcaaggcatgagacagatgttcctgctttttggatcctgtaaaaatgatttttccagaatgataggctaaacatgtgaccaaagcgtgatgattgtctacaacaatcttacaacgcatagcgggaaaaattgtgggatcatattggatgttacgaaatctgtgtgggtccagtgttggtataaaattcaacagaggcaaacgatggggtaatgtgaatgaaccaactatgtttgtcacacgtatctcatggagttctaactgagagcccaaagcatgctgcacccttcttctgattttttgcgcctcgcgtaccgctctgtttggacaagggacacccgttaacaccgcacgggctgatcgaaatagaagacacgcaagagtgcgttgttgaggcagacgcagtcgtataatgattgcatggaatcgttggggatcgtactccgagttgaatccgttttgagcaattttcaaaaactctgtgtttgtgaagggcgtccgctgtagttgaaatgtcactgtacaattttgaatagttaacatttattttttttaatctgacattaaaaaacgacaatatttgaattaaaaaaaaaacacccgttcatcatgcatcatcatcatcatcactaaatcatggttctttaacaacaacaacactaagacactcaagcgggaacagagagctatgatcaccaccaccaaattgaagaacacatggcagttgggggtaagccagctttataccatgctttacatagtagtagacgcgcacctaaagtgtattgtacacatagattggttaaatttaaataaatcaaagacaaaccgtaatgccaagataaccgcgcatagcatatgcagtttgagctggatgaattgttagttcgttgcaatggacgcgaatgtttttccaggcagggcgcagatgattggtgcgtaaatgaagattggaacgcaacatttccgaaatttctctacgtttgctcagcgtctgcagcagaacgtgaagctcattcattgaacatttgtagtgtttgcagagaaaatcaatcaacggcacactcttctgcttttcattgcaactgcacttggtttgtggttgcgggtgctttggcaactcaatgttgtctaaatttaaaaaactgtttttaatgtctaaaaataactaaataaacctttcacttgttccagttccatttgatcattttgcaattccctcgcccgctcctcctcctcctcgatgattttaagccaactcatttgtccttcctgaaaatttattttatttttttactaatatagttttatttataaacttttttcataaaaaaaatacccgtgttgctttatctttttcttcatttcctgttgtcatcttttgttccgggtacgcattgtggagccaatcggtcgcaagaatcgcgtccatttgtttaatagttaagagattattattatttctgtaaagctttattgtgtatatataatattttttaaacatggataatataagataaaccgttttgcaaaaaaaaaaaaaaatggcagacaattttcaaaaatttgatgaaaaacacttacaactcagacacccgtttacgctgacaatctcagggagcacggggagtggaaaatcggaatgggtgttacgaatgctgaggaatgtgaatgcgctagtttcggaacccatctcggagattttctactgttatggggagttgaatccaaatataatacagcttcagaaaagtggacacatcggcggttgtagggttattgtacatgctggaagcccaaccgaagagcaggttaatcggcgcgcaaaagagtgtgatggaaaactgttgatggtgttggatgatctcatggttggattgggccaacaatttcttgacactgtgttcacccggggatcgcacaattggggggtcagcgttgtgttggtcactcaacatttgttcgcaaaagaactgcgggttgcgcgcaacaactcccactatttggtgctgatgcgtaacccggcaggcgcgctccaagtgcggacgctcgcctctcagctatttccaacgaaaagcaactatttcacggaagcataccgggatgcaactgaaaagcaatttggctacctactaatcgacatgcaccccgagagtccggaattgttgcgcctgaaaacgaatatatatggagagcagggtggtcttcccccattggtttatgttgcaaaatgaagcatgtcaaaagaagaaaaagactaacagataaacatactatgaatgttagcccgctgatgttgaaaaatgctgacttcttacaccactttcgctcaaaatatcgctcaaaaagcagacagcgcaaaatgatagagaacgctttggatgagcagttgctctgttttgtggagatgggtttcaatgtgttgaagggtcgtgttccgttagggaagcgacaaattcaacggttgggtgcattgaagcaccagttgaggcgcttagcacgcgcacgttgcgcaaaaaccgcgcgcagagtactattattgaatcgtcaagaccaacaacaacaacaacaacaccaaaccggtgctggctttccggtggtagccagtatgctgacaagcattctcttaccagtgttaatggacaaattactgccaaaaactaattgataaatagataaaaaataaatatataaaagcgaaacagctaagagagcactcgtttaattaaacatttagaagagcgcaaaaaatgcgtcacgcaatgcgaatgtttctcgtcccggaggacgtctttcagtcggtatttgttcaaccccaagcagcaacagcagcagcagacggtgccgacggtacaccaattgggcttttgcgctcacgcatccaacaaattgagcgtagcagggagctgaacgaagagcagaaggccgcgcaataccatcaggaattcaaacggctcaacaaactggtgcgcgagcaggaggagcagccgatcaatgttcgacttcagcacgaaaaggagagagaaaaaaatgcagcaacgccgccgccgccgccgccgcaaacgataaatcattcaacgccaaaaagattggagaaaaacattgtaccatcagcgtttgggttgaggaggcagagacaccactacacacaaaaggcgggggcattatcaaatcgcagacctgcccaaaaacaacaaagaaaagcagcagcagcagcagcagaaacaccaaacagcagtggaaatggagaaacggaaaaagaagagggtgatgtagatgatggggaacagtgggacgacgcacaatcatcatcatccacggcgtcaacaggtggtgtcgcaccaaaaagaatgctcagagcaagagatggggaagcaggaaaaggaggaggaggagaaacggctgatcgccttcaaacaaaacacaactaccagatgaccaaaaatgcactgatcacacacattcaaaaaaaggggcacagtctgggagtcagtgatcagggaaaggttttgcgcacagatgggtccgagtttaaaacgagcaacgtggaggcaattgtcagccatttgttgaacagggacaagcgaagcgaattcaaagggccgcctgtgggctataaggaatttgctgaaaaggctagagaagatccgttgctaaaaaagtatttgtttccggaacagcctctacaatttggcaaaggcctgactgactttaagcatggaaaaggacataaaaagaagtgcgaagggggaggagggaaaagtgtcttcaggttcaaaccgacactatggtagtcgaccggaagaaagaacagctgttggaccagctgtacaaagatgttaactcatcggtcagctttaccagcgttgagccgcttttacgcgaggcgaaaaaggtgaacaatcaaatgagtagaaaggatgtagtggactatttggccacccaacgcacatacaccattcatagacaagcgaagaggcgctacaaacaactaccaacactcgcttctggactgcacaccgaatggcaagcagacctgtctgtctttgacaaattgtcgcgagagaatcacggctacaagtaccttcttgtctgcatcgacacactgagcagacagctctttgttgagccggtgaaaagcaaaaagagctccgacatggttgctgcttttgaacgcttgtttaaacgctccaaatacataccatggacattgttgaccgaccaagggctcgaatttaaggcaaaagaggttcaggaatatttcaaaaataagaacgtgaaaaacttttttatgtacacctcgccgcgaattcacgcagggatggcagagcgggccaaccgaaccatcaaagaacgcctttatcgctatttcacggaacggggtacccaaaaatgggttgatgtgatacagcaaattgtgcatggaataaaccactcgtacaactcaagcataaaaatgcgcccagttgatgtgaattttgagaatgccgaaaagctcaggaaaaaactcaagcagaacgctattggtgggacagcggaagcagcagcagcaaaacggaaacaaccacaaccacgttttaaggtgggtgaccgtgtgcgcattgagaagtacaaacacgtgttccaaaagggctacaccggacgcttcaccaacgaagtgttcactgttgccgaagtgcacactgaccgctttcccgtcacgtaccgaatacgtgatgacgacggttccctgatcaagggccgtttctatgccaacgatctctgtcgtgtgctagtgcgcaaaaatgatgatgatgatgatgatgatatcctatatgacattgaaaaggtcgtccgaaagaggaaaaagcaaggtgttgaatacgttttggtgaaatggaaaggctacagtcaacggcacaacagctggattcctgcaagctcgatgacatggaaaaatatataaaggggctcttttttttaaatttcaaatgagaatgccttcatccaactcattctatgtgatcgttccttccaacacaaatgttgaaggaaatcgcacaaactcttttcgagttcgactaccaagaaaacttcaatttaattcggaatgggatgtgggcttaggtgtgatcatatacccccattcgtggccctcactcggcacatcagaggaccaatttgttcaaattgaatggaaaattggagagaatgttcaaataccaattccatcctctaacgtgacaaaccccgttgagctttggaaaagtctttacaaactgcttgaagaaggcaacaaaccgttcgcagttaaagtggaaggcgtacagaaaaaatttactgaagcggccaatacagcacgtcaattgggcagagccgagtacatcaataaacaacaacaacaacaaagagacaaaagaaatgttaatgatgatgatgatgatgatgataaaaacgaagaagaattattaaacgcccttttagcgggggttgacacgttgcttgacctttacggagcaaccagtggtggtctacttgagagagaaaaacgtgcagcaacaagcaaggtccccctgcggaattgggatgacactgaagaggaatatcagaaaaagcttgataaatattttttgcgtctacgtggccgtaatttagaacacttagagggactgataacagaaaagttgaatgcggaaattgcactgatggatgacgaagaaaggacaattctcgatcaaaccaaagaattaggcatgacagcgtggataaaaatttttcaatcagcgtactctgcatgtttcctgcattttgacagtgcaacgaacagattttcgttgaaactggacgatcgttatgtgcaaaaaataaaaatttcagaccaattggcctacattttgggttttaactcaaccgatttcactgaaaaagaaacgattgcaaaatttatgccagacatgagtggaggagttgcttcttttcatgtttatgcacctgatctaattgaaccaatgatgattggtgacgtgattgccccagttttgcgtatcgttacgattcggggaaaacctgacgaaattatagaggagcagtttctctccgtccaataccatcgcgtactagtcaaagaaataagtgaaattttcatcgaaatcagaacatccggtggtaacctaatgccatttcaatacggtacatgtacattaaccttacactttagaaaaagttcctacttttaaaaatgaacagtgttcaaataaataaaattcttgctcgaaacccagtcacgcgttcgacctttttagggtgttttccatcagatcaaattccagcagtagcagccacaccagctccttattcaatggtgattaacgttgatccgagcggttcacctggttcacattgggttgccgtgtattgcgagcagcaaaatcgggtggaatactacgattcgacaggaatttggccaccgctaagccctttcatccaaaaatttttaaagagttttgctcaaattcagtttcatcaactttcgctccaagcaccatactcacactcatgcggaaagcatgtgattttctttatatttggacggtgtatggggatgcactttgaagcaattttgcaactgctaaaacgcgcaaaaatatcaccagatttttttgtaaacaaatttatgcaaaaaaatgtgtttaaacaaatataaataactagaaaactcaatttaaaaagcgcaaaaaaaaaaagaaagaaaaatgcacgttgattttgatccttttaaagttgaatggtcagcattaacccaaatttctccagaagtagtcgtccaatacggtggttataatgtgttcagaggggttccataccagcgcggtagtggtatcgggtctgtttttaggagtctattgcgttacctaataccaattgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaggtcaagggttcgactttaaacgatacacaaagagaaatgatgcaagagaaggtggtgcaattggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaataaaacaaccccccagaagcacaatcatgagttgttcacaaaaaattagcgaaagtagtccccttgccacaaatagtgctttgaacattttttcagtacctccaacaaatgtgtcggttgtgcgctcatatttccgtgaagtcctccccctagtgacaataacgcaagaatctccgtatctttttcgcctgtacagtgacaatctttggaccgatctttcccggatttatctcttccttgacctttcaatagaaaaaccggatgtggacggcaactgggtgtcaatcgcagctaccgatgctcaagtcggcaccattcagggaattggtcaaacatttgttcaacaactaaaagtctcagttggaaacactgaaatttacgacagcggaaatttgtacccatataaggtttacattacgaacacactttcgtttccgatgaacgtcaaaaaaagcttcctcgcttcaactggtcactatgcgacacgcacacacgacagcgtcgctgatgagggctttaaagctcggtgtaaaatttttgagggtgggaagcgagcccaatttctttcacgtctggactttgacctgggaaaccaagaactttatttgttgaacaatttggatcttttatttacaatttacaaagctcgtgacactttcatcatgcagacattgaaagcaaacgatactaccaaataccgcgttagagtccatgacgtaaaactgtatgctaaaatgattgatgttcagtcatctttgaatttaagcatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctctctctccatttaattttaaaccgtttgacattcgagacattgcagtgtacgctggaggcatgatttacccaattgttccatacaaacttgactttgccaaagatatttttgtccgtccttttgttgacatgtatgaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaattaactgtataaataagatgcataatgcgaaaaaatgccaccataaaaatggccttcttaaacactacagtcaacgccagtttaaagccagagatacaagtactaacatttgaaaacaaaagcgttcatcctaacctcctcgtgcaacttctattgcttgcccactatctcattgcttttcccgttttcattttatgctggtattctttgataaattttcttaagagaagaggacatatttctcagcgtgatgccaatgagatgatggatgatttgcgaaattaccaattaccaaaaaattcatcagttatttttccaagtttatcaataaagaaatgattaacgcacaaatattcaattttttttcacatgatcccctttcagccgtgatgaagatcaaaactaaatttaggagtgcttttcgttcttttgaaaaattaaggttacgtgacaaacgcatatgggccaagcttttccaacaacgttaattggattgttatgaggagagttgacgatccaccactcggatagagccaactgcaaatctctctgtgctcattacgaaaaattgtcaacgtgcaatcctgtctcatggtgaattcacgaagaaaaaacaaaattgcaatcacatcaaggccattttggagtttgtgtctcatcatcttcaacaataaaatgcatttttaatggatttaaaaaaaaagtaaaggacatgctcaatcttttttttaaagctcacaacaaatgaatcatttttctctctctctctctctatcaatttttcttggccttcttggttgcaatctcatcaacatcatttttttcttttggcacatcactgtcatcattccctgggcacttcttgaaaaggttgacaatccaatcaaatccagtgtacgtctgattgttcgcctagggcgtggtttgtcaaatacataataaatagcaacaaaaaaaaaccttaatgttaacttttgcgatcagcttcacagcaatcaaatcgtccaagtgtttcgcaaggctttccggctccttctccttggcgagcaattcagcagctttcattcccaaaaactcttcggcaacactcgaaaacatggtgacacgttgagcaatgtctgcttgttcaacatcctgcagcagaagacggacaaacaccgtgtggatgggagcaatcgctttttggccgcaagcctcacacatgttatcatcggacaattttcggcggcaaatgagccccttggaacgaaatgggcatgcctaaactagaaaaaattaataatttaattaattaatttaatttggactttgtaaacacggtactgcatatttgtcacttttcccaaaacataaaaaacgccggccgaattgaagttgaccacatcgctgatgtgtttcggttcaactgaatccaactcctcttgctgtcgtgtcccttgctccgggagttgaaagcgtttaagagaattcattgcaggaagatcggaaaaaacgaaggaggatggaattttttaaaaaatggaacacgaatgatttttatttagaaaaactgtgattaaatagaaaaaaaatggggcgggacaaaagaaactaaaagcaaaaaaggcggagtcaacttcttagtaaagcaaaacaaaaatcaatgggtgtgaccaacaagaaaaggggcggagtctttttactttgcatgatgacgtcattttttacaatttaatgaattggagttttttgctaatttacttaaagcttcggatatgatatatgcaataggcttgggtttattgattatttgtgtacagtccttacaataggttttgccttttttttttttgggggggggggggattattttttaacctcctcatagactggggataattggagactgggggataattagagcaaatactgtattttctctctctcgaccccatccaataggtttgggtttgtggaaggggatgtcagagaaaaaaagtagacacactcaaattatcgatcgaaaatcaatcgataatttgattgggaatattatctactgatgtgaaattaaataaattttttaaatccaagatttaattataatttttttgaagtgaatggcgatgctattaatttggacaattatggacaattatttgatggaaaaaacagtgaacaatcgatcactgatcagcaacagtttaaggtggactaaagaacagaaacaattgggagaagtatttgaatttataggagacaaaactgattttttaatttaaatttaggaattccatgaaaagtttgccagaatggaaatcgaattaaaaatggccaaattggaactcgaaaatgtgagatttaccttaaaaaataacgattaaaaatttgtctaaaaatttagaaggaacaaaagttaaagctccacgaactgattggagaacagaaggcattaaaggaaaaattggccaaattggaacagaaaaagggaaaaaatggtaaaaaaaaaagtaattaaatgaaaaaagttacaaattaattttattttattaatccacagattgttgtcaaaattaatttattttcagcaatttttccaaatctgagcacatcggaggaaatgattgttctgattgccagaattgctgagctgaatcgagctaacacagcggaaccatcaatcgcaagttctgctgatttgtttggacaagacggaaacggtaggaaattgggggatactgtatcaaaattatactgtca

SEQ ID NO: 25 - DNA, 2577 bp, Heterodera glycines
cttcggggtcgctgaacatgatttgacattattttgaccaatgttgagtccttaggccgggattcaagcaaaaggtcgaaaattcaaaatttcaagtttcaccctttatatattcgaatctgcttaaaataaccccattttactgttgcattctgaggttttttgtggacgctgatcatgaatatagcattttatgcttgttttaatcaatttaagaatgaaacatggataagctttgaattttcgacgaattcgggtccggttgtccataaccgaaacaggtcaaaataaatgttatattcgtgaacagcttccccaaaacccttagatgcatgttttcgcgccttttaaaacaaaaaaatttctaccaaaaaaagaaggagagcaccatcgcagtattactcaattttaaaataaaagtgcgaaattctgaatcctcgacaattgccaaatcaaattgaatgaatgtgtgtgtgtgtgttaagtgataaaagccactatgctttaatctcataattaagccgaggatttgtaggggcaaaaaatcccaaaaaggggagaaataggagcgaaaatgttggactaaaaatgttaggtgtaaaataaaaaaaaaccatgtttttatgaaaataaattgaaaagtgcttgctattgatttttatagaagtagaaaatcagaattattacaaaaatcaaaaataacaacaaaaaaattgtatgcagatatcttaatgaaaaatggtccgcgatacagtttcttattgaatatggcatatgatataatgaggaataattcaatagacatgtttaaattcatcgccctcccctttcctcattagggatgtgtcaaaactttccaggaagtcgagtccgagaaaaagaattcgaattctgtatccaacccaggcttcaattaacgaatcctaaccatgtaattttataaaaaagcaaattgattattcaatgagtgccatgtcaactactattagcacaaggaaaaaattaattttataattaattttattattaatttaattggattcaatgaaaaaaacattggaacaaattccatggatttcatatttaatttaatctgaaaatttgctatattcgaatagatatttttatttggttacctttttaattgatattgaaaatagtaataaggaaaatagaaaacaaaaataaataaatttagcgacaaaaaatatttaaaaatatgacaatttgaatcgagatttaaattaatattacgatagtgaagctaaattattatttatttttaatattgctatctattttttaaaataatctcaaatataattaacctaaatcaattttcatttttattagtcattaaaattgttgtcgttgataaagattagagacaccattttttgcctatttcggggtttttgtgcttaatgcctatttgcctatttttgtgcctatttcgccatttttggcgcctttttcaggattttcggaaaaaactttaacaaaaatgcaataaaaacgaaaaatacactactaagaatagacccgaaatattttcagaaaatggggctgttagttttcgacagtggtgatatcgacagtgttggtttcgacagttattgatttcgacagtaaagcttatttttaaaaaatttgttccatattgcataagtctcgtaaatttgacaattaaaatgataagaacatggctcttatacattgcagaggggttcgagattttccaatttgtaatggctgatcaaaatagctgtggtagctcaaagtgctgtgggagcaaaagcaacaggggccaaaatgaaggaaagatgactccaaacaacagtcaaccctccagtggtggatgtggtctagtggctaagacaacgggtccacgtaaggggccccgagcagcggttcaaatccggccttccactccaatttttcgcctaaataatatggttacacttggcggacaccccaggtcgtttggtcttcacaccactcgacactccagaaacaacagctggcaatggggcaaaagaaccggaggcgcgccgatccttgcatagagggaacggcccaacgccatctctcgagagagcgtgcacgaatatgagaggaggggaatgtaatagctgacgttgtagacattctcaattacagtccgatcactttcatatatatgtcattggacggacccgtgaggtgttagtattgttcaactttccgtcagaattccaatttttgattcaggcaatttccgattttgggaggcagtgacacttcgatcctggaattaccgatgacagtatagaattcgcaaattagaggggaattggcaagtttatcatcggagaattatcgagaaagcatgtatatttaatatgaattctcactgaacagtcaaaggaatgagtaaatgtaaagcacggtccatacgagaagagaaaaagaggggattcgtttcactgggagatcaatcgagcaatcacgggacaaagggggtgtttgtttgcccattccctcagcattagccaaggagttcctggatcagaaagctgtaggggtgggtattggtta

SEQ ID NO: 26 - DNA, 12023 bp, Heterodera glycines
gagagttagaatagggatgatttaatttttttaaatcgatcttttttatttgtaatggcttttacaaatagctgtggtagctcaataaatgaatattaagtgctgtgggagcaaaagcaacaggggccaaaatgaaggaaagatgactccaaacaacagtcaaccctccagtggtggatgtggtctagtggctaagacaacgggtccacgtaaggggccccgagcagcggttcaaatccggccttccactccaatttttcgcctaaataatatggttacacttggcggacaccccaggtcgtttggtcttcacaccactcgacactccagaaacaacagctggcaatggggcaaaagaaccggaggcgcgccgatccttgcatagagggaacggcccaacgccatctctcgagagagcgtgcacgaatatgagaggaggggaatgtaatagctgacaataaagccattctcaatggccgtccaatcactttcatgtctgatgagagggacggaccccaccctttgtgcccgtcggatttcctttccccccgttcccaaaatttaataattgagccggacgaaccgggagtaccgttccaaccttcttcctctaagaaattggcccatttgtggtgcgccactaatgagtccctccggcgtttttggaaggtttggagccgggagtaccttctaattttgaggggccgcacccaggacacccattccggcccaaggatttccgctccgggccctcccaaaattggggatgttgtgcttgtggaacaggaggaattcccgaggaatcactggccattggggggaattctcgccctgtttccctcggagaagcaacggagtgcaaaaatattaccgggaacgaggagcgaatgggaacggccgactaatcaattggtaccgttagaagtcacaacagaatggaatgatgtcccacccccgctcatgataaccgacaaagaagggagaggcaaaagagaaacggatttaaggggcgaaaagctgaggaaaaatgccccgaggcaattcaacccaggcggaaaatggactcgtctgctgtgagggtgtatgcagcagagaggacactcgaccccttatttgctcccacttccaccagatttgctggctagcggatatgaatgccatattacctattctttggcgggggagagagtttcctcattagtgcaatgtgatccggtggagggggataatttaattaagtgtaatttttgttgggaacggattcttaacccgcactgtgcccccttcttattaccctttgtcctcggaacacttgccggtgcaattgcggtcttatttctcatctgggtttgttgggtactgaagcgggccggttttgatgtccatcgagccgacttgtttgccaatttctccagggctaacactcgacggggaatccccgagtctaccgtaagatggagacgcggacctagtgtaagagaggaaggatcggacgaggaaagcgaaattttattccaccagggtcaattaatggggggtcgcttgggccagggggacgagtcacccaggcctagacgcctgacccgtttgggatacgctttggccccgccaattatcgcatttttattgccatttgttgggttacggcagtaaatgctgggcttgaagtggtgtcggtcactgccggcacataggaatccaccaccgattacggtggaacgacgtgtcactttgacagcgtcagtgctctaacgttgctgccagtcggctaacgagtagagctagtctttcatacccctcacaccgaacccatggccagcctatttttcatacaaattgtttaaatgtcccacttggcagtttcgtttacggctgggactgactcttgagcgtgaaggcttgtcccaatccgaggaagtcaaataataattttactaaccaattttaattaattagatcgacgataatatgctaatttcatttatgaaagttgttcaagaaaccaaaatattgttgaatgagcagagattgaattatgaaataaaatttgaaaatgaacaaaaattgccaatttatgaaatgtttttgcaattagcaattgctcagcaaatgaatggcaaacacatgaaaatttagaaggaataattcggcaaaaatttgacaaaaattttgaggaaatgcaacaaatgatgacaaacatgaaataattgtggattctaaattcgataataaatggacatggatgagacttaaaattcaatgaaacttaaataatttcaaaatttagattgatgatgctttattttgtggatttgtcaaaggattagaaacaaattcagagaaatttttaaaatggctaaagtattttcaaattatttagtcaagtgaaagagaaaggaagttaacgacgatgaattgaattacgatgttaaaaaggagaaatgtgaggaaaatgctttcaaaaaatgaaaccaaaatgaatattgccaaacttcgtaatgaattggatcaaaaaatgaaaattttatccgaaaaagccaaggaagcaaaggggaaattagacaacgcaaaatcagaagcagacgatgataacgaaaatgcagatctggatgatgaatatgatgacaaatttggcacttttgtttcgtcgccattttcataatttttggtattgtcaactaaattcggattcttctgctgattattgcataattctttttcatttaaaattgttttgagtctttttttccccatttttaattattatttttctttaaaaattcatcattttttgaaatagtagattttaaagttggtttactaaaatttcttggacaaaaaaaattaaattttttcatgggaatgatgacaaatcttggtcaaaattgtcaaacacttaggaaaccatcgattattacgaatcgaatcattattataaaccggaattttatcgttaaaggaaaagtacaaaaaaagtgaaaatagaaaagacagaagaagcattacgaaagaataaaggaaaaatacaaaaaaaatcagaaaaagccaatcattttgtagaaagaaggatcttatgtgaaaggtgacgaattaaagtagggttcggaccccgtgggcggggtggtttttagcgggggcgggattgcggggatctgagtcgcgggggcgggggcgggggtgaggccaaaaaacctgtaccgtccccggggacgggggcgggatccgaacactaaattaaagtgtcaaatttgttatcatattctccactcaatttgtgtcttttttgcgtggtgagccgaagtgacaaaagtatcaatgttcgtaatatttaaatttaattataatttttattttaattgtttaataataaaccataatttagcttaaacttatttaaatttatccatcttggtattagaatgtagctctacatattctatattcttatgttatttaaaaaaaattagtaataatttacaaaaagctaattattctgtaatttaattgtccccactcaattcaatctttgcagttccttgcagcatcttgacacaggaagaaattattggcgtttatcagttccattgtcatccgaattttcgagtgtttggacaatacccacttaaatctttgagtcaagaaagggcttggggatcgtcaacaatttttttgtcattgaaaaggtgtccggttttttgaaagagacagtggggagcagccgatacagcaactgtgtgactgtaaggactaaattgaaaatatggaacgaactggaatcaattgaaggatacaatgagaaatgtttgggcttttaccttttgtgcgaggttccaagtaaaagtactacaaaattaatcaatgggtgaaggtgatgaattcactacccgaaacgaaaaataaaaaccaagaaaaatagctattttttaaatgacttaattcttaaaaaatttcacccgaaagtctccgaatcgaaatttagaattttactattaaaacaatagatttatttacattaagttcaaaattggagctgcaaatgttcgacaactttcgaattttttctctactattctgtaaagaagatttcaaacatgaaatcaatcaacgaatttttaacaatgaaaagcgggaattggcttcagaaacttttcggtaggtggcagtctttatgaacaaaatatagataaaatttatcgaaattgttaattttttctttatttttcgtaaatatgtatttttgtgcagaaatttcatgtctaaagaatgagtctctactcatatcgattggtatgcatatgcatctgtaaaaacgcacaatgccgctctctgactgtctgccggctataaaaatagcactgcatttccgggctcacttcttgtctgtctctgttttcttcacctttcacttgatgagattcaatttgattcccttcactgtttttcttcttttgctcttttctatcaaaattgtaatcctattctgatattgaatggtaagcaatgattaagttttattttcattttcaaaaagtcacttcatgccaaggatgatgcattgaatgaggagaacgggatttcgttgaaagtggacaagaaggaaatcgaattggaaaacgtgttgcgttaaaaggaggtggaggatttgaagtttaaataaatttcattgttttaaaagcaggccaaaaaaggatgaaaattggatcttgtccagccaattatcctcttaagtttttaggccaaaatttttattattcagacattcatgataccgatttaaaaaggccttcggggtcgctgaacatgatttgacatttattttgaccaattttgagtccttagcccggattcaagcaaaaggtcgaaaattcaaaatttcaagtttcaccttttatattcgaatctgcttaaaataacccattttactgttgcattctgaggtttttgtggacgctgatcatgaatatagcattttatgcttgttttaatcaatttaagaatgaaacatggataagctttgaattttcgacgaattcgggtccggttgtccataaccgaaacaggtcaaaataaatgttatattcgtgaacagcttccccaaaacccttagatgcatgttttcgcgccttttaaaacaaaaaaatttctaccaaaaaaagaaggagagcaccatcgcagtattactcaattttaaaataaaagtgcgaaattcaaaaattttgagttttcgacttttttgttcaaatcattattcggggctcgaaaatggtcgaaattaacaacaaaatcatgttcagaacttcgaaaaccattagaaacttattttttcagtgacttttaaaagctaaattttattcaaaaatggggtcattccatcggcagtattaccgaaaagagcaaaagtagttagttaccagggcgggtagcgggtagcgggtggtgattgatgggttgcggtttctttgaaggtgccgccgtgattaatgagtgcgggaatgagtctatgcctatggggggggggtaattaattagcgtgggtgcctgagggggtagtttttgcgggaaaatttcccgcatttgtgggggagaaaacttttttttgtgaatttttttaaacgtttattaattatgtggtaattaagggtgtgcctgtgggggtagttttttgcgggaaaatttcgcgcatttgtgagaggtgtcatttggggggggggacgaaattaatatgcattgtgaaggggagggcgccgcagcatgtgtgagagaaaagtcagagagaatataaatcaaagagaatgtgagatagttagagaaaattatgagagagaaggggggggagtaaaaatgtgtccttttcgtgtcatacgccgggggggggggtgaaaaagtaaaaaggtatggagcaaaactttttggccaattacatagatcagataaatattttgtttatgtttttgatcaagaggatgtgtgtttattgggaatggaaaatgaatgaaaaagaaattatgcatgaagttggagggggggggatggtgaagttaggttatcctgtgggccattttcatttctcatcaacaacaaaaaatggagtggctcaactatagctgtacttcttacccggggggggtgctttgcaaccgcccccggggctacacaaaacccgttctctgtgtgcattggtccattggcaatttcacgcaatttctgcgtgagtgcgttcaagtggcggcagcgccaaatgccacggaggcaacgacgacgacgacgacaaattgcccaaatttgtcaaatttgatcatcgccagcgccgctctgattttggtgctcttcattgtccaggtgtgtttttttttattttttgttttatttcaaaaatgcaacccccccttcccatacagatggtgcttttggcgctgaaattgcgccatgccgttgagaatcggcttctgcatcggcggcttgtgcgccgacaaaaaaagagtgagttttttcccatcccaaaataaataaataaataatttttttcaagaccagaaaacgcttcagtctctctgacgccagggtgcgcaggcgaccccattggtcatggccgccaaccgcccctttgtgtcgcctttggctgggacttcgcaggccgacgtgattgttttttttctcaacattaaatttcagcccaatgtgcagcaccgggtgaaatttgcgcaagatgagctcgtgtactatgtgccggcaggctgaacgaattgtctgagggctaaagagagttagaataggatgatttaattttttaaatcgatctttttatttttaataatttttacatttaacttttgtaaagtttaataaatgaatatttggaaataaaaatagtatcaaatgtatttgaacagaaataatttctgtaatcggaatttgctagaggaatgagatttttgatttgtttgagagtccatttggatgattgatgagaatttttgaatttgttttccgttattaatggaataattaattatatgcgccccaaaatgtcggtgaatataaaggaaaattcgccagatgcgcaaattggggtcaagaacacacattaattgttttgatcaaatttgattataaataaggaaattgtacgagcgagattcattcattcattaatacataaaatatttattattattatttctgttttcttaaatatttcacaaatgtctcaacaatgtaatttaatttaatatttttattattcatctaaaaatccgttccctttagccatgaactcatcggactgtcgctcaccgactcccgacatggagctaaacgaattatcgtcctggtacgacattctgcaggatgatgaggacaatgtaaaaatgttttttcatttttcattttcaaaaattattattccagattttaaattggttcacaccggtgacggctcgcgacgtttgccaggaggtgttagcaattgcacaagagcgctgcatgccgtttgaaaagattgttaaatggaagcaaattttggacaaaatttgtgctcagatcgcccaaaaaaaagtgatcattttgtgaggaattcattttaaacgtatgcgcttttttcacactgttaaaataaaagttcattttaaatttatgtgagaattatatcgaattgttggggcggtgggggggggggttcagtgttgaatgtggtacgggactcagtactgaatgcccaatcagcgatgcactcacacggggctctgttaagagtgcccattcttttcaaaattccgtttgcgcaatttgaaacttaaaatgggccgggtttcacagacggctggctgtatataagcagctgatcaatctgacgtcctccatttcattctcaaaaattttttcccaaataaaaatggcaattaatatttgcgacaagaaagcgcttgtgaatcaaatcctcgggcaagcggacattacagtgacaacaagcggcataaccgtgagtgggccacgtctgtccacaccacggtttattccgttcgatgaatgcggccgttgccgcgcatgtaaagcaacagaggttgagatggacacaatggtgaccaaagaggggatcacattgtggtgcagccgggtcagcaagtcccaattcgtcccatttgatgccgtttatgatctacctggtcactgcttcttccgtgtgaaaaacaaggccagggtgttcaacgtgccctacggtgacttgccctccgacacgtgcaccactcccaccactacaacacaaggaacgcaaaccaatatgcagcaggacctgaagcgcaaagctaaggtagcacttgatttagtggaagccgggctaatggccgataccatgcaggacggcgtgcgttggaagaaggccaaaaccgcattcagtgtactcgggaacctacttttagcggaatcgttggacaacaaagtgacaaacagtcctgtggaggaacagaattatgtccaggaagagcccagacgagacgaagaggaaaacaaggaggaccttggcgacattgacaaaacgcttgacgagttttttgctagtattaaagcttcgacctcaaacatgtaaatcattttgtccccaaaaaatgcttaatacacaatcctttaccaataaagatatttgtttcaaactgccatttggcctaatcatttcgggtccctcctcatcgggaaaaactgaatttttgttaaaatttattgctgaatcggaccaactaatcacaccaaagcccgtctcaatgctctattgttttggtgaaatgaattcgacagtgccgccgcttcaaaaggcgggagtcgatgtgtattcgggagtcccaccgtttgagcggaaaatcaaagtggcccgcctgtccgctcagtacctggtgctgatgcgggcccctaattccctgttgtccattcgcaacattggtatccaactctttccgcgtcagctcgactttttccttgatgcttaccgcaaagcgaccgcccgtccctatggctatttgatgattgatatgcacgctgcatcagatccatcgttacggctgcgaaccaacatatttaaggacgagcagcagggtgaagacgaaggaacagttgtattcattcccaaaaatggagcggcataaacagcaaccagtaaagattggagagctgataaaagagaatcgcggttggctctgtgccttggtcaggacaaaatccggaaaaaaatgcaggaaacttatacgaaatgcaaacactgaacaactactatcgctggtcgaaatcgactagccagagtatgataattttttttatttgacagatcgattcactcccaatgcaatattctgatcgctttgtacgcttttttgccatttttctccaaatcggattttgtgtcaaaattgtcattttcatttttggcataaattttataactctcgggacatgcttttggatacaattcatcagccgctcagcttgtgtgatggccataatattgcaattgtgcatcggagtggaacgattaatggccgtttcatttccaatttggtaattttacagcggtcaaattttggcacagaaaaaatgtcgatatttatcgcattttcaggtacaatatgagcggaaagtatttagttttcaaagtgctggtcattatctctacaattaaagtgattgttgataaatgcgtggattattacggcagttccaagcattgggaaaagttgggcaattcggcaaatgacccattttactttaattgatgtttcttttttcacagattagtcagatgcgaactttccgacccggcaaatcaatccgaaatcattggttacacagtttataacatactgattattgaggttgctgaatttttgtgctacgcaatgctttggctgatcagttggtggaatcagtgtcagtgaatgatcatattaattcataggcacaaaaaataaagccgcttggaaaattaccgtttagattttaacaaaaaatgatttttgttgattctttggcaaaatcttacccaaaaatacaaaaaaaatctaaaattttatataaattttttaatggaatttctcaaaaacctctgcattattaatatataaaaagtcccagaataattatgacaaattcatttaccaaattgacatttagctttaacggacgtacaaagcaaacggttgcttcgttcagtcagtttaattatgtccatcaatctcatctttcatatcggagtttgtttatttgaatttcctcaatattataagcagggaacggatttatatgtttttacatattttttgcgcatatgtcatcgcatgaaaagctcaaaactagcatttttacctgttttcatagcaatcaagttagctaaacatattttgggctttttgctcataaaaacaattttgggtttttgatagtttttatcatatattttggcgatttttttttaattttgattttttttcacttttatggcaaaatttgaattttctcgaaaatctggaaaaataagtcaatcttagaaagcgaaaagaagttttcaccaaaagcattgaaatgattttgtttgcatttatgctagcgaaataataaaaaaattgagacttatctgagaaatcacttatttttgagcatttttttattcaatttttagcacatattttggccttttttgggctttttagcacatattttggagtttttcagcacatataaatccgttacctgattataatatttttaattatttcattgtttttaagacagctttttgcttccaatttgtctttgggtggttcaatttgagtgcatttactctttcgcacattgctcgtcccgttgcttatgccttttttgtggtgggccattgcagcagtgcgccggttcttttcattaccaggtccaaattgtatttaaaaatttatttaaattttagtttggcaaataaattagctaatttaattgcctacagttctgtgtaccgacaagcataccaatccgtgctttggccaaattataaccacttgacacctgtacagaatttgcagcgtcaaccaaacataacgaacaatgttcgcaccatatgaatcctcgacaattgccaaatcaaattgaatgaatgtgtgtgtgtgtgttaagtgataaaagccactatgctttaatctcataattaagccgaggatttgtaggggcaaaaaatcccaaaaaggggagaaataggagcgcaaatgttggactaaaaatgttaggtgtaaaattaaaaaaaccatgtttttatgaaaataaattgaaaagtgcttgctattgatttttatagaagtagaaaatcagaattattacaaaaatcaaaaataacaacaaaaaaattgtatgcagatatcttaatgaaaaatggtccgcgatacagtttcttattgaatatggcatatgatataatgaggaataattcaatagacatgtttaaattcatcgccctcccctttcctcattagggatgtgtcaaaactttccaggaagtcgagtccgagaaaaataattcgaattctgtatccaacccaggcttcaattaacgaatcctaaccatgtaattttataaaaaagcaaattgattattcaatgagtgccatgtcaactactattagcacaaggaaaaaattaattttattattaatttaattggattcaatgaaaaaaacattggaacaaattccatggatttcatatttaatttaatctgaaaatttgctatattcgaatagatatttttatttggttacctttttaattgatattgaaaatagtaataaggaaaatagaaaacaaaaataaataaatttagcgacaaaaaatatttaaaaatatgacaatttgaacaagatttaaattaatattactatagtgaagctaaattattatttatttttaatattgctatctattttttaaaataatctcaaatataattaacctaaatcaattttcatttttgttagtcattaaaattgttgttgttgata

SEQ ID NO: 27 - DNA, 9888 bp, Heterodera glycines
gaaatgggcccaaaaagtatgcaatttttagccagtttttccggaaaaactgacaagaccttggagttcggtcaagaaacaaaaaaaatccaaaaaagtccaacttaaaatcctatcgaggccgatttttcatttaggcctttaaaaaatttttgaatccaaaaaacagcaaaaaaaatttttaaaaagtgacttttcggcgcctggcactcagttggccctcggatcggaaaatctatagttttcctgaatgcgccgtcaaaagttacccccaaggtcgaaatttcgaatccctcccggcaaaccgtaaggagattttgtttttggaaacgaaactccttgtttctttagtagtatataaactagggtggacagtcggcttctggtgctgaggggaaagcgcttcgcgctcagggacgcggctgcgccgcgtctctagggttcgcaccgccgtttgtttgttggatatggctgttttttgttccgcatctccgacatcttcgcttacagcagcagctgctgcagttgcaaacgacagacgtacagggacccgccacgtgaagccgcacggtggcaaaaacagcgaaaaaccatgggtccccttttttattttatacagaaaaaggcaaaaaaggtttacaattatgatgacatattaaatgattaagatcacaaaataaagagagttaaaattaagtataattaatgaaagacttaataaaatatatttacaataagaccaaaacgaaatattaaaccaacctaacgataagcgttcaggtcatgattaactatttcgtactggcgaacaaagaaaatagggggcaaaacaataaataattcctaaatatcattcaaaataaatcaacaaaattggttggcatccatcctccatgcataaaattcaaaatcattcgtctttttattttcacaataacataacttcagtcaaatcggattccgtcggctacaatattacgcaccaaaacatttccgtctgcatcaactggcttattcggggcatacacccgaatggaatcagagcttgtagctcgtgaaaaagcagtgtatgtctgaccgtgggcaaatgcctcttcggtgaagtcgatgcccagccgctcgcatgtttgtccttgggccttagtcacagtcattgtgaaagccacccgaacggggaactggaatctttcgaagttaactccgtttggctgtttgtctttgtaagttgctgcaacttttggtattgctacttcaattccactttgagctgttgcaccagttattgcttcggcaacaatcaaataatcggtcaattttttgacaatcaatcgagtaccattgcacagtgatttggccgtgtttaaatttatcaacaacacaattatcgagccaacttttagccgaagatgatgcgccggaatgccagcagggttcagcaaattgaggtgtgcaacatcctggtcagcagcattaagtgccattgggttcgcgtcaattggtctgtcatcagagaagtagtcggtgtaatcggaattgatatttctcaatatggcatcattattcatgtccacaattcggttggttgttgccagcattaatcgcttcagcatttcatttgctggctgtaaaaagccttgatcaaatacagaagaaacgacttcgtcgcgtgaataaaccacccactcctttggaattggcactgtgtcaccgaatgcacctgtaccaaccttcttcaaccattcaatgaattcaatgtcctgagaattaacacgcatgttctgtacgagccttatctttgtgaagagctggtagagcggtgaagattgaatacatgctgcgacttgaggttcagtgccatatgcttcagtaacaactggcagcgactgtttccaatcacccgaaagtataacaacttttcctgcaaagggaagttggccgaagcgaggaaccatttgcctgcacaacaaatccacattttccaagacagttttttccaacatcgtgatttcatcaataataatgacctcagcttcgataattctgcgtccgaaatagctttccattggtattgagggaatttttccggcttcaacctgaatgccaaggcgaaaagcagaatgcactgttgtgccacctgcgtaaaagcgtgtggaggccatgcctgttgaggcggtggcaatcacttttttaccaattctgcgcaattgatacaatagataattgagaaggaaagtttttccggtgcctccgtcaccagacaaaaagaatagacggttttctgcagtggttggtcgagttgaggcgatctttctgaccatttggaaaaatttctcctgctcgggattcattcttgccgaatcaaactgtcgtgtatcaactgtttcgtcaacgtcatcatcagccagatggcctgggaaaaagaaatcgttcacaccacgtgttgggtcgttgacaattgagttcataggcgccggaagtccaaaatcttcacaagtttttccttgtctaaccaaaagtcgttcaagaagggcgagtgcctgatcaattcgaattggtcgttctgcatcactacaacgtatatcgtacatatgcggcaaaaattggttccaaagtgccaatgcatcaatgagacaatcttccgtgttgccaaaaagaagaatactggcgaacaactggcgcatttgggctggattgagataattggctccttcctgtagggttcgtatccatacatttgaatccttgatgagaccacgaagtcgggctgcttccaggaagctttcgcattgatgtccattaaccaatttcaaatgctcagggtcaccagcaaaatgcttggtgagaatgaataatgcgaacttctcatgagaacgtggcagaattggataaatccgtcccaatatttgttttcgttgggcatttcgtattcttggcttccaaacttttttctgtttgtcgaaataatatttttcaggcatattttcaaataaaatgttcttcaacgcagggtcattacgccattgttgccaatacgcagagaggggagtgaccggaagctccatttgtcctgccagaatttgctgtgcgagctcctgtgcgttttgtcccggccgtaaatacattttttgctgtccgggaagatgaattgaaagtgccatgacagtgtgtgacatgaatgtgtatctgtatgacataatccttgaaaaagcctcaactggggatctgtacaatactctcgcgtaggatgctggctcatcaatgttcgttttgttggtatgttcacttcttatatatgaataagatggtcccttgagcggatatttaagtggatacttcatatttgttgattttccatatgcgaactccaagttgtgatgtgtctcgtatagaaccaaaatgaatggattgtaaggaataactcgtgaattatcataagttatttcggaaagcccccgctttacagtcagtgtttcgcctccgtccgttggttgtagtcgtttatagactgcgggcttgtcatcaaaaaggattgtgaatttgctgaatggttttgggaagccttttgagcagcgtccacgagcgttttggcaatgaattccacaatcatggaattgatactttggcagaaggttcctcactttgcgaataaagttcgcccatgaagattggtcttgtgcattaggttcagcaggaatatgagcccaaatcaaattttccacgcattccgggatggccaaaatatccgattgaaaaagtcgatgtaaatgtggtcctccaattcttttctgaaattctcgcccctcaccatatccaatctgtgttccaaggatttttttatcctccaaaaggtggtgtaaatgccttcgtttgtcttcatagacccggcacagaatgtcaaagcggtctaccattttttggtcagcacgcatgaagttccgcttgatttcaggccaccgtgggttacaagtccacgtgagcatgaagcaagctcgatcaggtttcctgatgcgtgccattatagtggtagcatcatagtatttgttttggaagtaggcaagtgtgcctggttgtgtttttcggaacaaaacaattgaaccaatttcttctggcgaggtgagacctgcattgcgcgcgaaccatcgaagcaagtgttctggcatggtgccacgaaggtcaaattcaggacgacgaagatactcggcaacatctgcatcaattctggcagcataatccaacacaattttttggctgagtccaccggcgacgatccaaatgtgatgatacgtttcgtcaaccctgattgccaatcgatatcgaacatattctcttaaagacatttttctgaaaggccttacttctccatcgctttcgtgcgaagccaagctggtccggtctgactggctttctgtgtcgtttgttgattcataattagattcaacatcaacatcaatatccaatattgtttctccttctctttgttcgttgtgccgttcctcgatatgcaaagtgcttttatacagttttttgtgatatccgtcgtctccacttggaaaaaccaatggataacacagtgtgtcagttgacggatgatatggtggaaattgctgaagttggccttgttctgtagtgatccaaatgcctctttccattggtgggcggtccgattctgtccatacagcaaataatgtaccttcagttggaagattggtctgtcgtgggtgcagatttggatcccgtattccagttggtgccattcgtgcttcaagaagtgtgagacggaagttatgtacggcatccgggccaccctctgcaagctttgattgatattgttgatgaaaattcatgagttgatttgccagtggatggtgttgacgtagtattgcatccaattttttcagagtgtttgggtttacacgatcgccaccatatcgtgtgttcttttttcggtgctccagtgcctgttcagggtctaacacaaataattgcgcgaaatttggtgccatttgtccagaaaaaagcgaactgatccggcggacaaacatcccattcagcatgaaacacacatcgccacccacagagttttctttgtatccaacagaaacagacgcaaacgcaagcaatgaattgtaggcattttgattcttccgaaattctttagcttctgctgagttttcagttgaaagagcatataattcagcaggcaaatcgctaagttttggcaagcagatttttccaaaattgcagcaaattgctgaagaagtcttgccatgttttgctgtggcttcactgttgaagagcttcgccttgcaaaaagcgcatattttatcaccaatatttccagagtcataatatggttgataatggttggctcgaatatcggcacacggaattcccttgtgtcttacatgacaacggcgagttaattgattgattgatatggttgtagattcgtcaacaatagaagattctcggcttgattgatggctcgcaatacgtgaagaacgtcgggatgatgaaacggaattggttgatggctcccggctattaaaatgagtttccatgatgggcgtagaacatctttgatgtggtatttgtgcacctcgtaagaaaatatttctttgtccaagattttgttgtccatttgtattcctcggaaaatattcaactgtgtctgatagaagtaattttgcgagttgtgaaataattctttttctctcagtattgatgtcaaggttgggcaaaaaaaggcagcggttgttcatcaaataagattcagcgtacaaaattgtaaaaaaaccacaattaattccatctaactggtatgtgtattgatttggcggaagaatttgaatttcaaaggcagatggttcgagaccttgagtcaattgacaaataatttggttcaggagaatgattcggttttggtcaaatcccggaaatctgctatcattaagacggttgttaaaatcagcggtcaagtttcgagtaggcggcaatgaatcaatgaaccaacaacgtaattcttctctgttggagcggtcaaatatcatgagcgtaaaatgtccaggaaaaacgacaggcacgagcaggacatcatagtctactgagtggttgtagcagtgatcattaagttccaaatggattgctccagggccgtagtgtacgtttgggtcggtgtaagatggcgcaacaactgcaacacgtttgtcattattaatacttgccagataacgcatgtaggcgtaaatgacacggtcatcgcacatctcgttttgattattccacaaatttaataactcatttcggcttgcaaataactctggttgcgcaacatgtccatcacttgacataagtggtccttcttcgatcattagtggttcagaattcgactcagtgtgaggcatctcttcatttggtggtaaagcttgtagattagaaacaggtgctggtgtattatgacacgaagatgagctgctgcgatgcccacgacccgggcccgcaattcgtgttcgtttttttggtcttcctctgtttctttttggcgtttcagagcaagaatttgtatgaattaaagtcgagttcgatgaaggtgttgcggttgcattgtacaaacgttttcttgggcgcactattggtgatgctgatgataactgcgaaaatgttgacaagcatgattgtggagtcgatatggctaatatagacatctgattgatcggagtagtttcagcagcgaaatcattccttccacgtcgagcggctctctcttttttcttctttgacggcattgcaattcaattgtaatacctaaatgggaagggaaacattaatatattgtccataaaatattaaattatttatgctgcgcgttgatggcacgcaataataaataattggaacccttgagttatcgtagcgtttaccacaacctgaaaggtgtgtttcggcccatcaagccgtatacacggtttgataatttattctatgagcgggcctcgtcagtacggcactcatagatttattggagcgatttgaatttatcagtctttaaagccactggttattcctcaatgtcacttcatttcattttcacttcactcaatggcacttcacttcatggaatggcactttacttaacttaatggcacttcacttcactcaatggcacttcacttcactaaatggcacttcatttcactcaatggcacttcatttcactcaatggcactcaattacagcgaatggcacttcatttcactcaatggcactcaattacagcgaatggcacttcacttcactcaatggcactcaattacagcgaatggcacttcacttcactcaatggcacttcacttcactcaatggcacttcatttcagtcaatggcacttagttcactcaatggcacttcatttcactcaatggcacttcatttctgtcaatggcacttcacttcactcaatggcacttcacttcactcaatggcacttcatttctgtcaatggcacttcacttcactcaatggcactcaatttcagcgagtggcactttacttcactcaatgacacttcatttctgtcaatggcacttcacttcatggaatggcacttcacttcactcaatggcacttcacttcactaaatggcacttcatttcactcaatggcactcatttacagcgaatggcacttcacttcactcaatggcactcaattacagcgaatggcacttcacttcactcaatggcacttcacttcactcaatggcactcaattacagcgaatggcacttcacttcactcaatggcacttcatttcagtcaatggcacttcacttcactcaatggcacttcatttcactcaatggcacttcatttctgtcaatggcacttcacttcactcaatggcacttcacttcactcaatggcacttcatttctgtcaatggcacttcacttcactcaatggcactcaatttcagcgagtggcactttacttcactcaatgacacttcatttctgtcaatggcacttcacttcatggaatggcactcaattacagcgaatggcacttcatttcactcaatggcactcaattacagcgaatggcacttcacttcactcaatggcactcaattacagcgaatggcacttcatttctgtcaatggcacttcacttcactcaatggcactcaattttagcgagtggcactttacttcactcaatagcacttcatttctgtcaatggcacttcacttcactcaatggcactcaatttcagcgagtggcactttacttcactcaatggcacttcatttctgtcaatggcacttcatttcactcaatggcactcaattacagcgaatggcacttcacttcactcaatgacacttcatttcagtcagtggcacttcacttcactcaatggcacttcatttccctcaatggcacttcatttctgtcaatggtacttcacttcactcaatggcacttcacttcactcaatggcccttcatttggggcaatccctcttcacgacggggaacggtgtaaaagaggggggggggaatcgccgacgaaggggaaaagagggaaatttctgaaaaatttgcctattttattaagaaaattcattaaaattcttttcatggacggacaccccttcgcaaaaatttcagtttacccacccgcccccttttcatgtatgctcttgctggtcctgccaaaattgctgggaaagtatgtagatactatcgtcatgtccgtactttatacaaaagtaaggcctttgctgctcaccgaatgatagtatgacggaagaagactccgttcaaatgatccaaattttcgtcgttttcccattgaagcgccgccgtctcctcaattattggacaccgtttcatcagaaaatcacagatttcatcaccgcactctttctccttcgtcagtgtcagcttctcattcgtccgttcgttcaccaattcaaatggaattggccttgttttcttataaaaagtaattcgcatattgtaactgaccgaagtggtggcacggagaaatgcctaaacacaaaaattggtaaaacaaaaacaaagtgtttagtctcgaaatccttgtcgataaaagcacaaattgtgagagaaaatgtgtcgaccacctgcttgtgattgtggaaccaattgtttattttcataaaagcaaaatgcgagcaacgcaattccttcggttgaccattttttgtcggagttcgtaaccatttggccaacgcttgaccagcagttgaattcggagcattttcatcggggaatagataaccagaatcgattgaattcaattgatcaagatcggagagaagggtctcttgagcgtgttaatgcatggtgtatttttgtgcgccaatctaagtgattttcatctatgagttaacaaaaatctgcaggtggtacgaacaaaaatttgaaaatatttaacaaaattaataaaatttaaatttttaataattttaacataaaaattatcattttctcattacgcactatttgctgaggtgtacagccttgttagcgtgatcaaattcctcgctgaacaagcagctttccccatgggtgtgagtcaccgcagcttgacgacgtccaaaacagtcggttacggaaggattgtgcgcgtacaacgttacggtatgcgtcactgagtgtccaactctcgcgctcgtcccttaccgtaccgttgatcagatcgcgacctgtcatcataatttatgtttgtacttaatatgctaggatatggtaatttcagttactggtattccctttttgaaacctatatttgataaagaaccctgaaaaatacaaaaaatttttattggaaaaagtttttgaaattattttttaaaaaa

SEQ ID NO: 28 - DNA, 8098 bp, Heterodera glycines
actcaattacagcgaatggcacttcacttcactcaatggcactcaattacagcgaatggcacttcatttctgtcaatggcacttcacttcactcaatggcactcaattttagcgagtggcactttacttcactcaatagcacttcatttctgtcaatggcacttcacttcactcaatggcactcaatttcagcgagtggcactttacttcactcaatggcacttcatttctgtcaatggcacttcatttcactcaatggcactcaattacagcgaatggcacttcacttcactcaatgacacttcatttcagtcagtggcacttcacttcactcaatggcacttcatttcactcaatggcacttcatttctgtcaatggtacttcacttcactcaatggcacttcacttcactcaatggcacttcatttctgtcaatggcacttcacttcactcaatggcactcaatgtcagcgagtggcactttacttcactcaatggcacttcatttctgtcaatggcacttcacttcatggaatggcacttcacttcactcaatggcacttcatttctgtcaatggcacttcacttcactcaatggcacttcacttcactcaatggcacttcatttctgtcaatggcacttcttcactcaatggcactcaatttcagcgagtggcactttacttcactcaatgacacttcatttctgtcaatggcacttcacttcatggaatggcacttcacttcactcaatggcacttcacttcactaaatggcacttcatttcactcaatggcacttcatttcactcaatggcactcaattacagcgaatggcacttcatttcactcaatggcactcaattacagcgaatggcacttcacttcactcaatggcactcaattacagcgaatggcacttcatttctgtcaatggcacttcacttcactcaatggcactcaattttagcgagtggcactttacttcactcaatagcacttcatttctgtcaatggcacttcacttcactcaatggcactcaatttcagcgagtggcactttacttcactcaatggcacttcatttctgtcaatggcacttcacttcatggaatggcacttcacttcactcaattgcacttcatttctgtcaatggcacttcacttcactcaatggcacttcacttcactcaatggcacttcatttctgtcaatgcacttcacttcactcaatggcacttcatttctgtcaatggcacttcatttcactcaatggcactcaattacagcgaatggcacttcacttcgctcaatggcacttcatttcagtcaatggcacttcacttcactcaatgtcacttcatttcactcaatggcacttcatctctgtcaatggcacttcacttcactcaatggcactcaatttcagcgagtggcactttacttcactcaatggcacttcatttctgtcaatggcacttcacttcactcaatgacacttcatttctgtcaatggcacttcacttcatggaatggcacttcacttcactcaatgtcacttcacttcactaaatggcactttatttcactcaatggcactaatttacagcgaatggcacttcacttcactcaatggcactcaattacagcgaatggcacttcacttcactcaatggaacttcgcttcatggaatggcacttcacttcactcaatggcacttcacttcactcaatggcactcaattacagcgaatggcacttcatttcactcaattcacttcactcaatggcacttcatttctgtcaatggcacttcatttcactcaatggcactcaattacagcgaatggcacttcacttcactcaatgacacttcatttcagtcaatggcacttcacttcactcaatggcacttcatttcactcaatggcacttcatttctgtcaatggcacttcacttcactcaatggcacttcacttcactcaatggcacttcatttctgtcaatggtacttcacttcactcaatggcactcaatttcagcgagtggcacttcacttcactcaatggcacttcatttcactcaatggcacttcatttctgtcaatggcacttcacttcactcaatggcacttcacttcactcaatggcacttcatttctgtcaatggtacttcacttcactcaatggcactcaatgtcagcgagtggcactttacttcactcaatggcacttcatttctgtcaatggcacttcacttcatggaatggcacttcacttcactcaatggcacttcacttcacttaatggcacttacatttcactcaatggcacttcattttcatctaattatttacaaaagttaaacacttatgccatttattttacgaaccacatccctttgtaaaaaagggttcgcaatccgtgccaatggcaccgggattcccagcacacaccgcgaggaggtttgtggtggaaaatggacgaaaaccatgtgcaccaaaaaaaaatcgggcatgacccctctcctagccgatggtttgggccatttttggagggccaaaaacacgctagggcgccccctttacgcattttctacccgccgacccaaggccaacggatgggagggcatgcccgccacctgtgaccatcatagcaagcgattatggaaccgctcatggaactcaaagtgtgtggcactaccatcccaaagtgcaaggtttggtgtaggcctccctatgttgggtaattactcccttcataaggcacttgtgccaacgcccacagcacatatgagttccgtcaacgcggattttaatccggggtgttaagtttgagcagctgcgcgttcgacactgctcagtgactcacggtcctccgggccagccagtcccggttattctctcgctgtacgaatgcagcccgaaggcaggacacattacggctaggaaccgccacccccgctgctaggtgcaagctcaccttcaccccaaagcgcagggatgaagggccaccgtccacaccagaccgactatctggctggtccttcagatcgctgtgacacccggcgggctcaggaaggaacttggttccatccgtccaggccgcagccctggataccagcgcaaaaggaccagtggaaagcgaacgcccacgcccacccaactgggaagaaaacccagtaccaggcaggactccacggttttcatggatggcccccagggtattcgaaaaagcgtatcaaacatcctataggggtttactaccgcgtcaaccaaatatgcaaatgtttcggcccttcaaagccgtagacacggtttgaatttcaaaaaaatacgagcgggcctcgtcagtacggcactcgtattttattttttttgttgctaagctcaccagtcagcctttggcgtcaccccggattgttgctccctaatggtcaaaatgtttttgaaaaaaaaaaaaaaaatttaaatgtttaaatatttgttcattaaaaaggaaaaaaacaattttagggagtaaaaacatttttgttcggaaatgaaatgaaaaagagatgtttggggggacaaaaatatttgttgttcggaaattaaatgaaaaagtgatgtttggggggacaaaaatatttgttgttcggaaattaaatgaaaaagtgatgtttggggggacaaaaatatttgttgttcggaatgcggaaagaacaaatgaataatatgtgcaaaaacatttaattatataggcataaacaggaaaaaacggcccacgtaatgtctgaacatttgtttttgcaaggaaacaaatggaaaaacacaaatgcgcatgtttaaacatttgtttatgcaaagaaacaaatggaaaaacacaaatgcgtatgtttaaacatttgtttatgcaaagaaacaaatggaaaaacacaaatgcgcatgtttaaacatttgtttatgcaaagaaacaaatggaaaaacacaaatgcgcatgtttaaacatttgtttatgcaaagaaacaaatggaaaaacacaaatgcgcatgtttaaacatttgtttatgcaaagaaacaaatggaaaacacaaatgcgcatgtttaaacatttgtttatgcaaagaaacaaatggaaaaacacaaatgcgcatgtttaaacatttgtttatgcaaagaaacaaatggagaaacacaatgcgcatatgtgttcacagtttgaatagataacgatacatagttggctgttttttttggtttggtaaaaccaaacattgttttgataattttagtaaaaaccaatttgttttttattgtatgttcaatttaaatattaattttttttattgttttttatatatttttatttgttttgttattttaaaaaatttatttaatatattattattctttctgagtgaatctttgcaattaatttggttctggtaattaaacaaatattttcattaaatggttaaaaatttacaaatttttttttggtaaaattcaattggattttatgacaagaaatttcgatttttgttaataaaatacaattattttaaatattattatttttttgaattcatttaaacatttttaaagataaaatttgctaattataacattggcagaatgtaatttttgcgtcttcgaaactgtctatcagaatcccgagaagcagggattctgactccttacgatgccttggttgtaaattaattaaattcgtgttgaaatttaacaatcaatgcattaaagaattattttttggtctttaagttaatttttttatgtaggcacagatagccttaaaatgatttgaatttgttttaaaaaaacaaacttggaaaattaattacaatttgttacgaataaaatttatctgtttttggtgggccatttttgaggatttttcaaaaaattagataaatcagcaaaactttctcaaaaaaatcactacaaatcagcttctcaaaaaataatcatgcatacccctttaaaatcagcaaaaagatgacaaatcagcatatttgtttagtttgtgttttttctttctttctatgttttgtccattttattttgatgggttggaatagcatatcttgagatttctcttaatttgaccttttggctatttctaaaaatcagttaccaaatctcaaaaataagttccggcaagctgtcggtttccacaatcttaaggcatttcaggattataatcacaaaaactcaaaaagtaaaaaatattttatattcttctgggtttttacgacaaaataaattttaaaaattcatttttttgtgaaataaaatggtttttattaaattaataaactaagctttttgttggttaacatcaagattttgctaagtgatcatgaattttggtaataaaatataaatttttttcttgttaaatggttaaaaaaaacgatttttggtgactaaaaaatgatggttattgctaaagcatcaaaatttttgttgtttatttgttaattttctttattggataaatatttgtaatgtaattgtttgtattttgtgtaattttatcaaaattatacattttcataccaaaagaaaatattgttttgatcagggatgtgtcgtaatgtgatttcctattaccgtttttctatttgaataaaactcaaaattgtttagtgattaataaatgaattaaacatattttttataaagtgttataaaataatgcttaataaattcattcataattattgaccgggtttttgggttttttatgagagaagctgaattactttaaaaatttattatttattttcttaacaatttgtcattgtgtgcgcgaaattgatcaaaaaatgagtcactttttaaattttttgtgcataaatatactcaatttttccaacctattttgcactttttttagcattattttagcgtggctgttaatttcgaaactgggtaaattcgacactgagaattttcgacactaagtaatttcgacactacattttcgatacagagaaattttgacactgagccaatagcctaattttgggcgctaattcaaaaaatatactggtcagtgatcactgtcttttttgcattggttgttttgctcatccataactcgcagcatccccaactaaacagaacaaaatttgtttttttttgaaaagaagcgagtgcaaaactatttgaaatctaaaaaagttgtaagaatttgaatctatttttgtagacacattttgtcctcatcaatcatttacgcgaaaatgcactattgtatgttttatacaagccgtgcgcaacaatttcaaccatgttccatagtgaatagatgccacctttgtcggaaaagataatgcataaacctttttggttgcatactgaattataccaaattaaaaaattaggtatttgtactgttgctcttcctaggcaatacggcgtatgtttagaatatttttattagctttagttcaaacgtttagaatgagatggagtttagttttaaattacgaattggtaaatgaaatagagaaaatttatcataaaaactaacatttttgaattttaatattattttttaaaaattttgatagtgtcgaatttactcaatttcgaaataaatagagtgcttattaaatgaacagataaaagaatcgatttggttttataaaaggatttttatagtaaaatgcaaatgtttttcattaaatggttaactttttttaattaaatagtcaaaatttatgatttttaatcgtctcatttttgtgcatatggagatttacaggttcaaaggggaggtttatttaatggtaaatcctaatctttcatagaaaatcaattaaaatttgtaaatgatcagaaaaacgattaaaataagggttttgttttaccattaaaatgaaattttttttaaaaattaaaaaaaaatgtttatatgagggatgtgtcagaatagcgattttctaatgtgtaagtatttcagaagtatgtttttaattatttttgataccaacaatcagttgtattttttcaccttttacagtacttaatttattttgatttattaaattgttttttttaaattaaaatttattttgaaaattaatagcaataatgtaatttttttatttaattaattcaacgaaaataagttaatttataattaaataatgcacaacaattaaaaacacgtataaaaagcgcttcgcgcccgttgtttaattttactggctacagtcgggcgctatgagtaatttattaattattaaaaaaacaaaaggaaattttaattaattaataacatcgaaaaaactaaaaaataaattacaaaataataaacacggcccggatccgaatctgccgccccacccctcagaatccccaatcacacggggattctgaggtcttagccatgtctaaagtaaaatctgattacatattcgtgatcagcggcccaaataacccctaaaatcatatttttggaagttttttggtgaaaaaaattttccactcaaaaatcatggtcacacccctgtggtcccaaattccaaaatcacttttatttctataacttttttccaaaaagtgataaaaagctaaaataaaatttataaaatagagcaaaaaattgcggattttttgagtatattatttttataaaatactttttcagaagggagttaggaatttttttctgaaaaatcgaaaatttccagattttctggaataatttttttaatttgaaagatataaatccccaataaatcccataaaattttcccaatttttctctatttttaaagctttattctactaaatttaaccaaaagcgaagtgagttatgaattttcaaaatttcactggattttccggggcccaaattgtgacgatttttcaaaaatttttaaccaccttccaaaaagtctgaaacccaaaataaagtatatattcgtgttcagcaccataaattaggccataaaaatgcattttggctaatttaggagcaaaaaaatttttcataaaatgcaaaaccatggagtcccccctatggtttttaatttcaaaataatatttaatttcataactttttttaagctcatgataaaaat

SEQ ID NO: 29 - DNA, 4114 bp, Heterodera glycines
ggccgcttcgcggcctcaggacgggcgcttcgcgcccgttttttaatttttttggggacattcgaccgcttcgcggcctcaggacgggcgcttcgcgcccgtttattaattttgttgggaacattcggccgctgcgcggcctcagtacgggcgcttcgcgccatttttaattttttggggaaattcggccgcttcgcggcctcaggacgggagcttcgcgcccgttttttaattttgtggggaacattcggccgcttcgcggcctcaggacgggcgcttcgcgcccgtttttaatttttttggaaacattcggccgcttcgcggcctaaggacgggcgctcccacccctaagaatccccaataacactgggattctgaggtcttaaccatgtctaaagtaaaatctgattacatattcgtgatcagcggcccaaataacccctaaaatcatatttttggaagatttttggtgaaaaaaattttccactcaaaaatcatggtcacacccctgtggtcccaaattccaaaatcacttttatttctataacttttttccaaaaagtgataaaaagctaaaataaaatttataaaatagagcaaaaaattgcggattttttgagtatattatttttataaaatactttttcagaagggagttaggaatttttttctgaaaaatcgaaaatttccagattttctggaataatttttttaatttgaaagatataaatccccaataaatcccataaaattttcccaatttttctctatttttaaagctttattctactaaatttaaccaaaagcgaagtgagttatgaattttcaaaatttcactggattttccggggcccaaattgtgacgatttttcaaaaatttttaaccaccttccaaaaagtctgaaacccaaaataaagtatatattcgtgttcagcaccataaattaggccataaaaatgcattttggctaatttaggagcaaaaaaatttttcataaaatgcaaaaccatggagtcccccctatggtttttaatttcaaaataatatttaatttcataactttttttaagctcatgataaaaatatgggataaggcataatagatagagtttaaaattctctacaaaaaagttcttggaagatttttcgctaaaatcaacccctgcatagttataagtcataaactgaaataggcgccaaatttcggaaaattttctatttccaaaaaaattttgaaaaatttttctgaaaatgccaccaatcgatagagcatgaaaaacgattgcttgaaagtggtcttggttttcccgagaaaaatctgcaaaaaataataaaattcaaaaacggaaaattttcgagggggcctagctcgaaaatttctgaaaattttcaaaatccgaaaacatggatggatgcagctcgtcgagctgcacaaaaaagtaattatcaccatcccgctcagatcaaaacacagcgagttattcgcgaaattcaaaaaatgccaaaattggttttcaaaattcgccgaagtgtacaggccaggcctttgatgctagggcctcgcccaagaagaaaaaaatttcccaaacattccaacttagggccctctcagcagacatttttggctccggcttccctgaaaaaagttttggcccaaaaactgcatgcatttttccccaaaaagccatttcagcgccgctggcgctcagttggcctccggaccggaatgccattatttttcctggatgcgcctcaaaaagttgcttaagcaatgtcaacatttcaggtccccccgattagccgttcccgagattttagttttagcaatgaaactcgatgttgctttagttatatataaactagcgtgtggcgcagtaattgctcggtgtagacagtatgcttttggagtatatgggcgggcgctgacatgagcgcttcgcgcaaaggacttcgttgctagtgcatgcgcggttttgaaatgaatttatggatgtgataagggattttggtctacaggcatcgcgaggacgcattcataattttctggaggactttcggccgcttcgcgacctcaaagggtgctccgcgccggtttttaaactttgtggggaacattcggccgcttcgcggcctcagacgggcgcttttgcgtccgtttcttaattttgttgggcttagacgggcgcttcacacccgttttttaatttgttgggatttttcggcagcttcgtggccttgggacgggcgctttgcgcccgttttttaattttgtggggaacattcggccgcttcgcggccgaagaacgggcgcttcgcgcccgtttttagactttttggggccagacgggcgcttcgcgaccgtttctaaattttgttgggcttagacgggcgcttcgcacccatttaaattttgttggggccaaacgggcgcttcgcgcccgttttttaaaatctattcatcaaaaaataatttatataaatacacgaaattctttatttaaaaatagtaattaatttttaaattaaacttttattcatcaaaaaataatttataatttacaaaaggtttttcatttaattaaaaacatttaaaataagccaaaaataaatataaaaataatgtgttaccgtccgggttcgaacttgccctatttaaaaaattctgaattttggcccaaaaaaacagcgatttgaagaggtacaacaaatggtagaagaggtacaaaaatgctttaataattttttaaaattgtaaaataaatgcctatttttattattaaaaaaactttgaagcttataataatttaaatttatttagattgaactgaaattaaattgaatatttatttagtttgaaatgaaattaatttttttgcaaattcaaaaaataaataatgaaaatttttaattaaaaaaaattaatttaaataatttacaaccaaaatattttaaattaattaaaatcattaaaaataacgtaaaatgcacagaaaaataatgttacaccgtccggatccgaacctgccccctcccccctcaaaatgatgcctcagaatccccaatcacacagggattctgaggtcttatcgatgttaaaagtaaaatctgatcacgtattcgtgatcagcgtcataaaatagccctaatgacatgtttttggaggattttgggtgaaaaaatttttccactcaaaaatcatggtcacccctttggtcccgaatctcaaaatcacttttatttttgtaacatctctcaaaaaagagataaaattgccaaataaaatttatattatagagaaaaaaattgcggatttttgtagtattttacttttccagaatatcttttcagaaccgagttatgaatttttttctgaaaattcgaatttttccagaaattctggaataacttttttcttttttgtgaaaaaaaactcaaataaatcccataaaattctccttatttttctctatttttaaagctttattatagttaaatcgatgaaaccatcaccgagttatgaattttcaaatattaggccaaaatcccgagggccaaaaaattgccaaaaaataaagaatttttaaaaaattccaaaaatcatgaaacgaaaaacaaaggtcaaattcgtgctcagcacctcaaaataccccagaaaaaaatttttcaccacccttttcaagcctaaaaaaaatttcgaaaatttctagggggcctagctcgaaaatttttgaaattttccgggcatatagcacaccgttcgatagagcttaaaattctctacaaaaatgttctaagacgatttttggctaaaaccaatccctgacgagttatgggcccaggactcaaatgtcccgctgaggccaaaatttttttctatttccgggaaaaaatcgaaaattttccgaaaaaaataccagtcgatagagctcgaaaaactatgttttggaagtggtcttcgtttttctgggaaaattcgttaaaaaatcctaaaattcaaaaacccgaaaaccgttttttaggcctagctcgaaaatttttgaaaattttcgaaatttttaaaattcagaaaatagagcttccaaaactctacaataagtctgctgggcacctttc

SEQ ID NO: 30 - DNA, 4370 bp, Heterodera glycines
cccgtttttagacttcgtggggccagacgggcgcttcgcgcccgtttctaaattttgttgggaattttcggcagcttcaaacccgttttttaatttgttgggggacattcggccgcttcgcggcctcaggacgggcgcttcgcgcccgtttttagactttttggggccagacgggcgcttcgcgcccgtttctaaattttgttgggcttagacgggctcttcgcacccatttaaattttgttggggccaaacgggcgcttcgcgcccgttttttaattttgtagtaatcattcagccgcttcgcggcctcaggacgggcgcttcgcgcccgtttttaaattttatggtggatattcggccgtttcgcggcctcaggacgggcgcttagcgctctttttaaatttggtgggggacattcggccgcttcgcggccccaggacgggcgcgaagcgcccgttttcaagtacaacagtgattagaagaggtacaaaagcgattagaagagtgattagaagaggttcaacagtgattagatgagtcacacagtgatcagaagaggtacaacagcgattagaagagtgattagaagaggttcaacagtgattagaagtggtacaacagtgattagaagaggtacaacagcgattagaatagtgattagaagaggttcaacagtgattagaagaggtacaactgtgaatagaagaggtacaacagtgattagaagaggtacaacattggtcagaagaggttcaacagtgattagaagaggtacaacagtgattagaagaggtacaacattggtcagaagaggttcaacagtgattagaaaagtacaaaaattgtgaaatggtacaacaatggttaaaaggtaaaataatgattttaaaattaaacaaataagtaaatggtttatgaaaatagaattaaaaaatgtattaataatttttaaaaaattattaaaaaatgctttcttttattaattaaaaataaactttgaatttacaatgattaagtattattgtattgaaataatttttttgacaatttcaaattttaaaaaaacattaaattctttaatttaaaaaaaataattatttttaataaaattttcaccaaaaaataatttaattcaaatgaaaaatttttatttattattaataaaattaaaaatattttaaatgaacaaaaattgaaaaaccgaaaataaatggtagaaaattaatgtacaccgtccggatccgaacctgccccctccccctcaaaatgatgcctcagaatccccaatcacacagggattctgagggcttaacgttgtaataactgaaatctgatgtcagattagtgatcagcggcccaaataacccctaaagacaagtttttggaagatttttgtcgaaaaaattttccactaaaaaatcctatgctcacccctttggtcccgaatctcaaaatcacttttatttttgtaacatctctcaaaaaagagataaaattgccaaataaaatttctataatagagaaaaaaattgcggattttttcattatttaaaatttcaaaaacacctttacagaaccgagttctgaatttttttctggaaaatcgaaaatttccagaatttctggaataactttttttcttttgaatattataaaaccaaataaatctcattaaattctcccgattttttgctatttttaaagctttaattcatttaaattgaccagtcctccattgagttatgaattttcaaatattaggtcaaaatcccgagggccaaaaaattgccaaaaaataaagaatttttaaaaaattccaaaaattctggaactgaaaacaaacaccatattcgtgctcagcacctcaaaatagcccagaaaaatatttttcacccccatttttgacccaaaaaaaaattctgaaaatttctagggggcctagctcgaaaatttttgaaattttccgggcatatagcacaccgttcgatagagcttaaaattctctacaaaaatgttctaagacgatttttggctaaaaccaatccctgacgagttatgggcccgggactcaaatgtcccgctcaggccaaaaaatttttctatttccgggaaaaaatcgaaatttttccgaaaaaaataccagtcgatagagctcgaaaaacggttgcttgaaagtggtctatttgtttgggccagacgggcgcttcgcgcccgtttttaaaatttgtttgggccagacgggcgcttcgcgcccgttttttaaatttgtttgggccagacgggcgcttcgcgcccgttttttaatttggtgatttttaggccgctcgcggcctcgtacgggcgcttcgcgcccgttttttaaatttagttggggccagacgggcgcttcgcgcccgttttttaggggtacaacagtgattagaagaggtgcaacagtgattattaaattcattaaattaaaatgaaaatttttttaacaaatttaattaagaaaatacatgaaatactattaattaaaaaataattaatttaaacttttaaaatttattcatcaaaaaaaaattaatttgaatataattttttatttattaaatcattgaaaataacgtaaaaataaatagaaaaataatgtacaccgtccggatccgaacctgcccccccccctcaaaatgatgcctcagaatccccaatcacacagggattctgaggtcttgacgatgtcaaaagtaaaatctgatcacgtattcgtgatcagcggcccaaataacccctaaagacatgtttttggaagactttgtgtgaaaaaaatttttcactcaaaaatcctaagctcacccctttggtcacgaaccccaaaatcacttttatttttataaaaattcttaaaaaagtgataaaaatgccaaataaaatttatataatagagcaaaaaactgcggatttttgtagtattttacttttcccgaatagcttttcagaaggcagctacgaatttttttctgaaaaatcgaaaatttccagaaattctggaataacttttttcttttttgtgataaaaaactcaaataaatcccataaaattctccttatttttctctattttttatgctttaaatgagctgaattggaccattttgaggcgagttatgaattttcaaagaatcacttaaattcccaaatccaaaaaattgacgatttttcaaaatttttttacctccctccaaaaaatccaaaacgcaatataaagtgcatattcgtgttcagcacctcaaactaccccagaaaagtattttttggcaattttaggagcaaaattatttttcataaaatgcaaaaccatggggtcccccctttggttttgcattttaaaatttatttttattttataactttttttatattaaagataaaaataccggataaagcacatttgatagagcttaaaattctctacaaaaatgctctaagacaaatttccgctaaaatcaacccctgacgagttataggcccgggactgaaatgtcccggtcaggccaaaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactgcacaaatgctcaagcggcgccaacccgctccgcttaaaccccagcgagttattcccgaaaaacggaaaatgccgaaattgggtgccaaattttgccattttctgcagcattggcatttacagatagccccgccaaataagcgccaagttttcccaaacagtccaacttaaaatcctacctccaagcattttccgctcccgcttcttcccgcaaagttacaggccaccaaagacggacaaaaaaaatttcacgccgtttcagcgccgccggcgctgaaccgtccaccggatcggaatgccgatagttttcctgaatgcgcctcaaaaagttgtaagacccttccaccactttcagacccatcccgacagccgttcgactcaaattagtttttaagacgaactgcaacgtttctctatatatgtataaactagcgtgttgtggcacagtaattgctcggtgtaggcagttggctttgcacagtaattgctcggtgtagacagtatgctttgcacagtaattgctcggtgtagacagtatacttgtgagagatgaaaagaatatgcattacatgagcgcttcgcgcaaaggacttcgttgctagtgcatgcgcgg

SEQ ID NO: 31 - DNA, 18217 bp, Heterodera glycines
tcatattcgtgctcagcacctcaaaataccccagaaaaatatttttcacccccattttggacccaaaaaaaaattttcgaaaatttctagggggcctagctcggaaatttttgaaattttccagacttatagtacaccattcgatagaactttaaaagctctacaattttgccctaaggcaatttttggctagaaccaacccccgacgagttatgggcccgggactcaaatgtcccgcttaggccaaaaaatttttctatttcctggaaaaaatcgaaaattttctaaaaacatcactaatcgatagagctcgaaaaacgatgttttggaagtggtctccgtttttccgggaaaaatcgttaaaaaatcttaaaattcaaaaaccaaaaaatcgttttttaggcctagctcgaaaatttttgaaaattttcgaaattttaaaatttgcaaaaatcgagctcattgagctctacaataagtctgctggcgccccctggcttagatcaaacccgggcgtgctattcgcctggtactgaagtgtccaaaaaaagtgattcttacgttgcctaacctacaggtcaggcctttgatctgatcgaaaaatttttgctggcaaagttgtaggccacagttggggcatttcgcttttgtggtcctctatgttctgaaagcaaaagcaaaaaatttcgtaacagtgaaactgtcagcaaagtcagttttcgcgccgctgggactcagttggcgaccggaccggaaaatccgtatttttcccagatgccccgtctcgagctaccccttggtgcaaaatttcagccccctatctgttcccgttcttgagattttgtttttgcaaacgaaactccttgtcaatataacatatatagtaatagatattttgttttctaaaatttaaataaataaaataaatgcaaatgtgaattttcgcgtggatgtctgcggggagggacgcgagctgggaggggagggctgtaaaatcaattaacgtgtgcgaattgtttatcggtggaaaagtaaaggataagcggaaatggtataatttaggaggtaattaagagcacattggttggtgtttgatcggatagaaagacataggaatggtgtgatgagtgggagtattggaattgattgtggggagggaggtcatttcaaaaattgctcgcacgcctgacagctcgggtcgcatttttgtccaacgtgacggattatttctatcatttttttctctctgtctgatcgcttcccggacgtggacgatgtcctggaaaaggaagacgacgacgacgacgacgaggaacacgaactggcggttccaggccgcgacaactcacaacgcgcttgcacctttcgttcggtgctgatcagtttgtatgctcggcggacgcaatcgcggggcacacgcaacgaggtggaggaggagcacggttggtccgcggccgtcttattagggaaagttttttacatttctagttaaaaaaggggggaggggcaaccgtaagcacaacatcgcacaacggcagaggcgccggggcatcatcgagcgggacaatttggagtgccggaggcgcaaattgctgctgctgctgctgctgctgctggtgttgcagatgcggttgaaaagcgaactgtagcggaggaagtaccaaaggcattgcgaatggtgggaagacgggcagtggtggcatgcgcatttgcaaagtgctgatcgcctgttggacggcagctgaaagcatcggcggcggttgttggtgctgtgttgccggggcgcaatgtgtcaattgttgctgctggtgctgctgctgttcgttggtgtcctcctcatccatgctcacaacgacggttgtttccacctcaacctcaaccaccggtgaggggacgggggtggggtccggagtggcgacgggagtggcaaataggcgattctgaacatgtgagtgagcactcattttgcgctaaattttttggcacattaccacatcaacacgctggccatcaattattccaaataaggaaaagtcctcattcccacgtccattttttgcaaaaacgctaaatttttgtaaattatcgaatttatgcctaattttctcctacacttggcgcgctttttgcgcgttaagccggttgccatccattgcgaaggcgttcacaaaggtgagcagtctgccgaggcagaagccggcctagaaattatgcttattattaatttatggctttatcaggaattttacatgcgttaggacattttcgtcctttaagtaggacccgccccacttcgtaacgacgtgtggcgtagcgtagtcgatcagataaaagaatctgatacgtccacagagcatacacgcgcagtggtcgtacaacatgatggatgatatctcgaattcctcgctgccgtcatcctcttcagcgatgtcggcgaagtccatgtctcggtgacggtgccggcactaataaacaaatcaaattatttaagtcaactaaaaatgaggtagctatgaattgatctgtcccatttttcacgcaaaattatcggaatatttgggttcagattgttttacttatgttgcagaattataaattactttagaatgactcttaatacataaaatttccccgaccgtcccctaatcacaatttcaacaaattttataacacattcattaaattcaaattttgccgccgccaaatcatgtcagtggggcgcctaaagttacttattcttttgtgtccaatattcctagtactaatctttgttgatcactccccgagccaaacaaaggaagataacatctgtatggccatttggacaatgaaaagacgacaaattgacaaaagaaacaaaaatttggagaactaaagtggatgggaaagggggggggggttaagcgatcgggccatactccgctggtcatttctctgaatattcgcgccatgcagtggattaaatttaactgcacgctttgtccgatcggtctgcattgtttttatccgcgcaagtacgcaaagcctgtgctttgtgcgcatcccagcgtccgtaacatcacggactttttgagcaccggtcagcttgacgaagcggcaacgacaacaacaacaacaaccgcacttccgacaactgcggaggtgtcggcggcggcggcagaatgcgcacctccgcccgcgcatttgaccgcgtggatcgcggtgtgcacagcgctggtggcgcttttggtgattgcggaggtctgttattaattttggtcatttatccgctaaacccctattcctcaattaagcttgtgcgcgccggattcaaagtgcgcaaatttttgaaggaccgcgccttcaaaaaggggatgctgcgccgacatcgccagcgtgagtttctcgctattacattttagcaaattgtaattaacaatttgtacaggaatgagcgccgcaaggcgcaaccgccagccggcaagcgcgccgactccgctgattttgccggctatgttggccggcgtttctctgcgcccaacgggcgtcaatttgactgtggaccgggtgggcaattttaattaaattaaaatctttatatattttaatttctcactcattaaaattacaatttaaatttaaaggcagcggggcagcgccgcgcggatggtacggacgaagagcccgtgtacgatgaggtgccgcttgacaccgtggaacaaaggcgtgatgaagaaaatggggaggaggatgaggaagatgatgacagtgatttttagtgattcggcaagcgatcactcaccatttaactaatcgatcgatttttcactttaaaataaaattttaaaaatgtttgaaaataggatcgctcactcaaaaaatgggtcataaaaagtttaaaaaataggtataaatccagcaaataaaattctaagtaaggatttagagtaatttaaaaatgtgggtgggcgctcgcgctatataaataagtgcgcgtgtccccatcggcccatttcaatttattcctgtcaaacatttggccatcagtttttcatgtcggataaaaaagcattgtttaagcgtgttatcgcagaggtggacctcactataagcacgggcggcataactttgagcggcccccgcctgtctgttccccgtttcattccgtttgaggaaaacgggcgttgccgagcatgtaaaggaactgaggctgaggtggacacaatggtcaccaaggagggaatcaccttatggtgcacacgcatagaaaaagctcagtttgtcccttttgatgttgtctacgagcttcccggtcattgttttttccgcgtgaagaataaggcaagggtgttcagcgttccatacagcgaactgtcgtcctcagacaggtgcgcccagcctctaccaccaccaccaccaccaccaatgacaacagcaaaacatcaacggacaccggacgacgaggaggagaagaatttgagacgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgagcaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatagcaaaaaaagcgcaaaactcgctctgccctatatataaaagttgattactgctcgatttgtcataattttttgaaaatgttaaattctcaatcgttcagtaataaagatatttgtttcaaattgccttgcggtataattatttccgggccatcctcgtcgggcaaaacggaattcctactaaaatttattgctgagtgcaatgaactgatcgcacccagtcccatctcaattctgtactgttttggtgagatgaattcggcggttccgctactgcaaaaggcgggagttgaggtgtattcgggcgtaccttcggaggaactgattaggcgccttcccaaaccgatgctgctcattctcgacgatctgatgctgtcaatagaggagcgctatctgtccgatttgttcaccaaaaaatcccatcaccatcagtttgcggtagtgttcatcactcagaatctgtttgagcggaagatcaaggtggctcgcctttcggcgcagtatttggtgctaatgcgcgcgcccaactcgctgctgtccattcgaaatattggagttcagctttttccgcgtcaactcgattttttccttgacgcctaccgcaaggcgaccgcccgcccctatggctatttgctaatcgatatgcacgcatcatctgatccggcgcttcgcctccgcaccaacatatttaaagaggagcaggaggaggacgagggaacagttgtgttcatccccaaaaatggagcggtataaacgtcaacaacaacgacaacaacaacaacaacaagctaaagttagtcaactaataaaagataatgccaactggctttgtgcactgtcgaaggcaaaatgtgtgaaacgatgcgggagactgatcagaaaggcgaacactgatcagctgctgtcactggtggaagtgtgcttgaacattgttgcttcccgattccgactgacaactcggcagaagaaacgactaatgccctacgtggacacggtgcgccgcgtgagcagagcgaggagcgagaggggcgctaagcgagcgcttgtcatccagaaaggagaggggtttggcggactatttgcagcccttttaacccccgtcttaattgaattggccaaatcggttgtgactcgaaacacataaataccctcgtaaaattgtctcacaccgcattcattcattaataaaaatggcaaacaaattcattctcgtaccacaagaaatttatcggggtctcacctccgtctcgcagacgggagacctcaatttggacgcggttcgccacgacctggaccgggccaggggtggacagacaaatccttcggcaaaaaatgtgcattataaccagcagctccgacgttatttacagatgagaaaggaacatgcggacagaccaaccaaagttgagctgaccaagggaataagtgtactgatgaatagaggtggcgaagaaggcgaggtggttgataccccacgccgtcctcccgctcctccaccaccacctccgccgcctggaagacctcctcgtcgtccaccgcccagtcctccgggtggtcccgggggtccttcgccaccaacaagtcctccgcctcgtccacaacgccccccgagaccgggcaggacttctcggagaggaggtcttatggagcaatggcggaaaaggcgatacgatatacaacaacagcaacggcagccgccgccgctagtggtgcgggacctccttgcggaagcagctgcggcgccactgcccgaaagtgatgatgatgatgagtatatgctagagaatggattcgcgctaccagcaccatcacaatactatggcgatttgcctgtgctgcccgacaatgcggaagaaattgaggaaatggacacagctcagcgcaggattgccatcagaagaaaattgaaaaaggacgaggctgatgctgatgatgatttgcaacgcaaaaaatatatgatgatttatcaacctccaccactgcctcgcgcaaaagtaaaagttgagcagccgaggtctcctacaccccggccgcgtcctaacgtcaagagagaacaacaacaaaagccaaagtcagaattcaaaccgccgtcgacatcaaagaaaaccggtcaccctactccggcaaaaagagtgccagagtttgttgatctcgatccacgaccatccacatcaaggcaggccgggtataacccgcctcccccgacgcccaaaataaaacatgagccgacaacaaagagacccatgccataccgtatcccaaaaagggaaccaaaagtcgaggaagcgccacaacagcaacaacctcttcctgctgccgctgttgtcgtcgaagaaatgcccgttgttcctccgcctaggaggggggccaaacgtcgctaccccgtatatgaagatgatgaggtgcagataagaaaacgagtgagacagccgagaagggtaagggtacagtactcacccgagccaggcccatcgacatctgcacaaagtgatgaacaacaacaacgacaacaagaacgcgaactgtttgccattccatcaaatcagctgaccatgactcagcgggttgaacggctatacatcaaatgcaaccattacgctgatcgtatgggcgttcgtggaaatacaattaacaccgcaaacggcaagccgttggtgcataccaatttgcgaatggccatccgctatataatagacagaagagcgggccgccccaccattagaccaccaggagcggccatattggaagaaaggcttcagcaggacccaattctgtattcatggacggctccaccaaagagaccgtcacagagcaaaaccacgcggacggcaccaaaaatcaaaaaggaatttcgtccgaaaaaatggagctgatcaacgcaacgcttgacaagctgtataacagtccatcgtcgcccgcggcgttcgcgggcgttaccgcgctgtggaaagaggcgcgaaaaagtatcaagcatttacgcaaaaaggacgtccagcattatctggaggggcaccgcacatacactctgatgcgcccccgtagggtgcgctttccaagggccagcactgtagcggcagggttcatgaccgatgtccaggtggatttggccgattttcaagcgctatcgcgacacaaccggggtcaccgctatctgcttgtcgcggtggatgtgctctcaaaacgcctgtttgttgttccactcaaaaataagagagccgaggagatgctggaggcattcaagctgctcatcgatcaaatgcccatggccccccaccgcattttctccgataagggaaccgagtttaagaacagattgctgaaggacttttttgagcagcgagaaattgagaagcatgaacccgtgcattcatcggtcaaggcgtcggtcgccgagcgggccatccgcaatgtgaaacagcgtctgtaccggtattttgcggaaacggagacgctgaactgggtggatgcagcacagaaaattgtggacgggattaaccgctccccgtcacgtgcccacggaatgcgtccgattgatgtgggtttttccaatgctcagagggtgtggaagcgattatatgatgatggacaccgtgcgccccaaaaacgacgaccgacccgcttccgcaaagacgattttgtgcgcatgagcagagagaagagacagtttgagaagggctatttgccaaattatggcgacgaaattttggaggttgacgaggtgctgaaagcggttcgccccgttcggtacaagctacgggatgagcgcggggagaaattcaagggcagcttctatgagcaggagttggcgcgtgtaagaaaggatgcagagacgagctatcgtattgaaaaggtgtacagaaagagaaagagggcggatgggtccactgagatgcttgtcaagttcataggataccccgagcgcgaatgggttcacgagtcacaatttgttgtataaaagccccacccatataacaacatatcacattttcataaattttacgtgaaataaaaaaatgtcatcgaacagcttctttgtgtttttgcctagcaatgtgacggattacccggacaatcagcccaataagtttcgggtccggctcccaaagccgttgcattttaacggctcttgggtttgtgggctgcatagcataagctacccatactcatggtcaaccattggcacattggatgcacaatggattgacattcacttcacacagcgtagcacaatggatgaggacaggccgagagtgatccgggtgccggtgcccaagacatcacataacagggttgagcagctgagagacttcattgccgctacactgaggaaccatatcggtgcaaaaatgttgccgctccctcatgaagaggaggccgatcggaatcggacaaagccgcttggctctccaccgccacggaagagagacagaagagatgtgaacaacaccactcctccccaatcccccgtgctgtttgatgagcacggaaagcgactcggctctcccccgttgtacgatccgaatgctggcgaagagcaacacatgagcgatgatgatgacatgcgagcacaaaaagggacactaattattgatccaaaaagcccgtcgcctatagcgacacccccagttccggcggttaaaccgctaacaacaacaacaacaccgactcctccagccgtaaaaccggtaacaacaacaacaccggccccccagtcgtccgcaaagccatcagcacaacagcaaaagccaacaccggtcccgccaaaaccatctgccccacagacgtccgaaccaaaaatagcaacaacaacaacaacacccgcccctacaataaagccagcaacgccaccgctacctaagcctaaaacgacagttgctctacagccaaagcaaacaacaccgactcgaccacaacaaccaataacaacgccaacccctcaaacaacaacaacaactacaacaccaaagattccatcgcctaagccgcctgctgttaaacttcctcctcccacttctacaacacatccgcctcagccagagccaacaacaacaacaacaactgctcctaccaaaactttcacttcctctcctacgacgggggctgttatcggattaccttcaaaaaaaaaacaacttccaaccgtcgacgaacctgtctcggctgcgttaactctagaagagttagatttaccagtaaacagcttcatagttgaaatagactcgctccaatttgtgcccaactcggtgttagtccaatatctcgatgatgtggaacggttcaaagtggtgttcaagaacgatattatcagccacttgtccttctcgcctcagctgggctatgttctgggcttcgaaaaccctcaacatgtcgtgtcaaatgaactgtcaaagtatccggttgatttacggggcggcatctcaagctttgcggtctactcaaaaggattgaccgaaaatatgataatcggtaatacgctgagctcgttgctcagggttgtgtctatcagtggtgccatccctggggattataatgagaagatttatgactcgccaatatttgcgcgagtactgccgcgggagatcaatgagattgatattgagctgcgcacaatggacaaaggccgtctggtgccattcgcgtatgggacgacgatggtcgtgttgatatttaagaaagtgataaatttctgatttattcactcgtcattcattttgtattttatttgaataaaaatggttcatatcgtgtttgacccaagcattgcgcagtatgacgattacatgatgatgcaatacggtggcggatcggaaaaagacgatttcgactactttcggggctccaccccctttcaaaggggctatggtgcagcacagcggggagcgggcgttggtgacgtgtttcgaggactttggcgcttctttctgcccattttacgtcgtgtgggcaccacagtagggtcagaggcgctgagcactgggcaacgagtgctggagcgcgttggaaacgagggaatgccgattaaggaggcgctggtcaccgagggaaagcgaggaatagacaccgtgctggacaaaggaggactgcctaagcagtttggtactggacagaagggtataaaaagaagacgaatacgtgcgccaagtcatcaaacaataattcgcggacccccaatcgccgtaaaacagacaacaagaaagcgtgttcggtcggacgcctttggactctactgattagcagcgaccagcaggatgtcatttcataaaatcgacaatgactccgtgaactcaatcaccaatgcgctggactttttccgcattccgccgacaaatgtcagcgtctcttcatcaaaggtgtttgaactgcttcccagcaaccctctgaccgacaccccctaccatttcaaacttcattcaagtcaaaattacattgacctctccaaatgctatttgctcaccgagttccgaatccggaaggaaaatgcgaatggtcaacttatggacctgaccattgacgacgaaaacattgcgccaatccagatgattgggcaaacattcatccgaaacatcaaaatgagcatcaacgggcgtgaagtgttcaacgcaaatgcactgatggcctacaaaacctatttttcacatgaactctcctactcaacaactgcaaaggactcgcacttgaatgctgcaggctattaccgggatacgggtgagacactggagacggggccgggctacattcaacgcaggaatttgtttgccgaaagcaaaacggcccaatttattgccaaaattgataccgacctattcaaccagccgctgtacttgattaacttttgtgaattggatgtcgaaattttaccaaatgacaacgattttgtgctaattgcacccgccatcggcggtgttgttcctcgttaccgtttcgaggtgatggggctcaaaatgtatgtgaagaaggtgtcattaatggacggattagcgctggacattgcgcgaaagcttgagataaagcctgcacgttatgcagtaaggaaaactatgatgaaatcgatgttcatcagtcagggtcggctcgagtttaccgccaatctgttcatggaccaaattccccgccgcatcacaatggggcttgtttcaaattccgactactcgggcacaatcacgcggagcccgttcaatttccaaccgtttaatgtgcgggaaattgcgatcatcgccaacggccgttcctacccccaggccccttacgatttggactacccgcatggtaaatatgtgcgcgctttcaacgatatgaatgaggcggtcgggttcgcaaactcgtcggaaagcaacggaataacctttccccaattcgggaaaacgcattgtatctacgtgttcaacttgacaagcagcggtgacgaccaagccgcgctctttgatctgataaagaacggaacaaccgcggtgagcataaaattcaatcgtgcggtaccagtggggggactgatgctggtcgtaatgggcgaatgcgactcgctggtaatgctggacaagaaccgatcgataagcaccgataccactatataaaaggcgccgatttagtgtatttctctcacatttgttacattcactgttcaccaaaaattaaaaaatgtattttaaaagcgctactgctgatattttattctttttggttgtttttattggtattggaaaatgtgcatcggctaattcaaacaaaaccaaatcccgaggggcagtaagcacccccgtcaccaccaccaccaccaccacaactgtcaatccacagaagattgatgtgtctcgtttggcatcagcaactcgaatggggaaaagcagcgtgactggcaaaccattaaaaattgtcaccaccaccgccaacaccaacaggaacataaccaccgccaacaccaataccaacatgaacataaccaccgccaacaaaaacaacaacaacaacagcagcaaaatcaccacccctacaacaaaaactgcaaaattggttgtggatgagcagttgccagtcgcaacactcctcccaacattgattcaccaaatgtgcaaggatcgtaccggggaagaaaacttttatcagcaagccatctgttgggcactttttgcgctctatttaatggtgattgtcagtctggtacttcatcagctttgttctatctgttggttaaagaagaaaaaggagtatggacagcgcgcagatttcgactattttgaggcaaagtcgggaaaccgcacgagttttccggggctgtttcccaagtgaccagctcccagcgccggacacgctacggtacccagcggcgctagttgtgaacaatgacccacactacaaacaaggatcccattggtgcgcgatttatgccccttcaaagacggaggaagcggtcatttactttgatagtctcacaaaaacaattcctactattgtaaaaacatcatttctggataaatttccaaaaggttttgttacaaataagcacccgtaccagtccccactgactaccacatgtgcaattcactgtatagtgttcatttatcatatggccttaggtcacccatttgatgcatttctgcgcatattagacgctagtgaaagccccgacatgtattctttgtgcattttgaataaaatgattaatccgtatttgtgtgtgcgtgccaatttttatctccctagggcaaagcgcataagggaaatgattgattagtttattacacaacggcgcacggtgcgcgctgttggtgccgccgcatatatacagcgaactcacgcgggaaaggctcacttttttcacaaaaataaataaaatattaataaataataataatgtcgttggaagatcacaattattgcggcgagttgggccgcaacgaagaaacgcccacaaagagaagaaaaagaaatgatgatgatagggaacagaaatttcaaaaaaactgcattcgcactctgagcgccgacaaacagtacaaccaaaagttcaaagtgcagagcgtaaagtcgacttttgtcatcgaaaatttgcccgccaaccccgagtcaatgctgcgcgcattgttcgctcactgcatgtcaaccgccctggacgagtcacagcagaacgggatcacaccggatcaattgggcgctacaatctcttcagatctgctaaatccgagcatatggattcccatacgccgcatttccgacaacaccgccgactcaattatgaaccgcttccttgaggtggcacagtcaaaatcgcgggagggctctctgtggggctcgccgttcactgtgaccatcacaacgttggatgttgcgcagctacctcatcggcaacaggtgcgtggcagtgggaaaaggacagcaaattcagtacaacatatcatcaaagaaagtgctcttctgcggatcaacaacaacgatgatgcatattgtcttttttacgctttggagacaagcaggaagtaccacatcaaagagatgagccgacagaccttttctaaatatattaatcggcagaatgggcgacgactggaagacgtgtttggactgatgagcagcgcaaacattcgcaccgatctgagagaatatgacgcggttgtctatgtgccaattgtcgtggactattggaatcggaaatacgccacagcaaaccagcgatttaaggtgttcatttttggcgctacaggcagctatcggccaaaatttcaatatgggccggacaattacaacgtcgaaatcccgctctaccatcacaacggccatttcgacggaattcgaagcggggtgggcaaagcggtgtttgggcgtgactactactgcttttcgtgcgagtgcccctacgataatgccaatgatcattcactgcagtgtaaagcaaagtgcataaactgcggtcgcataggagtggggcgaccgtgccgagcggatgacaacaacgacaattattacagagaatgcacagcatgcggcaaggatttcatgagccaagactgcttcagtcaccatttgtcgagcaatgtgtgccgacaattcaagaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccacaaagtacagactgatcgcctttgactgtgaaacaacacagaacacgcgaattgagggcgaccgcagacttcattccgtcaacttcatctcatgctatgtcgtctgcaccaagtgcataaacgaaaatttatggcgaaattccctacaagcgccatgtggcatttgcggtcggcagcgcaccgtcacattctcccaccgcgcctatgaacgcacacaaaccgatgcccaattcatcactccttgtccaatggcggcctttgctcaatggctgctcagcgaattcgatccgcgctatcccacaatgctcttcgcccatttcgggggtcgctttgacaacattatgctgtttcggcagttcttcctcaacgggttttgcccgcaaatgatccgccgtggtaacaaattatacgaaatgaaaattgcgaggggcgaaaaaaacccggaaatcatcgtaagagacagctggaaccttatgccggtgccactcggcgctctgcccggagcgtttggactcaatgtgcaggataaggagttcttccctcatttggcgaatgttgaggcgaattatgggctcattctgcagtcgctaccgccaaaagctgactacttatacggcggaatgacgcccgaccgacagcgcagattcgaccagtggtacgcggaacaccaccatcagcagttcgacctgtgtgaacagctcgcggcctactgcaccaacgacacgcgcatactaattgaggcgttggtcgcttttcgcacggagttcttgacgatcagtgacccgctggagcggcatggatgcttggatgacgacaacgacgacgaagatgaagaggaggaggtggatgacgacaatgcatttgaagtgatcggcggtggcattgacataacgtgggagccgatgaccatcgccagtgcctcaatgagacactttcgactcaatcacctcaagcgggatcagctcgccattgtgcccgagtgcggctacgacactacaaacacgcaaagccttgtagcgctcaaattcatggactggtacgccaaaaagaacggggtgagcatccagacggcacactcgcccggcggagagaaaaaaattggccagtacactgtggacggatacatcgcggcgaccgacaccgtgattgaggtcaacggctgccactggcacgcgcacgaccacccgcgtcaccgctttcagccccaaacagtgatggcgaatgggaaaacggcgcagcggatacgggaggacgatgcgcgacggatggccttcatcacatcccaggtgcaacaagtgctcgtattttgggagtgtgaaatcaacgcggagaagcgcaacaacgacgaaatgaagcgcgcctttgcgcagtacaaggacagcggcccaattcgtttgaaggactgctaccatggaggacgtgtgggtccacaacgactacactacgaggtgccagaggggtggcggatgaaatattacgacgttcgttctctctacccccacacgaatgccgtgacagcataccccgtgggtcacccaacacgagtgaacatcattggtgaggcagagcaggcggttgactggcgacgcgccgaccaggtgccggtccgaggcattctcaaagtgttcgttgtgccgccccatcacgttgatgtgcctgtactgcccgtgaaatttgatcagcggcttcttttcccgctgtgccgtacctgtgctttgcaacatccgcatggagccgtcaatgaagactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgcagaattcatggccatgaaaacacatgccagcggcttcccggacgaaattggtacaaccgaggaagatcagcagcaattcatagaggaatgtgaggacaaattcggaatccgaatcgagcgggaaaagatggtgcacaacaaggccaagcggaccatcgcaaaactgtgcaacaactccctgtgggggcgcttctctttgcgcaatgggttgtccaaaacgattgtgaccgactcgcccgcggaactgcgcgctctgcttgacaacccagcggtggaggtcagctccgttgaccagctcaccgacgaatgcgttctggtcacctatgcggccggaaacgaatgggtggaggaacacgagtgctcaaacattgtgctctctctttggacaacatcggtggcgcgcctacacttgttgcggctaatgcagacggttgcgcgcgcaccaaactctgtgctcatctacaccgacacggacagtgtgtgtttcgcccatcgtgaggcggacgggtgccctctggagacgggaccccatctaggcgacctttcggatgaatggccggaccacgaactcgtggaatttgtttccggtgggtgcaagcagtacgccctgcggatgcggcaccgccaaagcggggaggagaaaacggtgctcaaagtacggggcataacactgagcgccgatgcctgtcagcttctccactttgacacattcaagaggagtgtcctacgctacgcaatgtgccattcaaatgaggatgatgaagaaggagatgatgatgatgatgacatttgttcaattttgattgagtaccccaatttcctgagacccaacattaaggacgggactgttatttctgttaagctgtcgaaacgctatcgccctattgtaactaagggggttgtgggaatgaatgcaattgtacatgattttggttttataaaggcgtaatttatacggactgcactttttaaaaatgcataattaacaaatagaagattacaatttaaaataatgaagcgtgagaagttgcaaattttaggtagaaaaatgcataatttagtaagagaagtagcagttttggaaatattaaaaagattcatcatcatctgagttacagagttgctgtttttaggtagaaaaatgcataattagtcatatttaactgcttgacttagaatatttttgatttgctctttttcaatccatatgattcctttcacaaaaccgcaagacggaggaggtagtgttgccgcaacactgttttgtgtgggcatcgagccgggtggagagaccatggtcgtcataatcagcatcatcggacgaa

SEQ ID NO: 32 - DNA, 3661 bp, Heterodera glycines
  misc_feature (48)..(48): n is a, c, g, or t
  misc_feature (53)..(53): n is a, c, g, or t
  misc_feature (69)..(69): n is a, c, g, or t
agtgtgtgtttcgcccatcgtgaggcggacggtgcccctctggagacnggacnccatctaggcgacctntcggatgaatgccggaccacgaactcgtggaatttgtttccggtgggtgcaagcagtacgccctgcggatgcggcaccgccaaagcggggaggagaaaacggtgctcaaagtacggggcataacactgagcgccgatgcctgtcagcttctccactttgacacattcaagaggagtgtcctacgctacgcaatgtgccattcaaatgaggatgatgaagaaggagatgatgatgatgatgacatttgttcaattttgattgagtaccccaacttcctgagacccaacattaaggacggaactgttatttctgttaagctgtcgaaacgctatcgccctattgtaactaagggggttgtgggaatgaatgcaattgtacacgattttggttttataaaggcgtaatttatacggaattgtactttttaaaaatgcataattaacaaatggaagattacaatttaaaataatgaagcgtgagaagttgcaaattttaggtagaaaaatgcataatttagtaagagaagtagcagttttggaatattaaaaagattcatcatcatctgagttacagagtttatgtttttaggtagaaaaatgcacaattagtcatgtttaactgcttgactgagaatatttttgatttgctctttttcaatccatatgattcctttcacaaaaccataagacggaggaggtggtgtttccgcaacactgttttgtgtgggcatcgagccaaaccagagaccatggtcgtcatcatccgtatcgtcggaaggagatgataggaaatttcgcggcaatgatgacgaggatgatgatgatgacgatgatgcgccgtcacgcttttgagacagcgaattaacgtacacaggcggaaagcagtcatctacgacttttaccagttcaagcgggtaatatttgtgcaagggtccatcatccctttgcccaaaacatttctcgataacgcatggataatgcgggtattttagcataatgcggtgccgcgagtaataatgggccgcaacgcaaacattgtaggggcgcctcaggttaccataagcaagcactgagtcggcgccctcttcagtgagcccagcaaagaagagcgtgtgagtgaagccattacggtcagagtatgtagtgatgagcttacgatgtgcaaattccttcaacaatttttctcgattcgcaacactagcacaaattcgtacgcccacttcgtcaggggaacagtccaaaatgcgcgagaatgcgataagcaaatgcattgcgcgcaagtgagattttgtgcacattcaagcgcttttatatgtgcgtaggagcaccgtaacttcgtctttcacgtagcgcgcagcactgtaccttttcgctatataaaagcacacaaattgatgcaaaacttcattttaatcagacgattttttgcaaaataaaaatgaatacttttaataatgttcagcaaaacatgccggaagaatctaacaacaacagcacaaactacaacaataataacatcagcaacatcaacaataacaatgagaatgctcaattatggaagcttgtacgtaagaaatatattctgaccttcaatctttgttacggctgttctcaaaaacttttcgagtccactaaaaacaataacaacaacatcagcaacaacaacaattatgcttttgaaactgatcagtttggaggcgttaaggtgcaatttcgcatgtgtaagggatgtgtttggttgaacatgaagctgagcgatttaaatagtgcacccaaaagtggtaataatcatatgaaaacaactcgcaactttccaaacacaaacaatgcaacttactctactgacaataattttggctccttcttcaataacaccaacccgcagaataacgcaaatgaatggatttgacaaaatttagagcagatcaaaattgtaacaattaaaatatttattaattgtatggaattattttattaaatattttgtttcattcaaattcttgtgtcataaatatgacaaacctatttgcccaggaaaaatgattgatttcattcaatgatattaaccttttgagtcggcggataagccgcataaccgctattgtacgttttttggatctcgtagcgcacccatacgccctaacagatggtcatgctgtcttataaaaaggcaacggaaaatgccggccacctttttcctgtgccccatttttcgtccaaaaatgaactctcagcagcgccaaattgaacgagagcagctccgcgccaggcttaatttgttggtcgacgaggtagatatggtcgtccaaggccttatcaacaactacaggagcgatggactgataaatgaagtgagtttaggaatgcatgcccaaccagggactaggatttcaatgtagggaggcataacgattttctcgtcctctgtttaattttataaaactaaactttgatcaggaagcggccattggacaggcaccagaaactgtggaactacagaacgtgaccattgggtcacaccttcccgcgcaacaaggcgaggaatgggaaattgggccacacatgcccctacaacagcattatgagcatcagccttgggaactggacccaccgatgcccgaacagcatttggaaattgggccacagctcccggatgcgtgggaactggttccctatcagccaccaccacaatgggctcaagttgtgcatgtggaacaacagcaacaacaacaacaacaccaccagcaacaacaacagcagcagcaaggcgcgtgggacgagggatgggaggagcagctttcgccaaatgcgttagcgcagatccaggacgaggcggatgggttgcgccaggatttgagtaagaatttcgggtcggggtccctcccataaaaggaaaattaagtgattgagagatttgttcgtgtggggcagccgcagcctacgtggcccggttaccatagatgttcggaaaattttttttttattatgcactaattaataattaatttagcattttggctcgacgagggcacggcaggcattcctgaccaacaacaacaacagcatccgatgcagggatgggaaactccgcgcacccactttgagcgccccgtgccgcagagaacgcccagcccttcgggagattcgccggcggcactgatcagagaattaaatttctccgatcagtgcctcctgtgcatgggtgagcacgggttggactgcgaagtgaccgttcgcggcaacaactgcgggtgtgtcacaatttgtgacacgtgctgcgaaaatggctggtgggcgaggtatgcggatgctgcgcgcgagcagtccgcgcggcagctcgaggacagcctcgacccgtggactgggctagtccgcttagatgaggacagtcagaggcgttgggtaaacacacaaaacattgattttctgataaaatttaatttggttcatgttttcaggtcgaggggcacgatgtgcgccctaagtgtctcggctgccagacgagccgaatcgactacttgatcggggtaacgcggccgcgccgctcgcaacgcacgcgcaaggccacccactgcgccttttgccaatgatgg

SEQ ID NO: 33 - DNA, 1418 bp, Heterodera glycines
cagcggacgccaagcctttcgggggattgcgcgggggcactgatcggagaataaaattttccggatcaggtggctttctgtgcatttggcagccatggagtggactgcacagtgacagtccgcggcaacaattgcggctgtgtcacaatttgcgacacatgctgcgataacggctggtggcagcgttatgcggatgcggcgcgcgatcaggccgcgcggcaggtcgaagacagcatctttccgtggacaggactcgtgcggggggatgaggccagccaaaggctttgggtacacagaacacattttttttttttgataaatttaattcagtttatattttcaggtcgaggggcacgatgcgcgccccaaatgtctgggctgtcagtcgaggcggatcgactacctgatcggggtgacgcggccgcgccgctcgcagcgcacgcgcaaggccacccgctgcgcattttgaccgggaagctcgtagacaacatcaaaagggacaaactgagccttttctatgcgtgtgcaccataaggtgattccctccttggtgaccattgtgtccacctcagcctcagttcctttacatgcgcggcaacgcccgttttcctcaaacggaatgaaacggggaacagacaggcggggtccgctcaaggttatgccgcccgtgcttatagtgaggtccacctctgcgataacacgcttaaacaatgcttttttatccgacatgaaaaactgatggccaaatgtttgacaggaataaattgaaatgggccgatggggacacgcgcacttatttatatagcgcgagcgcccacccacatttttaaattactctaaatccttacttagacttttatttgctggatttatacctattttttaaactttttatgacccattttttgagtgagcgatcctattttcaaacatttttaaaattttattttaaagtgaaaaatcgatcgattagttaaatggtgagtgatcgcttgccgaatcactaaaaatcactgtcatcatcttcctcatcctcctccccattttcttcatcgcgcatctcgaccacaatgtcgctgtcaagcggcacctcatcgtacacgggctcctcgccctcctcaattgcaccatccgcgcggcgctgccccgctgcctttaaatttaaattgtaattttaatgagtgagaaattaaaatatataaagattttaatttaattaaaattgcccacccggtccacagtcaaattgacgcccgtcgggcgcagagaaacgccggccaacatagccggcaaaatcagcggagtcggcgcgcgtgccggctggcggttgcgccttgcggcgctcatccttgtacaaattgttaattacaatttgctaaaatgtaatagcgagaaatcacgctgggatgtcggcgcag

SEQ ID NO: 34 - DNA, 3153 bp, Heterodera glycines
atttccggtatacgcaccggttgaaacaaacccgacgattaaacgtctcggaacaatgctggtaaaaacattgtgtgagagatcagaagtgccccgtggaatgaaaagactcctgatctcaatttttctaaccggatatttggccggggtggtttgtagctgattgcttattacgttatttaatgactgggtaatgtcgactgtttttacataaattctaatatcatgtatgttaatacgatatgtgtgcgggttcgctatgactgcatttcctgaaacatatggcggtgccataattagaaaatcatcggtattacggtgtatgctaaaaatgacatccgagttattaagcaatagattgggctgacgggcgagatcaaaattaagtttcatcattgtttcacattttgcaccatcagcaaaacgtgacgctctgtttttaaagccactgtttgtataatcattctggtcgacatcatcgacgtaatagcaggacgcttcacatagaccctttttgacatcttctgaaaatcccaattcagtcatcatatatgccctaaccgcatagtaaataccggaatcataagattcgacaccggaaattgacacctttaatgttttgacaaagctgtgcccaaaattttgaatgacaccgacgtgttgatcagcttcactgtccgtggtaattggaatccaattgcttttgtcttttctctctattgatgttgacaaatagagaaaagttttattgaggtcacaaaactgattatctgaaaaaagtctaaagatatacggtccagattgatttattgctgaaagtggcagcaattcccgaatactggatttattaattgcaacgttcgtcggagggatgtcgaaaagggaaaggcccccctcgagaccgtcctcactcgccgtgtcgactttcttgagagttgtcatttttaactttttgtattatttattccatttatacctttagatcaaacttaactgatcatatacttgtttccggttcttattagtgatcagagacctttttcctttaccacattgttgtaacttatcggtaaggttagtaaacccctgtcttgaatgttccctgacggcatcccttaaattacgaccctgggcgatgtcactcagaactctctgcccagcggcgagcccctcctgtcctgcactcgaggcaatattcctcgcaatatgggtcaagaaacgtgccacattaccgagtaaaccgaatccccgttgatacttgcttccgacaaagtattgtttctgtcccctcccatgttgtgaagtgaaaaaagatgaccaatcgaccgactcgggatcgaaaaacacatgtgtcattttttaaaatatacttttcttaaaatgtaatgtgagaatacaacttccccagtgaaatttaacgaattcgccaaacggtgtgtgaatttcaattgtaatttctgaaattcgtttcgactgtagacgatgaaagtactcggtgctatatataacttcactaatcgaccctgggtcattgacgacgttaactattcttaagagtggagccatctggttcccgataattgtgttttctattaaatttggtgcataaatgtatagctgccttacgcctcccgtcaaatctggcatataattcgcctcttccgcgtgaaatagccttgtgttcttaaaaccaagcacataggcgaggtgttttgacaaatctatgtgggagacagcagcagaaagatagacaataaatttttgatcaatgctgtcatattgaaattgaacatcctcattggctagtctctctcttttttgtggtcctttctcagcttcagatacttgtctattttcaatatctttacgtttaatatgctcacccaaagcctcattaagcctattcactattccgaggcgtactgtgaattttgacgtagtgttctcctgccccggtgtgttcgacggtagtacaatgtaaaaatcatccatctgttttcactaattcctggttataaaatatgccttttattaaatttccttccaaatcttcgatcctgtatgaatcgggtgtcgttggattaacaataacgattttaaataattcttcggtaaagtttgggagatacccctttgcaaattttcctttttccttggtaattcgaacgatatcgccaattttaaatttgttctttttcgaaattttaaattccttcgccttatataatttttcccagagcggccgggcattttcaaaagttacggatactggcttggcccccaatgtcctattcacactgttgttaatgtttattattattttgtctattacatcgacccatcgtagagtgtccatctttgtaaaatatctgtacaagcgctcctttattgtccgatttgccctttcaacgactccggcgtgaaggtcaggactatacatcacatttttgataataaatttttcctcaaaatattttttcatttttccagcctgaaactcgagtccgctgtcgctatatattttcatcgggataattttcgacttttcgaacacccgatcaaaagcctcaatcatgtcctcactcttctttgacttggccggtgcactgaagatcattcgactcagcacgtcgatgcataccaacagatatttgtaaccgtcgttatgctttttcaactggtcaaatatgcacaaatcgcactgccaatcggtatggaagccgctcggtaccgtctttagtctcgggaattttttcctgatgggcttgtgaatcgtgtatgttctctgcttttctaggaatttattaacgtcatcggtcgtaatttccgagtcaatctttttggcctcatttaaaattttttgaatccaagcaaaacttgccggagattttaaattaaaataaatttttgataaaattttctctacagtcttgcccatattagtggtttgaatggtttcttctctcgtgctatgccgtgtgtttttatagattttattgcctttttacttccacgtccccacatgaccttcgatttatcaaccatgtcttttactgttggatccttcagtaaccgatctttaagaaattttgcaccgcgcggtgtttcatctttcttccccgcgagatacaacaaaacatccctataattact

SEQ ID NO: 35 - DNA, 7461 bp, Heterodera glycines
catcagaatttgggtgcatgttaatcatgagatagctaaattgattattggtcgcatcatgatatgcatccatgaaataattcagtctttttgggaacagttgtgaccctagagtcctcacttgtaattgtcctgaagggttgcgcattaaaaccagataatgggcgttcgctcttgccgttttaatgtcccgaccatagagactctgggttacaaaaattacgcttacgttccaattatgggagcccctggtaaagagtagatcgaggaaagtattctgcatattaagcattaaatcgtcaagtattaacaaaagggggttttcctgttctttaatcttattcatgtccggaatcccgttaaaagtctcaacgccctccccgattaatcctaaaatactatcattcatctcaccataacaataaagaattttttcagccgatggttcaattagattcttatgatgttttaaaaaccgtaatagccaacgggtcttaccactcccagtagcccccgagagaattagagtgaacggacgtgaaacatttttaatgcatcttatttatttgactatttatattttcatagggaacatgtttcgcacatttggggcataaccagaaattatcaaaaaatgatgtaccgaaatgcaaaagactgtgttttttacatctgttacacatctcgtaatgacaggggcagtaatgacaacacttaattttatgtggacagttcatttttcaatttaattttatttttggttgctatttatagaaggggtatataaagggagtgaaaggaccatttgattggtacattgtatcaaaaatgcaaaaaccgataatcgtaaatataattgctctcgctaatgagtactccgggattatttctctaaaatttttctttaacaaaaacgacaattattgggtattttatttatatcactttttagccctttctttcttctatcgaatgcattttgtttcagaaaaaaatatttgtctttttaacaaagacattgttgttaaatataggtgccaaagtggggaaaagcacattttttgacccccatgttacaattggtcaaaattggcacttcaagtttaaaatgtgtaaaaccgaacggactaattacgaactgttaatttgaaatagtgaaagtaaattttgttcatgattaagcatatcttcaaaatatttttttatatctaaaattaagagaaacgttctgatgagtccaaattttgcattgcatttaaaacaaaaatttttataaatattttttcccgaaattgtccgcaaatgtctggacgcgggcggaggagaagaaaaaaaaacatttttatactaaaatattagcgtagcaattaacgacggcttctgacagcaacaaaacaacaaagcagatcctgtgattttaataaacagcaatctctaccgttcttcgcatcaatttttttggtcctatctctgtcctagcccctgctactggtacaaaaccagaggtgccagatctgaggctttagcctcattttgtggttttttgataggacaatgaggctaaattttaaaaattgggcgccagcatgtttttccactataagtttctataacttttttctatgtcatccaaatccaacatttttgatatcattcgaaagcttaatgtatttagaaactttttataagctattacttcacgattagacaaataccaaaaaagttatacataaaaattgcgaaaaagtcgaaattttcaagttttttcattaagattttttcaggcttgaaaaactttgcaatttttgaaaaggctaatagagcatgttaagatctttcgaatgataccaagattgttggatttggataacaaataaaaaagctaaattggaaaaactttcttttcatagggaacatgtttcgcacatttggggcataaccagaaattatcaaaaaatgatgtaccgatatgcaaaagactgtgttttttacatctgttacacatctcgtaatgacaggggcagtaatgacaacacttaattttatgtggacagttcatttttcaatttaattttatttttggttgctatttatagaaggggtatataaagggagtgaaaggaccatttgattggtacattgtatcaaaaatgcaaaaaccgataatcgtaaatataattgctctcgctaatctcggtaccggaattaaactaaactctctgacgatcaccgaatgcgaatttaagtataaccctagaaaattcaatgccgcggttatcaaatgtataagccccatcaaagccacggcattattatgggaatccgggaaaatgatatgtttggggacgaaaagtctgatagactgtgaaaatgctattaaaaaatttatagaaataattaagggctcggggtgtccggggcttcttacaccggacacacggttgaaaatattgtttcgacctttaaattcggacgtgaaattgaactgaacgagtttcgaaaaaatcgtcgtgcattttatgaaccagaaatattttgcggtttaaatttcaagcggggtaaaagcatgacagcgttaattttctggaccggtaaagtcgtaattacgggaactaaaaacaattctgaaatagaggaaatgtatcatcatattctcccctatttgaaaatggctcaaaagaagttagggagacgataaaaatttttcatttattgggacggtccctcaatttatagttctgttgggcatttattttgttatcgattacttcgcgcggcgccggcatcgcggcgcaccggcggggcggagaggaaatgcatggttttggcaaattttcaaaattcagaaaaatcatcataaaaatctcaggattgagaaaataaaacgctaaaaggttttgaaacaaaagattaaaatttgcaaaagttaaattgaatttccttcacctgtcactttggtgacaggtggatgattgatgaccttcccgcggcgctgcgcggcgcggggtgaaaaaacacccgcacggatttgggtaaattaaaatccgcaaggcggcagagttcaaagaacatcccataggctcaggatgtgagcgggcggcaacttcaaagggctgcacccctaccataggcacgggtttgtgcggggcggcaacatcaaagggataccccctcccataggcacgggttcgtgcgggaaacacccgctcggaacccgctcgcttttgacgctctatactacttggaattggccttgttttcttataaaaagtaattcgcatattgtaactgaccgaagtggtggcacggagaaatgcctaaacacaaaaattggtaaaacaaaaacaaagtgtttagtctcgaaatccttgtcgataaaagcacaaattgtgaaagaaaatgtgtcgaccacctgcttgtgattgtggaaccaattgtttattttcataaaagcaaaatgcgagcaacgcaattccttcggttgaccattttttgtcggagttcgcaaccatttggccaacgcttgaccagcagttgaattcggagcattttcatcggggaatagataaccagaatcgattgaattcaattgatcaagatcggtgagaagtgtcggcgaagtgtgataacgcaatttgttcaaatgatcgccatcctcaaagcacaagtggcgaatgttggtagcaaaaattggccaaatttcaatggcaaaaacatgatgaattgtatatattcttcatattgaactccaatttggtgccaattctgtcccaaatttgcttgttcgaacggagaaatgtaatgacggaatggtcaatgtacctgaagaaatttattaaaatacacaagccttaaaatacacaaagttaaaaattactcaatcagaaggaaacgaaaacgaattttgttgggaaacggatggtctggtatcggaaattccacaaatgtgccatcgatctgctgtacagacagtttgtgctttggtccttcgtccttgccaattttgatacatcgccaaagcgtaacttcctttttgccatcaaaatgcatgtccaccaaaacatcgtaaaagtcagaaagcaatgctattttgaggccgagtttagcatagtcaaagaagggcagaatattcatccaaatgtcgccgcacatccaacttaaaaacatggaaaaattaggaaaaaatggaaaattttgaaatttatcaaaatttccttaccgtctattcattttttgctgcaattaggacgctttgccgttttacaattaggtaattggtgacacaatcagaataaatagataattgttttgaaaattctttcctaaacaataagcaaatcgagcgacaacaaaaagtgtagagacgtaaaatgtgttttattcaaaacttttttctgttttaattattatgtgtatcttttacatatatctagggctgggatttttaggtgctaaaaacagggttcgcagatctgaggatttatcctcattttgtggctttttgataggtcaatgaggatttttttggaaaatgaggatttgaggatttttgtggctttttgagaaattttgaggatttttgaggcttttggggaaaatcctcagaatcttttaaattttgataaattggcataatgtttgtcaattatttaatttgaattttggtttttaatagagtatcaaacggaaatctcacccaaatttagccagaaaattacaattttttcgaaaatccacaaaattatgaatttttttaaatgaaaaaattttcatctgcgaaccctggctaaaatcctaaaaaggtactaaaataggtgctaaaaaagtgcaaaataggtgctaaaaacccccaaaaaggccaaaataggtgcgaaaataggtattaaaaattggaaaaaccaagtatatttatgttttttgaaattttttagatcgattcttggggtgcatttttcgtttttattgcatttttgctatgaaatttctggaaaaaggccaaaataggtgctaaaactcgaaaaatgccaaaataggtgctattcactcgaaaccctcgttttaggtgtttttaggtttttataagtcgctctaaatcaaaaattttcgaagaaaatgctatttttgggcttatctcgtcataattaagccgcaaaaaaataggtaaaaacctaaaaatcccagccctacatatatcaaattttctaattcattttagaaattcttgaagacatttgcagcaacaaaattaccagaaatgtgacagacatttgcggacggacatttgcggacaatttcggggaaaaaaatatattcttaaaaaatttttaaaaaaatctcaaaacatggaatggcgactgcaaaactaaataaaaatttatttttggcttttaaaggtatcatattttatttttacactttaaagaattaatttaactggccaaagtgagatgctgttccttaaaaaattttcggaaaggaaaaccgaaattccatggcacaaaaattacaggaatctgatattggaaatcgggatttcgtgcagctattgatttttgaatatggacctccaaattgataaaaatgagtactccgggattatttctctaaaatttttctttaacaaaaacgacaattattgggtattttatttatatcactttttagccctttctttcttctatcgaatgcattttgtttcagaaaaaaatatttgtctttttaacaaagacattgttgttaaatataggtgccaaagtggggaaaagcacattttttgacccccatgttacaattggtcaaaattggcacttcaagtttaaaatgtgtaaaaccgaacggactaattacgaactgttaatttgaaatagtgaaagtaaattttgttcatgattaagcatatcttcaaaatatttttttatatctaaaattaagagaaacgttctgatgagtccaaattttgcattgcatttaaaacaaaaatttttataaatattttttcccgaaattgtccgcaaatgtctggacgcgggcggaggagaagaaaaaaaaacatttttatactaaaatattagcgtagcaattaacgacggcttctgacagcaacaaaacaacaaagcagatcctgtgattttaataaacagcaatctctaccgttcttcgcatcaatttttttggtcctatctctgtcctagcccctgctactggtacaaaaccagaggtgccagatctgaggctttagcctcattttgtggttttttgataggacaatgaggctaaattttaaaaattgggcgccagcatgtttttccactataagtttctataacttttttctatgtcatccaaatccaacatttttgatatcattcgaaagcttaatgtatttagaaactttttataagctattacttcacgattagacaaatactaaaaccactgtatgtataatcattctgaaaaagtcgacatcatcgacgttttagcaggacgcttcacatagaccctttttgacatcttctgaaaatcccaattcagtcatcatatatgccctaaccgcatagtaaataccggaatcataagattcgacaccggaaattgacacctttaatgttttgacaaagctgtgcccaaaattttgaatgacaccgacgtgttgatcagcttcactgtccgtggtaatcggaatccaattgcttttgtcttttctctcaattgaagttgacaaataaagaaaagttttattgagatcacaaaactgattatctgaaaaatgtctaaagatatacggtccagattgatttattgctgaaagtggcagcaattcccgaatactggatttattaattgcaacgttcgtcggagggatgtcgaaaagtgaaaggcccccctcgagaccgtcctcactcgccgtgtcgattttcttgagagttgtcatttttaacttttttgtattatttattccatttatacctttagatgaaacttaactgatcatatacttgtttccggttcttattagtgatcagagacctttttcctttcccacattgttgtaacttgtcggtaaggttagtcaacccctgtcttgaatgttccctgacggcatcccttaaatcacgaccatgggcgatgtcactcagaactctctgcccagcggcgagcccctcatgtcctgcactcgaggcaatattcctcgcaataggggtcaagaaacgtgccacattaccaaggaacccgaatccccgttgatacttgcttccgacaaaatattgtttctgtcctcttccatgttggggagtgataaaagatgaccaatcgaccgactcgggatcgaaaaacacatgtgtcattttttaaaatatacttttcttaaaatgtaatgtaagaatacaacttccccagtgaaatttaacgaattcaccaaacggtgtgtgaatttcaattgtaatttctgaaattcgt

SEQ ID NO: 36 - DNA, 517 bp, Heterodera glycines
  misc_feature (504)..(504): n is a, c, g, or t
aaaagtaaaggcctcctgggcctttctgagaaaaagaaacttttcccagcatcgaggctggtgaaccctttgattattttaaaagctgttgttaaatcattgatttttcttctttcttctaatttgtgtaaatcagtgatttttagtctttccccatattttttgtacacaaacccacattttctaagttcttttcttgtgaaaaatttttgaacgcgctcaattttatctatatctttttttaaattagggttccaaactttggtggcatattctacttgaggtcgtacaaaagttttataggctgctgttagagtttttatttccctgcttttcaacactctcaaaatttggaaatttctaagatatgcgtttcgtataattttgctaatatgttctgaaaaattaagtttcgagtcaattataattcccaagtcacgtacactttccgattctgaatttttgagttaataaaatattcttttttcttgttatttttccctnaaataaagaacaa

SEQ ID NO: 37 - DNA, 1502 bp, Heterodera glycines
ggtcccgaatactcatggaaacacgtttttataatttaaaaaaattttatgtggcctaaactgcataagtaccgcagtatttaccaggttagcctcttcggcgcatcccaaaaaatatgtaaaaagtagagcccggacgggtccgtgcgcccgccgggcttttgccgggccacccgtgccaggaaatttgaaaaaacactggccccggccgcccggtaaaacggatttctttttggccgggcagcacgttcaattgtcatcaaagcccgggcacggccattttgaccgagttaaaacgggcctagatttcaccagtgcaaaaatttcaataaaatttccaaaaaaaaaatacctgacaagaaattttaggggctgacgggatgcagtaaaagcagggttgccagatctgaggatttatcctcattttgtggctttttgataaatgaggatttatttggaaaatgatgatttgaggatttttgtggctttttgagaaattttgaggatttttgaggcttttggggaaaatcctcagaatcttttaaattttgttaaattgacataatgtttggcaattatttaatttgaattttggtttttaatagagtagcaaacggaaatctcacccaaatttagccagaaaattacaattttttcgaaaatccacaaaattatgaatttttttaaatgaaaaaattttcatctgcgaaccctggctaaaatcctaaaaaggtactaaaataggtgctaaaaaagtgcaaaataggtgctaaaaacccccaaaaaggccaaaataggtgcgaaaataggtattaaaaattggaaaaaccaagtatatttatgttttttgaaattttttagatcgattcttggggtgcatttttcgtttttattgcatttttgctatgaaatttctggaaaaaggccaaaataggtgctaaaactcgaaaaatgccaaaataggtgcgaaaataggtattaaaaattggaaaaaccaagtatatttatgttttttgaaattttttagatcgattcttggggtgcatttttcgtttttattgcatttttgctatgaaatttctggaaaaaggccaaaataggtgctaaaactcgaaaaatgccaaaataggtgctattcactcgaaaccctcgttttaggtgtttttaggtttttataagtcgctctaaatcaaaaattttcgaagaaaatgctatttttgggcttatctcgtcataattaagccgcaaaaaaataggtaaaaacctaaaaatcccagccctacatatatcaaattttctaattcattttagaaattcttgaagacatttgcagcaacaaaattaccagaaatgtgacagacatttgcggacggacatttgcggacaatttcgaggaaaaaatatattcttaaaaaatttttaaaaaaatctcaaaacatggaatggcgactgcaaaactaaataaaaatttatttttggcttttaaaggtatcatattttat

SEQ ID NO: 38 - DNA, 22869 bp, Heterodera glycines
cagtagtataaggtcccaggggccggggtccagacccctgcccctgcttaaaaaaacacccatttttgttcttcatgattttgtcccaggtgccggggtccaaatccatgagaggattaattaaattaattcatccagaggcagagggactcgaacccaagaggtctaatccaaagcactaccattgggtcagcgatacagctatccgaaaaaggataattagcaattatatatatatatataatttaaaatcgattaattcaccaatgggagggggattcgaacccaagaggtcaaatccaacgcacaaccaattgaccgaggaacatagtcattcgaaaaaggatatttgtcagttatgtagtaaaaaaagtgttgcaagagtcaaaaatggacgggagaggggatgcaggcgacattctcccttttgcctatataaagggatatttgtaagcaaaaaaagcacaaagaaattttattaaaaaaaatgttcaacgcaccgtttacattaattttatccggcgctacgggaagtggaaaaactcaatggctattgaaacttttaaaacactacagcttgctaatcgcaccgcctcctgtaaaaatactctattgttattccgagatgaacgattctgtgatcgggttaatgaaacaaggaattgagacacataatggggtaccgacccaaacgttggttcaaagtatgcctaaacccctgcttttgatcctggacgacctgatgttgagtgtaaataacgattttttggatttattgttcacccgaggctcccataactgggatgtaagtgtgatttttgtaacacaaagtctctacggacgcaatattcgtaccgcaagagccaacagccattatttggttttaacccggaatccttctggtcaacttcaggtcagaacggtgggctctcaattgtttccgaagaggctaaactattttatggaggcatacaacgatgcaaccagcgaaccattcagctatttggttataaatatgcatcctaatgcgcccgagtctgaacgtttaacaactaaaatcttcccggatgaacagcgtgaggtgtacctaccaattgaataaagaaagggtataaaaggttgagaaaatctgtaaccttcactacaaatgtatgaatttagtccatatataagtgaaaacgcagaatttttttaaaaaattgcctctacgaaatcggaaaaaaagaaaaacatccttctgcgagacgaaacagccgaacaaatattagggcttgttgaaatttgcgcaaacatattaaaattcaattttagcctaaacagaaaccaaaggaaacggttggccgaatacgcggactattatcgtgcaattgcacgctcgcgtagtgaaaagactgcgagaaaaaggctacaacagggaagtggtatagcattaggggcaatattagtgcctattcttggcgcactagctcaacacctggtcgagaaaattacgacctgacaagagagagctacaatgaaatatacaaaaaagatggttatggtgccagagagtgagtatttggccctcattaatctactgaaaggaaacagcaccgtatctcctcctctaggcgacccgttacatggcgagaaaacgctgcttgatgtacagattcaaaagaatttggttgatccaaaaacgaacgcagaaataaaaatgaagcgtcactcatggttgtacaaacgtagacaccaactaaaagatattattgagaacaaacctcaaaaagtaattgttgagagtggctcagttacagcaccaaacgttgcaccgtatatgggcattcagaaacaacaaacaccgtcgcatgtgagcacaccacaccgcaactcggcttcaattcaatcaattggtgcagtaagtaagagcaacactgatgtagaagaggacacggacttttcaactgcttctgatcagtttgagcctgctgctgatgctgctactacttcgtcaaagaaaacaccgcatcaaaagacgccaaccgttcctttaaggaccagcccgaaaaatttcccaaaaatgatgggcattatcgggaaggatcacaaaaaattcggtgtcaacgcaagcagcggagaaattttgactaatttcaataaacccgtttcaggctctcattttaccgaatcgttaaagcatttgacaggtcagcgcgaagatgtgcccagaggacatcgcttcttcattcaacgcatctcaaaagacccggaaatgatgaaactgcttcaaaaaataccacaaacgggggaaggccggcggcgcagcacagtgaagaaaatgggaaagaaaaaattagtgcttgtcaatatgatgaattcaccgtctataaaaaccctaggattacaccgaacggaaccaaaacgcaaatttaaacctgaattatggacaagactatagcaccaaagcagccgactgtggataaattattggaacaaatttattacgatttacgctcaccggccagctatgctggtatgctaaaagtttgggaggaggccaagagaagagatcctcgaatttccttacacaatgtctatgaatttcttcatcgccaacgcacttacacattgtttaagccacggagaaacaaatttcctaggctcaaaacggtgccgagtggcctgcatacagattggcaatgtgacctgtgcattatggatacgttaagggcgcataatgacggttaccgctacattttggtttgtatcgatgtgcttagtagaaaaatttttaccgcagagtcggagtcgaagaaaagcgaacacatgattgaagcatttgaaaaggtgttcaaaaaagctggtgtgctgcctaacaaactatacagtgatgcaggtttggagttccaagcaaaacggatgattgaatactggaagcaaaaggatataatcaaacacataatgtacagtcctagcctgcatgcgggtgtggttgaacgggcgaatcgaacactcaaggggcgcttatacaaatattttagcgaaaataacactctaaggtggttaggggtgatagataaaatcgcaaataatgtgaacagtactacaaatcgtaccattggtacaaatccggcttctgtaacctttaagaatgctccgacgttaagaaaacgcctatataaagaacacactgatgacaaggaaatcaaaataaacacaaaattcaaatttggtgatattgtaagaattagcaaagagaaaggccaattttcaaaaggttactatcccaattttacagacgaactttttagggtccaacgtgtaaacaacacagacccgcactcgtacagaatacgtgatttgaacggagaagacataaagggaattttctacgatcaagaacttgtaaagacaacggaaaacggtacccatcgcgcagaagtgctaaaatcgcgtacacgaaacggagtcaaagaacatttcgtccgttgggttggcttgtctgacaaatacaacagctgggtccgtgactcagacctagtgaaacgccgagcatttgaataaagctaaataatggaagatttttacattgtacttccctcaaacacacctggtccaggaaatactgcctcaaattttacggttagacttccgcacaccttagagcttgactccaaatggtccgtcgcgttatcagcaataatctatccatattcattcccgtcgatcagtgtggacgaggatgactctatctctgtcaaactggttaatcctaactacagagaagatgctggaaattctgacgaggaatcgcaaaagtttatcaatttatcagtgaagattccaaatgtacaattccaaagtgtacaaagtttacaaaaaacactgaatcagataatccagaatgcttacgatacaaagtttggcggctcatcatcattaaatgatggtacaaccaacaaaagagccaaacgacaaaccgaattgtcagaaacaggcgctggagttatcgaagtagagaatttcttcactcgaaatccctttgactattggcaacagattggagaactgagaaaaaagcactatcagctcagagaaagggttgaaaaaatggcaaaggagtacaattcaacagcggatggcgaacgaaaaacatttctctcaacggaacttggggtttttcaggggcgagaaacttttctgaaagaacatttgcatttgattgaagaagaggcgaagagaagggacggtgagcagcaagaagccaatgaacaaagactcattgaccgtttctttgcccgataccccgacaattatagagagcagctggacgaatggaggtcaagttacctccgagatgtgctagatctacaaacaaagatgggagagtatgaaggagttaaagatttgaaaaggcttgaagagctcaattcgcaaaccgaacgaatgagaaattccatacacgtttttggaagaaagatggaaatattaaacaacgcagcattgcaacgtgaccagaaaaggtctcaagaggagtttgaacggacaagccatgaacaaaacctgaccttcgtccaagaattcttccaagccaatcccgtgaattattggcaagcaatccagaaaaattatgaagcgcttcagcttgagtacaccaagaagagggaattgagggaaaagcttgaatttgaaactgacgcaacggaaagggagtcgctgcagcgacaaatagagagcattcaacgtctgattgactacaggcgtaaacggtttgccgctttggaatacgaggctaaaaaaagagatgcgcagacagggaaaactaactcaggcctcagtgctgtagctgaggggtcaaatagtactagttccaccccaatagactccttttcaccagcagatgagcccgcaaacccagacgaagaaaatgctaccaatagtaaaaacaaccaccaacaaaacatcactactactgccaccgctactttatcatccgagacaccagctgagcaaattttagcagatcaagataatagtattgatgagaaagacgaagcaggtacgccgccatcaagtgggttaggacagtccggtgatgcttctgctacatcagtgactcaagttgaagatggtcgaaatttacctcaagcagccgcgttgacctccaataacccaaaaattgttgctaaacaatcaacggtagcgacagagagaaggaaggagaaaataattgaaaagctgatcgacgaacaagtggaccgaatggtcgacggaacacatgcacagcagaagatgctacaggaagaaggtaaagacaacgagagtcaacaccgcatttcaacatataaactcatcgaagaagtgctacatggtgagcatggacagctaatgtcgcaacagcgtgaatccaaaatggcagctgaatttgcatacaatgaaataactcagcgattcggcattagaatgggccccggagtaatgcacgttgatttgagcaaacagctgtcctatgtgttggggtttgatcgcaaaacacgcatttacaacaatcagtcggcaaaatatccacctgatctgtctggtggtgtccgtcagctgtacgtttacgcgcctaaactggtggaggattccattataggtgaccgcatggcaccgttgctgcgagttgtcaacgtgtcagggacaccagggttggacatgccagaggttatatataccaatgaaatttttcattctctccaaaataaacgcatttctgaaattaacattgaaattcagacagcatttggacgttacgtaaaatttggttggggaactaccgtaatcacattacattttagacaaaaactattttagcaaaaaaaacgatagttatgacgcacgttgtttttaacccggacaacgtgaattggtccgcgttccttgcgttacagcagcagcaggagggaagcggtgagctgcagtattttgtaggcaataaatttcagcgtggtggcggtctgttacaaaatatttcgcggttcctgatgcctgtagccacaaacctgctaaagtctgcctcaaaagagggcatttccgcagggacacggatgcttgacgatctcgcgcagggaaaggcgtttaaagagtctctcaaaactcaggcaaagcaaggatttgagaatctggccgaaaagctcaaccaatgcggaaagggtgggcggcaacggcacaagacaatcactcatagaaaaaataaaaaaactggtacaatgagagggaaacggcagatcatcgatcaactaacacttgcacattaacattcggcaccacacgaagcctataaataggtaggataattttaatttttttcactaacgactacactctcaacaacatacattaaatattttgagagaaacatactaaccaaaaaactcagtggaaaatgagcgtaattaaaaagattgacaaagacagtgttgagggtctggaaggaagtctgtcattattctctttgccgccaaccaatgtggccataaataagacaaacgtccgtgaattgctgcctctttctgcacttaatcagacaggtccctatttgtttcgcctgttctcggacagtcaattttgtgacttgagcaaaacctatatgtacctgctcagctcaattgaacggaagaatgacgcgggagaatgggtagcactcagtgacacggacccaaacgataaacatgttggcgtcattcaaaactttgctagcagctttgtccgctcgctgaaggtcaatatttcaggcattgaggtgtttgacagttcaatttattatcactaccgcgactacataatgaaggagttgggttattcacaggaaattcgcaaggctttccatgaggcatcgtgctactacgcagacgatgatgaccagaacagcgcaacaaacccaggttttaccgcacgtgcggcacgcttttcaggtggtaaacagtgtgagacaatggtaaaactgaattttgatttggcacgtcaaagtgcattgatgttgaacaatcaggatgtaatattcaccattcaccgcaacaatgattcattcctcctgcttacacccccatacaaaaaaccagatggtacacagcaggaaaataagaaagagtaccgcatccgtgtgcatgatatgcgtctctatgtgcgcactgtggacgtaacaccaagccttaaccttgccattagccgacaattagagtcgacttcagcaaaatatccgctgcgtaaaattgagatgaggtccatttttcttggcacaggccggaccgagctggcacacaatgtgttcacttctacgttacctcgtcgtttaatttgcactttcgtttcaaccgatgcatattccggtaaccgaaaaatgtcaccctacaagtttgaacacgccaatgtacgttcgattagtgtcgaggcgaacgggcagacctttcccagcaccccgtatttgctgtccttcgatggtgtacagccccgctttgtccgtgcttttgtcgacatgtacgcaggcctgggtttggatgactccgacaccaaaacggtctcaattgggatgcagcgttttcttaacggttgggcctttttcgtcattccgctgacttccactctggaggacacacctggttttgagctgatcaggcaaggcacatgcacgataaaggtgcaatttgagcagcctataaaaacggatggatatgagatgcttgtccttggcgaattcgattctgtgttgtccattaacgcagaccgggttctgagtacagacggaagtgtgtaattgcaattgactgacactgaaaagcaacaatgaattcagctcaattggaaataattctgaaaaggttgcgccctaccaaaaataaattcattggtgttttcccatcggatcgaattccgaagcgggtatctaaatttccccattgcatggtcgtaaatacgggcaaagaagggacacgaggtgaacattgggtggcttgctatgctttaagccatagaagcgttgaatattttgacagtcttggtgagcccccaaaccccgatttagcagcctacctcaacacatttaaagaggtactggtcgctaaagatcaaattcaatttcccacatccgatacgtgtggccatttttgtatatattttttggcaagccgatgttctggcattcctttctgccgtgtgattgagactttgcgcaagactcgaggcatggcagattacctcgtgaaatggtttgtcagaaacttgatcaacggtctataaaagctcacgtttcctaagcagtaagaaagatgctggttcatttcatgaatgttttttacgcgggtatagtcctcagctgtgtgccgtcacgattgcaatcggagctgataaatgtagattttacggttgacaatcaaaactattttgacagcggcaaatatcgtaccttttcaaaagatgctacagcagcagaacactttggttatagtcggaatacagcgtgccgaatagagaaatgtgagcgtgacagcgaatgggccgtttcgcttcaaaatgtgtacactttgcacagctatcagagtgtgtttttcgaaatgaaatcattggtgaaaatgtcaccattggcctgttttgaatacaatgggcatagttttaccttttttgaagacagcgaatctggtgagactactatcttccgtggtcaccagcataagattgtgcaacgactgtccaaacatggacgggttgtgtttgatcacctatcgggtcgattgtttctgatcgataagtatcagaggcggatcagcgaaatagagcttgaatacctggagcattggtggcttcgaaaaaaccaatcttccgcacatacgatcttgaagagcaattttgtcgcttttcttccaccagataaaagcgactttactttggcggacaaccatgtgtttgtgatcagagaccagcgcatctataaatttcacattggcgactatgcaaaagggaatcgtgcgctaacttttgtaaccaattcaaatgatgtccgctttaattatctaatctataaacccaaagaccaaaatgttagccgtggtgtttttgcccatctacgcatgtcggacgcatggatgccgatatcgtacctgttcaatctgctcctaattgtactgtgcacatacatacttaaacagctacggcgagtaaaccgacagagtccgcttaacgtgtccgatagcgccgattattacagcagcccgttcattgacgacgcttattcgccccaacatcaacaattgctgaacataccgtatgaaactgaaacatcgagtgatcaaagtggtggagcccgtagtcggagtatttaaagaacgattttttgttgtttggattcagttggccatttgtttcctacattttaagaaaagctattgtcattttacataattgtcacaatatatttacctgcttattgcatgcaaagggcaatccgttatctgatcgacagttacgggctgagcagtgtagacgatctgtacacctgcttgaaagaagaaattaaaagtgggcctgaaggtgggaattgtctctatcccaacccgctttgtgctgttgactgtgtacacgttgcaaacgctgatcatccgaaccaacctgtgcatattgacgggtcgcttgaattgattgctgacgttgaattgtactcaacatgctatccgaagaggaagttcgaaggaatagtgtggtaagcctactaaacaaaaaatattttttgtcaatatccatttttaaggagcgaacctctgtatgtggagctgaaagatctgaagatttgtccgggcgactcgccgctgtgtctatcgcgccatttcgaactaccgaacagcaacaacaacaacatggacctgatagtcgacgagctggatctatccaactattggagcgacgacgagcgcgaaaacgagactacaacttggtgagagtgctgtgccgattcaataactgtggtccctaccgactcgctaaacagctacagaaacggaggaccgaaaatctcacctatcttaatcggttagacattgaaactgctcatcttaggaaaaatatcaaagttataccggatgctttatgcccaaatggggctaatcaggtgtttgcttatcgcggattcctcggaatcaccgttcaacaacatttgtattctcgccaccgtgtcatgctaaagtacccgggtttaccatgcattgttcaatttggcggtggttaccaccgtgacctatttcccattgaattgttacgagtcgctaatgccgaaatgcatagcgaaatagcttaaatttctatctttttcccaatcacccaattatgtcatgaatacgattgttgcaggataaatttttactcgaataaattgcgctttcagggttaacaataggaaggggctagaatttccctttttctatcaatttttgcggtccagatagaccgttgaggttggttcatccaaatccttctcactattgctggagtccatatcttctttcttaacagcctgggcctgagcagacaaaaactcaacgctgacggtcttggcttcatcacgaccgcgcgtgtccatccattttttggccttctcttccgatcgacgaattcttataagaatgaaccgactattggcacgaagcagattttcttttgaaacatacttttccataatttcttcaacgctatccacgaaaaaatcgacggtgtcttcgtcgctttcctcaccgcctatatccgcttccatttttgaatattttttttcaatgttgtcgagtgcttcagccctgcaacaaaaaaagaattagctatccatgtgaaacccgaaccaagtctgccttgctcgacaagaaagtaacgggagcgggtagcttctttttcgattgcgcacctccttccctgtatttttcttgctaccattgtcgtcgttctttccgctgttgccacctttgtcatctttgccggacatttcttatctgatttctaacgcaaatagataaaactttacgattattgtcaaaatattccgttgaaaatcagacagtaaatttagaacatgacgaataatttgtagtgtatttttattaaaatcacaattatttttattcatatccaaacggaaagacttcatactgctcatttattattcctttttggcacacaggcacatattttttgcgcatctctctcgtgataatgcgactatcacgtgtcggcattattttgttgtagcgaaatactgagggtgcatttccattattgtcgctgtcatcgttatggtgatcgttgttgccgatgttaacattcctgccataggtggccaccttttgctgaaaattctcaaactgcagagctttactattgttcacatcaaatgttatgccacgaatctttaggacgtattcaactgctccagtgctcttgtctttcatacgaaaaccgtattgtttggcaccttgaacatgtttgttttttcataaataaataataggcaaattctataacctccgcagacaaaggttttgatattgtagttgaggtactcctcgctcatttgacctaaatattctccagtctgtattggcgcaacgtcacgcttgtgcaatacaacaacactgtcggtgtcctatgaatttgatgttttttttcaagagccattaaagaaaaaaatgaccgtatatagtagttttgctccttcggtgcgctcaatttgagtcataaagtcgagcaatttaaggcgggcgcggcttgtagtccataaacttaggacgatgttgctggatgagtgttccgtgatgaaatttcttttgtgcttgtaaagaactcttacagccctgtccgataaagggataatagctgttacttcctaaagaaatatattagaaaaaactatatcttgttactgctcacaatcgcatgatctaaaataatgtcgaaaaactcttgtggtctggtaatcactttattcacacccagctcatttctcatgctgaacttgcccctaaagtgaaaataaggctgctacagaaagaataaagtctttaaccaaccataggctattgagcattaactttgcaatgaatctcagtccaggatttttacacacatgccccaggtccaaattgacaccgtatgtccgtctatattcttccgcgtattggtgccgttgttcagcacagaccacaccgtcaggaaaaccgctggcctcaatctgccaaaaacgatgttccgttacgtaaatgtggtcacttaccttaagctttatgagaagtctgacgtagtctttgaatatttcgtcgctcctaaattgaaaaaaaatgtacaattaatcttcccgccggtacgcacccataccattcgtcgtagtgccaggctctccagaatctgtccactctgtagcctgattccaacgcacgttccagttcaatgtgtgtgtagttgccagtaaacgcacgttgctcatctgtgtgtatacatttatgtgttcggcgcgtatttgtctttcggaatgctgttgcacaatggtggcagcagcagaacaggaggcggtcgtcaattttgagtggtaaaacgggtattcgaagcccccgcggagggattacgcggacccgatagattccacgatattgtaattgctcagcccgagtccaatcgacaagcatctcctcagcggtcgggtggattaccgacggaacgccaaccggatagtcggcggaataatttacccatggatatagcgatataatatcgaaaactgatattttttcgtcctctttaggctcggcgatcagctgaagtggcccggttctaccgccataataggcctgtcgtgggtcaatcggtccccgatccgttcccagatcggcaaaaaaatctcgcatttcgtcgtctcttttgagctgttctctgatctggcattcccaaactgcctcaatctctagcctgctgtgcaaatcgcctggaggtccacgtagcttcaataaacgtagatgggtcagctcgttgagctctctgcacgtttttccgtcgaccaacttgtcttcgggtttgaaacagcgttcacatccgtgccagtagcaccccagcacttcgatgcatttattttgctcctcaatccaaccatccaacctaaattgctgccaacgcttttcaagcccgtttccagcgtgctgtattcgtgttccgtctttttttgagcgccagtcaaggtattttatggcaaaaacactggcacgatcgtttctctcataaccacattcgggtacgatggctagctgattttccttcaaaaattgtcctttgaagatggtcatgcagacactgaacagagagtgacagttaacagccttcgtttcctcgttgttcctcatctgttaactgaacctggcaattgtagcgctgagaggtaacacatcaaatcctccggtaacctcgtccatcaatattcgccgaaattcgataatcgcggagagcaaaatttctgtgtcgttttggcagtagagacgcaactcctgcgtcagcgaaaatggagtgtttttgttttcttcgtacctgctcgttttgttattagagtttcgaatcatctcctcactcattctacataccattttataaacttatcatatttgtcttgcctcattgaccctgggtaatagtcgttcattggcggcagatgttgcaaatttacattataattttcactaaatttcacagaaatcgttaacttttaccatagtttttaatgctaactgccgattgaatgcgtatggaaaaaacggcttgtccgcacaatccaaactgaacgtttttggcaaatcctcgagtcggattggcataagaagacaagaatcccgccatgtgagcagtgaatgacgtctcgaatgttggaggcggaattcaaaaattttaagcccgttcattacaacatccgggcggcgtttagtttcgcccaaatactttaacacaaagtggccgtcaaatcgtgatgcgttgtgcgcctgatttcaaaaacacgtgtagataagaaaggtttggcgtgttaaatgggtttaacccacccaaatataagttttaaatttgttagtccatgcgcgcataatccattctacaaactctgagattggctcgtgtccttcagcttcgctcctattaatagacgatgaacctttacataatgtatgggcagaaattttaacaacgcactgaccaattttttagccgatccaacgttccatacacggtcgtgcaaatttggcaattggtccgagcccgattcgcagaatcacaacattctgtgcatgttatcctcgcagaaagataattcactttgtgacgctgatgaccggctatttcaaggggttcgagtctggtctccgtgtcccagcatattatgcgatactgctgcttctcttttggcaccataatcttcttaatgaaacaaccggcatccttctcatggtacacctacgaccatttattatttacgttagccagatattgacgaaaaataccctgcatcgtgtacaaaaagaagtgtagcatttatgagggcgtttaggatcctgttggaaggtacggctacatctgggacaacgcttaagcaaattgcaggtctgactgcgtcggtggccatcaaagcacgtttgggagaagaaaaagcgattacattgctgacagtgaagacataccccttgctctctattgcatggatattggggtccaacttaagcaaaaataagaaataataaagctataaaaattatttggaaactacctttagcacattgtggacagcgacttttgcacgatattgtgtgtttagtgtcacggttgtaggcacattcgcagtccagacaatattttcggcctaatttgaagaagcagtgtatctttttgatgccaaaatagtgtccttcggacacaaaaagcgacacatagatgcggcgtcccatagggcccttccaaatcgggcgaggcagttcctcggaatggtcttcgaacagaacaatccggtacaaaccagcgtaggtttggtcctgtttttcgtattaaagaataagctgattttgctaatagcattcacccaaaattgttgaatttgcacgaggtgctccatcccatatgcatcttcgtctgtcggaatccctgcagtatgcatcagctccgccacggcagttttcatccgttctcggtttgacacaagtcggttcaacgcctcgtaaccagcacaaaagtccggcctcgtcatcactcgtcgaacgatttcagctggcacggcaccctgcgggccaccatcctcttccgcctcagccgcccgtcgcgaagacaacttcaaaaactcttggtctgtgtatgcacgagtggcaatcaacgcatggaatagacaataattgtcatccatatgcataatgcgaatcatctgccggtcatcatagccccaatgttggtattggtggaaacgtggcgcagcgccaaccggaggcgcgatgcacgtgacaataatttcaatcggttcgctgagcaacagtgagcgtttgcttatccctccaccgtgcacgtcctcatcaccgtccgactggccaagcttgtctagttcagccatcaaaacttctgctgtgttttgctccggcgggcggattggcagcacaatcggatcactcagacctgttgggcagagaaaaatcagccgccaacataaaggaaacaagtgttccctcctcccggtcaatcccacctctcccattcaacaatatgccaagtctggtgacttgacgcttgcgacgactgtcgctcaaatctccccttgctccacttccggtttgctgtttggggtcctccgcatttcggatcgcacgctcaatgatgtgtttaaaagtgcgctggagctcctcttccggctcatcgtgctgcccgttgagcaaaaattcggtcacgtgacgttgcatagcgaatcgttccactcgatgcacataatagtgtctctgttcaaacaacggcggtgatttcggcctgttctctccagtcgctgcatccatatcaaagtgggacattgtcttgaaatcccaactttgccgtctcggtcgtttgaccatgcattcttcgtctccgccacgatgatcggtcaatgctgaagccttcacagtgtctgcttctacccttttcatcgtgtgttttgcaggtatattttcttaataacttcgcccaaaatagagcaaggattggtgcaaaatataattcaaaatagatttttcgtttcgataactaaatcggttcaatgtgaccattattcaaaggaaaattttattcataacaatctttttgcaagcgacctatcatttttccgcctttgacatagtccagccctcttcgcaaggcggcagaccgctcaattctttttggcccgcttcttcggtggaccgcctcctgatggagcaaatgcattgtcactactatcaagcgcaattatttccccgtcttcagctccgtctccatctccaaattgcccgttattagtcaccgttggctcctccatctgcattttttcaccttcaattagggccgaaatgacccagtctagcaatccatgctctccttttgcctaaaacgaggcgagaagtcgaatacagttagtatcaaacgatggaaaaatggtgccgaccttaagagtcagcttgacgcagactatttggccaattttcgactcaagcatcgcctccaccttctcaggtcgctgctcaaccatgtcggcaaattggtctaccttcatatccaggtaactctcagcaaccgaagcgaacatggtcgcatgttggctaatttccatgtctccgcaatcgtgcaattccagacgcatatacagaccgcggagcggtctgttggcgcgatgcatgcatattccgcagaagctgtcgtcgtcgagcttctttttacacagcatgcctctatttttaagggggcacgcctaaaacgttgatttttaagagaaacatacaacggcagatacttaaagcatttaataccttatacaaagagaattgcaagtccgtgactttggcatttgcgtaaaaaactccaggggcattgaagttttttagatctcgcaaatgtttaagaacggtaggaaattcctcagaaacgcgcttcttcggtgaagcggcaatttcgaaacgtttcaggcaattcattttatgggtaatgtgctaaaaccagttataaaaattttatataaatttaaatatagcttgattagcttaacaaataaaaataaaaatgctaattaaaatattttttatactgatcaaaatgaaatatcggtgaaataaatgctatatatataacagtttgaagtgcctcatatccttaattaaaaattattaattttcattacggaaattcattacctaaatatcggcggctaaaaccatgagcagaaaatcttcaaaatcttaaaataagctatattataaaatgcacttactgataaaattttacggatattaatgcggcctgtggcacaaacatcgacagtacgaaatgaaggcataagccgctgaagcataatgcacatatgcataaagtcgtcaaacaataaacaacatgaaaaggtgacgaagtcaaaaatactcaagaaaaatctaccggtacgcgtccgatcgaatcggcgcagaagaatttgaaaaaatggcgtagtaaaattgaagcctgaaaagtacaataattttttttaaataaaaaataccgtattgggctaatgcattttgaagctgccgcatagacaaaaagccaaggttctcgctcaatttgacgaaatcatatttccaatcgtttacatgctgtaaattcagtaaacaacaataaattcatcatttcctacattccaaagcgccttaaaatcttcatagccgacatatccatttcttaaagtgtcaaattggactactaaaagacggcatgtgtcgagattaaacggccgcgatgtcccatttgttagagcgcgctgcaatttaacggctgttaactgtccagaaccgtcgttgtctattttgttgaatttttgctctataaggagcgaggctgtggattttctatccattttagacaatataatctaaagtttccaaattattccgaggttttatttctcgaaattagaaggttataagcaaattaaaggctggcatttagatttagaaaaatatgagataactacacatataatcaggtttgattttaaatgagcataaaaaaaggtttgatttgataatttaaccatcagtaaattttggtaaaaatatttaaacgatgaaattaatgcgaataaaaacaaaaaaatttcaataaaattttagtggtttatggttatctcgggttgaaaaataaatgcaaaccctatggagctatgcgcgaatgttttgggaacaaatacacgaggcacaaacgcatacacaccatatataaatcgtttatttcactttacagaagtttatatgtgcataaaaattccataagctataattattttcagagaacactaaaattaaacaaatcccgcgaaaatgtgaaaaataaagttatatgagttcaaaaaaaagccaatttcaagtgctcaaaacgaaaattattagcaacgtactaaaggttttaaaaagtaataaaaataaacaaaataaaatcaacagttaaatttaattttacaattttatcaatttgataagaaaaagacaaataatagcttggattttaattgtcatgttaaatgacgaaataattgctagaactcgaaaaattagtgagagttatatttatctttaatttcaacatgctgccggtgccggtgacagggaaaaaaaattgaaattttatggcccttttggcaagtattcgatttttaaaaagagttttggagtacagcgcaggattatggaaaaattttaaaatagttgataaaaaaaaagtttaataaaccaaaatagctggcaataagcaaaaactccaaaagctgataaaaaagaccaaaaaaaaaacttttgaagaaactgattatatatgttatctgtaaattagtttaaaacaaaaaaaaattgaccttggaaaataacgggttaacgggtcatatcctacaatatcattgacacgagtgagagttatgtttttctttgtatttcagcatgctgctgataccggtgacagaaaaaaatgaaattttatggcccttttggcaagtattcgtttattaaaacagttttggagtacaacgcgggattatggcaaaattttaaaatagttgataaaaaaaagttaataaaccaaaatagctggcaatagacaaaactccaaaagctgataaaaaagaccaaaaaaaaaaaacttttgaagaaactgattatatgtgttatctgtaaattagtttaaaacaaaaaaattgaccttggaaaataacgggttaacgggtaattagtagggcatccaaaaatatgcacataaaatcgcaaaatatgcgcataaaatatgcatcaaaaatggcaaaatatgcacataaaaagtgaaaaatatgcacataaatttttccaaattgagggtataatttttcaaaatttctttaaattcgctaaacgcaaagtaaaatttcataaatggttaaatatggcattaaaaacatgatacagcttaaaaattactcattttagcgaaaaatcaacctgaaaagcgaaattttcgcttttttgcttatttctgacataaattaacgaatttttaagaaaattgaatttaatcaatatttttgacaaaattttgataaaaaaatgtctttttcggaaattttttcggtctttaggggtcaaaaagtccaatttacctgatgggggccgttttaataggggttttttgaaaaaatgccaaatatgcacataaaatatgcacaaaatgccaaaatatgcaaatatgcacataaatcgcgaaatatgcacaaatatgcatatgaaaagtcatcctagaagcttcaaatcaagctaaaaacatgtttttcgtgcgtttcaggcctcccacagtccaggaaaaaaatatgcatgtgcatatttttggatgccctagtaattagatatggatttgtgtactccatgtggagtcaatttttataagattttggtaaaaaaaaggttaagctcaaactgaatggctaaattgcgataaaggataacggttttgccaagtggcataaagttttggataaggatttaccgatttaatgggacataaaagcattttttattaggctgtataaagaaaaatgccgatagctaataaaatcaccaaccaactctctggccaatcactgacgagtgcaggccgctatctctctgagtgttttctgcgccgtagaaatggatgttgtagttggagtttacaattaaacgaaagcttaatgaatgctaactgccttctgtgagcatcttttatactcattcatagcataaaaagttggtctttggccatgtctagacaaataacctgttaaagtaaaacatgatcaaaaatgcttctgtgtgtataatttttttgggtaggccatatgctcattaaatcagattattttaactaatgtttgcctagggaattaaatttggtcctccaagtgtctggcgtttgacatttatctcagtgattaattgccggctgacggcgaataaagaagcttagcgctaaacattttttatctccggtgaccatcttgcgcttcatcggctggtcatgtgcagttcacccgttccattccactccgacgactatttcaccggttggtcatgtgcaatgcagccgttcggttccgctccggcgaccatcttgcgcttcatcggctcgcgcatgtgcaaccgttccgttgaacgttaatcctccgaaaaaagcagacaagcagacactttgataggctatttaaatgagatttcttctgatgatcataagcatttgtaatgaatcggagagggcgttcagtgccaccaaagggcgtaaatagcgaaagtaattgtgcaaactgcccattggaccatgcgttccgtttctttcaacgtttgcacgatgcccgcggcggaaaacgtttagtgtcaacccctccggcatttatttttcaagaccgaagactcccgcctttatgtatgccaatttagaaatttccacacgccccatttaattaagtgccaaaaatatattccgaaatgccgtctgattcgactgacaattccaccaaccgcggagcaaaacggagcgcggacgcggtcaagcgctcgatggacctggaaaaattgaaggacgacaaacggaagcgtcgtcagcatagacatgaagaaggcatcagaaggcaaaaagcactgctcctgctccaatccgagtttcggacggcgcgtgaggctgtccagagcgggcatttcaaattagtgtgcacacccaattcaatcaatttgaccgtcccgacgcttgtgagttgccttttttagtttttgagggggttgtggccaaatccttccgatacatccattcataaaatgacatttttccttgtttgccagagacgttcgcctttttttatggccataaagcaagaagcggtgcaatccataacgccaactgacccccgttctgctgctcccgcccctttaagtcacactgtgccggtttctactagttgtcagtgcttttgttttgaaatggcatgtcgtgaccgtccttgttgattttcagctattgctcccgttccgttggcctcagttgtagtctccacatgccctcccccgccggtgccaccgaaacttcaatctgttgctcattctggaccgttgactcgaactgctgctggttcgtcaaaaatgcactcgaaaaacaaggcgcaaaaaaaaccctattcatccgatgatagcacgtggagcgatggatccgagggaccatcggaaccaaagagaaggatgataatttgctcggatgatgatgaaaaaatggaggggtaaaattaggccgcaaatgaattttgaattgaaaaatggttgtgacacaattcatttttgaatttgttgctcgcgtttttagatgttctttgtgttattgttgctttttaagtttaaatacataactctttacctttaagtggtggctttaaattaattaataatgacccgatactcttctgattttaatttaattatttttaaattaattcgtagttgcacaatgctcctatcttaagtacatatcgcagacattttcccctcgttcagatttccacgtgagtaccccctcccctgtcggcgcaaattgaattccttcgccgttcactgagtagtcgcatttttaacacccccagtgtaggtcaataattttgtttgccgttattttgttcagattatcattatatttttaacagttagccgtctgatataagcgaatacatggctaaacggtattgagacaggtttaaaagcgctcataatagttcgaatccgcctgcaaagaaaaatatttattagcattaaaattaagttgaagacattgaccaaaaaaatatgaaactaaagtgtttgagtaagccttataactcaagtttctggcaaaaatcgaaaatggttgaaagggtgtgattggttttgtgacgggttaatgtatttggattaatagagtttgtttgtatagtgggcaaaatctttttcggatagctgacccgttggtcgaatgccattgctttggattcggctctagggttctaatcccaatgcctgtgtgcgaattaattaggccctatctagggcatggatttgaacaacggtccttgggacctaaatcctgggtaataatgggtgtttttttaagcagggg

SEQ ID NO: 39 - DNA, 16472 bp, Heterodera glycines
tattaactttttactgttattctgtatttttctattcctccacggaactataatatttccctttgattaaattttttcctttatgctatattttcgtataaatgtttttccttcatacaaagaactgactggaaattctaatacaattataggtagagcatgaagcaggacgatatcgcgcgcgagaatttacgatttaaattaaattattggttttaattcaatagaataaatgtgcgtataactttataaaacattaaaactattaagattaaattaaattaaatttttatatttttccgtttgaaatttttctcccaagaaaagtttattgccatctgccgcattcaaaacatttttatttctctttaaattcagatttgtttttgtataatgagcctgttgggcgtatcaattttgttgcaattttgctatttgcactataaatgtttttttgctaaatgaagtactgaattaaaattctaatacaattaaaggtagatcaataagcagaactggatcccgcgagagttttgcggtaaccaggccacaattataaatttcccgggattaatcccgctggatcccgtctggtaacattttgagtctcaatcccgcagaaggacacgcaaatttgctttttgtgcgtgaacccagcgggaccagtattgaatttttttttgttgagaaattcaaaggacattatgccaaatattttctattacaataaatcaaaattttgataaatgttaatattgaattatagaaataaatttatcataataattagggatgtcaaaaatatgtacaaaagatggtcaaaatatgtacataatatgtaaaaaaaatcccgaaatatgtaagaaaaacccaaaatatgtaccaaatatgtaaataaaatttttaaaatggttatttttttggaaaaaaaattcttcggaaagggtgaaataggcacaaaatgccatcccgaaatatgtaaaatatgtataaaaccccgaaatatgtaaataaaagtccaaacttttgtttgcaaacacaaaaaagaaaatgtttttcctactaattagagcatgtagaatccaggaaaaaaaatatgtatttacataaaattgacatccctaataataatatttctaaacgatggtcgaaaataaataaatatgccaacttccattctttaaattcataatcattatcaataaatttatttttaacaatattttatttaaaagtgtcttgtttcttttacattttttattattttaatgtaaacatgtaatttgtagtgtatacaaaaattttaggcataattttaatttcgtttatagatttttttaggattaaataaattattatgccttgttgtgaaaaaattttaaaaaataagctcgaaaatttcaagagaatgtaattaaattaaaaatgaattttattttaataccttttctgaaacatttcagataaaaaaatagaataaaaaataaagcaaataaattttatttctattaattttttttagtgtttttgacgttggaggccaaaggtcagaacggcgaaaatggattcacttttttgacgatgtaaatgcaattatttttgttgctgccatcaatgaatatgatcaaaaactgcgtgaagacaataaaacggtaattttaaaccaattaaatctaatcaaaataattaattttttcttaatttaagaatcgactcattgaagcgatgggtaattaataaatttatttgtcttaaaaattctaaaaatgattttttttccccagaactttttgacggaattgcaaacagcaaattttttaccaagtcatcaatgattctgttcatgaacaaaaaggatttatttgaagaaaaaattaaacgagtttcgctgaacattctttttccatcttataaaggtaaaaaaatttaataaaaaattatttaattaaaaagcaatatttttctaattaattaaaagttttttttgcgaacataagatggacttttgtttacatatttttacatattccctgatttttttatatacaatattttgaattttttctcattttttttttctgtaaatattttgcatttttgaggatttttaagtataatttttcctgttttctctagagaattttggaaatttcggaattccggaactccggcgaaaagttaaattccgagaaagtataaaatttttaaaatgcataaatttctaataaaaactttcttgaccctaaatttggaagtttatagaaacagaaatttttgcttgatgaaaatttttgaaaatataaattttttaaggagacctcacgtatgaggacggtgttgcatatttacgtgtcaaattccgcaagttgtacagaaataaacggagtttgtacatccacgagacattcgccactgacaccaaccaaatcaacacggttttccgatcagtgcttgacacgatcttacaagaaaatatgcaagacacgggcatgttatgattatgatcagttttggtgttgcattgtatggataaaatttagaaaaaaaatatttaagcctaattaagaacattaatgcctaagccataggatgttatgattatactttgggaattgggttttagtggcgaatttaaaagagcgatttttcgtaataaatttataattttgaccgcttttaaaattttttcgtttttgtcgatattctataagttattttttataaattcgcaacttaccaacataatatagatagaaatctaataattaataaggggtttattttttctacaattaaatttacatattcattcaacaactgtttggcatatgccccacccccgcatatgccaacaattgtttggcgtatgaaaaagcccccgcatatgccaacaattgtttggcatacgtcaaagcccccatttataataaaattatagaaaagatattatgtggtgccaacaaaatgtatgacatttgacacatatcattttcccctttttctctgccatactcttcatttaacatactgtctattctacattgtcttcgtatcttttccgctatcctttatacaaatactattttaatacctaccccatattctcatatgaatttccatattagaacagattgtgaatatgaaaaaattattattatttattgtaggggaatagtgactgagaacccattactaatgaaattttcatttttccattatttatcaaaaagtaggcctcgggttcccagtcaatttttttgtataaagattaaaaaattttttatagaaaatggtaaatatttcaataaatattggttctatttttctctttgcttttgccacaagcttatgtggaggcaagccaaatgatgacaaaaatgctgcctccagctcaagtgtgccaagcgaaacggaaaatcccaaaaacgaagagtcgaaaaagaatttggtgataattacggacatgggggcggatgatcaatttacactggagatgatcagcgcaacagaattggccggtaaagtgttggcaattgggacgacggagaaaggaagaaaagcggcattgtcacaatcactgggatttgagaaagtgccagtgtatgtgagaagcagtggcgaggaatacgagaaaatgctttttatgaatcccaatcagagtaggttcagtttgcaagttgaaacgtatgtcggcattttaccctgaaaatttttgttttagaggatacaaaaagagaggaaaacgaatttcaacattttttgaaaaatttgctggatgaaagattgaaaactaatgcgatgaaggttcattttttggtgctggcacctccgatcgatttaagtgcagtattgttggagaatagacaattggcaaaagcagttggacaaatacatattacggatggatgtaaaaattgtcaggaattgcaaccgccgacaccgcttagcctgaacaattttttgaggcaattaccaagggaacacaccaagccaacaacctacaatgttagcatggacgcattggcaactgtgtaccttttggaaatggccgccaatggagaagttaatgtcctactagtttcttcaagtttacttgctgaaaagttcggtgatggagtcgaatttggaaaaaaatttccaaatctgaaattgacaagaaaaaagaaaacattgggctttaaaattattgtagaacgagaaaaaaaatgtcaacaaaaaccacacattgacgagcaattcagtgctgccggtccaatagctgtgcttgcaattatggatatgacaaatgtaagggtggatggagtgcccgaatctgacaattttgtcctgtttacaactcaatcaaaaaaagtgagcttgatcaccccaaaaagtggagagcaaaagccagaacatggtgaataccaagtggaaattgggattaaaaaagcaacaaaaattagattgcttgtcaattttaatgttgacacatttggcaacgcaatgacattgattcttgagaaaatcaacaagcaacgccaagaggcgaaaaggaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaggtgccagtgtatgtgagaagcagtaatgaagaactagagaaaatggtttttatgaatcccaatcagagtaggttcagtttgcaagttgaaacgtatgtcggcattttaccctgaaaatttttgttttagaggatacaaaaagagaggaaaacgaatttcaacattttttgaaaaatttgttggatgaaagattgaaatttatgggcgtaaaggttaattttttggtactggcacctccgactgatttaactgcagtactattgaggaataaaaaattggcagaagcggttggggaaatactcatcacgggcgaatgtaaaaattgccaagatttacaaccgccggcaccgcttagcctgaacaaatttttgtgggaattaccaagggaacacaccaagccaacaacctacaatgttagcatggacgcattggcatctctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgaccagcaattcagtgctgccggtccaatagctgtgcttgcaattatggatatgacaaatgtaagggtggatcgagtgcccgaatctgacaatttcgtcctgtttacaactcgatcaaaaaaagtgagcttgatcaccccaaaaagtggagagcaaaagccagaacatggtgaataccaagtggaaatagggattaaacaagcaacaaaaattagattgcttgtcaattttaatgttgatacatttggaaacgcaatgacattgattcttgataaaagcaacaaacaatggaattacaaaatttcgtccgaaaaacaaaaggtataggacaaattagaaaaaaattgttctctaaatatgactcatattattcaataaccaatttaattatcctaattaggggaaagagaaaaaccaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaagtgccagtgtatgtgagaagcagtaatgaagaactagagaaaatgttttttatgaatcccaatcagagtaggttcagtttgcaagttgaaacgtatgtcggcattttaccctgaaaaatttttaattttagagaatcaaaaaagagaggaaaatgaatttcaaaattttttgcaaaatttgttggatgaaagattgaaatttatgggcgtaaaggttaattttttggtactggcacctccgactgatttaactgcagtactattggagaataaaaaattggcagaagcagttggtgaaatactcatcacgggcgaatgtaaaaattgccaagatttacaaccgccggcaccgcttagcgtgaacaaatttttgtgggaattaccaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgaccagcaattcagtgctgccggtccaatagctgtgcttgcaattatggatatgacaaatgtaagggtggatcgagtgcccgaatctgacaatttcgtcctgtttacaactcgatcaaaaaaagtgagcttgatcaccccaaaaagtggagaggaaaagccaaagcatggtggataccaagtggaaatagggattaaacaagcaacaaaaattagattgcttgtcaattttaatgttgatacatttggaaacgcaatgacattgattcttgataaaagcaacaaacaatggaattacaaaatttcgtccgaaaaacaaaaggtataggacaaattagaaaaaaattgttctctaaatatgactcatattattcaataaccaatttaattatcctaattaggggaaagagaaaaagcaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgttggccattgggacgtcggagcaaggaaaagaagcagcattggcacaatcactgggatttgagaaagtgccagtgtatgtgagaagcagtaatgaagaactagagaaaatgttttttatgaatcccaatcagagtaggttcagtttgcaagttgaaacgtatgtcggcattttaccctgaaaaatttttaattttagagaatcaaaaaagagaggaaaatgaatttcaaaattttttgcaaaatttgttggatgaaagattgaaatttatgggcgtaaaggttaattttttggtactggcacctccgactgatttaactgcagtactattgaagaataaaaaattggcagaagcggttggggaaatactcatcacgggcgaatgtaaaaattgccaagatttacaaccgccggcaccgcttagcctgaacaaatttttgtgggaattaccaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgacgagcaattcagtgctgccggtccaatagctgtgcttgcaattatggatatgacaaatgtaagggtggatggagtgaccgaatctgacaatttcgtcctgtttacaactcgatcaaaaaaagtgagcttgatcaccccaaaaagtggagaggaaaagccaaatcatggtggataccaagtggaaatagggattaaacaagcaacaaaaattagattgcttgtcaattttaatgttgatacatttggaaacgcaatgacatttattcttgataaaagcaacaaacaatggaattacaaaatttcgtccgaaaaacaaaaggtataggacaaattagaaaaaaattgttctcagatatgactcatattattcaataaccaatttaattatcctaattaggggaaagagaaaaaccaagatccaaatgatgagaaaaatactgcctccagctcaagtgtgccaagcgaaaaggaaaatcccaaaaacgaagaggcgaaaaagaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaagtgccagtgtatgtgagaagaagtaatgaagaactagagaaaatgttttttatgaatcccaatcatagtaggttcagtttgcaagttgaaacgtatgtcggcattttaccctgaaaatttttaattttagagaatcaaaaaagagaggaaaatgaatttcaaaattttttgcaaaatttgttggatgaaagattgaaatttatgggcgtaaaggttaattttttggtactggcacctccgactgatttaactgcagtactattggagaataaaaaattggcagaagcagttggtgaaatactcatcacgggcgaatgtaaaaattgccaagatttacaaccgccggcaccgcttagcctgaacaaatttttgtgggaattaccaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctgaggataattttgacaaaagatttccaaaactgaaattgataagcaaaaagacaatgggtgctaaaattattgtaaatcgagaagaagaatttgaacaaaagccacacattgacgagcaattcagtgctgccggtccaatagctgtgcttgcaattatggatatgacaaatgtaagggtggatggagtgaccgaatctgacaatttcgtcctgtttacaactcgatcaaaaaaagtgagcttgatcaccccaaaaagtggagaggaaaagccaaagcatggtggataccaagtggaaatagggattaaacaagcaacaaaaattagattgcttgtcaattttaatgttgatacatttggaaacgcaatgacattgattcttgataaaagcaacaaacaatggaattacaaaatttcgtccgaaaaacaaaaggtataggacaaattagaaaaaaattgttctctaaatatgactcatattattcaataaccaatttaattatcctaattaggggaaagagaaaaaccaagatccaaatgatgagaaaaatactgcctttcaaatatttggaaaagcaatgacctttatgcttgacaaaattaacaaacaacgcaatgataaaaattatcggtgcccttgaaatgaaaatttgacgtaaaatgattaagcatgcatttcttcatcccttttttcgcggtgaatcaaccaaagttacagtatttggggcctgattaactatttatattattttccattttgatcggggttggtttcactatgttttactgtattttcctatttattaactttttactgttattctgtatttttctattcttaaatcataactataatatttccctttaattaaattttttttcgttatgctatattttcgtataaatgtttttccttcatacaaagaactgactggaaattctaatacaattataggtagagcatgaagcagaacgatatcccgcacgagaatttacgatttaaattaaattattgggtttaattcaatagaataaatgtgcgtataactttataaaacattaaaactattaagattaaattaaattaaatttttatatttttccgtttgaaatttttctcccaagaaaagtttagtgccatctgccgcattcaaaacatttttattttcctcaaagcatcgattttatttaaaaaacatatttattattatttttttagaaaaataattaatttaaccaatttcaaagattggctgagtattttttaattcagcttcttcattgtgcacaggtgaagcgatagtgcctgtgaataaaaattattcttttattttttaatcagaaaatattaatacttttttatatttaataattaccaaatttgcaaatgccagtcaaagcaaatatcaccagaaaaacggtgatgttgctgttgtagaagttcatttttttaatttgttaaaaatttaaaatatgaatatttaataaataattaaataataatttgtgttttttccatgattttttggcattttttatatgccaaatggtaggcttaatgtttgccataatttccggcttctatcatttgaacaatgttatgatgatgacattgcaaaggatgtccgggaatacaatttcatgtgaatatttttgttttttaattatttttattaatttgattaataccaataaaaaaatttcgcatattaaataataataatgttttgatgaaagtgacagtaaaatgagtaaattttcttaataataaatatgattataatatctaattttttttgtcaaaaacgatttattaaaaataattaaattttgcgttaccattattaaacaaaattttttccagcttttttggttcttcaaattacaaataacatacggcaaatatttgaatttttgctttaaattctttccatcccttcgcggaatgttttccattttgcataaatgcattttttattttaaaatatttttcaacaatttttcttttatttatcataaattttttgaatgtatactgaattttctcactttttaattgtttcttccatctttgaatgcttttcaaacttatgaccaaatgttttgctattattttccaactttttttcaccttttccctccaattttttaatttattcatatataaactatttaaatttaatgcattattaggttataaggtttgtgtatttttttagtgcatataaatgcttataatttgcaatatttacgttttaaaaatatattcggtatttttttggcgataaatgcctacaaattaaaaaacacacacttaacaattaactttaattatataatatttttgtaataattcgccaaattttaaatgattaaagatggtcctgaaatttgagaccacttattctgaattttatttttaataatatttacttgattttaaggcaaattttaccactgaaatttagttgattttaaatgtttattttcaaatattaatagtgtaagaattatagtaaatcaattttttaaaattattttttaaatgactttttaatttttcagaatggggctgaaattttgtcagtgaaatacctaaaaattcatgctaataacttaagaaatgcaattaattacatatttatggatgttataaaatcagaaagattatcacaattaggttaatatagtcaacggcgcacctctaataggttcgccactgacaccaaccaaatgaagtttttcttttttctcatttttttatactttgggaattgggtttttagtggcgaatttaaaagagcgatttttcgtaataaatttataattttgaccgcttttaaaattttttcgtttttgtcgatattctataagttattttttataaattcgcaacttaccaacataatatagatagaaatctattaattaataaggggttttattttctataattaaatttacatattcattcaacaactgtttggcatataccccacccccgcatatgccaaacagttgtttgtcatacgtcaaagcccccatttatgaataaaattatagaaaagatattatgtggtgccaacaaaatgtatggcatttgacacatatcattttcccctttttctctgccataatcttcatttaacatactgtctattctacattgtcttcgtatcttttccgctatcctttatacaaatactattttcatacctaccccatattctcatatgactttccatattagaacagattgtgaatatgaaaaaattattattatttattgttaggggaatagtgactgagaacccattactaatgaaattttcatttttccattatttatcaaaaagtagcctcgggttcccagtcaatttttttgtataaagattaaaaaattttttatagaaaatggtaaatatttcaataaatattggttctatttttctctttgcttttgccacaagcttatgtggaggcaagccaaattatgacaaaaatgctgcctccagctcaagtgtgccaagcgaaacggaaaatcccaaaaacgaagaggcgaaaaagaatttggtgataattacggacatgggggcggatgatcaatttacactggagatgatcagcgcaacagaattggccggtaaagtgttggcaattgggacgacggagaaaggaagaaaagcggcattgtcacaatcactgggatttgagaaagtgccagtgtatgtgagaagcagtggcgaggaattcgagaaaatgctttttatgaatcccaatcagagtaggttcagtttgcaagttgaaacgtatgtcggcattttaccctgaaaatttttgttttagaggatacaaaaagagaggaaaacgaatttcaacattttttgaaaaatttgctgaatgaaagatttaaaactaatgcgatgaaggttcattttttggtgctggcacctccgatcgatttaagtgcagtattattggagaatagacaattagcaaaagcagttggacaaatacatattacggacggatgtaaaaattgccaggaattgcaaccgccgacaccgcttagcctgaacaattttttgagggaattaccaagggaacacaccaagccagcaacctacaatgttagcatggacgcattggcaactgtgtaccttttggaaatggccgccaatggagaagttaatgtcctactagtttcttcaagtttacttgctgaaaagttcggtgatggagtcgaatttggaaaaaaatttccaaatctgaaattgacaagaaaaaagaaaacattgggctttaaaattattgtagaacgagaaaaaaaatgtcaacaaaaaccacacattgacgagcaattcagtgctgccggtccaatagctgtgcttgcaattatggatatgacaaatgtaagggtggatggagtgcccgaatctgacaattttgtcctgtttacaactcaatcaaaaaaagtgagcttgatcaccccaaaaagtggagagcaaaagccagaacatggtgaataccaagtggaaattgggattaaaaaagcaacaaaaattagattgcttgtcaattttaatgttgacacatttggcaacgcaatgacattgattcttgagaaaatcaacaaacaacgccaagaggcgaaaaggaatttggtgataattacggacatgggggtggatgatcaagttgcactggcgatgatcagcgcaacagaattggccggtaatgtgttggccattgggacgacggagcaaggaaaagaagcagcattggcacaatcactgggatttgagaaggtgccagtgtatgtgagaagcagtaatgaagaactcgagaaaatggtttttatgaatcccaatcagagtaggttcagtttgcaagttgaaacgtatttcggcattttaccctgaaaatttttgttttagaggatacaaaaagagagaaaaacgaatttcaacattttttgaaaaatttgttggatgaaagattgaaatttatgggcgtaaaggttaattttttggtactggcacctccgactgatttaactgcagtactattgaggaataaaaaattggcagaagcagttggtgaaatactcatcacgggcgaatgtaaaaattgccaagatttacaaccgccggcaccgcttagcgtgaacaaatttttgtgggaattatcaagggaacacaccaagccaacaacctacaatgttagcatggacgcattggcaactctgtatcttttcgaaatggcctcaaatggtgaagtgaatgtcctactagtttcttcacgtttacttgctgaaaagttcggtgctggggataattttgacaaaagatttccaaaactgaaattgataagcaaaaagacaatgggtgctaaaattattgtaaatcgagaagaagaatttgaacaaaagccacacattgacgagcaattcagtgctgccagtccaatagctgtgcttgcaattatggatatgacaaatgtaagggtggatggagtgaccgaatctgacaatttcgtcctgtttacaactcgatcaaaaaaagtgagcttgatcaccccaaaaagtggagaggaaaagccaaagcatggtggataacaagtggaaatagggattaaacaagcaacaaaaattagattgcttgtcaattttaatgttgacacatttggcaacgcaatgacattgattcttgataaaagcaacaaacaatggaattacaaaatttcgtccgaaaaacaaaaggtataggacaaattagaaaaaaattgttctctagatatgactcatattattcaataaccaatttaattatcttaattaggggaaagagaaaaaccaagatccaaatgatgagaaaaatactgcctttcaaatatttggaaaagcaatgacctttatgcttgacaaaattaacaaacaacgcaatgataaaaattatcggtgcccttgaaatgaaaatttgacgtaaaatgattaagcatgcatttcttcatcccttttttcgcggtgaatcaaccaaagttacaatatttggggcctgattaactatttatattattttccattttgatcggggttggtttcactatgttttactgtattttcctatttattaactttttactgttattctgtatttttctattcttaaatcataactataatatttccctttaattaaattttttttcgttatgctatattttcgtataaatgtttttccttcatacaaagaactgactggaaattctaatacaattataggtagagcatgaagcagaacgatatcccgcgcgagaatttacgatttaaattaaattattgggtttaattcaatagaataaatgtgcgtataactttataaaacattaaaactattaagattaaattaaattaaatttttatatttttccgtttgaaatttttctcccaagaaaagtttagtgccatctgccgcattcaaaacatttttattttcctcaaagcatcgattttatttaaaaaacatatttattattatttttttagaaaaataattaatttaaccaatttcaaagattggctgagtattttttaattcagcttcttcattgtgaacaggtgaagcgatagtgcctgtgaataaaaattattcttttattttttaatcagaaaatattaatacttttttatatttaataattaccaaatttgcaaatgccagtcaaagcaaatatcaccagaaaaacggtgatgttgctgttgtagaagttcatttttttaatttgttaaaaattaaaatatgaatatttaataaataattaaataataatttgtgttttttccatgattttttggcattttttatatgccaaatggtaggcttaatgtttgccataatttccggcttctatcatttgaacaatgttatgatgatgacattgcaaaggatgtccgggaatacaatttcatgtgaatatttttgttttttaattatttttattaatttgattaataccaataaaaaaatttcgcatattaaataataataatgttttgatgaaagtgacagtaaaatgagtaaattttcttaataataaatatgattataatatctaattttttttgtcaaaaacgatttattaaaaataattaaattttgcgttaccattattaaacaaaattttttccagcttttttggttcttcaaattacaaataacatacggcaaatatttgaatttttgctttaaattctttccatcccttcgcggaatgttttccattttgcataaatgcattttttattttaaaatatttttcaacaatttttcttttatttatcataaatttttttgaatgtatactgaattttctcactttttaattgtttcttccatctttgatgcttttcaa

SEQ ID NO: 40 - DNA, 6573 bp, Heterodera glycines
  misc_feature (6)..(6): n is a, c, g, or t
aaatantgaaaaaaataaaaattaaaaatgatattcgaatcgataaaatttatttgttttacgaattaaaatagtttatgttatattttccactttttaatacattattcattaaacattaaataaatatacgaaataaacttacacttaaatattgaaatgtttttagtaaataataaactataatgaaaaaacaatttaaaaataaaaataattgtcgataaaaatgggtgacggagtgacgacgaggaggaaagcgttggcgaggaagaggggatgaggaggaaaggaagacgagaaatgaagaggaagagagtgtgccgagaagggaaatgtgtgagtcgagggggggaggacagtggcggttagagccactaattgaaggtcaccggaggggcagcagatggaagcaaagcgacgggaaagagaaaataagggaccatatcttttttagcccaaaaattaacacattttccgagaaaaaaaaattaaaaattggtatggactaaattataattacttgttaaattggcactcgacttttaatgaatttattacaatgagagggttttgccgggtgaactcacttgctatgtttaattttaccaatttctgggtttagcagaatttttattttatttttaagaatttttggatttcattcaactgaaaaattagcttttttagttttctcaactttccattcctttcgcatttttaacaactttgaatataatatctttaaatttccacatgatcattaactttgtcttccttgtccccgtcattggtcgcctgcttttccccaaactgagctggtactgttcaaatggttttgtaattttggtcaacgagtcaatccacacaaaaaaaagttgaaaaaaaatttaataaagaaaattaattaataataaaatttgagccgccgagttcgatttacaaaagaatattataataaatgcatatttatccgggatgggtcttaaaaaccaggacatgttaatcttttgactatacgacatttgaggattttttaaaaaacaagtaaaaatcaggaattaatcgaaaaatatcggactttttcataaaatttaataattaattaaattaattaaataaaaacctatttacggatttacattttcttttttaaatctttctacggcacagatttctcagcaaatcgttccaattcggcaaaattaagaaatgaaaaacgatttcgaaagaaaaatttacaaattggaaaaaataaatagaattcaatatcgtaaagaattttgagtttttggcacaaaaattttgtaactttatacttatttatctgtgagcgaaaaaggaaattttgaattttctttggctgctgacgacgaaatcatttgcatccaagaaaagtagcagcagaaatacttattgttgttacaaatattagcccgaggataaatttataaataaacacttacaaagaataatttttaaaaattaaaaaagtcaagggttaagactttttatccgatggggttgctgatcacgaatatgacatccatctgaccaatttcgaatcctggacccgaattcgaacaaaagtcgaaaaaattttcaccaaaatccacctttcttgtccaaaatcgattcaaatgcatgaaatggccgtgaatgcctattttctattcaatttagtgcatttgaatcgattttggacaataaaggtggattttggtgaaaattttttttcgacttttgttcgaattttggtccggggttcgaaaattgatcggaattaatgtcatattcgtgatcagcgacaccgaatacgcctggaaaacacgtttttaccagtagaaacaaaaaaatcttctatgtggtccaaactgaactctgaatcccagacccgaattcgaacaaaaaatttaaaatacaaaattttaaaaattctcgcttttgttccttctctcggatttataggtagtttagtttgaacatttgtaggaaaatgccggcgttcaacggcatcccaatacaatcgtttccactgcgattttcgttacgaatttaagatttttgcaacaagcttataaatttggcatcattccaaagctctacatgtttagaagcttttgataaggcatttataagcgattgaacaacttataaaaaagttgcaacatgaatactaccaaaaagtccgaatttttgcatattttaatttataacttttttacatgtcggcatatctttgtgatttttaggaagccgatagagcttgttaagagctttcgaatgataccaactttgttggatttggtcaacaaagaaaaaagttatgatgctctaaacttgctcagacgcaactggcccgttccgagctctaatggggtaaaaaagaaccatgttgatcattacaacaataaataaacaatttttatgagcgcatcgatttcaaatttcataattattaaatcgatcgatcacttctcaacaaatttatcctaaagacataaatattgtataacacaaaacaaataaaagttgatcattacaataatatgggctcaaattcgttctccaactccgcaattcaattagatcgatcagttctcaacaattgattcattcattcacttctgctgatgatcacttgggccgggatttgcgttgagaagcctaaaaatagaaacgcaataaatatgaatttttgaaaaaagcattcgcttacccatctccgatttcgccctcatcattaatccgaatgtcaattatgttccattgctcataaaattgccagtcaatcgcttccttttcccattttgtccatttgctttcatcacgcgcaattggacaacggaccaacagaaaacgattgctgtagtcatcagttcttttcaatgccaattgttcccgagtcaattcattgatcagatcaaagggcacaacgaagtcaggaaaagacgtaggaataaaacacatgacgacaataaaattgacgggggaagaagcattggaaaaagcctaaaatatgggaaaattgattaacgaaataataaaagaaagcaccgttttgaatggttcaatatttgacggccaagtccaagcatccatgtacaaccagcatttgaacacctttggcacattgctttgaagtggagtgaaaagccatttgaccaccgcttgtccatccgatgccgcgacactgtcattgcatggaaattcggcgaagaaaccagtataataggcactgataacgcgaagcgatggacagtcgtcgagaattgacggcacgaatttgcgcaaacggtagaaaacttcgtcggacaattggatggcacaaatatgtttcacgatcattggccaaatgttgtgcaaaatgaactccgaaatgcgatcattgtgcgcataaatgtccaaattaatttgacaggcggcgaaaagttgacgaaaacggtggagaaaagcgatgacattttggtcgatgaaactgaaaatgatgggaagtgttgtctaaatttttcataatcgaaattactagatgctgatgcttttgaatccgatgattttctttggcaattgaatttgcggaattggcaatgattcacaattagaattgacaattgccatttctttggtgccattttctccaattttgcttcgaatttcaataattttcagtgcccattttcgcgtcttgaaatgttcgtccacgtaatagtcaaatcggtggctgatcatcgcaattccaaggccaagttgacgaggcggcaacaaatcgaagacacaaagccaacaatcagcggagatgaagctgaagaaaaagaaacaaaattgaaaattgaaatttaaaatggcattttaattttaatttacattgctttttccattttttcctcggcttcttttcggcggtctgacattttgttgttggcaaattattaagacagttttcggcacttaaatgggctttattttcttcaagattcatataaaaatgaataggtattttcataaaatatcataaaagaattatagtctcattgctatttttcactgtcatttttcgatttaagttttcatttagaaactaaatgttatgcccgaaggaatttaaatttaaaagaattaaaatgaataaagtggggtcatttaagcgatgcgtcatcatcatcagcagaaaagccgacatttgcggacgaattttttgaagttttttttaacaaaaaatttcttaagcatgtcagtccgcaaatgtagcgacacgaatgagaaagaaatcaaaaaagtcaaaaacacgaaattttggtactttcaattagccgccgggctccaaaatttcaaacttttcttaaaaaatggcctaaaaaacgtaagaaagagacgaaaataaacaaatggcaaatggaaaaaataataatgaaaagtggtggaggaagagcaaccatttttatactaatttttacaggatatacagtttaggccccataaatttttttttgttaaaaggcataaaaaacaattttccgtgggtttttggggtcgctgatcacgaatctgacatccattccgaccaatttcaaacccctaacccgaattcgaacaaaggtcgaaaattcaaaattttcacatttctcatttttagactctaaattgataaactgctaataaaatgcaacaatccataaattctacaaagttaaacacgtaatatatataaaataaagtaaagttcaacacaatcaaatacagcaaagtcccaaaatcgacaatatggagatgttagatcaattttcgcatgggtacaattcagcaacttgggaccaaaaatgttgaaaaacggcgtcataatcgccaaaatgcttccgccacaaatgttcagacatgtaccgtatttgctctaattatagcccagtctctattaatttcgcagtctccaattatccccccccctttctgaggagttcgaaaaataatcccccatgggctataattagagcaaatacggtatgtacgtgtcgtacaatgcacgtgaatcaccaaagcgacgcttcgctatattcttcagtttctgccacatactttcgactgattgtgtatgggaccccgtgttaggattgacgaagttttcactgtgattcacagtgtagtgttggtatctattttcgaataatatacgccatcctatccattactctacccctgctggggaaggttaggaatccccccatacgctctccacatgtcactgtggatgacgctgcctggcaagatgtgttcagtaatgagtggaagtaacgtggcagcgtcgcgtcgcataaccggtagtgatgctcgagagtctcggtctcgagtctcgactcgagaaaagtctcgggtttttttggtctcggggttttgggtctcggtctcgagtctcggggtcgagtctcggtctcggggtcgagtctcggtctcgagtctcgggaaatttttggtctcgagcatcactaataaccggcaccataaaacaacgctgcggatttcctcgttcaattccaccgaatatccaaacgtcattaacgacgagccttccacgctcgtattttcttcgaaccgcaagtgtttcatcgatttcgacgaggattcctacgagatgacaaactacaacctgtgtacgatggcgacaaaaaaccttggccgcctatgcgggcagggtggcgaatgaaaaattcgatacaaaccagggatgtgccgagccagacaaaatccgattccgattatggccaaaaatccgatacggttttaaaaccgattacgataatggcccaaaatccgattaattgcgattccgattacgattccgatttttttaaaataattttttcccaaaaattttattcataatcaaaatcataaattttaagattgtgatgcaaaaataaaagtttgtccacattctcaggcaataaacgttttctcagatctgtcacaatcaacccagcggtggagaaaagccgttcgctttcagtcgatgtagctggggctgagaaatatttttttgatagcttagattcggaaacgaaatgtcttctgcacacagaagcccaacaactgttttgttttgcaaaaaacgatcaagcatttggaaggtggatgaccaacgcagctgataggaaaattgcaacttagtaataattcattcatggttcttttctgctttaatgtcccaacaaatttttttcttcaaaatttcgacttttggttcgaattcgggtccgggattcaaaaataggtgaattggctgccatgttcttaaactgataccattaacaacccttcaaagactgacatttttgctaaataacaaaaaactggattatatcggggagaattaatccggcactgctttgtgagaaaaatttaatttcagtcattatgttaaaataagattaaaacattcgtttcagaaaacatttttttcaaaattcattggtattctcgctaaaaaaattccttcaaaggtcaattcttaggggtgtaataatcggatttccaaggcaaaatcccaattacgaatatcccaattccgattatggcccaaaatcc

SEQ ID NO: 41 - DNA, 2458 bp, Heterodera glycines
tacccctgacaaaggaggggtcggcaagtgaccgtgggatttccaaatgaaatttggtgggtggatagatgacgcccaggttctattgtgaaattttgactatttttgccaaatgagcatgagtgccgagatatgacgtgccaaacttttttaatgaacaaacaaattaaataattatttgcaaccagtcgcattgtcaaatggtgtagaggtaatgcgttagtagcagtcgcaccaggttcgaatccgctatatgcaatttttttgttttttttttttttgctttttatgaaaagtcaattctcaaaagattagttttataaaaagactttatttttaattttactttttattttggtacatatgataataaaaaatatttttaattttactttcattttgatatgtacataagataataaaatattttaaaaatacgacaggatatttattgcacctttatgtttaatgtagtaattttttgatttctaatggaaaaaaatttaaaataaaaatatgtttttactaaaaatttttagatagttaactttgcatgaaaatcaaaaataaaaattataaaataatatatacatgcatgggattcgaacctgtgagataaaaaagatttgactaacctactacctacctctacaccaatggcttctttcttggccaaaaagaattatatcttttctaattaaaaaagcgtaaaaactttggcacgtcatatctcggcactcatgctcatttggcaaaaatggttaaaatttcacaatagaaactaggggtgatttttccacacaccaaatttcatttggaaatttcccggggcacctttcgccccctccccttctttttttttttgtattcattcatggttcttttctgctttaatgtcccaacaaatttttttcttcaaaatttcgacttttggttcgaattcgggtccgggattcaaaaataggtgaattggctgccatgttcttaaactgacaccattaacaacccttcaaagactgacatttttgctaaataacaaaaaacttgattatatcggggagaattaatccggcactgctttgtgagaaaaatttaatttcagtcattatgttaaaataagattaaaacattcgtttcagaaaacatttttttcaaaattcattggtattctcgctaaaaaaattccttcaaaggtcaattcttaggggtgtaataatcggatttcaaggcaaaatccgattacgattatccgattccgattatggcccaaaatccgattaaagttaattacgattccgattcggcacatccctggtacaaatgtcgcgaaaaaattacgccaatctacgactgtttgaggccctatcatagtaatttgagtaacttccactaaacaatttacaaaacctccgatatcgatttcgcgcatcatttgatcctgagtacccaattcctgcgcccagaaataagacaaagaaaacacctgcttaatagcaaggtgagagccggcgaaaaaagtgccaacaaggtagcccatttccggacgattgcactgtgcgtttttgcacctccattttccataatgctgatttgggcgaggttggcagcgtcccatttcatttccacattgaggacatgtacgtctaccatgtaataggcctaattccacaagccactcatcaaactgatcatcagccaatgccaatttttcataaagctttttggcggtaaaattgtgcaattggttcatactcgttgaaaaaatatgtaaatcctcagatctgggaaccctgcataaaacattataacttttttctttgttggtcaaattttataaatttggcatcattccaaagctctacatgtttagaagcttttgataaggcatttataagcgattgaacaacttataaaaaagttgcaacatgaatactaccaaaaagtcagaatttttgcatattttaatttataacttttttacatgtcggcatatctttgtgatttttaggaagccgatagagcttgttaagagctttcgaatgataccaacttttggtggatttggccaacaattctaagggggcccctgctgaatttaatttttatttggttttttgatttccatttgacaataacaataataaaaataatttgaaaatttaacatcgaaaaaggttatcaaaatgggtaaaattaaaatcgatcagaattggttaaaatccagaattattttaattgaaagttctttttgccaataaaaacggttattttcctcccctttttctgatggactcaattccaaagggggcggggaaaaaaaggaagggaaaaaaaaaagggaaaaaaaaacccaaggggggggggggaaaaggggggggaaaaaaaggggaagggggaaggggaaaaaaaaaacctttaaaaaaaaaaaaagggaaaaaaaaaaaaaaaaggggggggg

SEQ ID NO: 42 - DNA, 10998 bp, Heterodera glycines
  misc_feature (10818)..(10818): n is a, c, g, or t
  misc_feature (10968)..(10969): n is a, c, g, or t
aaaagtcagaattgttgcatattttaatctatatcttttctacatgtcggcatatctgtgtgatttataggaagccgatagagcttgttaagagctttcgaatgataccaacttagttggatctggtcagcaattataaggggcccctgatgattttaattgtaatttgtatcttgatttgcatagactatatcaataataaaataatttgaaaatttaacatcgaaaaggttatcaaaatggttaaattaaaattgatcagaatgtttaaaatcaagaattatttaattgagagttcttttgtcaataaaacggttatttcatcccttttctgatgactcaatccaaagggcgggagaagtgagtgagagagagaggagagagagccaagggggggggaatgagtgagagagtgaagggaaggagaagagactgagagaaagaggagagagagaagggagggagaagagagtgagagaattgagggcgaagtgaatgagagaagaagaatgaaagagaggaatgagtgaaagagagaaagtgagaaagagaaggagaaatggaaaatgaaaaagagaaaaaaaggaaatgaaagagagcaagcaatatggagcttttaataaaaaaaacaaaaaaattaattaaataaaaacttatgtcctcatcagtcgtttactgcaagttttgcgcaacatttgatctatgtccatagcggaataggaaaaagtactacatttgtcccgaaagatcatgcttaaacctttttgattgcatactgaactatatcaaaactaaatcttcctgggcaatacgacggattagggttgggcccccgaccatcgggattggaattcggggtcatcggggtcagcaagttcgggatcgggttcgattaaatcgtcggggtcgggattcgggagcccaaccctacgacggatgtttagaatattctttagtgtaaatccgatggctttagttcaaccgtttagaatgaacaaggaaaatttatcatacctaaatactaacactatccaattttgacattaattaaaaaaaattctcaatagtgtcgaatttactcgatgtcgaaatggtccagtgtcaggaaaacagtgaaagtttttgaaatagttcagtgtcgaaaattctgtgtcgaaaatgtagtgtcgaaattacttagtgtcgaaaatactcagtgtcgaaattacatttaaacgcgtcgcacatagttttcctatttttagactttaatttccgagcgcattcaagtggcctctagggccaacatgattgcgttctaggaaaactatgatttgacgaaacaaataaaaaaaaaaataattcaataaattgaagatggagtgtcgcactcgcacataattttccaaatcgaaaattctgaagcggacgcaagtgcccactgacaaaggagagtgttcgggtgatggtggaacttccaaatgaaactttgtaggtgggtagaccacccctgggttgtattgccaaattttttttctagctgcggaataagcttctgtgccgagatatgaggctttaaatatttaataattatattatattaaatttaaaaggagaagcaacaagcgaccggttggcagggtggttgtgtgtcacgatttcatttttgtaatggaaagttcgagtcccccctacgcaaacatttttttttattgtttttaataaaattacatatttagataatttaattataatgcaagttaatccccaaaatattatttctttacttcaaaaacatttttcgaataattttaatgattcaactatttcgcctgtcgagattgaaatggctaataattttatttcaatcattgaacgatgccttaaaaatgaagaagaaattgaaatcgttgaagatctcgcatttgatgaaaatgcagataaaaagtttaaatttagtatgtggaaagaatttacaaggaaagtcactcaatttgttattgtttgtgaaattgatttaaatttgcacactcgggacaatatcattaaattgcaatcactgatacacaaccagctccaagcaagccggtttaatgcttggataaatttcgcgtggcgaaaagctggattttatgggaatgactccttcccaatttttacgcacccagttaaatattgttttgatgcaaaaaagcagccacatcaatgccaaaagaatgaatgtgccaatgttgttttaatccggtgcgctcattgcgaaattttcctatgttttgaacatttttttgtcaattacctgtactgattagatgattttgatttagagaaaattaaaataaaatttattaaaaacaataaaaaaatgtttgcgtaggggggactcgaactttccattacaaaaattaaatcgtgacacacaaccaccctgccaaccggtcgcttgttgcttctccttttaaatttaatataatataattattaaatatttaaagcctcatatctcggcacagaagcttattccgcagctagaaaaaaaatttggcaatacaacccaggggtggtctacccacctacaaagtttcatttggaagttccaccatcacccgaacactctcctttgtgagggtcagcagggcggctttttggaaaactatgtgcgacgtggccaaaactaaatcaatgatcaaatttcatctaccaaatttctctcatcattttgccaacagcactcaaagttcaaagcatttgtccgcattcggcaatgttttaagcctaaatcataaataacatttttgtattagatcacggtgatcgagacactgaaaattgggaaaattttagaaaaaaattcataggggcttagaaaatttttttgaaaaaaatcattaagactaccaaaaagaacacaaaaaagctaccgaattgtcttatgaatggtggatcgaagtcttttacaaaagggcaaaaaatgctttccgcaaaaagtgcaatttgaacataaaagacctggcctcatcagtactagggttggttttccgatttccgaaatttttgataaaacgtcggaaattctaaaaaaatttgaaagtttttttttaaaattagcaatttttgtacattatatattacaataaaattttcaggaattttcccagcggcgcctatcggaaccgacggatgaaccgtaaaagtcattaattttcaaggaaaaaatactaaaaccgcaaaatttggtcatctttatgatgaagaattttatcaaacaaaaaattttttgaaatcatctattacttggttaagaattttaaaatttagcttgttaaaatattttaaaattttttaatttattttatgtttttcaaaaatttccgatttccgccttctgatccgacgtttttggggtcagaattccgatttcgaaaaaatattggggcttggaattccaatttcctaaaaaattttgagcctcggaatgccatccaatacgatgtctttttgttgttaaaataattttaattatttaaaatctgttttaggcattattatagacaaaccactacaaaataaagtaaaacaaattatacttaagttaataaaaaataaatattttaatttttttccacaaaatacttaaaaaataataaagagcaaagaaaactttaaacttttcgcgaaatgacctagcatcttaattttaggcaattaatttatttgttttattaatgtgttcatatctcgttaattttatagaaaataccattttttgtcgatccatgtcacagttctcattgtgaccgcatttttggtttcgaccagctgatggtagatgaccaaagtggattccggatggacaaaggtgaatttgtcgaaagtgatcgacatgtcacggtcgacaattggcttgaaaagccttccgcgctcaccatcacgctgggcgatctttatttttcaatataaataatttgataaatacgtggattacaacaaaaagcaaaaaacaaaaacaaacaaaaaagaggtataaaaaccctcgattatgcattaaaaatagtcaaacaaaagttttctgaaagattttaaggtaaaaaatccagaaaaattattaggaaaaaaaactttcttgattatatttcaattataaagaatcgaataaggaaaattttaaatcaatttattgcgaaataaaaattaatttggggatcgactttagagatcatttttcaattcttagggggcatattttcgtttttattctattttaaaaaattttttccgaaaaccattaaacaaaaacggcgtaaaaccatagggattcgtccttgggtgccaaggacgtccttggatttgggctctacgtcttggaaaattgaaggagttcttatttgcaagaatgcctctggaaatcagatagaaaaatatttaaatttctcggtgaaaatctattaaaaaatagtcaaaatctcgaattttttcctccgctgcgcctatcggcagctccggaccccaaaattcctatttcttcttttaaaatggtcaaaaacgtttttaatgaagatctgtaaataaacttctttcttcccaaaatttttccccgcagagactatcggcatcgccgaaaaaatagtaatttgtccacaattttcattaattttttaaaataattcccattttcccacaaaaaaatttaatttaaaatagataattaaataaattaatcatcatattattatttactggcttgaaataacaaagtttacaaaagaacttgtatttttaatttttttacgatttaaattaaaattcaaatccaatttacaattaatgtatagcatttgataaattattgaaatagtttgtaaattttaaaaacttatttggtatcatttttatttaaatttcaattttaaatttttcaattacctgcatgaaatacccgtgcagcagtgattgcttgatgttcttgaagtattctggagaatttgggttcgcgaactgcatctaaaacaatttttcagctataaatcggcccttagttgaaactatttgttaacatttataatctggcttttttgcaatgaataatttataaaaatacctagtcaatttgcaaaattttggccaggtcccggtcccggtttttgaaaaaaagaaatcccggtcccggttttgccagtcccggtcccggcgggactaaataagcactagtaagaatggcggtctggtgagaaaagagaaggaaattggtggagaaggaaaaatttttgagaaaaaaattaattatttatttcatttaatcataattcctcacgggatataatatttttcatattttctttaccattattttactgtaattaaaattttaattaataaaaaatattcttttatttttaaacagcctaaaacccacaaataaccaaatattttatcacttttttggtaaattctgttaacaaatctcacgcaaaatttcaaaatttttaccggcagcgcctatcggcaccgccggacccccctccccccccccccccaatgttcctaaaaagttttttgaaaaaacagcgccacaaaagagagatttaaaagcaaaaaaattaagagattgttaatttatttaaaaaatccagaatttttggactcagaaaattccaagattcaccgctccccccgaaataaacggttggttctgttcccgtttttttgggtcccggtcgaaaaacttggtcccaatcccggcttttctcgtcccggtcccggtttttgtcaaaattccctgtcccgctcaactctagctaaaactcgtttttcgttcgtttcattccatttgcagtctatgaaaaaaatgcaaatacatggacaccctaacattagcattttaggcgtttgtttgattttgtgttttgttttttttctctttactttgttgtacttttttcattttttttaaatggctactaccatatttcttctcgtcggctccttgattttgtctgacagctgctttcgtattaaagtagcttcattcaatgcatcgaagcgtacaaaattttgattgcaccactttttgcgttcttcttcgctcgtattcactgaaactttaacatatttaagggctttatcgaaaatttttcaaaatcagaacatcgggctcaaaaaatcagattttggtgtcgaaaataaaaatatttcaattatttttaaatttattcgaagatttttcgcctccgatcatctttagcaattttgggaatgaaattagcaaattgaattttaatgcattcgggataaaaaaaatcaaattttaacaattttttgcggcgcatttaacgaaaaacttttgggaaatgggcgaggggataggatccggaaaaatttggtaatttctttcggatttgttaacagattttcatcaaaaagaccaatttttgcaattaagtgccaatcgatgattttttgcgcttcgaaacgctttttttgctgcgcgtttttcaaaaattttgggggatgggcagggggtcgccgggaaagattttataatttttaatgcgatttgtttgtcaaaaaatgaccaaattttgcgcaaaccttagacattctgccataaagtttcaaaatatgaatttatttagtgaaataagaacaatttttggtcactacatacctccaaatcaggacaaatctgacaaagggatttaaaagcgtaaaatcaagcaaccggttgtcaagtgattagtgtgcctaccttaggtggtgtgttgtcatgggttcgagtcccattagtgttgtctattttcaatcaattaattaatcaaaataattcaattcttttttaaaaattaattaagtttattaaataaaataataattattgtaaattaataaataataatttatttttaataaaattaaaaaaaacaaattcgaataaaataaatatgaaataaaaaaaacaataataataatgcaaatctaaataatttataaaaaaatgatttattgagtttataatagagttaagcggtaatcggtaattgtaaaaaaaccggtatcggtaatgaccggtactgcaaaaccggtaccgataccggtaaaaaccggtaattttccaacgttaaaaattcttagacaacattttcaaatacaaaatttttattccgttttcgtgcgagttcctgttttttagcattagaattgttcagaagtatatgtatcttgagggtgattaagtttttttttcaaattcaggatgaagaacagtaaaattcagatttatacctaaaattaaaattttttgcaaagcgaggggtcagcggccaattttacaaattgcgaaggggtccggccatgtaaatcgatgtacctttttttgctctcaaaccggttttttcgcggcgctttttccaagacttttggggaacattggggaacaaggggtccgccgataggcgccgccgggaaaatttgtaattttagttgatttgttaacaaaacttgacaaaaaaatgaccagaaaagagggaaatgagacaaaatgaggagagaaaagaatagaagcgagaaacaaagaaagaaagtgaggtgagaaggagaagaaaggaaaggatagagaaaatgaggagagagaggaaagaagaaagaaatagaataagttaaggagagaggaaaggatagagataaagcgaggagagacaaagagaggaagcgagagagggatgagagatagtgaggcgaggagagaagatagaaatgaacgaagagagtaaaggaaagagagggagagaagataaaagaggagaggaaagaaggagaagagagcaaagaaaaaagagagttaaagaaaaaaagagagggagagagagatgagggagaaagagagaggagagacagagaaaattcgagggagcgacagaaagagcgagagagagagaaaaagagagggaaagaaagagaagagggagagagagtaaagcgagggagaaaaaatagaaaataagagaaagtaagagagaagagagggttagagagataaagaaagagagaaaatggaaaagtgagagagaaagagagagtagaaatgaaagaaagatagaaagagatcgcaatttttttttaaattttattaaaaataaattattattatttattaatttacaataattattattttatttaataaacttaattaatttttaaaaaagaattgaattattttgattaattaattgattgaaaatagacaacactaatgggactcgaacccatgacaacacaccacctaaggtaggcacactaatcacttgacaaccggttgcttgattttacgcttttaaatccctttgtcagatttgtcctgatttggaggtatgtagtgaccaaaaattgttcttatttcactaaataaattcatattttgaaactttatggcagaatgtctaaggtttgcgcaaaatttggtcattttttgacaaacaaatcgcattaaaaattataaaatctttcccggcgaccccctgcccatcccccaaaatttttgaaaaacgcgcagcaaaaaaagcgtttcgaagcgcaaaaaatcatcgattggcacttaattgcaaaaattggtctttttgatgaaaatctgttaacaaatccgaaagaaattaccaaatttttccggatcctatcccctcgcccatttcccaaaagtttttcgttaaatgcgccgcaaaaaattgttaaaatttgattaatattaatttgctaatttcattcccaaaaacagaaagagtaagagatagaggaagagaaaaaggaggagaaaggaaagaaagagtagatataggaattttatatttttagtttcctattttcgtatttctattttattttttaattcgcaactacccttctatatccccacccttcttacaactcataaacttgttgtagacgttcatcattgtgatgtgatcgccatggtagttggcgaactgctccatcgctttcatgaatcggctgcgatctatttttttagggcgaataatgcacggttgttgggtcgacatgatggccgcaatggatagcatctcttcaatgcaatcgtaatctttcgaagctatcagggcccttgccatttgcggatccacagggagatttgccatgtgattgccaatttgagtaagtgatacgcgttctataaatgaggaaatgggcactattaatatatattttttcttttttaagaacaatcaaaaaattgaattaattttattttagaagtttgtgtccatatacaaagagtaagttcaattccccgtataactaaattttttcgttttaaaatttattctttttttaacagaatttcaccaaaactggcaatttttggtcaaatttgaatattttggtggtatttagcagggatggcatggaattctgatttccgacatttttgggtttggaattccgattttcgacttacgaaaaatttttgggcctcggaattctgataaatctaattcataatttgtaatttcgctattatttctaaaaataaatatatctggtgttatagccgaaaatttttggggcttcggaatgccatcctggtaattaggataaaaaacgaagaattccgtttttaatttatccattttaaattattttgattgcttataatttaaaatagttttgttttatgtccatatattaagttttaaaaaattaaattacggtataattagggacccgctttgaggcattttttgccttttttctgacttactagggctgtctattttatgtaagaaaaatcgtgaaatatgtaaataaaaatttataaaaaatgctaaaatatatgtgcaaaaaacccaagatatgtactaaaatatgtaaataaaaatttttaatggtaatttttttggagaaaattcctcgtaaagggtgaaatatgcacaaaatgccataaaaataggcttaaaatcattttttagtattttaaattaatttttgatatcattttttgaaaaaaatcgattttttagggatacattttcaaaaattttttttaattttcacaaaaaatttctataaattctcaaaaatcctcaaaatatgtaaaaaaatatatgaaaatatgtacgaaaaagtgtggaatatgcatgcaaatatgtacgtatgtaatatgaaaaaaacccgaaaatatgtaaaaaaaagtcccaacttttgttcgcaaacacaaaaaagaaagtgtttttcctactattcaaagcatggagaatccaggaaaaaaacagagcacaacccacttcacgagtctcgaagactaaaatcgagaccgaaaatccgggaccgagactacaagcatcactactcttttatgccttttcacaaatttgtgccattcggtgcccttttgaaaattttttgtggaaatgaccggactgaaatttttaattttataaaaaattaaaataaattttcgccaaaaaaaaaaaaaatattaccatcgattgctcccagaaaataaagattttttaatgcgcttccaatagccgctttcggtggctgatcgcggaagcggaggtcgccaaggtgctcagaaatactgggaatggacttcattttaaggaccattgaagtcagatcggaccaaagaatctaaaaagcatttcagcttattaaatataagtcggcatacaacccagttattctggattcaattttaactactttgtaaagtgaattccaaaataaaatttttgggtgaaaattagtcgttaacccgattcagacataaatatatatatatatatatatataaatacacggaaatttctcaaatgtatgcctcactanacttaactgtattatcgaccgcatttttttaatgttcttgaaagtaaatctctggccaatttgataatgtaattttaatttttaatctcatttgcccaaaaaatttagagaaaaattatgaaatatgagaaatcagactcgcgaagtcannagcccggatctttctttactcgatcttca

SEQ ID NO: 43 - DNA, 3429 bp, Heterodera glycines
aaaaagatagaaataaaaatctttgaaaattctgccttttttgcggttttcatctgacaacttttttgagacttgactaatccctgagaaatagcttataaatatcttttaaacatatagggctttcaaatgataccatgattgtgaagtttggccaacaaagaaaaaagttatagctttttgaacattgctgagacggagttggccagacggagttgacccctaccgtcgccggacccctccccctcccccggtgtcagtggggggggggggggggggaccggcagtgccgatatacttcgcctgggtaaatttgtaatttttaatgcgatttgttaacagattttgtccaaatgacaaaatttttttcaattttggatcaatttgttaagaaaaaatgtgagttctttggggggggggggttggcggtgccattggcgttgccgagagaaaaattagaaatttgacgttttttgaacagattttcactgaaaattttctattattaggttaaattttgcataaattaatgattattattacaaaaggaaaaatttgattttttttcataaaatgtcatttttacattcatatgcaaaaatctcgatttccaaggattttgatgaaatcataaaataattttttcaagcaagtatagaaaaatagcctattaaaatatttagaaaattttttagattctatttttttttaaatttccgattttccggcttccgaaaaaatctttagccacggaattcagttttacgattcccaaaatttttgggccacggaatgccatccctggtacattaattataatagtgaattcattttcaatattttttaactttttcaacggtataactgacgccggagtaggacaaaacgtcgtcagccgaaacgtcgtcgaacgaatttttcgaccataacttttttctttctcaaccaaattaaacatttttggtattattcgaaagcattcgaaaaatgctattagcctgcaaattttcaaaaatttttatttatgcacaataaaatcagagcaaaaaaagttcgaattactgggcttttgagttccttctggccataacttttttgaaacttaacgaaaatttttgagattttgcaaattaataataaacacatagagctatcgaacaacaccaacaattcttaatttgattgacagtgaacaaagttatggttcaaaaagtcttccgacgacgtttcggccgccgacgttttggggtgcaccgaactgacgcatttcccgtttcaagatctaattttgccattatttaaaaaaaactaactgtgatgccctttttggtatcatatttgaggtgcttcgccaagccactatcaacaacatagacgatgccgtcgatagtgatcgatgattcggcgatgttcgtggcgatcacacattttctctggtctatttaaaaatttgatttagaatacggaattttaaatataaatatttttttatttaatgaatttgggatcaggcaataatgagaagtgccgaaggaaaagttttataaatttgatttattaaatttggttgtaacaatttatttttgacccgatttggcaagaaaaaaattaccagagatgccatcgaaattggcaaccaaaattgaattatgttgaaaaataaggacattattaaacccgattaaaaaattcttaatttcacgtaccaaagtttttcaattttagggaatattaaacatatatgtgtatatgtgtgctaaattttaacaactttccttccatttttaataaaaccatttaaatattcaataatatttttgctaaaataaaaaataaaagaaaaaagaaatcaaaaaacaaaaaacaaaccaaattaaagaattcaaaatttttaaattaatttttttaatttaaattaatattaattgttacaatttaatttaatttaatttttattactcggatatctttcgaacgcttttgcttgctggtcagttgtcaatgccccatacaacggccggcacacctaataaaaattgctataaaattttttcctttttattgtagagagatctttcttgtccttatttccaagaattgtctttattttccatttcattattatccttattttaatttggattaaaaataacaaaaatcagtatttttaacctaataatcataaaattgcaatttggtgcaaaatctgttaacaaatagcataaatttttttatgtttaccataatttgctaacaaatataataagcaaatgtacacaaatgtctcctattttatagaaaaattggaattctgtgccctctattcaaaagtttttttttgaaattaccaaatcagatctcttcaattcgcgtaatcgttccttcaccttgtcgcacactttctcaatttcctgtagaatacatacatatattaatttctaacttttattaaaattttgcacggatcgttttcaattaaaaaaattacatttgttttgttcctttaattttttcgtcttcttggcgactcattttgagtatgaaataaataaagcactgctgttgactttatttttagagaaaaaaagagattttcttttcaagaattcttaatcataaaaacaaacataaacggaaatcattcaaaaactttaagaatcaatgccaaaatgtcatttttcttgagaaaaaatggtacttgaaaacattttaaattaacaatataacgaaatagagaattttttttatattctaatttatattcattaaaaagttaactttaaaagaaccgtttaatttttaatttttgtttcaaaaatgaaaaaaattatttgataaaaatgtcaagaatttttatagtactagcaatttctaaatatctatgagttcgtaaattattattctaatattttaattttctttttgtatattcattggtttcctatcgacaaaatttaatccatatatatatatatatatatatatatatatatatatatttcaattgacacatattttatcattttttaattaaaatcagtacaaaaagtctttttgggactcagtctcgattctcgggtcagctggagaccaaaaatttcgtctcgagcaaaaatattttccatttattattcatacttacttcctccccttcaacgaaaacaaggatgtctccgtattgtttctcaacatgaatttggattattgccgttgcagcagcttccaatgcgtcctcaaccggcgcagaaaggtactaaaaactttgtttaactgacagcctagccattttcatttttagtaaatcccttagggttggaaaaagtttctggagaaaacaaaaagatctttagaaagagcacaaaattctctataaacttaaagtcgcaagactctactactatcatggggaaataggctgaagaaaataat

SEQ ID NO: 44 - DNA, 2650 bp, Heterodera glycines
cgcggcgctctttccccaaacctcaattatatgcgacaaacattttgtttttgtgttttaaattaatgcattgcgccaacatgacgtcgacctgtttttggcgaagtgtttgttactgtgcgcagggcatttcgccaatgtttttacgccaagcacagttcgtccccccttaatttcactcaaattttttgtgctgaaaatgagattggtactcacctcaaataaattgaaaattctatttgatttaggatttgggttcatttctagaaaactttcaactccttccttctcctctagtttttcctcctccttttcattttcttcttcctctttatcctcgatcactattttatgttttatcctttctctttttttgttcttccttccactctatctctctctctctttattcctcctctctttctcctctctcactctttatccttctctctctctctctctttatactctctctctctcccccattttcttttattttgttccccaaattcttcagcaataagcagcccacccactcccatacacaattcttcaattgctcaattgaatcgctcattcaattgtgaagcgtacataatcatcgaccattcattccgtcttctgtttgtttattcccttccattcatttttcattcattcactttccctttgatccgcctttttttgtgtgggtacaccctcaaaatgttgtgtggttgttcaacagttctattcatgttgtatgttgtttgctggggtattgtatttactcgggatttgaattttggtttcatctcgaagcaaatgataaatcttagcgaggattttcgaatgaccaaacaaaacacttaaatcccctgagaaatatcgagtttaaatattctttttagtaaaaacgcacactccaaatacataaaccacaaaaaaatattttaaaatgccaaatttgaatcttccttttattaaactaggaaatgtatatatgtagtgtaacaaaatattccgtcctctaaaaatggcaattttatcattgttttgcgcaatttgatacacatacaacaaatttaatttcacagctcccgcccccccccccattcgccgatgacagcggcagggcgacattcgagaacaggcttttactagtggggtgtgcgagacgtacgctgcgcaagtttatggcgtagggattgggctgggagaagacgaagaaaacattccccgcccccaattctcgcccaaattcccattcccccaattcactctcggcagaagagtgacgagactctcgtcagatgctccgcgcccctaagaagttaaattgattgtttgatggaaagaattgaattaaatttatttcaaattctaacaagacatagaacaagcaattcctttatgggctattgaaggccgcttcatcggctgagaggatggctttatttgtgcttggccgctccggacacattgggcttttcccttctcacaatgtgataggcttccatcctttcagatcgccaattttgttaaaaatcagaggaattttttctattgatttcgtaaaaattagttaagcctaaccaagtttcattaatatacaatgtatgtatacaatgtctttattctaattctatggctttttttattgctatattttgtaaatagttgagcatttaatttaatttttctaattattaaaaataatttttttaagtttaaatgttgcccacctttttaaggccatacaaatcttttttgcccacctcccttccttaatgtcccaatttgttgaaggcaaaattcttcggctaatttggccacaaatttgcccacatttccccccgactaaatgcatccatcagtccatcatcatccaccattggccacataacgatgttttgatcgtgtgatcgtgtgattgttgtgtgtatgtgtgcacatctgctgcttgtacgtcttgggccaagaggaggggaagtgagtgagtccaagacgaattgccacacaaaaatgggcggggcgggggagggcgcctccttcctgcgccaagaacggggacggacggacattgagcggagagaggataaatttgtcattcttggacactttattccacaattaattttgttccatccttatagataggattcattaaacttcttcctccccccacctctgggaacaaagcattggcccagcaattattaaaaattcaaaaaccaatattgccctgccaagtttgaaacacatagcagtctggcacccatactaatatatcccaaaaagggtccaaaaatttccgggattaatttgcacttatcttccctttttctttggatgtatttaagaaaagttatgtcaaaatatggcaccttctctcgagaatgaaacgcgtttatgcggtgggcatgttcagcaagcagcttttttcacttttcccgtgttgcccccgaggtgatggaccacacttttttctcgcctctctcttctcctagcagctcactaactcaattgcccctgctaaatattttcaggaagttgacgaggaagttcaatggattaacaaagtcgactgtctcataaaactgaaagaagaaagaagttattgcggaacgaaaaggtcgaaacagaataaaaaacatcagagcatggaata

SEQ ID NO: 45 - DNA, 2209 bp, Heterodera glycines
tgggggggggggaaaattcctttttcccccccccccccccccccccgcttcgcctccccttttttgggctggctctcttcgtgacctgttttgggggtgtcgggggatggggaggggagggatgcgattgaatgggtggggtccgtccgtgggctataaggggaaaatggttggtgaataataacaatgtgttgttaaagtgtgtggtgctgtgatgggaatgattcagcaacagaagaacgcccctctcccctccccaatcaaaaattgggaattgtttttgtatttttttgtactgattgaattgcatccctttactcagtttatttcagtgtgtgtggtgccccccccccccccattagaagatggcgaatgttttgataatgcattcgcggtgccatttgtttgcattacaaattgcctatttatggcacaccaaaattttgatggcacctttttaatgttgtatgtaaggtgtgcccatttattggtactttttaatagcttatatatggtgtaaaaagaaattttacaccatttcttatgtgacaaattgcgactttatggcatgccattaaatttatggcaatttatttgatgcaaatttcgtcttaaaaataataaattttccctctaaaaatattttttcaatatattagtgatattcttagataagtgtaccaccgctgttttacacatgtatttatttgtaaatgttctttttccattaaatgtcttatgagtatgcgtcttggcattgagaaattatcctatttttctaatatataatttttttttaatttaagcaaaaaaaacaaaataatgaaagtatttactgttgggctggaccagaaaccgccgctggaggaggccaaggggagtccagaaaaatcaggtaaaacgagcagatagcaaggagcaagcagaacatgatttttttgtcatttcaacaagaaatttcccaattttctgaaatcacaaaatcttcgaaataaccaagaagctctatcttattcgccttcaaaattttatttatgaactcctatttaatccaaattcctaattacggtgtccattacaatacctaccgtattcatttggactccatttctccctgtctaattaattttggctttgattatctgaagtttaccatttgctcaaccattagacacgcctccgccccgctactccaccaccgaggcgcgcattccgcttccgctcgggccccaactgccgcgtccgccgttgccgccccagccgattatcatgcgcaaggcgcgcggctacaaaggcattctgttggtgctgatcgccgtctttttgatggcagcttttgcgctcactttgtccgaaatggcgtacaacagacaacgcgaggagaacttcttcaagctgcgctggtcagtcaagtaaagaaggaacgattctgagcttaagcagttttttttgtcagtcaatcggtggcaaggcgtacaaagcataaattgactaaatgattgggaaattgagagagagagagagagggacggctaaatgttttatgaaatgccaacaaactcttttggcactgtttcaatttgggcatttttcagtagaaatggcttatcatattttgtttattggtttgatattgaatcggtcttttgcttgagcggatcttcactaaattaaacctacttcgaatcttcgtttctttaggcttaagtttcctgccgctaaatttcatttgatggttttttatctcactgatcagtttatttccgttttgaaacaatattggactgatcattggattagtagggctcggatttttaagcgcaacaaagtctaaaataaggccgtaaataagggcgaaaaaatcgcgaaataagggcaaaaaagttccaaatttaggggtatacttttttaaattgctgttttttatatgaaaataatttcagattaaggcaaacaaaatattttggtcgattcttaggggtgcatttttcgtttttattgcatttttgttaataaattttggacaaaacgcaaaaataagggcaaaaacttattttaagggcgaacatccaaaataaggatttctaaggtcgaataagggcgttaaaacgcaaaattttcgaaacaaaaaatgtgttttttcgtgcatttttcgtcgagttaaagccgcagaaaaaataagtaaaaacttataaatccgggccctact

SEQ ID NO: 46 - DNA, 2013 bp, Heterodera glycines
gaagcatcgtatgggctatgaaaacgccggtccctacgactattaccatcgagcatcatcggctattggcgagaaatttgacagattgttcagcctagcaaaaaggtaaactgacttttaattgtttttttaataaaaagtttgctatctgggttactgtaactgaaatttctgtaattgacaattgcatgtaaatgacttaaatctctgctggtatgtagcgaatatgcattgaaaataaatattttcataatcctttggggaaataaaacacagaaaaagagagtgtggcataaaagttatgacaacatatcaatttataataataacctataaaattttaagcttttttattttaatttttgcagtaatgaattgccaccatcgctgcccatttcggcgtccatggaccgcgacccgtccaccaccagcacaacatcggcaccggcacaaccgtcagagcccgtggtggccatcgactccttcccgcaatttatgggactcaacggccgcagagtgcaccagccatttggaccccaacaaaactccgtggaggtgtgaaataataaatttgttaaagatttgacgacaatagggtagagactaatggaaattgggcattgcgccagagtttcatattttagtaaaattttaaaaacttcggtttgaataagttcggttaacaatcatttccaactgtttttgctcgtttagatggagcaaccgatgccacaaatgttcggcagcaacggcatgaccaacagcgggccgttctcccaggtgcgcgacgcacgactgcagtttttgcgcaacatcctgcagaagatcaaacagcacgcggaggacattgggtaaagggctgcacgagcgtacggttgacagttgggtctaccgtacccatttgctacttactatacatactgtggtgcatttgagccgaacccgtataaataatctgtttatgattataaatgatcaaaccaacggcccactgttgtattcattttggatacacacgcacaaattaccatgaaaaaataaatgatattaaagttccccttatagaatacagtattttctacaaaatgtaccatgctttgtgtctcattttgacaaattttccacaaaaaatttaccgtatctcacttcaaattagactaatagatattttctaaaatatagaattaagcacgactcttttaatttaatttgcagctttgacggcaccatgcaagtgtccatcattgaggtggagccgcaaaacggtgccgacggcgccgagacggctgcccaagagaacggcaacattaacaacaacaacaacatttggggcccgcaacaacgtggcgtcgaaatgggccagcagccccagcaacagcaacaacagtcactccccgctcagatggcatttccgatgccgcaacatttcttcccacaccctcgcccactgattgacgatttcaaggtgggcagggcatcatatagccattggcaaagatttttgccaagttcatcggaggatttttgcataatttcggaaatgcactatttcaaattttggcaaaaaatgccattttttaatttttaggttctatatactgaattttaaactactccaatgaaatgaattttttaatgaaattggtttaaaaattgaaaaatagataaggctttatattttatagtaaatatgggacagaaccataaaaatgcaaatggtccatatacaaaaaataaaaaaaatgttaatgaatttgagaattatttattttttattttttgaagaattcgcgctcttttctcgacggattcggcgagttccatccgcccagctttgtgcaacagcagcagcagcagatgaacaatcatatcacggagccggaggagcgaccgcgcatgtttggcccatgggcacagcagcagcaaatgccgaatatgccggacgagttccaacaacagcaacagcagcaacaacaacaacaacagccgaatgtgccggattttagggaaaag

SEQ ID NO: 47 - DNA, 1318 bp, Heterodera glycines
  misc_feature (15)..(15): n is a, c, g, or t
tgtttttccaccccnattttcccgcaacaaatgaacctccgcttcccgcccattcagcctccacaggtgtccatcacaaattgccacgctttatcatttcaattctctaaaaattattaaaaaaatgttttaataattatttaatattaaaatttaaatataattaaatgtcataaaaggttaacaatgaatgggcccaacaacagcaacagcaacaaaatgcgttgcagcttcaacaaaacggggccgctgcgttgccgcgcccggccgcgttcgaccgttggaacggtggcccaccgccatcatcttccaacaatggttttttcgtgccaccgccgccgtcgccccaattcgcgcaacaacagcaacaggagcagacggagcagcaacaacagccgcaaccgcaacaatcagttgtccagcaacaacaacaacagccacagccgcaaccactgcagcaacaagttgtgtcgggcggggattggcattcatttttagccacaaaaactcaatcgtccaaagaattgaaacaataaattttgtccaaatttaccttgaataatcgggccgtttcaatctgtggtgccaattttaatagaaaaaacgctttgtagtaaataggcacttcagactctaaagctcctcagactgaaacgaactgactgaaatcggccagattcaaatgaccccatcgaatcttgaatactccaaatttaaaaataaaattttgaaaatgtcagattcaaattgacttccccgaggtcaagcttccgccgccgagcattgacagcaacgacaacagtaacaatgttgttgatgacaacaacaagaacaaattccaactgccaattgggcctccaactgaacagcctcaggcacaggtgaaaaatcaataaaaattttgtaaaattaataccaaaagtgcttactgtatgattaatgtctattgctgtgcgcttcagaatcaacagcaaccgcaacaaccgcgccaggactggctgcccaaatggtcgacttcgtcatcatcctcagccggtatttagagggaaacatgagaaagtgggggggggggggggtcgtagccaaatttacgaaaggtcaagaatgcatctttttttcaatcacaaatagtttaaacagaacagctttaaaattaggaaaaaaattttcttgagacattagaacaattaaatcaattattaaaaaactaagattttttctttaaaaatatttatttaaaaataaattggaaaaaacatgaatttaaacgaatttgggcattcgtgcaaatgcccggagcgcaactgtttgtacaatg

SEQ ID NO: 48 - DNA, 4393 bp, Heterodera glycines
  misc_feature (4317)..(4317): n is a, c, g, or t
  misc_feature (4327)..(4327): n is a, c, g, or t
atgcccggagcgcaactgtttgtacaatggtctgcatttcatttatgcccaacttttcttgctttcagctgacaagaccgaccccgacaacagcaaggacgatgatgataatgatgatgatgagaacagcaacgccaaccgtggcaccggcacaatgttcggcgccggtccgccatccgcccaaccgtcggacattgttaaatttcccactgtgactgttgttgaggcggcaaagaatgaacacgacgatgctgtggaggtgcatatctgattattaaatgaatgccataaaatttacgacgatttttccccgtttgccttaggcaatgatcgatgggtgccctggtgttaaacctatcgattattgttcgagagtcctggtctcgacttccttgatcgggaccgacactttttacactatcccctaaagaattttaagccgaaattccaacataaatttctggcacccgcttacatctcccctgctaattacttcgtgtacgggttccgcccccccccccccccctcccaatgtaattgcaaccggcaaacgagttcaaaaacctggacaggccaaacagcaagccgacaattgcaaaaatatggaaaaaaactattgaatacttttgcagccaattcccacctcgttgggcactgaacagccggcggcaccacccgctcagcccacgccagctgcggcaacacctcaagttcaagcagcgggtgcagctgtggctccctcccaaactgagcaccagcaggagaagaaggaggtgtggcatgtctcccatatacctttcatagataattaaatcgaaaagtaatgaactaattaacccagccactgtttcgctgaaagcgaaatttccgtgcactaatgacatggcttttcgttcggcttttctttaatcatgacgctaaaatattatgtttaaaaattgctttattgtttcatggaaaatttaaccaaattttttatttcgttcaattcgcattgaacttcgcccaatccctgaaaatatgattttctaaaaattcatcacatttcaaaaattaaacagcagtccgccgatgagttggttgaggtggacgcaccgccgcagccgattgtgccacaacagaacaatcagccggcgcaaccacagcaacaacagccgcagcagcagcaacaggaggagatgaccaagacggagcaggaacaaccgcagctgaaccagcaacagcagccatccccgcccggcatttcgccattccaacagaaatggttcccggaagtgccgtccgtgtttttccaggtattattttttgaaagggactaaaagatggcatttttttagaatattctttaaattatgtttaaataatttatctatctcattaacggatgcgttgggtgggagcaaatgaatgaaaaagagaagagggaaataaggaatggaccaccaaggaggaatgtaacggaattccgacatatttggctgaattttttttggggcacggaatttcgacttccagagagactacggtagagagagagagagagagtggaaagaaaacagacagtttaagtgtgtggcgtttaacgggagaaatagttaggcaaaacggtagagagaaaacagacagttagaggaatgccaactcttccgttaatggggtagcacccaaaaaataataacaatcaataatacaataattaattacctaacttattttatctttgtaaatctccgatccctaacacttaatttatcagttgataaatgcttgatcttaaccaaatgttagcaaaaacactccttaatttagtgctagcttagcttttttcgtgctaaaaatttgtcctaaaaatgcttttaaaaatttcagaaggacaattcaagagaagaaattgagaaaactgagaaagtgttcgagtcaatggtgcaaaatatgaagagaatgattgggaaaatgttcaaagtggacgattctgactccacagaaattgtccaggttaagatcaaacccatagaagcattttaattttattttcaaaaattctgaagaaaccttggattggccaaagatagaataaattgttttcttaaaaacagggcacggattttcaaaaaaaaattctaaggaagcgattaattcataacgaaaaaaaacaaatcaaagacttcaaagttcacgttctgttcatttccctgcttcatttacctttaaattttaaatctttataaaaaaacatcgaaatttttctttgaaagactaaaaaaattttttaaaaattattattgtattttaggacaacattaacacctaagcacaatttcgtacccttataaaccacaatttttttttcttatttaattttttttttctaaggttgatgacccaaacggtggcaacgccggtggcactgacgacgtgaacatgccaaaaccggcagaactggtcgccaatgatggaggtgctggggagcagcaacgacctcgacagccccacatggtggttgattgaggggaagaaacttgtggagaacaaagatattcgggaaaatttttttaatttttggcttttatttcgtaaactatgcagcaaatttcattggtttttttttaaattaacccatttaaaaaaaataattttgtctcaaagtgccaaaaattgcaaaaatttaacccaccaaaaccccttttatattttgaaaatgttaattctattgttcaaccaccaaaatcacaccacagtaaatgtgtcaccgttaaagtgatatgcatccattccttcgttgaattctgtgttttttttttaaattttcccggatgctttggcataacgtcgtcccgtgttccccgtttgaaaatggaattgattggagctgatcagaagttatcagcagcaggacagtaaatccgcacattagctgctgatcacttaagactcggctccctctcccctcccccctgcttttgctctctgatcgcaccgttgtgagcctcgaccatataaattaattagcccataacacactcactaattgacccaaccaattattattgctcgtatatatatttggttattattatatttttcattttttgtagcataaatttttctgaaattattttaaaacgctgcccgtcatttcgtcccgcgtcgtttcgtcctgcgtcgtttcgtcccgcgtcgtttcgtcctgcgtcgtttcgtcccgcattgtttcgtcccccaagccaaaattagtcgtttcgtccccaaatttattttaattttcaaaaacggcgaagaagtctaattttatatataagtctataaatagttttttattaattgaacaacacaaaaaaacaataaaaacattgaaatgaacaaatcctaagggatgacttcagcgattgaatcttccactctttcagtaattcaatttcctgcaattccagcatggaattggaaacagtgccgacggacatagaggctcttaccaaaggcggacttaaaatttagaaaacatgaaattttgtgaaattggctgtgccttgctgcaacgtgacgattcattcaacgagactgcaccaacttgtggtcggatgtgacggatgaaaatgatgtcccagcgagtgcttaagatgcaaaagccggatattccgttgtcggttttgctgacatttttacacgtacgtacagggcagtcacgcacactgcatctccacaatcattttgtttgtgcgtaaataatcggaacctaaaaacgaaaaattccttgaaaaaaaaattttttctcaccattaaatcaaatgcaaacacctcgtcttttcggttttccaagttcgagataccgtgttcttcaaaatcatcggcgcggtcgttgttttctcgttttgttgactgtgaccagcagcagactgcgtctctttttctccgtcattattattcaaaactttgcgcttacgacattttgaagattttcaatttttttacgatccatcatacttctaaattcgtaaatttatgctgtgttaactaaactcggaaaaaattttagtggtaacactttagaaactaaatattttataaataaaaagaaatttggggacgaaacgactaattttggcttgggggacgaaacgacgcgggacgaaacgacgcaggacgaaacgacgcgggacgaaacgacgcgggacgaaacgacgcgggacgaaacgacgcgggacgaaatgacagcgcgccgttgcaattgtgcgggcgaaattgataaaaaattagtcacttttgtacataaaaacactggattttttcaatttttaacacctattttggccttgttgnggcttattangtatttgtggaaaatttgttagttttttataagaatttttttgggcatttgaaaatttttatttgg

SEQ ID NO: 49 - DNA, 2083 bp, Heterodera glycines
aaccatatccaacattgttggtgtcgttcgaaagcttaatctatttagaagctttttctaagctattgctttgcgattagacaattatcaaaacagttatgcatgaaaattgcgaaaagtcgaaatttttgaacttttttcttaataaaatttttacaggcttgaaaaacttttcgtttttgataaggctaatagaggatacatagggctttcgaatgataccaagattgttggatttggatgccaaagaaaaaagcttaagtggaaaaacgagctggcgccgaaacgggagcgccgaaacgcgagcgccgaaacgcgtgggtcccccaaacgtgagggccaaactgacatggaccgtttttgcatgtgcccattttctcctccgtttatctccctcacattgtctatttaaaggcgtgttcccatcctccactggtcatttcttcttcttttctatttgttactttctcggctcatcttccgtttatgcaccacatctttttttaacatttttccaaacaaaaaatataccatacctatagtctttaggggtcgctgattacgaatccgacattcatttcgacccatttctaaactccgaattcgataaaagttgaaaatttatttttcatcaaaattcacccaaaatcgaaaaagaaccaacggcagcagaatctgaacaggagagccaatgacgactaaccaacggtctttcatgcatttcaatcgattttggggtaataaatgtgaattttggtgaaaaatgaattcgactttttattcgaattcaggtccggggttagaaatgggtcgaaatggatatcgggttcgtgattctgatcagcaaaacggatcatccgtcccgcagttccgtcccgggccggttccgtaaaaagtacatatttcaataaaaattttatataaaacaaagtacaataaatacacgacttgattgaagtttttggtgtacttcgtctttctatgacctttttacggactttattctcatcttctcacaatttgttttttcttcatttgtattatgtgaatctcttttatgcaattacggtttttgttttgtgtttgaatacaattctgacatgggttcgtccacgtcgcccccgcaaaatcagtattttttcttttcttgcatttataagattctgattaacaaagcatttttaaaatggggcagaaaatgcgacgacgacttaccgtattcattgttctggtcgtactgctcgcgtcatacggtgggtgctgacatttttgcacttgaatattattattgactctcagtttagagaaaaataaattttaatttttaaataaattaaattaaattgttccttcggcaggtgtttgtgcggaaggcaatgcgactgctaatgagccgacgacagtttcatcctttgacacaacgccaacggaacaaaatttggcggaagaaacgaaaagcagcgaaagcacaacacccaaaggagaagaagccgaagtgacaacagaagtagcagtaattaggaataataataatggaccaaattgttagttaattaattaatgccgaaaaattaaaattaaggcaaaaaatgaaacggaaatcggagatgacaataaatcggcacaatcagagcacgaaaatgagcatgagaagaagccgaacaacgaaatgagcagaatcaacgggggagacgaaacgaatgaaagggaaacgaataaaacggagtcagaggaaaaggtgggcaattaaacgctaattaattaatgagtgtgcaaaatgaaatccaaaataggaaaagcaaattggcacaatgccaacggaaaaaacagacaatgaagaagcgggaaacgcacaacagcgaaaagacgaagtgacggaaaaaagtgacgaaaggggcgatggaagaacaaaagagaaagaagaggagggggaaaaggaggcgaaaagcactgaaggaaaagcggaaaacgcagagaaagagaaaattgagacaaagaaggaagagacgagagaagaacaaaaagaaaaaaagacggaggaagagaacgaagaacacacgacgaatgagaaggaggcggaagg

SEQ ID NO: 50 - DNA, 3744 bp, Heterodera glycines
  misc_feature (3592)..(3594): n is a, c, g, or t
  misc_feature (3596)..(3598): n is a, c, g, or t
  misc_feature (3601)..(3601): n is a, c, g, or t
  misc_feature (3625)..(3625): n is a, c, g, or t
  misc_feature (3629)..(3629): n is a, c, g, or t
  misc_feature (3635)..(3637): n is a, c, g, or t
  misc_feature (3644)..(3645): n is a, c, g, or t
  misc_feature (3686)..(3686): n is a, c, g, or t
  misc_feature (3706)..(3706): n is a, c, g, or t
tcatttaaaattatgattttttagactttgacgggacaaattggcaacacaaagtaaagacgagaaagccaaaagtcccaatggtaaaaatgatcagcagaaagagctttttaattgttaatttagtaggcgaaagtgaaaaaaaaaaagccaagggtcgaacggagaaggggaaagaaaaagccattgttttcccaacagaaaacgcagaaaatggcacaacgccagccactccagaaaaggcatctttggcacttttccgagattaattacaatttaatttagcctaacattggcaatgccaacgaaggagaggaggagaaaatgccacagccggaacgggcacagatcactcacatgagccgagagggggacaaaatgccagagaaagaaaaagtgccaaattcaaaaatcaaaatagaaaattaaaaatcataaattaattaggcgaattccaactccgacactgctgaacaacaaccaaagcatcagcacgaactcgaaattggtcagttcagaagtccgacggcggaggcaaacgacggaagcgaaggattcgaagtgataacgcgagaagagaacggaggacaccaaacggaggagggagaagaggaacagaaggccaacgaaggcgagaaaatgccaaagtcaagtggaaatgccgaaaacacaggtcaaggagaggggactcagtcggctgcgaccaccacaacgtcggcgttggcatcgacgacaacgacaagcgaaactgaaacggcaaaacagacggagcggacgacagagcaaccacaatcgtccccaagggaagaaggcgcgggcggaggagcggccaacggacccgcggacacagaagtggacattttggcaccacggggaccacccgccgcgggtttgacagaaagacaaaaatggacaaattaaaaatatatattaattacagatgaaacagacaaagaaaaaacggaagtgccgttgttacccgcggaggagaaaccgtcgacgacggcaccgacagaacaaacgcaaacgacgccaaagacaacggaggcggaagaagaacaaacgacgccgacgccgacaacaacggcaatttcagcgggacatggcgtcgaaacggtggcggaagaaacttcggaaaatgcgcaaaaggaggcggaagaggagcaaacgcaacgaggcaattagaaacaatgaaaagcaattgaaattgaaatgggacaattgggtaaaaagggggggggggtaattaaattaagcgaagggtcattcattccgacaaaataaagacacataattaaactaataatggtaattaattaaggggatttgcccatcgacgagacgacaaaaacgaaaacagaagcagaggaggtgaatttgttaaatttaaataaataattattaatataaaatataatgattttgccaatttaaaaattcgttttccatttttcgaacgaaacgacgccaattccaacggcagccgaagaaggcgaaaagggagggaatgaagtgaccgaaaaaagcattgagcaaacgacgggacaaagggaggacgaaacggcggagaaacacggcaaaaacagcggaaaatggcaaataaaacgaccgttcgcctcccaattcagaattggaactcgcccgagccttccgcactcccttccttttgcgcctctccaaaatcgaatggcgtgccgaatttggcgatctgtcgagcggagcggcacggaagttgcaagagcaaatccgagcagatgtaaggcgattaaaccttcattttaactcccgccggaataaatccttcccatttctcagctccattccgcactctccgccgccattggtcccggctttttggactatcaaatcgaagcattgcaccaaggctcagtgattgtggaggggcaattgttgagccgagaagagataagcgatgcccaaagtgtggccatggccttggaacaggtgccattgagaagaatttgaaaataaatccgagtttatttggttacttcgcttaggcaattgtctcccgaggcggcgaattgggcggaaatgcggtggacacggaagggatcagtgtggcgggtaaccaactagcgatcatctgctgatcagcttatgattttcaaaattcacattttcaggccttcccgcccacgggccaaatggtaacggagtggcagcgaaccaaaggcagcaggaggaggaggcaagccaattcggaagcaaatgctcatttctcggctttgaaattcaggccgagagtaccggctacatcatcggtggtgccgtcgtcgtcggcgttctcatcgtcgtttttgccatttttgccattgtcgtttttggggtaagccatgggaagaacgattttgacattattccattaaaaagaaatgcttcattcgacagatgaacaataggcggaacaatggcactttgaaattgaaggaggaaatttgcatggtcgaaaatgggaaagggacgcaagcgacggggcaccgattcaccacaacggcggatggaaatggcgtcaatctgtacggactgactgaaattggcattttgagtgattaatcaatgctttagcaccggactgaggacgacaatgcccggcacggacagtgccaccaacggacaaagcatcggcggaaggctcaacggaatgaacgggcagcagcagccgatcatcctaagcggctcgcaattttccactccgtcggcgtacacttcagcgaacaacagaccctgaggggtggcgatcggatcgcccgctcggtgattgatcagcggattgtgatctttgaactctgatcatctgacggggatacggtcaatgccatcggtggtcctttttatatttaattgatcaaaatgacggtgatttgaattgactgtgtcctcatttgtcagttgcattattatattacgtgttgggaaaacctttgacttttgaagaatttgctaattaattgagttgtattttccttttcccaacaatggcatttctctgccaattaattccattgacttttttctgatcgcaaattcatttttattctctttgatttcccttttattagacatatattttccataattaatatattcttttgctttttctcggtgtgctcaatcacacaaatattttgaccatttctgctgttaatcgcttttaatgccaattcattgttaaatcattataaaatgaatctttccaatttataaatcatatttttgtcttttcgacgaattccattcattaattaatccatcaaatggcatcattttaatacattatccaaaataataaaaaatgtacatataaagaaaaattaataaatgataaaacaacgaagatgggaataataaaataatagaaaaaaggaagaaatttaaaataaaaataaaattaaaaacttaaaaaaatttgcgtcgaatcaaactcatttcacattaaaaaaagaagataatacaaatttataaattgttaattaattaattatattgatcagaaattgaactcaatttatttaattttacaggtgctgtggcgaagtgacaaaaaggcaaatgagtggtgataggaagnnncnnntcntttccctccggcctcgttcttctnctgnttcttnnnttctttnntttccaatcgaatgaggagataataataataaatatattanaaatatgacactgttgtctnccacgaaaaaagacacgaccaaataatattttgatgac

SEQ ID NO: 51 - DNA, 1999 bp, Heterodera glycines
ctgttctgtctgtctgatcatctccgtctctttttgtctgaacagcgtcgacctgcatgtaattgctgacaattttgtaacagtttctcatgcatggccccgacagaaagcaaaagtcgggcgtccgtttggtggcacagtgcgcccggcaccacggctcgcactcgtcgaagctgacgtaccacgagtggtgcacgttccgtggcgtgaatttctgcgcgcgccaatccgtttgcgcgacgggcaaatacgcctaaacaaatggcattatttaaaatcaaaatccaaatgtcatattggcatttccactttgggcaatcaatgttggcaaatgatttgcttcttcgcttacattgcattggctgtgccgttggacgaccattgagccgatgaacacggagaggagaagagcaaagcgatggcattttgtgaatttcattgtttttgatggttgttttttaattggatgttattaagtctctttctgtccacgttttttgcccaatttcgcccctttttatagccctccgtccgtccgtcgattcatttcggtggcgtggccgccccccgacgacgttttgcgttttgcgccggaaggggcaccgatttgtacggacggaagaacaaaacgaaacgaaggaagagaaggacaaattggaaagatcagcggaagaaagaacaaaagaaagaccaaaaaaggaggaggaaaatgggggaaattgagcagaaaattggaattttaatgaaattttgaaaaagttgcgaaggaaagaaaaatctttgaattgaattggtttttttgattgattggtcatgcaaaaggattaaagaaagggactaaaataaacagaacaaatccaatcataaaaatgagttggaaaaagcgaatgatttgaaaattgggcgaaaagaccaaaaaagggaaaaagcaaagatcagaagggagggcaatgaaaatgacctacaaaagaggaaattcttaaaataacaccaaaatgtgcagaataatgaaaagagaaacaattcaaatggaaagtccaaaattaattaaatttaaaatatttatgaaaatgccgggaatttttatgctcataaaagaactaattgaggtaaatgccaacatagcaatgaatgaatgtgccaaaataatgaaaaacccaagggaaaaatataaaagactcaaaaatttatttcaattttctcttctgctgaccaaactctgcttctgcttctgtgtgggccaatgctttttttgtcggcacaagttttacgccaattaaccaaattttgcaataatttgcgctaaatttaataaatttttttaacttcaacacttatttgcctgaatgatgtggcaatgatttgaatggaaatggcacaattttccctgtaaaattcggccattacgtgtgccgttccgccgttggactggtcaatattcacaaacaattgccagcgaattcgtccgtccataaattggcaaaatttgtccaattcgtttttttgctcggccgcgcaatttaccaaaatgaattttgaaactgaaaaatcccaatgagaaaactaaaaggcgaagaaacaattcaaattttatcaatttatgcaatatttgcttaatttacgtatttttaattttttttgatttgatgccgcacaatttcttcacaattcatttctgatataattagcgtttttaaaaaattagggaaatgatatgcctctggtgggagtcgaacccacgcctccatcccagtaaattggccattgagaatttaatttattaagcctaaatttgcccttttttctttaccaattttgaccatttcataaagtgctgctttttggcgactatcattgagaattcgctgaatcgcttctgcaccttttcatttgtctttccttcggcttacaaaagtgccgtattctccgaatggcactttttcgttcgctttctgtcgcttttttcataaattcgctgaattcgttattcgtttgtaca

SEQ ID NO: 52 - DNA, 1826 bp, Heterodera glycines
ccaattaaatgcccaaaaccaaccgcgccaaaacctccaaagtttgcaattgttttgacgcgaaatgttcgttattttctcctccaattcgctaaattctcttctttttttgcttaagaatgtccttttgctgttaaagttggtggcgccaatttcctatgccaaagttacctaaatgacccttcaaaaacgggcgtttttcgatgttaaaatttcatttaattttattttaaacattttgttatttttaaaatgacttagactttttcattttcagagaatttcatttttattgtctcatttttcttaacagacggacaaattaaatacttttcgcatttcttttttcccttttgtatttattgtggaaataaattaataataattgtaataatcaaataaaatatttgtgcaaaatcgcattattcttcttcatcttcttctctctcttctttggctatcctaaattattatttttttcaattaaaaaatgccaaattcgaattttcttaccaattccgcacagtttcccccgaggccatttccgcttttagctgaatattgtgaaaggatcccttctcaaagtccccttggagtttcgcttccaatttcttgctcagcttggcgttcagttttctcttaaatgtgccattggccttctgattgggcgccatttgaatgccgacgatccatgccaattcgcatattttcgatccatcggtctgacatttggacaaagcaatcgctttcgggaaaacatggcaaaaatcgacccaaaaggccaaaggattctcgacaaattcgagcagctcgtaacgaagtcgttttccgacaaatccgcaaaagtttttaacattaaacgaagtgccaaagcatttgaaaacgacgaaattttcaaactgaaaatgaaaaaataaagaaaatgtagcaaatagcaatcatgttgtactttttcactgaatttggtcattcgaattggtccaatgatcgcattttcgtcttttttgtttcttattttcgccaatgctataaaaaataattttttaatttgtattaaaattaaaagatttaatttttattttctttttaaattgcattttttattttttgcctttttttagttcatttttcaggacttttgcactcgaattgttcactttttcggcaacatttctctcggggaatgtcggcgtaattacggccattgccaattccatgcgaatgttttttttcgcttccttcccaaagttttcccatgcaaattgtctgcgccaaaaccattctctgtacggcgaccaactcaaaaatccgccgaattttttgtcgctaatttcggccaattggacgggcattggccaattcctgagaaaaagacaaaaatcaattaaaattcgaaatattttaaattattaccaatttgaaaaaatgagaaagaatctgtcgatgagaaaaggcaaagacgaatttgggaaaagaagaaccactttggaaagcatcagaagaagcatttgaccattaaaatagcccaattcgttgctcagaatttgattgtctgttgaaatcgccaaattaatcaacccattttaaaaattatttaattagatttattaaattcgtttttttattcatttttactttttgcccacttctccaaataagccaaaattgtgcgaaatttttccaaagttttggtgccaaaagcatcggccaattcaaaacgctccaaaattgccaaataattgttttcaggcaaaataaattgcaacactttcaagctggtcgcatcgaaggtataatagaaacattaaatgacattaattaatgat

SEQ ID NO: 53 - DNA, 2181 bp, Heterodera glycines
  misc_feature (76)..(76): n is a, c, g, or t
  misc_feature (2131)..(2131): n is a, c, g, or t
tccctcatcaaaatggtcatgtcttccaatttgtgaatgattgaccaaatttcatcaaaaatatttccgtttgttntgcgctgaaatttttgcgcggaattcgcgcgaattttggaatttccaaaaatttcacgtcaatttgcatctgcgaaaggccaattagtatcgatggaatgttcgaaaattgactttttgggtgtttttgaatgaaaatcaaatttattccctaaaaacaattaaattaagaaaacaattggcatttgtttttaattattttttatttagttttccatgactttgcaaagagcacaaaaaagcgaattgtctgaacatttgtccgctctttgctccgttttttcgtcacaattcgattccccaaaaattaatttttcttcaaattcttccggcaaaatgcaaattgtcgcaaatttgctgtgcgtatccctcaaaaagaataaactcggaaattgaaagtgcgccgcgtcggactgaaattttttgtttatttattttttattttttgggggggggggaaattagcattaataaatttcaattttgattattaaaattacccattcgtcaaatatttgttttatttcggccatttctcttccatttttttgtccgttttttaattttatttcttttttcacctgaaatgtttaaaaaattttttatttttctttatttttattactttttcagtttctctgaattttctcttcttttcttccgctgaatttaattcttggaatttttctgtttggaataattgtgaattattctctttaaattggcatttgtccttctcttcggcaattgttgttaaattcgcattgtttttgtattcataaaataatttttggtctgatttttttgggttttaatttacgctaaggttaataattaatagaataattaaatttaaattcattaattaatttatttaattttcacccagttttcgctgtgcctccgccctttttaaaaattccaaatttctttcgaatttctctaaaattgtttcactttttttctctgccattgtgccgttataaaggttcaaaagtgccatctttttgctgctttcgcccatttcttcccaatttttcacttttccctcttttattgcctcccccaattttcgctggtgcaattgtccaattatttggtcacattttgccccacctttttccctattttcccccattgcccccacaatttccccaattatttggcatatcttttccaaatgcttttcctcctttccctctctctctgcctgcgaatattccgtccttttcagcctctcccactgttccccaatgcttttcctttggcttccatttgcctcccattccttcgcttccaatcgatttgaaatttcgttagacaaaacgccaatgtttagcaatgcgatgctttttcccatttcttctgtgtgctgctcattttgttgttgccctttgttaattatctccaaatattcgtcgtatttcgctgccaaaaatttgccatcgccaaattccctcattttcattttccgattattttcgaccaaattattctcgccaatctccgtaattccctctgaataggcccccactttttcctcctctctttcctcattttcttttccttctttctgatcacttcccttctctaccgtaacgttttctaccgtattcggccccccctctctctcctcacctattacggtattttccttatcctttcccgctttttcctcctttctttcctcgttttcttttccttctttctgatcactttccttccctaccgtatccttttctaccgtattcgtcccctcctctctctcctcccctattacggtattttccttatcctttcccgctttttcctcctttctttcctcgttttcttttccttctttctgatcactttccttccctaccgtatccttttctaccgtattcgtcccctcctctctctcctcccctattacggtattttccccttccttttcctctttttcttctgctgctttcttttgctttttttgcttcgcttttttctttttccttttcactttcacttctttttcttctttccttttttcaaattttcttccaatttttttacaatnccattaaatcaattcttttcaaatttccaaatcgtttcttttcccaaatg

SEQ ID NO: 54 - DNA, 7943 bp, Heterodera glycines
  misc_feature (75)..(75): n is a, c, g, or t
gaattgtttgtccctcttattaaatccgttaattgtttccacgtgtttttccattaattgctcctctaaatcccncaatttgtcttcatttgttccttttcttttgctttcttcgtactttctttggcttttttcaattatttttctcatttccttctccgttcccttcccaactttttttgcgttttttaatattttttcaaaaaataaatttaattcatttaaaaaattcatttgaaatattttaatgtttggcatttcgtcctcattttcgtcgaataattggtcataaaactgacaaagcaacaattttttacgctcccaaaaagtggcaaaacgccgtgcgtccgttgaatgatttccaatttcaattgtttttgaaatttttgcatcgatccaacggaaaaaaacaaataaatccaactgaaaaattaaataaatttggcaaaaaaagggatgaatgaaattttaaatttaaaaatttattaatttttcaattgaaaatgctttcccactttcagcttggcattcagccatttcattgaattactcgccacaaaaaggtcaacgtaatgtctaatcaacagattgtcatcgctgaacagcactaaaataaaccaaaatttacttcgaatgtcgtgcattttaatgcctaattatctcgctaattgcccttaattatcccttgcctttcttttcgccgttcgttttgccttcgtccatccacaacgctttgaccttccaattttcgtctgttatgtccggcaaaagttccctcaccgtttcttcgctattaattttcagtaatttaaaaagtcgagtctttgcccccggtactccctcaattttcgcgcgaagactttggaaatgttcgggattttcatcaagaactttggaaagatttgcagagaaaaccgcagcgaagtgcgaaatggcacttaaatttaagcaataacaaaaaatggttttttaatggcctccccccgcttttccctcccctgctaattcccggtgcctccccctattccgctgctaatgccccccattcttccgggtgcccctccccttccgcttttgtccttccgtgttccgcttcgcttgcctcttcacaacttcctcctcttcgcattttcgcccgttccattcgcgcattacgtccgcttttcctactttaagctgtcccttgtcaatgctttccgccaaaatgaaaaacataaaaagcggacagaatgcctttctcagcaaaaggttcgtttcgttcgctttggccaattgcgcgtaaaatttcaccttttctctcccaattatcatcagtaaaacttctccaattgttttttcttccgccgttttggtgctgtcattctcacgcaaattgtgctcaatttcattgatggcacccaaaagaaaaggcgacgaaattcgcacgccggcattttccgcagccaaagtgccacttttgaattccaattgccgaagcagcaacacaagcagatggcttattgacaaatgttctaaattaggaattgaccccggctcccggtaaattggacaccggaaaatttgacatcatttcatataaaaataaataaacaaaaattttggtgtggcctaaaaatttttattttagtctgcacatacctatgttttttatatgcttaataaaatggaaataaatcatttgaaacatcggcagaagaaagccagttttccgttgtccaattttcctttggtgtccaaaattcggcggtccccattgacccctgcctcctctccacccattccccctatttgggaaaatgagcaacaaatgcacttccttcgcccttttatacgttccgccgtcctcggcttttgatcgccccccccctcggctttatccttatattagcaagtgcttattaaccgtaatgcatcacttcggggtgaaccatctccaatttgttcaggactctgtgcgaaacggttgagctgatcttgtgcttcatccataaaatgttttcttcggtgccattggccaaagtgtcgcgcattttgccagactttccgatcagatgggctaatgctaacaaatggacgccctccatcagctgaggacagtgaaggcgaacttcgttcaccaattcgtcggcttcgcttcggttggcacagtcaattcggtgccattggcgcgggcggtcggccaaaagaattaaacgctaaaataccacattatatggtcatcttttaatttaaattgttcatactccgttggaaatctgctcaaaagtgtcctctccaaattgtgccacattttctgccaaatttcgtccccatttcccattcattctcattaatttgtcgtcctttaccatttgataaacgaattggtaaatttggcacattttctgttccaattttccttcattttcccttccgattgtttttattttgtcccatttctttttgtaagtgccaatccattcattgaaaatgccattttcccactttaactggccaaagttgaacagtccgtcaacgcagtgccgataatagaaaatgatcgctctcatttcggtgtttctcattagtccgatcttcgaaagtcgcgacggatcgtcgtccatttggcaaaacaaattgacgaaatgatccgtcagagaaagcaaatcgaaatctgagaaggaatcgcaacggcggattaaagcgaagacacaattttgaactgacccaaaacagaaaaagcggaaacattggcagaggagggggagggaacggccgaacgccactcattttggcggtgatcggccaacgcattgtcttccgtctgatcacattccaaaatttcgccctccttccgatcactcattctttttgcgcattctttggcattctccggtgccacaatttctttttgtttttttggcgcttcgtccccttcaaattcgtcttctcttccgtcctctccttcttcgtcttcttcatccaattcttcttcactctgctcaaattcttcttcgatttcttcactttcttcgtcctcactgaaataatcctccaaattttcaatttgcgtttttttattttcttttaatttaaaatctttaaaaagttcgtcgatttcattgacatcaaaaaattggagtaatccttcgcgaattgttttggagccaaacacattcagaacttaatttggaaatgctttattgactataattattatttttacttatccatcatcgttttttttggggttaaattatttcaaaatggaatttcccatttgtttttccatttttcccatttttattttccgttttttatttttgtttttccctcctccgtttgttcttcgcttaccttcgctcaattggctcagttttccgtttttcagcagttttctcatttcctccgcgtgaatttggcccacccaccgtttctttgcctcaaattcgccgttttttgcctttttcgcctcttttttttcctcggcaattaatttccatcgttcgaataaattttcgctctttttttcggtcccttttaatttttccaccatttttttcgtcccccaaaataatttttccaaaaattcctccccgcccattagcgtcgtttcttcagcgtcaaaaatcggattataaatctgatcagaaatgtaatttctgatcagcacaaagtgagaattgagccggcgttcgaccgtaagtttctgccgaagccatcgcacaaacgccgccaaatcggcgccaaatttgtgactttttcgctcgattttgtcggctcggcacatcgcttgcaaataatgaacccagaaatcatcatcgttggtgagtgctgagaaaggcgaatgatcatagtttattgttaaaagactttttaccattattcacaaagagttgtgccaaatcgaaatgttccgtcagttggtccgtccttttcactgtgccggccaatcgcaaaaggcgtatctgtgccccggggtatttaagtgccgattggactttggtcttgtcgatcatcaacagctcggcgatcgcagcagtgatcagagtgccgagtcgcgtgcccatcgcctcggccatcgcctgtctctgcactcgccactcttcgcattcgctcgtccccaatttcttcaccgcttttttcgtcacattttccgcctttttctcaatgttcacttcccacacaaagatcaaaattgtgttcattacgcacagttgggaagtcgagccgaagtgccggagggcatcttccgccgcggcattcgctttgtccgccagcaagcgaagggcgggcgacgctttgggccgagcggtggcgccaaattgcgagtggagacgcgccatttggtcgaccaacagtgccgtgacgaacagcacaaagttgttgatgtacagctcggagttgcttcggttcatcagcatttgttgaacccgataaacgaccgatttcttcgtcaaaatatctttaaaaagaaacttttccttgtctaaaatatttttggcacttaccaatgcgcaaaacctcggggaattcgttttccagcaaagttaagtatttgccatttgtcaagtgatttaacgacactttcatttcatcgccttttagcacttcatgacaaaaaaagtgccgaaaactttcatatttcgccaaaagttccatcaaagttagccctatgatggggaatatccgcggggggttggtcagtcgtgccatggtttgcataatgccaattaaattattacaagtgaccgtttctgccttaatatgtttcatttcattataatccattacgttatttattaatttggcagttggacaattagttaattaacctatttaactctcattatttaattttttgtcctgttttggccaattagtgtccatttccccctcccactttgagaatgtccgcgatgtgcttttccttcgcgtattttctccatgcttccaccattaagctgcctttttgtgccgccgcgtgttttgccattccttcgaccatttttgtgcccaattcgtacattaagcaaatccacattaaccaattgttcattttgccgtccattttcttttggcccgctttttcctcaatttctctccgtttgttctcccatttttcaatttcctcaataaattcccctttttgctcattttttgtgccaatttttcgcgcaaatgccaaaattccgccgattgtccgctccaaaaccaattttagtgaattgattcgcattttcaacttttccgttctcttatttttgctctcattgcgaataaaatttttaaaaatattcattaattcaattctttcgtcgtctaaaaatagaaaaagccttttttaaatttaaatttaattcaaatgccaccattttcttccgtcgctttttccgttcgctttttcccctctttttcggggcatcggtgcctttcgtcgatcactttttgttttggcggaatgttccacagcgttttttgctccgtttcttcttccaatttgttttgcttcttccattggtttttgccgcttaacacaaaatttgataaacaaatcaaaaaaattaaaataaataaaaatttgacattaattgcggcaaaattcgtttgttttgttcgttgttcaaataccatttctgaatttaatatttcaaaaataaattataaataattctaacgaaaatccctttctttttcttttttaataaatttatgcccattaaaaaataaaataaataaatgaaaaaattaaaaaataaaatttttttgcgtggaatcaataaaacccacaattttatattcaaatgtttgcttaatatttgttggtttttgttgagaaatttaataaattagcatatattcaaacaaataattctttttttttcttcaggacaaaacattgcaatttcgggagattttttaaaataatttttgaattataattaccattcttttaagagaaatatttttctcttttataataatttattttctttcattgtgtcagtaattttaattaaaaatcactgataattaattaatttacatttattaataataataatattttatggtttattttcacaaattaatgtcaaaatgagtttattattgtccaaattgaccacgtggagataaaaaaaagagttgtgatatgaaaaatgatcaacaaaatggcaaattcattctcattcatttcgattcactaatcattcgccgcttattttattctttcgtttttaattcgtccattttatttattatttatttatttttcgttttattttttaattacccattaattttcgtttttgttttttaatctctgtgtcttccaatgcctttttttaagttttcgtttattttctgatcaaaaatcattgatattcgttcattgctccaaatcagccgaatatttgtcttttttgcaattattccataatcttcgtcccatcattccccaccccccgtaattaccctaattaccttccaccttcccccgctaagatcgaataatcgttcagcattctgcgcaaaagcaaaaaaaaacaaaaactgataaaacaggacaatgcttaatcaacaaacagcgcaataagcaacataataaaaaaactcgtttaattatttattttattaattattttcatcaaaaaatatataaaaaaatattcaaaattgacaatttttttgataaattatttcgacgtgaattgagtgattatcgctccatcagcagacacaccaaaacattcatttttctctctctgattgactgtcaacgaaatttctatgaaattgaccaaaatgtcattgagacaaaatttgggaaatattttttctcgcttcgctttttccaaagatttttgtctttttaaatggaaataatttttaatttacaaaagcaattaaagcgcataaaatgtcttctccaaatgacgtcgagcaaaatgaggaaaaagggccaatgaaatgccaatcatttcgatggcattccgatggggcggaggacgaatatggacgatatccattcactgaatatccgtaaattaacaaaataagcagattaattatgtgaacttatttttagaaaaaagcgccaaaaaattttaagcacagttttggaagcgatcggaaacactccgatggtaagggaaaagcaaagcgaaatttaaaaaagaaataaaaataaaatgctttttaaaggtaaaactcaacaaaatccaatcagaatttggcattgagtgcgacatttgtaattcgattaaaaacataaaataaataaatccaaatattaaattactttcaaagattgcaaatgcgagtttctgaacccgggcggctctgtgaaggacagaacggcacttcggctggtcgaaaatgccgagagagtgggccgacttcgcgcgggaatgaccgttattgtgcccttctcgggcaatgtcggcatcggagtggcgatggtttgtggcgggcattagccaaaatcccttcgggggaaaatggcacagagaaaagtgtcaaaacgaatgataggcgaaaggagcagcaaaagttttatatacgtgactatttttatgtgtgtgctatccgcggctatcgctgcgtcattgtgtcgcccggggggacggcgaattggcaaatcgaattggcgcagagagcgttgggggcgcgcgttgcgagagcggacgacgccgcgggggacgacgaggaaaagtgccgaaggaaggcacggcaaattcagcagggcattgtcaattccgttctgttggattatgtccgttttggggaccaaaagaggggagagattaattttccaacaaatatactgcagaacgaagccggcaccgcaatgtgccattttgacgggacggcggaagagattttggacgcgttggacggtgccgtcgaaatggtggtgatcggagttggtaaagcggcatttttaaatggcaaaagaaaaa

SEQ ID NO: 55 - DNA, 2346 bp, Heterodera glycines
  misc_feature (1666)..(1666): n is a, c, g, or t
cattgcttttcatgccatttccgccgccattggcggcacgcctttggtcaaattgcagaggctgccgagggaagacggcattgaggcggaaattcgtaatgaatggcatataatcaaattggggatgtatcagtcaattactattactaattgagcatcgcttcagtggtcaaatgtgagtttttaaatgccggtgggtcggtgaaggatcgaattgctcgtaaaatggtcgaattggccgaagcgaaggttggcaccccaattttttgggaatgtccgtcccgatgggtccgaattacctcagggcattctccgtgccggccaaagtacgatcattgagcccacctcgggcaacacgggcattggcctggcactgatggccgccattcgcggctaccgctgtatcattgtgatgccggagaaaatgagctgggagaaggagtgcgttctgcgcgcgttgggcgcccaaattgtgcggacgccgtcagagaagggatacaccgatgcggacagtcacattggggtggcattgcggctgcagcgggaaatccccggggccgtcattttggaccaggcaaaagaagcgggtggatggggaaacacgccacgggggagggtaacatccgcagaacagtaagtaatgcaaatagggatacggtatcaaccaaatagggatacggtatcaaccaacgaaaaatgatgggaaatggcacgggggagggcgaatcccttacagtaaacgaggatatataggcaacaaaagcgaaaatattagatacattaaacagagtaatttcagtacaggaatgatgggaacccactcgcccattatgagggaactgccgaagaaatcatttgggcatgcgatggcaaattggatgccgtggtggtcggcgccggcaccggcggaacaatgacgggaatagcgaagaaaatgcgacaaaaacttccgaattgcaaagcgagtcataattaaatgcattcatttgagtttggcaatgctttcgctgttatgtattcccttttagatcattgccattgatcccgagggttccattttggccaatccgacaaatcgccaaacgcacgcctacgaagttgagggcatcggatacggtagctcaaacgatgcattagcatttgtgccacgaaattttttgcacaaataagcaccaccaacaaatttataattatctgaagttatgcagcgggggattttcggggtaataattatgaatttcacaattattggcctaaatgggaggctatgcgatcaatcagttagttaattaaaggccatttttaccaagtgtccaattgtcccactgttttttgtctgattttctccctatgccttcccttttccgccaaattttgctgttttgccggttttaccattgtttaactaatcaacctaattccgttctaataattacggcaattagctttgtctgttcctttgacttttttcatgctaattgtcccttaaattggtccattctttgctcattttccctcttaaaaagactttgtgccgtacaccactgatcgcaatttggtggacgaatggatcaaaacgaatgatgcgaatgcctttcgcaccgcgcggcgactgatcagcggggagggattgctgtgcgggggttcttccggcgccaatgtttgngcggcgatggaagtggcaaaacggatgggcagagggaaacgcgtggtcacaattctgccggacggaattcgaaattacatgtgagcaaatgaagagaaataattacaattgttaattaacataattaggagcaaattcatcgacgacgaatggatgagagttaagggatttgaaggaatttgaaaaaggggacagaaaaagagacggctgaagatgaagataacggatgggaaagcaatatgccaaaagggaaaaatgccaataaccaaccccttgtgatatatttaatttacaattaattgctcaaattttaatcgtggctaatgagcgaaaaacggaaaaagcgacgaataaaacgagctgttcaaacaaaaagagacattggcaaaaaggatcagtctcttcagaaacgacaattatatcacagcacattatgaaagcatttcatttccatcgctttttatttgtaagaaaatttacagaaaaaaacttcggggaaatttggttttttttcaaaatttaaatagcgatagatggagaggcgctgctggcaatgttttaaaatttcggaattcccccccccccccccccccctgcaaagaaataaatgtgtcgagattgaaaatctctattcgagaatttctcgcgttttggggactctttgttctaggaaaaacccc

SEQ ID NO: 56 - DNA, 2297 bp, Heterodera glycines
  misc_feature (2221)..(2221): n is a, c, g, or t
  misc_feature (2228)..(2228): n is a, c, g, or t
  misc_feature (2241)..(2241): n is a, c, g, or t
  misc_feature (2245)..(2245): n is a, c, g, or t
  misc_feature (2284)..(2284): n is a, c, g, or t
ataaatatccaaaatttttggattttattttcggaatcattcatttgcctattcaatttcaacttaattggaaactctcatcagaaagtccatttattcgttgttttggagacttggttcaatttcacagatgcaaaaatatatttttattatgaatgaattaataaattttgcatgggttgggcccaattccttggccattcaatggcctaaaatgcaaaaataaatgggaaaaaattaattggattaacggggatttaaacatgcggaggaaaaaggtgcgaaagatgttaaataattatttcgtttatttactcattaaaaactttggcattctcctcttaaagagcttagaaattttttggttggacaattcgtttaaataaattttaatgcaaaattcagatgattaaatttgtttcgaaataaaatcattaatcgaattaaaaatgtaaaaaaaaataaaaattgtccattagtgatgaattgtccatcagtagtggtgcacattgtccggattcgtctcacagaatgattcaaaatttaaagtgtataaaaaattctaaattttagggcatatttttgcttgtaagcaaaattatcattctgtacagttcgaactttaagttaaggttattctagtgcactttatgagtacaatcaaaattagtatcttttgtcaaaaatggggacggacggcacaacgaaagttttaccgtttttcgattaaaatcgaaaaaccgaaaaaaccgccgaccgtaacattctctaagaaaaataactttttgaatggaaagcctaaaatatagatgaataaaaagaggaataccatcagcagaccttattgccatcgtatggaaaatcggaaaacgaatttgacgaggcgttttgccatccgacagtccgtttggtgagctttaaatagggcgcggattttcagtcattttgttatgttttttttggttagccgacttttgcgccgcggacatttgcgccgcactatttgcgccgcgacacttgtgccgctcagcaaaaaagacaattgcgccgcggacatttgcgccgtgccatttgcgccacgaaatttgcgccgctcattaaaaattttataagattgacccaacaatttttctaaattataatcgattgatattcaatcaaaaatcgcgaaataggggcgaaaaattaaaatattgtttcaaaattaaaatcgatgtaaataactttttaactattttaatgacaaaatacatacataaatttcatctttttttgaataaaaagcaaaaaaagtaagtttttcttacagaaaacatagggggggggcattaaatgaagtatttttgtgttaaaaatgtgtttctcttttctcattgaattaaaagccgcagaaaaaataactaaaaacctaaatatcccccaccctactcatcaatttcaattattttttgagccgtgggcagtcaaaaatccgtgagtaggactaattcaaacagagtcagtctgtttagttgttattcttcttcatttttcatatttttgatgaacctaatcaatgttaagctttttaatgattaaaaataaaaaaattaatgtttatctttaagtagtgattttttttaaatttttcacttcgttattttcgtcgttggttattagtaatcttattgatattagtgaaattgaaatgaaaaatattatttttgactgcgcggcgcagatgtccatttttgctaggcggcgcaaatgtcgctacgcaaatggagcggcgcaaatatccgtggcgcaactgtctgaggcgcaaatgacgcggcgcaagtgtcgactttgctgagcggcacaaatgtccatttttgctgtgcggcgcaaatgacgcagttcaatgtcataaaaaaatatttatttcttatttttatttattctgatttgagggtagtgagtaaattttgttatcttaaattactcataattttgaaattttatgatgtcaatattttatatagaaattttaatgtttggacaaaaatctgttaaaattttttggtggcgcctatcggcagcgccgggtaaataattaaataaaaaaatttattataaacctttaagaaaaaatgtactaacaatatgaagttataatttttttattgtaatataaattttaaaataacattaattttattttgtttttgatcataaataaattgaatcattatttatttanatggtanatattgcaattanatanataacacttttaaagattaattatttcattttgcaactntatgatttgatat

SEQ ID NO: 57 - DNA, 1284 bp, Heterodera glycines
ataaatctccatattttgtatgcaataatttgattaaaggtggttttaacaccggaaaagaataataaggaattaacaattaaattaaaactttaaaaaatgaattaaaaatactggaaaagtctcttcagattaataaaatattcaacaattaattgtaaacaaatttcaacattaataaaatttgtacaatatgcgaaaccaaaataatttaataaaaaataaactataaaaaatgttaaaaattaaacctttaaatcagttttcacttaatttgctttatgggggaagaataataaaatttattcaattttatttaattttataatctagcaatatgacgggggatgaggatgatggtaattaaatgcattaattaaattaataaataattatgagagttaaaatgaaaaattaatacaacataaaaacaatcaagattaaagaaataaaatattatatattgggttcaagaggataaaattataaaagcaaaatatatttacaactttatattttgtgagagccacagagacaaaataattttcaaacaaaagcaatttatttaataattttttgagtttttcaaattaatatcatctaaaatattttgaaacgaattaataaattaagccaaaaaaatactactattaatataaacaaaaactgataatcgtcaaatttgactatttagtgcttttcaaaacagcttttttcggtgcgatttttcaaaaaactaggaacagagatgcaggattgcggactgggatcccgcaaaatcacgcgcgagatcccgtcccgagctggtctctatttatatcaattataaacttttatattgaatttttttaaatatttattaacatttaaaagataaaatattaaagagttaatgaatatttcgagacaaaaattaatggcgaatttcctttgatactaaaaagaggaataatgaaaacgaaataaaatctaaataatttaaatttgtaagtcaaaatcaaaacaattaaaaaatgtatcaatatgttttaagaatgtccagatgctcgaatttagattcattttttgaaaatttgagaaaagatgcatttttttaaatataaaattcagaaaaaaaatcatcatgaaatattcatgtaaataataaaattaaaaaaaaaataattataataaatgaaaacaaaatttttcaaaatggctggaaagttagtccataaaaatctctatgcattttgacaagttataataaaaatgaataattaagcaacaaacaacattaataaa

SEQ ID NO: 58 - DNA, 5486 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaaaatgaaggaggagaaagggtgggggcaatgaaggaagggaaaaaagttgaaagaggggatgcatataattaaaaaaatatataattattattttaaaattattagactgtgagtttcttatgggacaaaaaatgatttaagatcttaaagtgaaatttatgtttgagtaaaaaatttataagatcttgagactcacaaaaaggtgtttaagattttaatttgaaatctctccatgcttagttataagacattttttttaaaagttggttgtctctttttataagttgtttttttaatttttaaatacattaattatttttttcttatatatttttatttaattattttttcttcaaatattaatgaaaagtaattaaatggatataaagataagaaatggatttaaaataataatataagtaattaatatatttaatgtgattaattaaattaattatttttttaatatacatgaattaattgaaaaaatcttataattagagaccaagaaagacatacttgtctttcttttcttctcacctctctttatattgtaagaattgtgaaaaaaaaatgaatctaaattatattactttaatgtaactctggtcccagacaaacaaaccggttcatctcgtaacttatcagcatgttagtgacaatggagttcaggatgtttatgactcatttcactacatccttaattttaactaaaactaaataacatttccttaagacagatctttagacaaaaagaagtggattcatctcacattttaaaaactaaaaatataattaagtcttttttatttttatgaacaaattaaaccaatgtacatagacgtaattgttctttagtcacggtttatgcatgtttttaaaaattcgtttatttttatttatttataataaaaaatcattttaaataaattaaaattcaattataaataattccaaactttttttacccacatgtcatgtaattatcacttacttcaatttcgtctttctttggctttttgaaaggttcacgacatattaatgaaagtttgagagtttaattttagatcatataaaattttatatcgttaattatttatgatttattatacatatattttttggataactattataagagtttaattttcaagtattattagtgtatatatttttatgctatcaatcatataaaaatcatttactatatgattcttaaaataattatcacaaaattaatattttttaactatatgacaattcatgattaagtgattgtgtaaacaatttttacactattaatatattttaattaaagtctatttattgaatttttaaaaataaaatataattattaatctaatcgcatcaatgagtgttcaaagtgtcattttattagtgcagtgagaaaaggtcattttagtgaagtaatagatgttgatgttgagtctggtcaaacaacaaatcaatagtcagcaaggaacggaagtaactgacattaagggctcatttaattacacattttacctctataaataaaattctaagttttaactatctaattatactttatttcatttaattacacatctcatttaatctattacgtacattgtaagcatgtaaaaaattaagggcatgcattcaattttttatactatttaatgtatatggacttcgggtgtctaagaagcgtttgtcacaaggtatgttaaacccggggttaggtaaggatcttttaattatagttagcaactagtagttggtttttgtaataattaagggctctatcatggtaggctgcattaatgatttccaatcttaagtttgggtcgaatatgtccaaggttgagatattcaccaatacttcgtttagcctaatgattagagtggtaaaaaattatgaatttgaatctcccactaatataacatactcactactaatatttacctataaaaaaaatcattttccataattttttcctcattatttttttaattggatttgatgggttttctttctcttttaagttttactacacataacaatagtaatatacttttcatgttcttttttttttttttacaaagttgttagtaaaaatggccaaaacaaaaatatgaaactccaagcaattaaaatttaaaagttaatatctgaacatgctttctgttgcgtttatgatgcatgtgagatcttaataagtgacctcacgtttgttaacctctacatgagatccattaaggcttagtgaataatggtgagacaaggtgtaagttaattcaatgtttcgaaccgggtctttgaaaaaatagacttaaattagaccaataaaaatgaagttatgacgtcatgatccatgttgactaatactgtaacactattatttcaggttggaaaatgttatttatactgatattgttaagcacagttcataaatagtttgatttcttaagtatgttgacaaaattcaattttatgattgtgtacataaaaagtattttattagaagaagtaaaactcatttcaataatttatagatcctagattaatcttgtgatagctatgggaaagtattgctttcaacaaaagaatatattttgtataataatttatataattaagggagatagatataaaatgtatggagatgttacgaagaaatatcaaacacataaaatgtggtatgaaaaaataatacaactactttttatatatttttaaatcaaactaatgtaaaatatagaaaatattaatttgatttaaatttgaagataataatataagtataacaatactattttaaaggcaataaaatttattaaaacataattgaattgggatggattcaatattatttttttaaaagcaacccagcatgagtcaattcaactttaattaggctagtttaggtaaagttattttgggttagatggttaggtcgatcaattacaataataatacattatggaaaatacaaaaagacaaaatattaaaaaagatcactggaatgaactacctaattagttaaactcattcaaaaccaagtcattcaaaatttaaaaaatgcaaaagccggttaaaacaataatcatgcacaatcagacagatcacatttaaaatgaaagcataaaataaacccctttgacttgaggacaattaaaatcaaacactccactttaactaaagtacaattaaaaattagtcatgttattaaagattccaatccatgtctaaattaaaattcaagttaaactatctagatctaacactattacaagaaaaatgcatgccctacagagtcacataatgatataactataataataattattttattattaacattttatgtatatcgagttgggccaggttatttgtgtttggaagtcattaatccaacatccaacctaattatacttgaattagctaaaatggatccaaatcaacgcaataattatagttagattgattgaacttgcgggctcatcacaattcacttacactcctaaatataaatggaaaaagatgtaaaaaaaaaatctaaatttaaattcaaatcaattttcatcgaattaaaattgactcaataaatttgacaacctaagtcaaaccaattagcttagtttagatatcgattcagttaatctattcctctcacttgaaattcaaatcaaattagctacatttgtttccgttagtggatttttttgtttattgcccggaatcaccagatgagccgatcaacattttttattttatttttatattaaacattttagattttagtcatttttttggtcctttttttatttttcaataatttttatattcttatgattttatttactgtctcaaaggatattgattttttcatatttatgatttatgacgtagttttttttatcatattttagataaaataattaatgagatatataaaagcgataattataaataaaaaattaaacaataactggtcattaaaaataaaaataaaaattgtaacttaaacagatatatatatttttttttttgtttccgcttcactttaatcgtggggaacaacacatacatgtaagaatttacttcactcgtaaaatacaaccactagaaaattaaaaataacaaagtcacattttttgcttccatttcacggatgctgacgagatcaaaaaacttatttttcaacaactgggaacattctaactcggagaatatgattcgtttttttttatctatattttatttattgttttagatattaatcacatacttagccagcttattgaccggagcaatgtattatttatatgcactgcttaatgatcaattgattaaatatttttatttatatttttacttttacttttttatttcatttttcaacttatttacttgttttatttttcactatctctttctttctagttttttaattttcttacagctgtctagctagcacaaagccagagcatagattcaacgttttcctttatttttacattgttcaacagccctgcatgtgctgtgcgttttttgacatttacaatgagcatatttgttatataggcagggcttgcacattttttttccctgactgtagatatatagatttttaaaatgtttattcggctgattttttttaatccttacaaatgaaagataatataaaaaattttataataactaacccatttttagttaatcaactaagttagactcccaactaataataatttatataaccagctaacctccttgccatcatttgatattttgattagaccataatgcaaattgcaaagagtgcatgtgtctaacttgctaacgatggttttcaagataccggttacataatttatacgcatcatattaaatatttttaattacttaagaagacacgtgttaaataattttatactttttatatatttctaaaaaatatatttttattttataatgtctaacatctatttaaaaaagagaaaaataccatatagagaagaaaaaaagatactatatcagtatttattcttaatgtgttttgatttgcagtaagatttgcgagtattttgacaggaaaggtcagtgtctttgaaggaacggaggagtagcatcctcttaggcccatttcctcgccctattcatcggcacagagaggagcacgaaggggaggggagcggcgcgtagcgggggaggtgggtggcggaagaagaaaagggtggggggagtatgagtatgatggtcaatatggagaaaaagaaagagtaattaccaattttttttcaattcaaaaatgtagatgtccgcagcgttattata

SEQ ID NO: 59 - DNA, 16040 bp, Heterodera glycines
  misc_feature (441)..(441): n is a, c, g, or t
  misc_feature (446)..(446): n is a, c, g, or t
  misc_feature (457)..(457): n is a, c, g, or t
  misc_feature (466)..(466): n is a, c, g, or t
  misc_feature (471)..(471): n is a, c, g, or t
  misc_feature (482)..(482): n is a, c, g, or t
  misc_feature (486)..(487): n is a, c, g, or t
  misc_feature (496)..(496): n is a, c, g, or t
  misc_feature (501)..(501): n is a, c, g, or t
  misc_feature (511)..(511): n is a, c, g, or t
tttattttaatttatttggagttatttagatttaatcttacctggggttattttattttattttatttttggggattctttttattttattttattttattttaatttattttattttattttatttaaatgtaatttattttattttatttgattttaatttattttaatttaattttaatttatttaattttattttattttaatttaatttaatttattttaatctatttaatttaatttaatttattttattttatttaaatttaatttatttaaatttaatttattttaatttattttattttattttaatttattttaatttattttattttattttaatttattttatttaaatttattttatttaaatttattttattttaatttattttatattttcagaacaattctgaggttttccagaattttgagaantgttntggtgtgtttnagaattagnagaantattgggaggntcannagaattttnagaantgttctggtntgtaacagaataatcagaacaattctgaagcattccggaacaatcagaaaaattctggtgtttaaattgtaaaaattgaatgcaaaaacacaaagcaaaacacaaggcaaaaaatcgtgaaaatactcgaaaacacatgctaacatattgaaacacacgttaatgtaacgaaaacacacgtgaaatgttgaaaacgcatgcaaacgtgtcgaaaatacacgtaatcgtgaagaaaacacgtgaaaaaccggaaccggtttaaagaacgcacgccgaaaacacatgtaaaccggttgaaaacacatgcaaaaacacaaaatccatccggtcggtcgaaattccggacattccggacgaatttacaattgtaaacggattgtaaaccggaaggcgaaaacacaaaaaaaatcggcttttttcgacctttgccggggtataactttgttcgaatttgtcgtagagctacgaaatttttttctcacccttcctctcgacgagctctacaaattgttcgcttaccgcaaaagcgtagctctgacggttcccgagaaataaggtgaaaacacacattttacaacccatttttggccaattgtaaaaagccgggttttttttctttaaccctattttacaaaaaatttttgctggtgcgaattttttccacacgggccattttgtagagaaaaccgagctctttcgattggtaccggtcccgtggcgatccgttgagccctttaggagagggaaatcgtttagtgggtagcccccccgttatttttatatatagataactaggcgtcccggtagatggctgcgcaattgatggggtcggctggtaggccacacgaggggtagatgcgtaaggtgtgcaccgtcgcggttgttagtgcagtagcagctcaggcgtagatgcgtgtctggatgttcgtgcagcagcagctaccgatagatgcaatgaatttaaaaaatgccgagcctagccgtttatcatcctattactgtcctaacaggaacatgcgtcagaaaggaactgtttgatcttgggatgagattggggcggcggctgtgtgcccagaaatgggggctccactggcaaagttcaaactttggatgagactgaggcggccgccccagaaatggagcctccatttaatggtaccaacagggtcccgctacataaaaaattcataaagttattaagcaaaaagtgaaaataaatttttaaaattaggggtgctttcaaaaaacagggattttcaaaaaaattttgctggtgcgaattttttccacacgggccattttgtagagaatcgaaagggctttcgaatgttaccggtcccgaatggatctgttcgggattcgtttgatgctaaattgtgcaagcttttggtcacgcatttttatgggggtaaccgttaatttttaattatttttaaattgctttagaaattttttataatttatttttatttatttccactattttgggttgcgaggcactctgaataattgtcaaaaatattactaaaaatttatgaaaaagaaaacaaaaacattaacaaatgataagataaaattgtacaaataaataaaaatttaatcaaaattccaaatattttttctctttcttctccttttcctccttctcatcctcctccattctttctctcaggagggtctcgcacatgtgcagcccttgttcctcgtcattccgtgggtcggtgatgtcccactccagttgacggtcgccaaggtcagagctgccctcccggatttggtcgatcacgagctggaaagctctacggggcgcgattggttgacgaatcacactcccgtaggcgtctctctggccgttgcgaaggtcttcgtagacactcctgtatttttgataaattttttcaaactttttcaattttttattaccaagctcggatcacaaagtcatcgtccggaggtcgggctgatgttgcgctttgactttgctcagcaaagtagtctttgtaggactgactatgcgagtctttggtcggcctaaacaaacattttatgctatatttttttttatctttttcaccatatgttgtctgggatgttgacggggcggcggcacttcggacatgtccggttggtggtcaacgaacggcgtaggcagatggtgtggaagatatgcttgacattggtgtcacagggcagctgagtgacgagatctccgcgaagcagtggttccgtgcagacaccgcacgtctcgttgttgtctcgccactgcccttcttttttgctgctcacgatctccatgtgtacaacattaaagttggggtgcggaccgggagctaaaaatttttttgcaaataatttttattctgtttgttacccttatcgtcactgccgcaatggacatcttccacataatctgcctcttggatgttcagtcgctggtcgatgatctcccgtgcccgtatggcttcggggtcaggctgaatgatggcgatgggctgctcagtcgtcaacatcgatgaagcggactcaacatgctcaggttctgatttattgtattttattatttttctatcattaaaaattatttttaccggcatttgcttcactgaagtaaagccgactaactgcatgttgtggttgcttccgagcgtttcctggtgacggcagagttccatttttgccactctcttcaaataatatgaaaaaatcacaaaaaattatatagcatttttactttttgtttcagcctttgttggtgtagaaatttgcgcttgttgttgtgtgcgctttcgtgttgagtcctttgccaggtgttgttggctttttggttgttcaagcttgatccggcgcatctttcgctcaagcatttctgcttctctctgctccttctgtattcgttcctctgccagccttctctcctgttcttggtgctctcgattgtagcgctggatctccagttccaattctgtcggccgtaagggctgctctgcggatgcgtctcctataattctctgagaaattattttgaaaatgtccaattaccggcaaattttcgccaatactgctgctcggctaatgctcgctgttgccgctcaatcacggcctggtgttgtgccatcagttcttccacatcggcgtcagcatcttggccggccatctcgagaatttcctcgcagagagagcgtatcgcggcgtcagaattgaggactacaattaagttattttattgtttttacttattttttgtttgttacattgctcaaaatcaattgttgctccttgttggacagctgcgcgaaattcttcatccaccatggcgcggaatgcatggtaccgttgtatgatacgttgttccattttggcctctctgtcccactgaagattgcgcactgccaaattattctgtcgatcgatttgcttgtgcagatgttgttgcactatagccagccttgcatccatctgtttctttgcttcttcattcctcctttgctgctgctgctcgcgttgtaattgcgacttttcggctgatgtcatctttgccggagtggagaagcgggactctgctgctgctgctgccttctttgcgcgctcaacattgacatcggaggctctgattttgcttggcgatgcacttgttctgcgccttgtcggttcgtccagctgtcttcgacgcgttgccgtttgcgaagtgcgaacggtccgcttcttcttcatctcaacttcgatctcatcctttttttccgacaaaatccgacgcaatgctgacaaaagtgcgtccaggtgttgttgatcctggctgtcttttttgctcttcatgaaccttaatttattattgtttgaaatattttttgaacatttttaatctcactttggaagcgactttaatggcgaaaagaagctggagcctttcttctttgggctgttgaagttttcgcagtcgttgtagactttggaaaatttgtcttcaaacttgtcgtcagcttctttccattgttcaccaagcgtttgaagacggtcgctgcaaaattcgaagtcatcctgccaatccttcagacttgcaagcgaggactttgcagagtcgatttggcgaagcgcttgccaaagcataaggtaattccttattgcattgtagagctctgccaatggcttgcgaagcttgtcaaaggacttttgcagcgcagcagagtccgaggaaacgggtgtctgtcggatgctttcgaacatggcctgttgttgtttggcttggaattccgcatctgtagccgcacggatgtgttcgctaagtcgatgaatcgacgcagtgcactgttgcagaagatgttgtttctttgccttttctgcttcactgatgttttccttcagcgtctccgtgttcatggccacagcatactttgctgctagcaacagggttttccgcgggctttcagaatgaatttcgagcttgttgcctcttcgattgacctcgacagaaggagctgctgctggttgttggcttgctggctgttgtttagccattttaagtggtccgctgtccaaaacttcacgagagggttgggccgttgttgttggctgtggttgagctggagaacccattgcggcagctggtgtcaatgctgcaggtacgtagttgtcgtcatagacaacttcgtttccggctctttccgcggaactacgtggcgccttaatatcttagtaaattaaatattcaacattaaattttgcattacaaaagtgacggtgtcaaagtggttgtggccattgtagtagagcacaatagcattgttgacaggccgtctgtccacgtgggttccaacgtcttggaccatcgtgaagttttggagctggtccacaggaacattgcgcagagattgctacatgaatttttaatattaaaaggtatgatttgcgtttttatctacccgcatttcgccgtctgggaagtagacatatagatgttggcgattatcgttccactgcggtctctgttgctcaatttcgcgttgcgtcagcgttgtcatgatgatcacgatgggccgttgcaacaacatggccaacagcatgctgtcgttcacctgagcccagtcccgttcttgttccctccgtccggcatactcctccaatgttgttattccttcatcagtgccgtggagcaacatgcggtcaatgcgacgcaaaaagctctccctggtgttgtagttgggattctgccgcaaaaacagccgctgatcagcaagaattgttcggagaaatgtgcacattcgcttgcgaagttggtctgcgtggttttctgatccgaacaatgtcaagcaaatggcattgaagaagcagttgccatctggttgggcacgcatcaaaaatgctttgcttgctgttgttgatgatgttgttgcttcagcgtgctggtcattttgcgcagttgactttttctgctggactttcggaactggtggtggaacgacagcaacgctttcgccagaagaccggttggatggtcctggttttgagtcaattgccagatgttttttggcgtgtgtgtcttttgttgttggtgttatctgtggcgtttttgctgctgtttttggaggcgttgttgcggccaagctactgactggtgacagcgaacggcaacttgacgccgcagagcttgctcttgaccctttggtgccctttcgctcgcttattttgcgtttgatctaaaaattgttcgtaaaattttatttttaaaaaatgaataatgcaccagttgccattggattttgtaaaggcgttcatcagggcgatcaaaaggcaccaaacggatctcgccgatcttctttgcgtccgatgggttttgcgcaagccaactgagcaaagcgtcaaaagcagctcttgaagcgacatctcgcggaatgccgcgctcgccagttccaagtggtggaaaagcctattttaatcaataaaatcagctttttaaatattatttttttacaattatctgcgtttgctgttctccattctttttcagctcattgatcagctcctgcagagatttggtgtagcactgcttcaaactttgaatgtcatcagcagtgtggtcccgtcctttgcaatttggagtggccacgtgagcaataactttaaatttttaaatttttaaattaaatttcgctttttctgctcacattttgctttttcagtcaaattgccatatgttggtgtgactgcgacgtaaccatcaggaactcggccttgaatggtttgtcgaatggtcttcagttgttgttgtagaccttcagaatttggctcacatgcacggaggatggcgttgtccgtgttgcctcgcttgtcgctgacaagcatgtcggcacgctgcttcgtgatatcacccatgacaatctttattttgcgaagattgtccagggtgatatcatcagcgagtggttcgtcaggcgaagatggtcgtcgtgagcgtgttgttggtgtcctaaatgccgatgttggtggctttggtggtccttttccgtcgtcatcgtcgtcgtcagagtcgtggtctggtggagggcctcgtgggtacttaaccaaagagttattaaaataattgattgtatcaatttttactgggtcattcgggtcgtccggaggacccattgtggcggtgtcaaggtcttctttgtccagaagctcgagcatgacgatgtttttgacccgtctgccggtgttttttgtgcagactcggatgttggtatcctcccgaactcgggacaaggcagtgtagagctgtccgtgggagaagcactgtgacttgtccagaagaactccgacatgtgacagtgtttgtccttaaattattagatcacgaaagttaaaaaaccaaaaaaaagaaatttaccctgggacttgttgatggtcataacactgccaggtcggagcggaaattggatgcgctcacatcgtataggaccttcatgcagagccttcgggtcaccgccaaattggaaccgcgccttgtgcaggtcgtgctcatctccacggtgcgtgccggtgaggattttgcaacggatgatgttttcgtagagtttcagcacttgcacgcgagttccgttgcagagaccctcttcgaccgagatgttgttggtgaccatcatgacggctccgactttgacgcgcagttgatgttgcggaatgccaggtggtgtttggcgtattaaattttcctggttgatgttggctgcgatgttttcgagctgaagagcatcgacatcatcaacaattggcacggttatcgcggtgtagatgcgatcgatgttgtcattattgttaccagcgttcatcatgtcctaatttaaaatttaattagcactttatttttccatgaaaagtattttaccataattttgttgttcaactcaaacgtttccttgttcagtgggcagagaattgcgcgctccgacaatttttgccagttctcaattggcttatccagcaactcttgcgggaagacgaactgcaggagggcgtcacggtcgggttcaacaatctgcttgggcagcttgactcgttgttggatgtcgttgatgacaccggtgccgactcgcctcaggaagtcacggtattgttgttggccggactggagtcggtggttggtgaccagacggtgcgttgtaaagtgcttgaagagagcagagttcttcacagacgcattgtactggtcaaggtggccaccaccaggcacaacgggagtcagctgcttccaatctccaccaattacgactgcctgaacaatttattaaaaaattgtttttccttagctgtccatcacctttccgccaaacggcagacttttcaaaaggtcagtcggaacaacaaagcgcagcaggcgatcaacatactccaggacgtcacggttctgcatgctgatctcatcgataagcatgccgtcaatcttgcgaagcatttcagcgaaattgctctcaaggtcaacgttcagtgatgttgacgcgtcaatgtgtcgttgtcggcaaagtcgcttgtgaaccgtttgcccttcgtacaggagttccgccgcaatgcctgttgttgccattggcaaaaagttgaacccggccgccttcactttggcaatgatcttctaaaaattagagaataatgctttttattttcaataatgcctaacattataagtgaaggtttttccggcaccgccttcgccagtgaccatgaacagtcgaggcatgttcaggtctttgtcgtcaaagtctccctttcgcagttcgtttgctgcctttacaccatcaaacacagcgtccaccaacatttgttgttcgttgtttggcttcggatctgctgtgtagatgtcggcgtagcgcttccgcattgaggtgttggcgttgtcggcgcgcatttcctcgggtagtcttgcgttgaccaagtcgtcccggaagaacaccaactattgtatttaaattcttttattttttttattttgttaaaattgctacctgtatgtaatcatcctttgtcagttgaactccgtctggtcttggaagcccaattttttcacatgctgtttggaaggttccgtcttcccttttgtcggagtctggatgcacaccattggccagcagaaaccattccaacgcgcggagcacgtattgtcgttttgcctctggtgtagcgttgttaagcgaccaaacggttagccaggtgttggagatctccatcacgtagtcgaacaggtccattggtttggacaagtttgccgtggcgaagaagacggctaaccatcttatgcactgtttcggtctttttttggttgcgaaagcctcccgaatggtgcgcatccacagctcgttgtcgttgagcagtccccgggcttgtgctgcttcaacaaaggtccgatgaacggtgccattgtgtctgcgcagatcttcccaccctgttgggtcctcgacgacaagcaaaagaaggcggattgcctagataagttcattagatttctaaattaattgttatttttaccaaaaggtccatgtttgtaggagacactgtcttcagtcggcacagctttagtccctccaacgctccaatcacgtatggctgccaacgacgatttttcttgtcgtaacgcagttttttgtaggctgtggcgtaagttaggtgtagtgggccatccgtgctggagcgttgtttgttgaaggcaaagtatgcggtgagctgggtgtttcgctcttcaccagttttgcgcctctcttcctccttttcggcagcttcgacaagtgcacctgctctttcttcttcatcatcaaaggcttgatcaaccgcaattcggtgaccttccgggccatggacgtccagttcatcgacctttattttttattttttaaaatatttttgtgatttttacttacaatatgtgagcgtttcacaagcggagtaccccacattgacatgaccgcttccatcgatgtgatgtagcgagccagtcgcaactggtgatactcatcataggcgagcgtcccttcttgaccgctgatcttgatgaacgccatgtcggctcccttcatcacgtacttgcacaagtacttgacgcacccatcaccagctacgaactcgacattgatgctgaatattttttaaaattttgtccataaaatattctagcatactgagttttgtatttggaagacaaaaatgggttgtaggcgacgacatgtgcgttatcctttttgatcagctttccgtagcggtccttgtactcgaacactcggccaaattgttcaggattttgttgagcttcttcgccactcggaggaggaggacgacgacggtagcgcgggtaagcattctccgagtagacgttgtcgtactcatacggcttctatttttcattacttttattaaaattgttttcaaagtaatttacaggaaattttttgacgcattttccatccaccagacaacgatgttcagcacaggtgtggatgttttttgttgtcacggtggtgtaaagatgccgttggagatgctcatcccgtgcattttcatctggctttggtggaatttcagcacagatgtactcgccgatgtagtcctcgggagttcgtattctgcctccgacgcgcattgcctcccagtccagaatcaggcagatgtggacatgtggcattccgctaaaaaaatgtttatttttaacttaatttttgtttcagattttaccgcttttgatgttccacagaatagaaccatccttttagcgggcccatgaccattcgcacagtcaagtcccttttcagctcagtcaacttgtcgatgaagaggcgagtcacaatgtccggtcggtcgtaccacgtctgttgttgtccattgttgtcttttggaagcagcaaggtgaattcttggcactcggggtccatcgtgaacgtgatgagcagatcaggcttgccaatctcacggcagatcgtcatgcagttggcgaattctttttggtagaactgccgcgatcctctgaagtgctcatcggtcatgatgacgcgaccgatttcgccagttagtccttagcaatattataaaaattattagaatgtatttaaaattattattcaccttggccatcacggtacttctccaacatattcatgatggaggctggcgtgaccaatttcttctttccaagcagacgcttcatgtactggacccgttctgcttccattctgttgttagctgtgatggagtacagctgcgccaattttccccactgccagagccagtgatgttcgtcatgccagccggcaccgcgaatctgggccatgtagcggaagaattggttgcgagagacgcgatctcgtggtctgaagacgcgctcaaacgctcccaaaaattcttcatcttcgccaagctcgtccttgtcatccaatgctttgtcgtcgtccttattgctgatgatgttttgttttgggtcgaatttttcgccctccttcatcttgagtggaagtccatcctcttaaacatactaatttattttataatttttttatattcaccaaatccaaattgtccttctgggaacatcagcggaaatgttgctggatcaatttctcttcgccaccatttcaaatgttgctgtcccgtgccttgtcttccaagtaggataacttcataatccatgttcggcagcacattttggccagagtccacaaagaactataaaaatattttgcaaataatttagacttttttattttacttgagccagaatatgactgcccgcttctgtctcgacttgcagacgacccgggtggatttgtttaagcatatggtcaggtggaagttgcacatcaatgggttgagcctcatcttcttttagtgtccgttcttggcctcttttatttgttcccacgacaagcatccgcaaattgacgcgctcatctgcaggaagttggttgaatgtttccgctgctgtttcgtagagcttggccatcgggtgtaagttgcgaagcatatcgtgcagttcagacagcaaatcggcctttatttttaaaatatatttaaaaataatttttttttacattgagctcaaattgttcagcaatttcgcccaagcgttcgtgtgcttgtgttggcgggatggtgaacagctgtccatgtagcagcggcagagagccgtccggaggattgtagtcccaaaggacgtactggatcatgttgttacacttgacgatccggaagaattcctcttcacttctctgcgtgatgacatggccgaatgacaagctgttgttatatgcaagcacatgttccattagatgtttttgctttcgaagggttgttgagtctttgttggtaaacagtgccttataacacgcaggctgttgttggagtgatgtgtatcgcgctgccaagtcgacacgacctttggcacaacattttgaaaatgctgcactgcctgttgcttcgttgttgaagagcaacgctgcacaatgtggacattttgatgtgccctttaattattaaaaaatttttaaaaaagatatattagttttttacattgccaagagtgttgtaatattttggcatgtgctttgaggactttgcagcacaacctaatccaaaatgtgttgtttgtgcgatgtttgcacactgatttgttataggagtgtgcgatggcgtcatcgataaactttggtggcttaatgttgatggtgtgcgtcggactcgtgagcttcttcttggagccaatgaagaaggtggcggcatcaacatggaatcaattgatgcattcgaaattcttgacgacaatcttgggcttttcagttgttcatcacttcgtggtctgccaccaataattccacgcggcgtaacttctaattgcgccacatccggatttgcaatgccgcaggatggccttaactttatttttccaaaaaaatgcaatttcctatacctaaaattgatctcctcaacgccatgccataatgatgagcagccatttgggcaacaattttttgatgcagtattttgccttaaattttatcgataaaattattattaaactgtataagttaccagcatatttggtgaaaataagagtgacaacattgcaggtaaactttttgttcttgaattcccgaaggcgtaagaacaaatagttttttgcataaattgcaaaatccaggatgctggacaccacaaccaatgcgttggcatttgccattgttgtcagtcaatctgttattttattatttaattaggtaattttattgtaaaattacattttttcaagagtatctgcatggatgtccatgtcatgggcattctttgtgcaataacagccacattcatatagtccataaccaatcttctttttacagcttttacattttataaatgcattttttttacatctttggttgtgacatcgcttgtaatgtccatcagaagccctgaaattaattaaaacgtatggtaaattttattgcttttttaaaaatttatttgttgcccaattttccgaattaatcgatttgttttaattttgaatatttaaattaatttaccattttgcatattctccttcccaatgacacttgtgaccacaatcaatgatggcgtatcccatttcttcgagcacattgtttttgcattttggcgcaaagaaacataaatcattcgtttcaaattgccctttcttgcgcttttgttttgaaaggccttaaatacagtaagaaatttatgaattaattattgcttcgattttcactttattataaatttacgaattttttaatattgttatttaagcaattttattaccctttatagatatgtctaattctttagcacgatcttgtgtcatttcatcaaatgcattttgttcggtaggatcctcagccccagactcagatgacatttcatcataaattgttgagatagcatcaactataaatataggtttaattaaaaatattttcaacaaattacagtataaatcatctgaagcaatggaggatcggttcgatttgatccgtcctcttgaagatcgcggggtttcgctctcagatgaacttggaggccctataattacaaattgattttgaaaactattgttccttcacttcctgcagattgcattgtggatgatcctctaacaaaatttcgccaccatctatgcaatttgaatcggtccacgacagaatcaccatattgttttttaattgcaagcattgcggattccttgtcatgcgggttcgctttgtatttgtacaaaaaatacagatattgagattcatcagacagtctcagctttgaattattggtatttgtttggtctccaccaccaccacctcggaggttgaagtaattttttggttcttaaaaattattgtatactgctcaattaagtaagatttaaataaccatttttaaagaaaaggagaacatcgaatttgttgtcgattaattttatttcagcagaattatgcgcaacagttttctggttagagcaaacaattctttgtcgaccaatgattttattctggattttttacaaattaaatttattaatagttgtttgcgttatatatttgcaatattaatttttttttcattatagtaccgtttttgttttttcagatcgcattccatttgtcatttttttgtgctcttgcgttttttggtgatttgtccctttagatttagtggaatgtgatgtctaaattttataattcgtctaatgaaatttaactaacaatattattacctttttttcagtcaaattttgcaaaatttgtcctgcttttttgagaaacactgtagaagatgttttttcttcaataaaatgttttcttaacggcatgctaattttgtatggtgtaactttcttaaaatataacttaagaataataatttgctctataaattgcttaccttaattccaaaaattatgtcgctgtacgttctcagttttggctcacaatgcattccttcacaaagcatagttggctcgttcgcaacaattttttgcggtgaaacggtgttcgtttgcaaaacggtgttctttaaataataaataatttattaacgacaattgataagatttattatctattaaccggttttcgtgaaagaaccgtagcatatgttgcaacgtttgaagccacgttttgcgtatttgtcgtttgctacggaaataaaaatatatttttgatgtttatatattttttgttataaaattttgtttatgtatatatatttatttgtatgaggaattatttaaattttttttaccgtaattggctttctgttgatataacactgccaatttgtttcttccacccacgctttcgagacaaagactttttttgcagacaaattcttgttaacactctataaattttttattattttcggtaagtttttgatgttcacctcaaattttttttcaacaaaattgacgccggaccatccgttggacgtgatccatgggttgcagtttccaatttccaaacttttggcactcatagtctgtaaattatttggaacactttttttatgtatttaatttatgcacttttccattcacaactggagaatatccaattggcgtgaaaggcttttccgccacggttttcagtgccttagcaggaacaggcttaaatgcattgtgaattataaattgaacagagaattcatcaatattacctttccatttttcacggtcatccattcaattttctttttttcacatttcaacggcatttttttggcacactcattcactaaattcttttctttgacctataaaggtggacataattttaattaaatattaaaaagttagtaataccggagccaaaccaacaatcggtccacagcgctgggtgcgaatgcgctggttgcgctcctttttgctaagtgtccggtcaaaatgcgcgtcaaggtacatgcttaattcaaataatattagcatttaatacttctcgttataaaatggacatttacccttccaaatttctgcgcagcacttcattccttttgcccaggtgtaagccgacctgca

SEQ ID NO: 60 - DNA, 5037 bp, Heterodera glycines
cttcattccttttgccaggtgtaagccatccatcaaaatgtgcatccggccacgggtccctcacttttccttgcacttcaatgccaacgccccgcgaatgggccacattctttttcgcctcttcggcgaaaaccttcatctccgtaatgaggcgacgaagttgcgccgcaatccctctatcttgcgcaaaagagtacgccgaaagcaattcgttacgctttcgacgatcttcgtcccaatttcgtccctagatgttacatttcttacatataattgatttcaacgaagctaattaccgggattggtttcttaaacaccgttaaatcggtgtttggtggcacttccacacctgatggacgcgccaaacgctcaggtgaaggcgtcacacgaacaccgccgcacggcgatggtgatcgctcacgttgcgtgccacgacgggcatagaagaatgccgtcgacgactctttagcaggcagaaaatgtgtcttggttggcataattgcaataggggataggtaaacagtaggaaattgatcgtggagatttttgagttatctgaatggtttatgaacgccaatattcactttgaaaaagttttaaataagaaaattcaaaaaaagtgcggttattattttattattaaattctaaattgtattaatgaaattttttgtgaacgaatgttgtaaatgttggttttctattaatattgttttgcgcgaagcatttttttgtgaagatgcaacagtaattattaaacatttgaaaactgaaaagggacaaggaaggaatgtaggagcaaagaaaggaaggaaggaaggaaggatggtcggacgggcggacgtacgaaatgaatttcaggcagataatattgtgatgggatatcattttttaatttagtagaaataaatattgtaatagttataaacaaatttattcaaatccaataaaacttgtgacaattatttaaacacaagtattaaagaatttaaataaaaagtttttttggagttttttcgctccagtccaatccgggaccaaaattcaatacacagcgcctataaaaaaataaataattatcggactaaataaagttagttgtttacaaaaaaattttgctctggcgcatcaataactttgtaacaaaagcagcgcctgtaaattatttggggcatttaaagaaacagtaagtttatttttgctttcaataaaattatgcgtgctcttttcatcatcaaatttttggtgacaaaatacagcacctgaaaaagcaaaaagcaatgaacagttgaaaagcatgtgaccaattttggcttacaaaaaatgttttgtgcggcgcccatcattactttttgttgcaattaaccagcatctgaaaaagtattgaacattttaaaagcatgtgaccaatttttgcgtaaaaaaaatgttttgtgtgacgccaaccagcacttttgttgcgattaaccaacatctgaaaaagcattgaacatttgaaaagcatgtgaccaatcttgtcttacaaaaaatgttttgtgtgacgccaatcatcacttttgttgcaattaccaacatctgaaaaagcattgaacatttgaaaagcatgttaccaattataacgcacaacctcacgagctcagaatatttcagggcattcctgaaaaattaataaattaagcttgtgtaaaaatgttaattgtttttataaataaaattattgttgttcatttgtttgacttatcttttttttgtgagtttcatcatcagaagtgttccgtttgtcaatacctgaaaatgaattgggattgattttttttggtaaaatgtgtgccgaccggaaagaatgattgcattgttaagcaaaacttttttgtttaacaatgcaaattttgatataacattacctttttacctttacctttaaaactacgcgcgggggtaggacccacctataactatatacaatctgtagagcaaatattaattttaatttataaatagccggaatgcatgaactatataaaattagtgaaatgatttttttaaatatttctgtaccttttaaggacatttttttgaacatgaatgatttaaatgtggtataacaaatgtataaaatgtccaaaaaatttgattctccttttcttttattttgaattgtaaaaattattatagagatacctttttattaattcatacatatccagcaatttacaaattaaaattatttgaaagattttttgaaacgggaaaggagagggagagggagagggagagggagagggagagggagagggagagggagagggagagggagagggagagggagagggatagggagagggagagggagagggagagggagagggtgagggtgagggagagttaagaaacgaaaagggtgttggatacggtgacggagacgggctgagttgtagacggagaccaaatggagacgtttgagaaacgaaaaatgtgatggagatagcaggcaagacgggctgagttggagaccgagaaggagagaagagggagatggagaccaagatgtaaatgcagtatgtttgatagagagttgacaaaccaaaaattaccacgataatggagacggtgatgaagcgaaaatatgatataaaattaaataataaaatttaaaataacaaaatttctgcaccaatcttttaaaaattattttctctattttctcgaagagttttgaatctatttctaaaaaggagacgtgctgagttggagacggtgaagaaatggagaaggttaagaaacgaaaaacggtgatggagacagcagccaagacggactgagttggagaccgagaaggagaggagagggagatggataccaaaattaaaattaactctacgaaaaatttttcagagttttgaagatattcataaaataaaacttaatcgaaatgcaaagtttaaattcaaattttaaggttaatgttgatgtgagagttattaaaagttttgatcaaatttttaaagataaaactttagtgactttttcaaaaaaattttatttaaagtaaaaattttataatatttgttaaattttctaacataaactaaaccaattaagccaaataattttttaataaagacaattcaaaataatcaattcaatttttgttattttatattttttttcagcataataaactcaaaatcaaaaaatgaaatctgttgtttatattgaaaatttaaaatgcttcactcttaagcatcggtttcttaatcaatttgttctttctttgtacgccgaagagtccgcaacctgaattttaataaaaataattatctcatagtaaatttttaaattaaaaatttaataattttgtgcaactgataatttgttaatattggaaatttagaaaattgtgcacagaaagggacatgtagaaaaaataatgtgttttttgaatttgggaaaaataggaaagggaaagggaaaatgtttttagaatttggtaaaattatgaaagggaaagggaaaaggaatttagaatttggtaaaattttgaaagggaaaaggaaaggggagagggaacgggaaaaggaatggtattttagaagtttggaaaattatgaaaaggaacgggaaaaggaacgggattttcgattttgggaaattattaaagggaaagggaaaaggaactggaaaaggaacgggattttagaatttgagaaaattatgaaaagtagtggaaaaggaataggattttagaattttttaaaattattaaaaggaacggaaaaaggaacgtgattttagaatttgggaaaattatgaaaaggaacgggattttggattttgggaaattatgaaaaggaacgggaaaaggaacgggattttagaatttgggaaaattatgaaaaggaacgaaaaaggaacgggattttcgattttgggaaattattaaagggaaagggaaaaggaacgggattttcgattttggaaaattattaaagggaaagggaaaaggaacgggaaaaggaacgggattttgaaatttgggaaaattatgaaaatgaacgggaaaaggaacgggattttcgattttgggaaattattaaagggaaagggaaaaggaccgggattttcgattgtgggaaattattaaagggaaagggaaaaggaacgggaaaaggaacgggattttaaaatttgggaaaattatgaaaatgaacgggaaaaggaacgggattttcgattttgggaaattattaaagggaaagggaaaaggaacgggattttagaatttgggaaaattatgaaagggaacgggattttggattttgggaaattatgaaaaggaacgggaaaaggaacgggattttagaatttgggaaaattatgaaaaggaacgaaaaaggaacgggattttcgattttgggaaattatgaaaaggaacgggaaaaggaacgggattttagaatttgggaaaattatgaaaaggaacgggaaaaggaacgggattttggattttgggaaaattatgaaaaggaacgggaaaaggaacgggattttcgattttgggaaattattaaagggaaagggaaaaggaacgggaaaaggaacgggatttttgaatttgggaaagttatgaaaagtaaaggaaaaggaataggattttcgattttgggaaattattaaagggaaagggaaaaggaacgggaaaaggaaagggattttagaatttgagaaaattatgaaaagtaaaggaaaaggaataggattttagaattttttaaaattattaaaaggaacggaaaaaggaacgtgattttagaatttgggaaaattatgaaaaggaacgggattttggattttgggaaattatgaaaaggaacgggaaaaggaacgggattttagaatttgggaaaattatgaaaaggaacgaaaaaggaacgggattttcgattttgggaaattattaaagggaaagggaaaaggaacgggattttcgattttggaaaattattaaagggaaagggaaaaggaacgggaaaaggaa

SEQ ID NO: 61 - DNA, 1937 bp, Heterodera glycines
gggattttagaatttgagaaaaatttgtgaaaagttaaaggaaaagggaattggattttagaattttttaaaatttttaaagaaacggaaaaaggatcgtgatttttagaatttgggaaatttatgaaaaggaacgggattttagattttgggaaattatgaaaaggaacgggaagaggatcggggattttagattttgggaaaattatgaaaaggaacgaaaaaggatcgggattttcgattttgggaaattattaaagggaaagggaaaaggatcgggattttcgattttggaaaattattaaagggaaagggaaaaggaacgggaaaaggaacgggattttagaatttgggaaaattatgaaaaggaacgaaaaaggatcgggattttcgattttgggaaattattaaagggaaagggaaaaggaacgggattttcgattttggaaaattattaaagggaaagggaaaaggaacgggaaaaggaacgggattttaaaatttgggaaaattatgaaaatgaacgggaaaaggaacgggattttcgattttgggaaattattaaagggaaagggaaaaggaacgggttttagaatttgggaaaattatgaaaaggaacgggattttggattttgggaaattatgaaaaggaacgggaaaaggaacgggattttagaatttgggaaaattatgaaaaggaacgaaaaaggaacgggattttcgattttgggaaattatgaaaaggaacgggaaaaggaacgggattttagaatttgggaaaattatgaaaaggaacgggaaaaggaacgggattttcgattttgggaaattattaaagggaaagggaaaaggaacgggaaaaggaacgggatttttgaatttgggaaagttatgaaaagtaaaggaaaaggaataggattttcgattttgggaaattatgaaaaggaacgggaaaaggaacgggattttagaatttgggaaaattatgaaaaggaacgggaaaaggaacgggattttggaatttgggaaaattatgaaaaggaacgggaaaaggaacgggattttcgattttgggaaattattaaagggaaagggaaaaggaacgggaaaaggaaagggattttagaatttgagaaaattatgaaaagtaaaggaaaaggaataggattttagaattttttaaaattattaaaaggaacggaaaaaggaacgtgattttagcatttggtaaatttttgaaaggaaaaggaatgagattttagaatttgggaaaaatatgaaaaggaacgggaaaaggaacgggattttcgattttgggaaattattaaagggaaagggaaaaggaacgggattttcgattttgggaaattattaaagggaaagggaaaaggaacgggaaaaggaacgggattttaaaatttgggaaaattatgaaaatgaacgggaaaaggaacgggattttcgattttgggaaattattaaagggaaagggaaaaggaacgggattttagaatttgggaaaattatgaaaaggaacgggattttggattttgggaaaattatgaaaaggaacgaaaaaggaacgggattttcgattttgggaaattatgaaaaggaacgggaaaaggaaagggaaaaggaacgggattttagaatttgggaaaattatgaaaaggaacgggaaaaggaacgggattttcgattttgggaaattattaaagggaaagggaaaaggaacgggaaaaggaacgggatttttgaatttgggaaagttatgaaaatgaacgggaaaaggaacgggatttttgaaaattatgaaaaggaacgggaaaaggaacgggattttagaatttgggaaaattatgaaaaggaacgggaaaaggaacgggattttcgattttgggaaattattaaagggaaagggaaaaggaacggga

SEQ ID NO: 62 - DNA, 1215 bp, Heterodera glycines
ttctcaggtcataacttttttgtaagttaatcatttttttgaaaattttgaaggataatagaaacacttagggctatcgaatcatatcaacagtttaaaatttagttgtttagggcgaagttatgcataattttatgtcaaaaatttccatttgatggttttttgactaacgcccattttgatggtttatgactaacgtcccagcacccaaaaagaataaaaacaaaaaatattcgaattgtagttgcttttgcaatattatttccctaatttttaaattttttgtttgaattattttgtgattaggccaaaagactttttcttcggcttatcctccttaaaaccatattttacattgaatattgtcaacgcaaaaatattagaaaaaaaagaggacattttcaatgtttcggattaaattttctggaaatcaggaaaactattgtataaaaaatcaggcatttatgattaatagggatgccaaaaatatggatataaaatcgcaaaatatggacataaaatggcaaaaatcgcgaaatatggacataaatggcaaaaatgtcaaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattctgtgcaatattttagaagaaaaaaaacatgaaagttaaatttattaatttttttagcgcaaaatcaaccacaaaagcgaaattttcgcttttttgcttatttttgacataaatttattaatttttaagaaaatttaaatttattcaatattctcgagacattttggcgaaaaaatgattttttgaaaaaattttcggtttttgggctcaaaaaaaccaatttagctgctgggggccgttctaataaaggtttttttgaaaaatgccaaaatatggacataaaatatggataaaaatgccaaaatatggaaaaatatggaaatatggacataaatcgcgaaatatggaaaaatatcgaaaatatggatatggaaacccatcctagaagcttcaagccatgctaaaaacatgtttttcgtgcgtttcaggccctcaacagtctaggaaaaaatatggatatccatatgatt

SEQ ID NO: 63 - DNA, 4112 bp, Heterodera glycines
tttttttttttacattaactaagcaaaaaccaaagacccttgccccggtgaattatcgttcgtcagaattgattctccgccgcgatgattgatccaaggattccccctcttccccgggcgagttcttatttgaagtgaggctaattacagttgaaaaagagagatggatgagaaataaggaattataaaaataaaatattttaacattaaaataacaaaattccatcaaaactaattaaatgtttatagtaaaaaggaattaaaaaaacagttattatattaaaatcagacggggggggggaatgagtgtcgggatgaagggaataaatgttacacccagagggtgaatgggaaagaatggaaaacaaaagaaaacggaaaacgtaaaatttcaaataataatttaaagaaaaaacttattaaatacgtttttggttttaggaggtttaacgagacccttttttaaaaatgaatttgtttgaagtgatggaggactggtaattactctcacttttattgaccgccgggaagggatagggcggggataattatgacgttaaggggagctttggtgcttaattctggaaattttgatttggatggacgggcgtggagggaattgatttgcactcaaatagaaatgaaaaaaagagaaagtggaaaacggaaaggccacgcaaaataaagaaaattcaaaagagattttaattgaagtaatttatttaaaaaattgctacagtataccttaaaataaataaaacaaattaaaagacaaatatcacaaaatcgaaaattaaagcaaattaaaagataaatatcacaaaaaaaatcgaaaattaaagaaaaataaaaaattaaatatcacaatggtaaagaatttcatcacaactttaatactagggatgccattttatgaattaaaatacttaaaaaaattgatttaagacaaaaaactcaaaataaaagtaatcataaatgttgggtgaaaaaagtaagtcaaggtgccaatttgtattaacaatttcaggcaaaatccaattatttctttgctaaaatgtggttttaaatcatctaaaatttacttttcgtttttaaaattgaagagacccaaaataaaatggcataactattacatatgcattaccatcaccattcaaatttcactccccaccacgccacccactattcctcgtccattggctcttctggcccgtgaacccgcgccttttttgcactcggcagcttttccgttgtcgcacgtcgacgaggcgccagaaaacggcgtccgcacaccgcgcatttgtttggcggtgcgcggacaccgaatgggttcgcgaaggttgagcatgatggcagcggaagtggcgccggtgccagcggcggaagagcgagtggcgcaagtactgggcccatttgcggcggccgcgggcaaaacggcgccatgccgatttgtggcggcggcggtaaaaacggcaattgtggtggcggcggcgggaaaaccggcaattgtggtggcggcggcgggcaagacggtgccaaagggcgcggcggcgcgacccattgaggcccctgaagttgaaagacacataagatttcattatttttttgtttcgcaaaattttaccgcgtttcgtggcaccggcaccgtccacactatcatattgttgtttcccatttcgttcacggcaaagttccccgagaggatggagtcgcggatgagcttcatgtcttgctggagtttgtggagtgcgatgattttttttaaattttcagtcagctgctctcggtttgcggacatgtttattgctaaaaaaatgccaaaatggaaaaagtctgggaaaaagtctaaaaaagtttaaataacaaaaaaaattcgacagtagactttcaaaaaaaaaaaaacaaacatacttaggggaggcgctctttgaaagatggccgggtttggcgtgctaactaaacgccgtccgcctttcaaatcgtgtaatctggcaaaaaagcggtaggccgggtcctgccacatacaaatgttggaagcggtacccggcctaccgctttcggacaaactccttttcgagcgtgccttacgagagggtgggggaaaggatttcgagcgatgcttcatcatcattacttatggtcataaaaactggcgcttataaagcccctcatccatcacctaaaaaaagccagctaattgactctgtctgggtcaggtggggggggggggggtgcttttatgaaataccgtcagttccattaagggaaaattatggaagaaattaaaaattgagctgctaattgagagggttattaactggcacaaagtgccgacgttgaacgggcctctccattagccagaccggagactaatcgacaggtcaattaattagaccagactaatggacataccggtctgtctgtccattagccagaccggactccattaatggaccagtccattaacggcaaaagtaccaaccggaccccactaatggaccagtccattagcggtcggtccattaacggcaaagtgccagccagggccccactaatgaaccagtccattagcggtcggtccattacggcaaaagtgccagcccgggccccactaatggaccagtccattagcggtcggtccattacggcaaaagtgccagccggaccccactaatggaccagtccattagcccactaatggaccagtccattaacccactaatggaccagtccattagcggtcggtccattaacggtcaaaagggtcagcaggacccactaatggaccagtccattaacggcctgtccattaagtcttaatggaccgaaaacagcggtatataaatggcctccaaagctctctggctcattgtcttcaaattgtttctcatcgataaagccccacctgggcctgcctatttcagtcccacccctcttaatgcgcgttattttaccccatcggtcaaatttgatcattgttgaacccgtccatttcagtaccctcccggccatttaattatcaccatttcaaaagagcttcttgttgtttaatgccaaaaaaataggtcataatgtcaattacttaattttttttttaaaatgtttctctgttatttcgaccccttctctaaaatataataacgagttcgaacattgttcgacttttagatttttgttcgaactgctctcaaaatgttcagaagatcattttagccaaggaatagtttcaagggttcaaaacgcatattgttttatccaaaaatgacgtttcgacccacttttcgcattcgtaaaattttcggtaattattccggtgctctagagcagcaagaagaccgaaaaaatcttcgcaacaaattacaaaatgatttagagcaattctcagacaaaaataacgagttcgaacaaaaggtctaaaagtcgaacatttttagaattggttccaaaatgttcaggagaccattttaggcatgggtttaccccgttaggggtaaaaaagcttgtattttcgtccaaaaatgacgtttcgacccacttttcgcagttcgtaaaattttcggtaattattccggtgctctagagcagcaagaagaccaaaaaaatcttcgcaacaaattacaaaatgatttagagcaattctcagacaaaaataacgagttcgaacaaaaggtctaaaagtcgaacatttttagaattggttccaaaatgttcaggagaccattttaggcatgggtttaccccatatggggtaaaaaagtttgtattttcgtccaaaaatgacgtttagacccactttttgcagttcgaaaaattttcggtaattatttcggggctctagagcagccagaaaaccaaaaaattttcgcaactaataaaaaaaaaatgatttcgagccattctcagaccaaaatagcgagttcgaacaaaaggtctaaaagtcgaactttgttcgaacttctcccaaaatgttcaggagaccattacagactagagtttaccccaaaagggtaaaaatgctcgtatttttgtcctaaaatgatgtttaaacccacttttcacagttcgaaaaatttttggccatcatttcggagccctagagtagccagaagacc

SEQ ID NO: 64 - DNA, 4876 bp, Heterodera glycines
  misc_feature (50)..(50): n is a, c, g, or t
  misc_feature (182)..(182): n is a, c, g, or t
taataggctaaaaacttctattaacatttttaggtaacaaaacacgaaanaatttaattaatctttttgttatgcttcaattataaaagaattataaaatcacttaattttttcgaaaaaacaaaattttaattttaaaaattttctctaaattttttgagggtaaatttacaaaacccaanaatattacaacatttaattttttatcatggttttggacaaagtaattttagaaagcgtagatgagcattaaaaaatgttaccgatttagttatgcattttctaaaaaataatttcgacaaattctcagtcttataaaaaaatctatatttttttgggaaattttcgaaaaatttctttcaaaattaataaaaatacgaaacgtatgaaaaagtttgttgaaaaataccattttctactatagaaaaaatagatcatttaaaaatccgaaattatataaacaaatgtcccaacttttaactaaaaaaaaaacaaagaaaaataactttatgcgcctaaccaaatcagttccgctcttagcaatttcgtgtatttcagtgccattttcttacactgagcgtatcggttctcccggaattgaaataataattatttatcatgctgtgcactcattttaacgcttttttagctttcagtgaattcatttttttttattcaacggtaaaaaaacaacaatgagcggtgagaacaagcttaaacgttttcaattcgtgccagcttccaaccaaaaggcggatgaatttcccgcacagcttaaggaattaagtgaaattataaagttcaattctcccggtaccttctttgtacgcgcggtcgttgacaacattcaatactgtctttaccaagtgattatctctctctctctctttctctctctctcatttaaaccaaaacctaggcgtgtccaattaagaccggtggcctcgtgtgtaaaaaaaaaactcaacgacgagctgtactgtgaatcatgtgatcatcacgctaccaaaccactgagcaacctctacttacgcatcgacttgcgcgattgtcatgacattgagacgagcaagcaaataactgccttttcggcaactgctgttaaatttttgaatgtaaaaatagatgaattttcacgcttagcgcagcaccgtcccaaaaaacttgccttaattctccaatcaaaaattgaacagacagttgctgctaaattggtcattaaggttgattttagcaccctttccatttcacaaatccatgctatgttgttaaggcaaagggcgagacacttgactgggttattgcttcaatccatgtgcctgagcaggaagaagaggctggcggtaatctggcaaacaaaaaagtcgttgaaagtgaagatggggctgaggatgacgatgacgacatctacacaattgatgatgctgaatgttcacggatgccgcctaagcggccaaagaaaaatgatgagtagaaagaacggacggacggataataaaaggatgccttaggcaccaatttcttataattatgtagaaatttgaaaattattttaataataatgtattagaaaagaaaagctccaatttcttttacacaacaatattttttactgttcaatcggcatgtatctgaattcaagctgcaattattattattatttcatgaatgtttagggccctaaaggcacaaaaaagcgtcaactgtccgtttttgtttacgttcacaggaaaaaatttttctgctggagcgatgaagaggggagtttctgcgtcagcaacggctaccgattccgcagacttacggacaccaaacgatgcttctgctgctgctgctactgcttttattggcgaaaacttaaacaaaaaacgagcgaaacggtcacgaagacaacagcgacgatgggactttcgcacagtcgccttctttgagcagcgctcctcctcctcatcagagtttgatgatgctgatcaggacagcaaaagcagcgcaaaagtcgaccattgtatgcaaataggctacggtagagcaccagcagcagcagcagcagcaggtaattcacagcggaacaacaacaacaacaatgttgacagcggcggcggcggcggcggcggcggcggcggcagtggtaatgaccgccgaagcgaagcagaaaacaacgccagcaatccggaagctgatgatgatgatgatgatgaaaaaggcggcgctactgctgaccaattgtatgaagagaagcagcactctgtgcatcggctggagcgtttcgcactgcagcggcacgtcaccgagtttgtgctgaacggtcagcatgagaggccggacgaggctctccgcgacgcatttgaacgcatcatcaaacgagcaatacgcaatgcggagcagcagcagcagcagcagcagaatgaacagcagtcggggaatcaggaggaggagcagccacaagacggtggcggcgccgctcaacaaagcccaagacgacgagtgacaaagattggaatttttctggatggaaacggtacttcttttttttgtttgttttggcaaatgtccccatcgaacatccatcatcatcatataggcctgactgaccctattgtgctaccgatacggccacctgagcagaacacagccgacactctgatgggtgaactggaaaagctgggacagtcggacggagacgaagacgtgcatggcggaggaatgagcaagcgatccctgttgctcagtgaaccggttcaaattgtcatcacctgcattgcaccgccggttggagcagctccgcgcttccaccattatcagcactggggttacaatgaaaggcagttgatccgaatacggaatgtcggtgaccatttctgcctgttccacgcgttgattgccgcccgttcttacactgatcatgacttgacaaaaatgattgcaccacagcaacaacaatgccatcaaggggacgtaagcagcagcagcagcaacagtgatcatcttattaacgtgccgtccgctgctgcaacagcagtgatgaggaggccggatttttgcgcaaatcatgaagtactgaatcgtcttctgtccagcccgggtcgaatgcaagaaacggtccgggggttgatgctgcatgccggcattgaccctgaagggcaagcgtacggggtggagcatgtcccgcatgttcaacagcattgggtcagtgccattttgaaaatgctttctgctgccgccacataataatttggaaaaaaacgcacacactttttaacaggatcggctctatccgggaatgtaccgcattgtgctgtttgaggaccgccctgaggaactgccgaggcctatctggaaggggccgatggggcgctgctttgtggtcgctttgttcatgtccggcggacatttcgacgcaatcaaaaaagtcaactgttttttcaagcttggccgtaaatattgtattgactgcgaatgcgtctacaccactgatgccaaacacaccatatcatgcaaaagccggtgtgctcagtgtacaagaggttattttgtgggccgtgtgcgcaaaattttgttcattgttgttgttgtacagtaggaccacagcagccatgtgcgagcgaaccaggcgtcagcatacattgctctcaatgcaatcgcttctttttttcacgcatttgttttgatgctcatcggagcggacaagcgtgcagactgctgaaacgatgcacaaaatgcagtcgaacattccaaaatgatgccaaaaacccgcaccagtgttacaccagtttttgtgggcgctgtaatgtacgttttttttttaagcggacggataaggacaacaaatttttcacaaaaatgcgcaggtataccacgaaaaagatgctgcttgtttcatcaaaaaaattcctgtcccgaaacaaaagcaaaactaccgcattttgtgctgggacacggaaacgcggctcgaacacctacaagaagcgggtcatcagcggcacaaagttaaccatttgtcggtcaacatcacgtgcacggaatgctgcgattctgcgacaggcgaatgcgtagaatgtgcgatatgcacaaccgaggagggaattttgtgcagaaagaaggactggtcggttcttcttcctttcttaatacatgcttgctcacatttttgccgacaggagtgaagcgaatggtgatgaaccgctcagggattttgtcgaatgggttctccgtgcttggagcaataaacacaagacgtatttatgggtttgttgtttgtttttttttgcttcactgactattttagcctcgaattgatcagctcaaattcaggcacacaactcttctcgttttgacggacatttcgttttaaagtatttgggcgagaccagtcgacgtccagatgtggtcatgaacgggcttaaaatttatgagtttcgattgcagcatagccgtcaaaattctctgctcatctggagagattcttgccttctgatgcctgttcgtctcgatcaactgccaaaaactttcaatttggactgtgcagagaaacctttttttccctatgctttcaaccgaaggtttttccgaaagctgtgacatttgtcaaaaaaaataatgcttttaagggaaaactatgacgtgaggcttccgcatttaccgccaatagaagactactgtgctggctcaatgaaacgagaaaaatacgataaatttgtcagttggtaagcaaaactaaagggttatttcagtggtgggggttccccatttcccataggtatgaggaaaataaaacaacaacacccttctatttgccggacgagcttcaatcatattgccaaaatgatacggagaggagggtgaaggcgattgtgcagttcagaaaaatattgatgcg

SEQ ID NO: 65 - DNA, 11932 bp, Heterodera glycines
  misc_feature (11923)..(11923): n is a, c, g, or t
atttatgagtttcgattgcagcatagccgtcaaaattctctgctcatctggagagattcttgccttctgatgcccgttcgtctcgatcaactgccaaaaactttcaatttggactgtgcagagaaacctttttttccctatgctttcaaccgaaggtttttttccgaaagctgtgacatttgtcaaaaaaaataatgcttttaagggagaactatgacgtgaggcttccgcatttgccgccaatagaagactactgtgctggctcaatgaaacgagaaaaatacgataaatttgtcagttggtaagcaaaactaaagggttatttcagtggtggggttccccatttcccataggtatgaggaaaataaaacaacaacacccttctatttgccggacgagcttcaatcatattgccaaaatgatacggagattcttctgaaggcgattgtgcagttcagaaaaatattgatgcgtgatataacagggggatacgatgtgctacccatctcgtgcactattgccaggtaaaaacattgattgtgtgatcatgtgaaaaaaggagaagaaatgttttaagcatctgtatgagcatcttccgggcccaattcctttgtgagaatcaacttgccattgtacccgaaagagggtatgagcggaacgacagagccagtgtgtttgctattaaatatttggattggcgtgctaaaactgatgcggttaaaattcaacatgcgggaaacgggatggaaaagcggtggagacagtttaaattggacggttggatagaagagcaaaaccgctgtattgaagtgcttggctgctactggcacggctgtgagcgctgttttgatcccggcgacaaactggtggacgccaaatcatgcagagaactgaatgaggagaccaacctgcgattgatgcagcttcgtgaaggcgatgtggacggacaaggcttgcaggtcgaagcagtttgggaatgcgaaataaatgcgcagttggcctgcaatgccgaaatgcgagcctttttctctgatttggggatggacagagggcctattgaacccagaggagcctattttggtggaagaacgggcccattgaagctatttgcagagccaaaggaggacgaaaaaatatcagtttttgatatcataagtctgtatccttttgtgaattatacgtgcgaatatccggttggcataccgaccatcatacggccaatggccgatgaaatgtgcgttaattggacacggccggagcagttgccataccgcggcattctgcgtgttcgagttgtccccccacggggtctgcgcgtcccggtgctgcctgtaaaaattgacgagcgacttttgttttgctgttgtcatcattgtgcaacgatgtttcgcaaaaaaagcacgcgccgcccacataaatgtccacacacggatgcacaaagatccttcaccggcagctacacgcatattgaactggaaagagcacttgaacacgggtacaaaattgatcgtctttggagagcttggcactatgatgaatggtaattgtctttctgtttaaaatttgtatgcgatattttttttctctataggagcgaccaaatttttaaagattatgttagactgctcatcaagttgaaggtttgtctgcagacttttgacccatctgtttaatcatgtgttttttttgttaagattgagtctagcggtttccccgagggagttagcagcgcggatcagaaacagcgctatgctgatgagtatcggcgcatttacgaagtaaacattgaattggagaatgtgaaaaaaaatccggggcttcgattcattgcgaagcttatgcttaacagtctctggtttgtatatatgtccagccgattaaggtgcagcctatttttaggggaaaattcagtatgagaaacgaacttggcgcaaacaaggtcatcaccagaccacaagagttctttagtctgctctttgatcataaaattgtaagttcataacgtatatatatttttattggcttaacaacaaaaatgtgtgtgtgtgtccaggaggtttctgcaatcgtaccattctctgatcaagcgctacgcgtgctgtacaagccaaagaaaaacttcgtttccgaacatacaacaagcaatattgtgataagtttgtggacaacaagctgtgctcgtctcaagcttcacgactacatggtacaagtcgaccaaagagaagattctgatttgctctatacagtaaacgggttttttgtgagcgcactatttttgtgattttaaggacacggacagtgtcattgttctacataagcgggacactactccacttgagactggagagtttttggggcaaatgagtgaggagtacttggattacgatataaaaacgttcatatgcggaggttagtcgtaaatagcttattcaaaatttttatgcattaaggtgccaagcaatatgcctttcgtatgcgccacaggcggacaaacgaactggaatttgtccaaaaaatacggggaattacttttgatgtcaacaacagcaaggctctgcaatttgacaattttgttgaaaaggtgctcaattatggtaaagttgatgataaagacaacgacgacgaccacgatagttctgtttcgcccgctgttttctcctatcaaaagataatgccaacgcgcgacagcaagatcataactcggaagcagttgaaaaagtatttgccagtgtgtcaaaaggggatcatcaacaacagctatgaagtgttcccttttgggtatgaatgatttggcgctcaataatgtacacattttctaacattaaaaaatattgcttaaatagttggcacaacacacacacacaagaatatatctgacagttgttgttgttttgtctaaattttataatttgattttgaaaataatatttctgcgcccttgctgcgtgtctgtcgtctcatctaaatcaaatggacaatggtaagaaaggagagctcaatgatcgcaaaggtgtgaaacggcgatacccattccctctggtgtccgcaagagcacaagattcatggtaaaagtgtaataagataccgcccaagcttccgatcaaacacaggagaaccaaacttgaacaaatggaggaaaagtacgccaaaatggaagaggaaatgtcgtcggaagacagcgatgatgccatcgattttttccaagacaccattgaggatattgtggaaaagtgggtccacgtggcaaacatgtttcgatttaattgttatattcctaataagaatcaaccgttccgaagaaaaaattaaaaaatgggaggagaaatgcagcagcagcagaagtaagatggacaccatgagcacaatgatcgaatggtaggcacaaatgctgctaatacatgttatttgtttgataaaatttccagcagtggtgtggtcaacggcgaaattgatgacatggatgatcagcaggacgatgatgatgctccaacgtcaactgtttatctgaatttgggcaaagacgagcgcaccgcggaaaattattaaaggcctaaatagactgttatacaaatttaacacaccaaatgtttgaaacatttattcttcatcatgattatgttagagaaaaatagtaatagttagaataaacatattaatcggtcttttgctcttctgaaacaacatggagtaattcaattggaaaattgtcctggtgactgttgccaccaaattgtacaacacatggtaattggggatatttcagcataatgcgatgacgcacatataaatgttgttgaacagttattcccatgaatccacggtaggcaaacatcatgttggctccatgtcgggacagcgcatctgcggaaacagctacattccttttcaggtgatgggtggctaatgacagtttgttcaagaatttcacattttcttccttccttttctgaagcattttgtgaagccaagttggcgaacatcggttgaatcggcagagcactctcaccaagtcgcgtcgttctctttgtcgtcgtcgctgttgcttgcgctgtgcagatccaactcgtccactgctagctggtaataactgctgctgctgctcgctcgtccgcaacgtgagagacattccggcgagtcgcccggacaaatcatcagatccttcagttccacatacagaggttcgctcctgaatgtaaattttatttatgttttttttggtatatgttttaatttaccacactacgccctctgtcttcctcttgggaaagcatgttgtgtaaagctcgagtccctcgacaaggtcaagtgacccttccacgtacactggttggtttctgtgctcagtgtttgcaatatgcacacagtcgactgcacgcaacggattcggaaacaatgactggccgtctcctgttggacaattttttatctcctccttaaggtaagcgtagagctcgtcaatgttgctcagtccgtaactgtcagtcaaatagcggattgcacgctgcatacaaagcgcacagcgaacagataaatttcaaatttagtggagaagcagcccgcgcgcgcctatttgttcagagcggggacgtttagaaattctgttgatgaataatggaatgatctgtaggcaaaatcggcgagtttatataccgattcctgacgacttaagctatagtgatgatgctgtcaccgttgtagaattataaacggtagattgttgggggtatgggccgccccctgtaccttgcaataaagacattgagtgaatcaggtcatattcgtccagctttgtcacagcggcatcgctgtttctgttgctccgacggaccatacgaatagcacatattccgatcagtaggaccaccatatcaagcaggtaggttaatgtaaacatcaagttctctgcccaatttgatgagggatgaactacactggatgtcgcagctgatcgtgcaaaatggccgtcaccacgatcgcgctccttttcttcaaacagaagaaaattgaaacgagtgtcgctggagttggtcacaaactggagctgtgagaatgactgattatggtagccgcctagtcggaacttatacacacgtcttctcctaatcaggtacacatgatttgaagcaatgaaataatccgttttttgctcgggcaacaatccgacaaaagtgcttcgaagctggtgtgtagcattgttattgccatttcctgtaacagcagcagcagcagcagcagcagtgttattcatcagccaccatcgcgccaagtctgagatggacagctcattgatgcgccgttctctcttgtctaccaaatacagccgagcatcgatgtggtcaaataatacgcgtccatatgaggccagttgatgtgcaactttttgtttttgaccacgcatcactgccacttcatttgctccattttttaggtcgaaaataaaaaagttgtgattgccatgttcaaaacatgccaatggcaatgcgtcaggtgtcagctctattgttgtctctcccgtgcgcatgaatgtgtgaacatcagtcagcgtgatgcgccacatagcatcgctgttgtatagcagattgacatttcttatcctttcaactgtgcaggctgtgttgcgattgtacccaaatagataggcagagggtgagtgtttggaaaacgatcttagggagccgtcaaaaaaatttggcgtgtcaacgctcagctcaacatttatccattcgccccgagacaaatggcaaatagtaacgcttagaagccaaattaatgcaaaaatcattatttttttctgtaaagcgatttgctacaatgctcaatcgcccgcccttttatacatgaagggatagtgtacatgtatgcgtacgtgtcacaacaccgccatctcagtcccgtttaaagcgcaggacttattaccaagtttcggacaaaccatttggcaagaaaatccgcaacacttcgtgtgcgacgtagcgtttccatcactttacagtatggggttcctgagcatctgcttaccagaaaataaatacaaaaatgaccacaggcatccgagttgacaaactgaatttgctctttgtttatgtgaatttttgaaaaattgttcaagtatgatgacaaatccgcattcggttcagcacccaagctgtcaaaatattcaacagtacgtgcatttgacacgtaacatgctatccaatgttcaccctttgtgccctctctgccagtgtttattaccatacagtgagggaatcttttacgttcaagtggaaccttattggacgggaagacgccaataaatttatgcttagttttttgtaatctgttcagaattaaatgaatttgcaacgaattcattttagcaagcgcccagattatttatacacttccgtctgtgctgagcacacgatctgcgttaatggagaggatggagtcaaactcgccgaggatcaacatttcataaccgtccgcttttataggctgctcaaattggaccttaacagtgcacgtaccctgacggattagctcaaatcctgccgtatcctctagggtggaggtcatcgggatcacaaaaaatgcccatccgtttaagaatcgttgcatatcaattgacactgttttattgttgtctgtttcgtcgagcccaaggccagcatacatgtccacaaatgctcgtatgaagcgttgttgtttgttgtcgggccctccctcgaacgaaaacaggtacggagtggagggaaatgtttgtccatttgcctcagcactgagcgatcgtacatgcgcatgctcaaagttgaacggtgacaggtgacgggctccggaataggcatccgttgatacaaatgtacagatcaggcgacgaggcagcgttgaggtgaacacgttatgtgacagctcggttcggcctgtgcccaaaaacacggagcgcatttccaccttacgaagcgcatattttgcggaagaattctccaattgtttactaattgcaaggtttaggcttggtgttacgtctacggtacgcacataaatacgcatatcgtgtagccgaatacgatactcatcagtgttttcgttccatttttccgtaccatcagcatttacggtcttccaaggcggcgtttgcagaagaagcgcatcgctatttcggtgaattgtgaaaacaatgtcttggttgttaagcatcagtgcattctgatgtgcgagatcgaaattcagcttaaccattgtttcacacattctgccatccgaaaaccgtgccgcccgtttcatgaaaccttgattttcactgctgttttggtcaatgtcatccacataataacatgcggcctcgtggaatgccttccggacttccgcagagcagcccagctcctgcataatataggctcggtagtggtagaaaatcgagctgtcaaacacctctattccagagatgtttattttaagggatcgaacgaaactgttcccaaaattttgtattacgcccacattccgatcttggatacgtcggtggtttgttggcacccattcgccggcagcatttttgtactccatggaggtgagcaaatacaaataggtcttgctcaagtcacaatattgactgtctgaaaaaagtcgaaacagatagggacccgtttgattcagagcggacaacggtaacagttctctatccgttgtcttattgattgccacgttggttggcgggagagagaaaaatgataggcttccctccaagccttccacactatctttgtctatttttttaattacactcattttttttttaagaaacaaaactgtttttaattttcctgtgtatgcacgtcacacgccttttggtatcccttttatacattttttttttggtcgtcagagcaactcaaggtgcaaatgtaagttggtcaattacatgtctctttccctttgtcatcactgaacttgggtatttcttcttcttattattaacgcttgatttgttttttgtcagtgttgttgttgtcttggcggcaccctttccacactgtctcagtttttcagccaagttctccataccatgttttgcatgtgcttgaattgactctcggagcgctttgccctgggaaatgtcttcaagcactcgattgccggccgtaagtccttcacgtgacaccgtctttagcaaatttgacgcaaccggcatcaggaaacgggccacattcttcagaagaccggcacctcgttgatagcgggtgccaacaaaatattgcatttcgcccttcccctcttgctgtagtgccaaaaaaggcgcccaatctacagagtcgggattaaaaggtatgtgcgtcattttttttcggtgttgatcaaaaaagtttacgcctgaaatgtagcgtgatgatgcaagtaccccagttaaactttacgtatcgtccaaatgcgttctgaatttcaatttggatttcagaaattcgtttgttttgaagagaatggaaaatttcattggtatatataacctcgggcacgtccgtccctcctggtgttgcagatacattaacaaccctcagcaatggagccatcttatcgccaattatggattcatcaaccagtttaggagcgtacacatacaattgtttaacgccgccggaaaggtcgggcatgtattgtgcttgttctccatcatagagacgaatactgttaaatcctagaacatatgccaggtgtttgctgacatcaatttgtaccacgcctgatcctgttttcagcacaaatcgttgagcaagctcattgaaatgaaattccgcggcagtttttccctttctctgttcttcaacaagccttttgaagctcgcttcagcttctccggtatatttatgatgctctaaaatcagcttaaaaatttctcctctcgttttggctgaagaataatattgatgctgtttctcatcctttttcttttcaatcaactccttcagagcttcacctcttgtaagttgccgatccgagtcggatgaaccatgaggcggcggcctcagcttgtcctcctttacaatattttcgagcaactctttgagaatctggcctcttgtgtgaccttctccgctgttttgcgtcacgtcacgaatgggctctttatctgctaacgacaacattttcttaagcagctctccatgtgtctgctcaattgtaattgctgagccagtgagactttgagcaccatccctttttttggcaatcatgctcaccaatttatgacctcgcgatagtaaatcgacggcatcgctgtcatgatcaccatccctctcagctgatgcgctggtgcctttcttttgttctagcttctcttttagaacctcggcatgggtttttggctctgctactgctttgccgtcattttgcaactcatttggtgtcgacgtggctatatcttgttgttgttgtattttctctttgagaacctcagcgtgggtttttggtttttccatcgaattattattatcctgatccgacttttctgtctgcttcacttgaacggcacctaatcgctcctttaacgcctctccggcggtcaatgcagatgaaattggtgaagagaatggagaggattgttgctgttgtccgtcacgtttctttgcctcaaattccaatgcggcaaatctcttgcgtctgtattccagcagttgttttgctcggtcaatttgctgctggaacgatgagtgctcgtcgtcctttagctgcttctgtgccgttttttgttggagttcttctatcttgtcgaactgttcccggagaccgtcgtagttgttatgaattatttgccaataattggtcgggtgtctttgaaaaaattcctgaacatatacgctattctgttcatggctgctcttttcatattcctctctagtttttcgcgaggggtcatcactgttggcgcgctgtagcacagcgctctcaaacaaattaagattgcgcagcaagtatttgattttttctctcagcttccctgtctgttcattaagttgcacaatttttgctccatctctttcaccgatatattcactcattttttcttgcaaaccggacaaatattttgtgaagatcagtcgagactcgttcagttttttttcatgatcatccggatggtgatggaagaattcccgtatttttttctgctgattctcaggggtgtcgtcatcacgacgcttcgctgcccgcttaagctcctccagctcatcatcttttctcttgaggcgaagccttaaaattttcaattcaccttcaagttcattttttcttttctgctctgtaccttcggcaccatgttccctctccttcgtatcaatctcctctctcaattcaaccaaccttttttccaactcttcaattttttcccaataatcgacagggtgatcgtaaaaaaaaagctccgtaacgtcaatttggcgtttcactttggcggctttctgtgatgagagcccaaaccgctgtttatacgcatcattaattatatcatttaatgtttgccttaaatgcccaacactagagaattgcatactcggtatttttagctcaatatccacaaaacgtttgtcatccgcaaatttaaaatttggatttacaagtttaatgctgatgaagtcgtcatcatcaattccgacagatgggaatgaataggggtagataattgatgaaagtgcaaccatccagtttgcgtccaactcaagcgtatgtggaagcctgacagtgaattttgaggtcgtgttccctggtccaggtgaattggatggtagtaccacataaaattcgtccattttttttttatttagcttcgcgctcttttacaagatcagcgtcccgaatccacttgttatactgatcggaatgcccaatccaacggacaaggtgttctttgactccttttcgggtccgagattttaacacttcaaccctgtgggttgtgtccttctcactggttttcaccaactcctgctcgtagaagacacccttaatctcttcaccttgtaaatcgcgaattctatatgagggaggattggttggtttaacctgtgctattttgaatagctcgtcagtaaagttgggataatagccttttgtaaactctcctttctccttgcttatgcgcacagtgtcgcccagtttatattttttgttgttattattttttgctcgtttaattgaagaggtagttgatgaattgggcatatccgcttccttatataacctgtgccatagtggaggtgcatttttgaatgtcactgcacttggtttcacccccgtggtccgatttacagaattattcaaattttccacaattttatcaatcacatccacccacctcgttgtattattttcactaaagtagcgataaagacgctccttgattgtacggttagccctttcaatcacaccggcatgcagatgtggggaatacatcacatgctttataatgtccttctttttccaatagtctaacatacgctttgcttgaaattctagcccagcatcactatacagtttattgagcagaacattatttcctttttaaacaccttttcaaacgcttctatcatatgttcactctttttagactcagattcggcggtaaaaatgcgtcgactaagcacatcaatacaaaccaataagtaacggtatccatcgttttcatctttaagtgtattcattatgcacaaatcacattgccagtcagtgtgaagaccgcttggaatagtctttaggcgcggaaatttattccgacgcggtttaaacagagtgtaggttcgctgatcatgcaaaaatttttgaacatcgctaataccaattgatttgttatgtttttttgcttcttgccagaccttgagagcccctgcgtagcttgccggggagcgaaggtcataataaagggctctagtagcttctctacagttttgcccantattgctgg

SEQ ID NO: 66 - DNA, 4584 bp, Heterodera glycines
atttttgtgatttttttaaaattcttaggggtctattttctgaaattttttcaggtcaattcttaggggtgttttttcatttttattgcatttttgagaaggatttttccgaaaatcccgaaaaggcgccaaaaatggcgaaataggcaaataggcattaagcacaaaaagtgcaaaataggcaaaaataggcattataaaagtcatcgtagacaccccaaaccaagcggaaaatgcttttttcgtgcttatctaagcgtattaggtgcgcagaaaaaagaagccctaatgatcagtccctgtaatattatacctaatgaaataaatttgaaataaaaaaggttcaaagcgttcaattatgccattcgccgttcacttatgtgccgatggaccaaacaatgtggcggtgcaacggaagtcgctgagtcggctcgaatttgtggacatttttgtaaatgacagagaagcgatatatgtatgttttgctatatcgtatttcctaaaatggcttttaaatcaaatatagtttactttagaaattatggaattggtaccattttattggatttttgggtcctaaataatattatctcataaaatgattttatcatgcaacttcaaaattgattaattcaatgattgtccatgttctgaatacaggatttatttaatatttggccattttccatttttaacaaaacaaaatcaaactatcatattttgttaagaaaagatatttatgcctttaatcgccaattacctggctcgtatttttattttattttttcatttctttttgccagataaaacaataaaaaaatataaagttgggagtttaattttatctgtactgcttggtcttattgtattagtttttgttaaaataaaaaataatttgtttgctcacaatttgcaaccggcaaaaaagaaaaaaaagacctgatcaaaataaatggtcaattttgaagtaattataaaagcattttatgtaataaaatgattaaaaaaactataaaattaaaataattttacaattcccacttctttctccagcactttcactgttttttgtcattgtcaactttgacactactgaattattgaatttttacgccactttaactcttaggcaattaaatcttgccttttttgatgttttgtttaataaatgataactttggttttttaaatactattcagaaaattttttcataaatattccattaaataaatctctaaaaaatccccccgtcttcatttattatcggaaaaatcaaaatttaatttccccattagtaaatttgcttcgactaattcccatttttttttttttgcaatttttaaatttaactctggcttttgacgaatatttccacattttacccgccagcgaaaaacgaacggagcggcaaaaccctcgccccgtcaaaccaatgccccagggcaaaagtgaaaggggcagcgaaccgccgccccgccagcgcaaaaagaaaaatcacgaaaaaatgttataatattttaaaaactgggttttatgatattaaatattaaatcattgcatcgcccaatgcactgaaacagcaaatttagtagcaaatgcataaaaaattacaaaattcaaccattaaaatttggattggtgggggtattcaatttaagttaaaaatttattttctgtaaattcttggaaaagcaaaaaagtttttgagaacttggggggaggaggtccagcggttccgataggcgccgccgtagaaaattttgaatatttaagggtgatttgttaacagattttcaccaaaaaatgacaaattttttgcgattttttgtcaatttgttaagaaaaaatgtgagttattttttggaagggcgatgggcggtgccattggcgctaaaattttaaacagattttcactgaaaattttcgatttttcggttaaatttagcaaaaattaatgattgttatgacaaaatgctaaaaatttgatttttttacataaaatgtacattttttacactcatacgcaaaaataccggtttccaattacatggaaatgaatacagttaaaattttctaagcacaaagccgaaatccgagtacgtacttggcatccaagtacgaatccgagccctgttataacagattaaaaaaaaagaatttttcacaaaaaatgaaaatcagaaaaaaatgaatgaaactggaataaattgaaggaaaaataggcaaaaaagttgggcacaaaacgtactcttattcatagatatattaaaaaattaaatttaataaattcaaagcaataaataatgaaaaactcagaatttcgaaaaaatttttaaaacaaataagtgttgaatattttcaggatatgtgataaaaatgtttaaaatagattctaattttatatgatgggttgaaaatgcatttatagaaaaaaatgaatgttttgtgtttcgaaagttgaaaaatttctagaattaaatttacataataattgctctgaaagatgaataaaaacacccagcggcgcaatttccaaaccaatttctgatcacacttttcgggaaaaaattcataataaattagaaacaatgatcacgaaaaaaagtgaactgaccttgaaaaacatttacgaatttggattactttgctaaaagacttgtgttataaaaatttctaatataatttttttataaacttagaattttgatcaaatagatacaatttaaattaaatttttgtcctcccaaattaaagaccaaattaaataaattatttatccaaacagaaaaaattattgaatttgcaaaatgcaaaatgaatctgtgttttgcgttctctgacataaccgttgtttgatcaatttattcacttttttcggaaaagaaataaatccgaccacagtcacaaattctatcattttaaacaaaacaataaataaataaaatttgtccaaatgacttatgccctcagatattccaatttgaagccattaaaaaccgaattaaatctctcaggcattatgtgaccaattaaggccaattagcgcccgaattaatggtgtgtactgttctcaaccacttgcttctgtttgccggtgctgaatgtcatccgccgagctctccaacactttgatctcttttggcggcggcatttccatcgccggatcaggcggagaacccatgccattcagatgattattatgctgatcaacaattttttaattggtgcacaaattggaatgtgtttcaaagcgtctaaaaataaatttacgatcagagaccaagacttgtcgagactgaattaactaaaaaagaatggaaaattaaacaaaaattttgaatgaacataccaaaaggattgaaagcataaatactttccattttttcactttttttttgctttccttcaatttattccattttctttttgaatatttggttcctttttgctagattttctttttcattttattaaattttctaattttttctcttttttcttctgatttttcatccaaattttcttcttccttttcctctcattttcctccaaatatctttcgttttttttctcgtatgctttgaatatagttgactttctttatttttgtttgtttgatttttccgaaaagatattaaaaaagtaacgtcgtattcttaattagctgctaaaattgtgaattggtcctaaataatattatctcataaaatgattttatcatgcaacttcaaaattgattaattcaatgattgtccatgtcatgtttctcttattcaattcagtgacatatttcaactccatgaaattgttaaaatataattttttgggttatattttttcatgatcaatttgcttccaaaatacctagcccatttagaagcgttttaaaacaaaactaaattgaaatttggggtaacgacagattttggcgtcgatgaatttgaaaattttaatgcgattattttcttcacaagaggcgtcggcgggagaaaatttcgcaaattttttgccatttcttaatagcaattttgggtttggggtcaaattctgaaatttacacaaaatttttcaaaggttaaaatttgtttaatcaaatttcgtttttattttcacgaattcccattcgcaatcaatattttatcataatgggcgaaatgtttcataaatatagcgcgccctctttggaatttcttggggttttatgggtcggtcgctcgctgatcacgaattaaaagaaattaatgacaaaaatttgcctattaaaaatatttttatttttggtaattatttttttattcatacatcactttcttataaatagcccatttctttcattttaaatatttcttaggggtgtattttcccgagcctaagcttttgactttttttggctttttgccggtcagctcttttatgtattttccaaattgaattttctgagagcgctagcgccctctttggaattgctgagaaaatgtctttgtggagatataatgagagtttttaaaatgaatgcaaaaatgaaacacttcttttgcttttatgaaaatttagcattttaaaattaaacggtattttttcaa

SEQ ID NO: 67 - DNA, 7349 bp, Heterodera glycines
  misc_feature (28)..(28): n is a, c, g, or t
  misc_feature (40)..(40): n is a, c, g, or t
  misc_feature (80)..(80): n is a, c, g, or t
taattggtcacataatgcctgagagatntattcggttttntatgctttcaaattggaatatctgagggcataagtcattnggacaaattttatttatttattgttttgtttaaaatgatagaatttgtgactgtggtcggatttacttcttttccgaaaaaagtgaataaattgatcaaacaacggttatgtcagagaacgcaaaacacagattcattgcaaattcaataattttttctgtttggataaataatttatttaatttggtctttaatttgggaggacaaaaatttaatttcaaatgacttaaacaaacaaataaaaccaacttggtcggaaatgtgcggcgcacactgtcgaagcataacagcacaaagtagacgaccatataagtgccgaacgagatcaagcagagccagtagttgtttttcgcaaattccattaggggcggatggacgaacggaacggcgcacatcagagagacaaccccgaacttaacttgggttcatatagcgaaataaacaataagggaagggaccgaccattacaccaatgacgaggaacactttgcggacaaaagcggcacgggtgatcggttcgctgaatccgtgctcatctatgggcatgtcatcctcggcactgctcagattcgtgtgcacaaatccggcacgaatgctctcctctttgaagccgagttcatttttggacgttccttccccgataatgttcagttccatggccccatcatgcagctcctgtttctgctccttttgctgtccgaagtatgccattggtcgtttgttataaatgaatttacttaaatgaaaagagaaaaattagaaaaacaacgaaaatgggaaaatgctccgtggtatttcaattggaattttgtaaaaattaaaagagaaaatgaatttgggatgtaagggacttgaactttggaccaaaaaattgtaaaagcttggcattttttatctcggcactttatttcatttgacaaaagttaaacaattttcttaataacatacggcaaaatcttggttaggtttaatgaataatataagtgatcggttgccagttgaatgtgacaaaaactaatttccaccgctttaaataggcacaacaaaggccaaatgaaaccaaataggagttgttacacaaaagaatatgattgttgtaatcattttgttgacaatttgttcattttggttttagcttcgaccatcgttaaaattattacatttttcttcacaggaaacgatttatttttgccatcaaattgtgcgcaaaagcactggtttagacctgttcactcatttcattttttccccgtcccaaatttgcgcaaaagcactggtttttgctgtctttacatttaattttggccgtcacaaaattgcaaaaaattatttttcattttacgcaaaaaataatgcaaacaatatgtgatagaaatataaaaaatcatataaaattaaatagatatatttttaattttcattttttaaaatgctacctaaatccatgatgccattttattatgaaatggctaactccgattttcttaatgatttcggcgtaatttttttacattttttgaatcttttcttctttcttgcttaactttttattttatcttattaagtttttcaataattatttttctttttctctgttctttctttcttttttctttaatattttcttcgtctttttctgcccattttctccaaatatttcatcaaatgattttatttcaattttttcttttctgagccaatttttatttgtttggatggacaaacaccaaattaaaatcttgcagcgtaatccaatctattactattcatgaaaaatcagagctttcaattgaaaatttcaaaattgcaaaagcatgttttaacagatgttgttgaccaaaaacgaccagcgaaaaacaaacggagcggcaaaaccctcgtcccgtcaaaccaatgccccagggcaaaagtgacaggggcagcgaaccgccaccccgccagcgcaaacagaaaaataacgaaaaaaattgttataaaattttaaaaaccgggctttttataatattaaatattaaatcattgcatcgcccaacgcactgaaacagcaaatttagtagcaaatgcattaaaaattataaaatccaaccattaaaatttggattggtgggtattcaatttaagttaaaaatttattttctgaaaattcttgtaaaagccttaccaaaagtggccacatttcgcgaagtgattgtgttcaaaaaaaagcggcattaaacaaaaaaccgggcggaataattttgaaaaggcattatgcttatgttgaaaataattctgacaattaatggcctaaattaaaatatttaataattaaatttattttaaaatttattattttatggaaaattaatgtgtcaattgtcattaaataaagaaagaattcagaactttgagctaattgctttgaaaattgatataacaattagttaagattaaatttatcaatttgagaattaattcactttgtctgtttctgtcaatgttggcattcgcttttctaattttgttcacttctccatctgaatcggaaattggaattcctaggatttcaattgatttaatgagaaatgaggcgaaaacaaatcattgaaaattgattagcctagcaggtggccagccgaaaaaatgttttttcaaaattttttagctttttaggctctcaaattaaaatctagaaaataggcagtaataacttgaaaagtagcttaaattagatgaaataaaagcagtagggatgctcgaaaaatcattacaaaacttagcaaaattttgattttattcggctacaggagcggtatcgagtatcggagtcaaaaaacgatatcgaaagcgcttcgaatatgattaagacattcttaggaataaaccacaagataagaacgccacttgtttcacatataaattattgtgggcaaacaaagattttggcgctgttctaacaaaattatttgaataaaaaaaaagaaatttgaaattaaaataaatttacaattcccacttctttctgtagcattttaacacttttttttgtcattgtcaactttggcactgccgaattaatgaattttaggcgccaactttaactgtttggcaattaaatattgctatttttgaaatttgtttttaaccaaagcattagaatggagaaattatttgatcgtttatggcgagttttttcgtcacattttcaatgaaaattgctactttgtaaggatgattaataaagaatttccgtaaatgcgatcactgttggaaactgacagaatttcacttaattcggtagtactttatgggtgctttttccgaattttaattgtcaaaaaaaacttttgggtttatttaacgtttgagaaaatttgatcttcgattgctgatcgtaggcgtagtgttaattcttcaaaattgtaaaaaagtgatttaaaaagcaaaataaaaattaaaaaattaaataatgtataaattctatttaatagatgatcagtagggcttcttttttaggcacaaaaaatcgcgaaataggcacctaaaataggcagaaaaaatcgcaaaataggcattaataggcacaaaaatcctcgaataggcactaaaataggcaacaattttttttttattaacgctttgtaggtattaaaacaagtaaaaattaatttaaaaaatattttgcttatatttcaattgttttaaagttgttttcgataaaaataattttttaaaccaaaattttatgaagaaaaaatgattaatttttggggaagaatttttgtgaattttttttaaaattcttaggggtgtattttctgaaattttttcaggtcgattcttaggtgtgttttttcatttttattgcatttttgagaaggatttttccgaaaatcccgaaaaggcgccaaaaatggcgaaataggcacaaaaataggcaaataggcattaagcacaaaaagtgcaaaataggcaaaaataggcattataaaagtcatcgtagacaccccaaaccaagcggaaaatgcttttttcgtgcttatctaagcgtattaggtgcgcagaaaaaagaagccctaatgatcagtccctgtaatatacctaatgaaataaatttgaaataaaaaaggttcaaagcgttcaattatgccattcgccgttcacttaagtgccgatggaccaaaacaatgtggcggtgcaacggaagtcgctgagtcggctcgaatttggggacatttttgtaaatgacagagaagcgatatatcttttgatgtaccgtatttcctaaatgccctttaaatcaaatataatttacttagaatttatggaattggtaccattttattggatttttgggtcctaaataatattatctcataaaatgattttatcatgcaacttcaaaattgattaattcaatgattgtccatgttctgaatacaggatttatttaatatttggccattttccatttttaacaaaacaaaatcaaactatcatattttgttaagaaaagatatttatgcctttaatcgccaattacctggctcgtatttttattttattttttcatttctttttgccagataaaacaataaaaaaatataaagttgggagtttaattttatctgtactgcttggtcttattgtattagtttttgttaaaataaaaaataatttgtttgctcacaatttgcaaccggcaaaaaagaaaaaaaagacctgatcaaaataaatggtcaattttgaagtaattataaaagcattttatgtaataaaatgattaaaaaaaactataaaattaaaataattttacaattcccacttctttctccagcactttcactgttttttgtcattgtcaactttgacactactgaattattgaatttttacgccactttaactcttaggcaattaaatcttgccttttttgatgttttgtttaataaatgataactttggtttttgtaaaatcatcagtagggctgctaattttatgtaaatactttaaatactattcagaaaaattttttcataaatattccattaaataaatctctaaaaaatccccccgtcttcatttattatcggaaaaatcaaaatttaatttccccattagtaaatttgcttcgactaattcccatttttttttgcaatttttaaatttaactctggcttttgacgaatatttccacattttacccgccagcgaaaaacgaacggagcggcaaaaccctcgccccgtcaaaccaatgccccagggaaaaagtgaaaggggcagcgaaccgccgccccgccagcgcaaaaagaaaaatcacgaaaaaatgttataatattttaaaaactgggttttatgatattaaatattaaatcattgcatcgcccaatgcactgaaacagcaaatttagtagcaaatgcataaaaaattacaaaattcaaccattaaaatttggattggtgggggtattcaatttaagttaaaaatttattttctgtaaattcttggaaaagcaaaaaagtttttgagaacttggggggaggaggtccagcggttccgataggcgccgccgtagaaaattttgaatatttaagggtgatttgttaacagattttcaccaaaaaatgacaaattttttgcgattttttgtcaatttgttaagaaaaaatgtgagttattttttggaagggcgatgtgcggtgccattggtgctaaaatttgaaattttgctcttttttaaacagattttcactgaaaattttcgatttttcggttaaatttagcaaaaattaatgattgttatgacaaaatgctaaaaatttgatttttttacataaaatgtacattttttacactcatacgcaaaaataccggtttccaattacatggaaatgaatacagttaaaattttctaagcacaaagccgaaatccgagtacgtacttggcatccaagtacgaatccgagccctgttataacacgtggtgagtcgaagtgcaaaaagtccgaatgagtgatgatcagaagaggcgggtcatttcagtaccgaataatattttaattaattaataacctgaaaaactatcttatagttcatttaaaaacttgaaataattcatgcttgcataacttttggtgctgatcaaaaaagtctcttacaccaacttgatcagatcactccttcctagtgaccgggacacccaaaatacactgaaaatcggggaattttcgaaatccctagggggcttgaaaattttttctagagaaaatggacaagctcactggaaagagcacaaaattctctactgatttgacttttgaataatggggctacgacttcttcataaaaagatatacttggttgaaaatttgatcaccataaaaatgatcaatttttgatcagcgtcataattttttctagaagcattcaaattaagcattcttggtatcatttgatagccctaagtgtcctctccaggaccccggcacatgcgacaaaaacattggggtgcttttaaatggtacatatatgaattttatcctttttctgtcaacactatccttggcctgttggttgtgctctggatttggctcttgggttcgggtcccccttatatgttgccgaattaattgaattaaaacaaaaaccctgggggtgttttaaataacaaatatataacatttgtccttttctgacaaaactatccttggtctgttggttgtactctgggtttggctcttgggttcggatcccctaacttctgggtgaattaatcggattaaatcctctcatgggtttggacccccgcccttgggaccaaaaccatgggtggtctggacataaaaattctggtacaaaatggatattttttttggggcggaaaccgtttttgagtagatttagactagaaaaaaatgtgaaaatatttgaaatcatcgtttcccacgtccctttctcccagggggtattatttatgtaaagtcatttgttttccccaataaactgtttcaaacctccatttttacgcaccagtgaatagttatgttttatgtgaattctagaaccgtatttgagtagattatactatgaaaaaattgaagaaattttgaaatcatgatttcccactcctcttctcccaggaggtattattttgctaaagtcttatttttcaaaataaacgttttcaaccccatttttcgcaccgtgaatgttatttttattgaattctgaaccggtttgagtagattagactagaaaaaattgaaaattttgaaatcatgtttcccac

SEQ ID NO: 68 - DNA, 5109 bp, Heterodera glycines
atactactatagataaaaaaaaactagaaaaatgggcattagaaaagtcatcattgaaatcactaccaagtggaaaagcattttatatgctttgcctaagaaaatttggatattttttagaaagaaaagcattatttaatataaataatggcaaaaattttatggtcatttcattatattaaggaaaaaggttggcattccaaaataactgcttaaaatatgccaaagttgcttcatattatacacaccgtttcaaaaaacgagatgtgtaccaataaatagagagtgccagagaaaaacattatctttttttctctaattttttgtcttcttttggcgtactatctaatatttttgttattaggaaaaacaacattcacttcgaacagcataacttttttttcctcaggcagaatttcttttaattttgcatatcgatagagaaaaaaatactgcatctgtctatagtgaattcatttttgtctatggtcaaactcaaaagttacaagtttggaacacccatatcttttttctgattcatcaaattgcttagcatttgcttagaaaaagcttctcctgatcaggaactttcgaatgataccatgattgtccaatttggttggcaaaaagcttcaaaaataattcccaaaattcgtcattttttaatattttggacaaaaataaataaaaatattcatgttgcacaacggactcgaaccaccaccctttgtccctttactatcttacaaaaaccactgagccacacatgcaaatctttttggaactgggaggccaaaattgaaacggtgtgtatatggactttttcgcaaaatgaatttcatgtggattaaatttatattttattttggcaaaaatgttttgtaaattattatttatcatatatggcaaaacatttccgctgtcaacatatgtacattcctactttcaattgagttttttctaagaattattttctttaagaaatgcacatgttattcatataattatactatcagtttcaacttccgtttatttatttgtacattaatattttagataataacataaattgaaccaagcaaaaataaattaaaatttattttttggataaaaggttttgcttaatttcttattatcggatatgaataataaagttcaagagtcttggtcttgtaccaaatttttggccttgactatgagggtgaaggttttcgaaaaaatcagctcataactaaatttgcactattggttttattcactgcgggcgatgaacaacgaatgaaaaagttcgcgagggtagaattaggaacccaacccttgcgcatctttgtcatttccttccttgatcggtcagcggcgcacattttgctttcggcttcttaaccatatgttcataatgaaaaaagaatgtggaaacttttacccgtcaccgaagatgcacaaaaatccggataaatttcgggtaatgcccattacaagggtcgtcgcaacaaaaatgtgttcttccgttgaaatttcgtatttttttccacccataatcacctaataaaatataatttgccacccaaattcaatgaaaacatgcctgaatgtagatggtcaagtaaaatataaagagcaaagccacgacagatgagtaaaaaatgtgccggaaaagggtggcaatgatcggtttgagaaaaaacgggaaaaacatacaacggttgaccgtagccgaaggaagaccaaaggataagcagaaggccgagtatcattaacaccatagtgatgataaacacaaagccgagcaaactgaaagaacggtccacccattaaatgtaaaatccacgaaatgacgaggtttttgagtaaagggaaattgatgaacagagctgggacttatttagaaataaaatttattaagctttaaaaagttgggtttactgtgttcatttctttgttgtcagtagagcccagaaatttcaaatttgcggatctcgcatagggattgaagctcaaaattttttgcgggacggtatcccgcgggattaatcccacaaatccagtaatcccgcatttaacttcatgacatgaaaaagccaaacaccaaaaagggcaggaaaatgcaatgaataaaacacctgctagtaatatcgcgtttcgtgaccattgttaacagtgcgatcccaacacatgaaacggtagtgatccccatggccaccaaaacggacacggacgaacagaaagcggttatgacctaaattattccaaatgaaattagtttgtgaacaaaaatcatcgcacttaccatggcgagaaaaccaatggacaatgtgaggatggcagtgaaaatcaaactgagatgcaaatggtggaaaaccgacgaaaacaaacaaataaaaccaacttggtcggaaatgtgcggcgcacactgtcgaagcataacagcacaaagtagacgaccatataagtgccgaacgagatcaagcagagccagtagttgtttttcgcaaattccattaggggcggatggacgaacggaacggcgcacatcagagagacaaccccgaacttaacttgggttcatatagcgaaataaacaataagggaagggaccgaccattacaccaatgacgaggaacactttgcggacaaaagcggcacgggtgatcggttcgctgaatccgtgctcatctatgggcatgtcatcctcggcactgctcagattcgtgtgcacaaatccggcacgaatgctctcctctttgaagccgagttcatttttggacgttccttccccgataatgttcagttccatggccccatcatgcagctcctgtttctgctccttttgctgtccgaagtatgccattggtcgtttgttataaatgaatttacttaaatgaaaagagaaaaattagaaaaacaacgaaaatgggaaaatgctccgtggtatttcaataggaattttgtaaaaattaaaagagaaaatgaatttgggatgtaagggacttgaactttggaccaaaaaattgtaaaagcttgacattttttatctcggcactttatttcatttgacaaaagttaaacaattttcttaataacatacggcaaaatcttggttaggtttaatgaataatataagtgatcggttgccagttgaatgtgacaaaaactaatttccaccgctttaaataggcacaacaaaggccaaatgaaaccaaataggagttgttacacaaaagaatatgattgttgtaatcattttgttgacaatttgttcattttggttttttcttcgaccatcgttaaaattattacatttttcttcacaggaaacgatttatttttgccatcaaattgtgcgcaaaagcactggtttagacctgttcactcatttcattttttccccgtcccaaatttgcgcaaaagcactggtttttgctgtctttacatttaattttggccgtcacaaaattgcaaaaaattatttttcattttacgcaaaaaataatgcaaacaatatgtgatagaaatataaaaaatcatataaaattaaatagatatatttttaattttcattttttaaaatgctacctaaatccatgatgccattttattatgaaatggctaactccgattttcttaatgatttcggcgtaatttttttacattttttgaatcttttcttctttcttgcttaactttttattttatcttattaagtttttcaatgattatttttctttttctctgttctttctttcttttttctttaatattttattcgtctttttctgcccattttctccaaatatttcatcaaatgattttatttcaattttttcttttctgagccaatttttatttgtttggatggacaaacaccaaattaaaatcttgcagcgtaatccaatctattactattcatgaaaaattagagctttcaattgaaaatttcaaaattgcaaaagcatgttttaacagatgttgttgaccaaaaacgaccagcgaaaaacaaacggagcggcaaaaccctcgtcccggcaaaccaatgccccagggcaaaagtgacaggggcagcgaaccgccaccccgccagcgcaaacagaaaaataacgaaaaaaattgttataaaattttaaaaaccgggctttttataatattaaatattaaatcattgcatcgcccaacgcactgaaacagcaaatttagtagcaaatgcattaaaaattacaaaattcaaccattaaaatttggattggtgggtattcaatttaagttaaaaatttattttctgaaaattcttgtaaaagccttaccaaaagtggccacatttcgcgaagtgattgtgttcaaaaaaaagcggcattaaacaaaaaaccgggcggaataattttgaaaaggcattatgcttatgttgaaaataattctgacaattaatggcctaaattaaaatatttaataattaaatttattttaaaatttattattttatggaaaattaatgtgtcaattgtcattaaataaagaaagaattcagaactttgagctaattgctttgaaaattgatataacaattagttaagattaaatttatcaatttgagaattaattcactttgtctgtttctgtcaatgttggcattcgctttctaattgtaaggatgattaataaagaatttccgtaggaattcctaggatttcaattgatttaatgagaaatgaggcgaaaacaaatcattgaaaattgattagcctagcaggtggccagccaaaaaaatgttttttcaaaattttttagctttttaggctctcaaattaaaagctagaaaataggcactaataacttgaaaagtagcttaaactagatgaaataaaagcagtagggatgctcgaaaaatcattacaaaacttagcaaaattttgattttattcggctacaggagcggtatcgagtatcggagtcaaaaatcgatatagcgcttcgaatatgattaagacattcttaggaataaaccacaagataagaacgccacttgtttcacatataaattattgtgggcaaacaaagattttgtcgctgttctaacaaaattattgaataaaaaaaaagaaattgaaattaaaataa

SEQ ID NO: 69 - DNA, 24040 bp, Heterodera glycines
  misc_feature (5)..(5): n is a, c, g, or t
  misc_feature (41)..(41): n is a, c, g, or t
aaaanaatttcagatcgctaaatccgaagatttttgcgctntaggccaaaaatctttttttcttttgcgtcaaaaatgataaatttttgctcttttgtggtctaattttcaaaatatgctaaattagggcttcggtggttcaaataggcgccgctgaggaaaattttttttttgaaatttattgaataatctaagaaaatgtgaaaaagtatcaaaaatttgtccatttttttacaaaacattattttatttgtaaagcacagattttaaaatattgaaaaaaagccaaaaatatttaattatatttacggatagatattggtgttcaaacaaatccggtctctattcatgaggatgataaaattcagaaaattgcctacactcattaatccacgaacaatcctagccaaatacatgctcagtttttcataccatcccattaccgtatccgactttacaaaaacaataactgtatgattgacgcatacgagacacaaataaacattatttgtaaataaaatttcctttttaatctttattgtgcaaactaaaaatttattaataaaaaaattcatttttttcgtttttcttttgcaattttcttaattctgcacaaattgttgtaaaaaaaaaattggcatcaacgagcgccacaaccgccaccacatccggcaccgccacaaccagctgcgccaataccgtagccaacaattgcggcaccgtacaaagctgcattgtgttcatccctttcacgggaacggtctctaccagcagtgccatgatgataatgactatcattaccattttgaccaccaaaacagccaaacagaccaccttttttgtggctaatggaacggttatcggcaacgcttttgtcgctggtggcaccaacactttcattggcattttgttctaaaaagattcaattgaaatttaatatcagaaaattatatagacatgatttgcttataaatgagataattaaataaatttttgttattcggcccccaaaatgttacctcaataatagtttaggtggcagcctaccccggccccccgtttactgagaagtcaaaaacagttttccaagaaatgaccaagaaatgaattttttaggggcttaagggtcggagagtccgaatctgaatgcgaatgcgaaaatttgaattttccactttttgtttgaatccgggttcggtgttcgacatagatcaaaacgtgtccagactattgcgccacggacatttgcgcccaagacatttgcgcctatgccaaaaattgaatttcaattaagttttttcaattttagaggtcgtaacagcaggcgcaaatgtgtgttaacaatatcaaaaagaatgaaagttcggattctccgacccttcaacataaattaactttttctcaaaaaactttcagtttttcgaaaaatgaggggggctgccatctaaactattaccgttagctgtatttttaagtaattttatgaattagcctttaattttttttttacatttttttaactttgttactttgctcggatgtaaattgcgtttcggcaattgaatgtagcattaactgttcttttgtgttccgtaaattcattaatgcattttctttggattgagcatctccactttcaagttgagaagcccattctttcacctgttaaattattaaaaagacaactgccattcggaattttaaaaatttaaatttagcaatttaaaaaaaatttcagtattttaaatgggtaaaaaaaagattatttcaaaaaattatttactatataaattcgagacgcgcatataaaaaatgaattttgaataatttaatttaagtcagagccgagttaaaaagagaaacttctttttggcgacatattttataaatttagtaccaatcaaaagcattaagatttgttaaactatttctaaacgattaagcaaatcacaaaaagtttaaagcttgaatactgtgcaaaaggttataattttaacttttaactattttgcatctatgccaatcattctgagttttgattagctaaacgcttgtcaagaagttttgactgataccaagtttaatggatttgatcaagaaatcaaaaacaatgattcttaagtttttcttacagacaatgaatgattagtgatgcccaaatttaccttattgcactcgtcactacatagggagactacttcaattatcgattgattggcttcgcagctttttttctctagctttttttttctcttgcctatatgtagtctctaaccgcaattaatttttatttatttttgaaatattttttaaatttaaatattttgattatttttatttattttttaaatttaaattttattaaattaaaagaaaaattcaaaaactgtggaatcgaacctttggttcaggccgaagccttaaccactcggccatgtagcactggggaaaaaggaagttaaatttgtttatgtttgttacccgataaacggtgagaattgaatgaaaggaaatagtatgtctttcatagaaaaaaaggatggatggaaaagcggccattatttttgtaacattctttattttcagcaaataaatttttatttttaaataattttattcgcaactaaaaaaatgttttttgttcgatggaggcggagtgtctccctgtccaaacaattttcttctgctgctaaagcattcgcacatttcacttttaaaattgcaggtgttaaccccataaatttcatttcttattcaatttaagtttttattttttatagaaaaaatgatcccagggcagcaaaatgttggcaccccattccaatacactaatccaaattgtcaaaacggtggtcagcagtttcaggcaatttattttgttttattttacttaagtaaaaccaaaaatttgtgtatttaaatttctttaattttatttagccaatgatcccgaccgcacttgggattcaccccatgtcttcagtgatccatggcactccttcagcgggcacatttcagccaactttttcaacagtgccacaggcaattcaaattcattaattaaaaaaattctttaaaaagtcagatttaattattcaaatgggtatttagcattttgtttctcatccttttgggatgggtcaattgaatggcgcctatcaaatgcccgggggttaccaaaactcatcgtctgcttcacaggcaataaattattcaagtcttttttctttaaatacataatttttaaattatttagcaaattgttgtacctccgagtcaaatgcctccgaatcaaatgcctcccccttatcaaaacgcctctcttgtgcatcaacaacatcaggcatttgaataatttttatttaaatttattatcttttgtttgttaatagtttgtgtccccagcaactaaccaaatgccgggaaatttccaaaatgcctctttcgctcaggcaatcaaataatataaatctaaccaatttttattagtctatttagctttttattccgtcagctcaagtctcgaataatttaccacacgctcaacacaataaccaatcatttgcacaggtttaaaaatcagattttaatgatattatcaaatctattataacatggattatttttgagttttaaaattaaaaaaataaaaataaagtttttctgcatttaaaaaaaatgatattgagatgcgaaaaatactttatttggtgctatattaattgagaaatttttaaagaagcgataaaaaaaatatcttgctaaagttgttgatctttgaacaaaaaaaaaattgtataattttaaaattctttagaagtttaagtcatttttagtcaaatttacttattaatgtttttatggaattttcgggattttttttgtaattacagaatctacggcaaatcaaaaaattaaagaaattttcagttggcgccggcattgcgtgccaacaacaatcaaatgatcacacatgccatggttggcccacaaaatgccgataattcgcagaatttgcaggcaaataattcaaaaaaaattgtttttataaaacatttattttttttgtttcttttagcccacgaattggtcaaatcatttgcctggtacccaacaaaatgtcgggccccatctttcaaacaatttccaatcacaacaacaacaaaattgccagaatcttcaggtagtgtattcttttttcaaatttaaattatcaaatacactttgtttttattaaaacatttttttgtttctttcagcccacgaatttgtcaaatttgcctggcatccatcaaaatgtcgggactcatctttcaaccaatttccaaccacaacaacaacaaaattgccagaatcttgaggcaaataatttcaaaattttcacaatttttgtttgaatttcaattttttcagcaatctcgccaattatcagaacaaatggtagtcccaggacttagcgaaaatggcacgacttcgtttgattttatggttaaatcggtctccaatttcaatcagattttaccgtaagaaatttacaaaaaattcagttctattaatttttttgtaggccaatacaattattcgtttcctctttggatttccgtgaggctcaattaacaccgaatggtccaatgcgtgtttgtaatgctatcctaatcaacggggagggaaagaccgttgaggtctcagcttggcgcttacaagcggatgtgttagcatcagccatgagaggctatttgtacattttcgtaaactgccgtgccaaaccaccgcgagaacggaccaattgctggttcagactgaacattgatgccatgagttcatacatggtacaggtccaggttcgagcgttgagcgtagcaaaaaaaaaatacgagattattttagccacatattgcagtgccacaaaatacaattgctcccgctcaaagccaaccgttcggttcaattatgcctaatgaaccgccggttaaacctttcttcagatttttaaattaaagtctattttcacccccagagatcacaaattgtcaattccggggcaaatttagtggctattcaaagccaacaaaatgaaaattccgtgcctatcacgcaatctgccccggtaaaaagtgttgtatttcagacaatttgatttttgaatttaatttatttcagtctaatcccttagctcatgatcaaattttggtgcccagtggggcgaactcgcatcacactgatgagatagtggaggtgttttttatacaaataataataataataataataataataataataatggcttttaagaccattttggattaaaaacttttttttaatttttaaataacaaaatattcttgacttttcattttttttattgaaaatatattcaaaaaaagtaattccttatgaagttgttttgaaatatagaaaataaatgtatttaaatgtatattagtggaaaaaaatcgttaatgttttttcaaggtcgaacgcaacgaatcagcgggacagggaaatcgccaacagcaactgagacgttcgaatgttgatcacggacgtttgcgacatggcggggacgacccgactgaatcagtgcgaaatgtacgcgtctaagaaaatgcttttttcttatattttttcatttaaatttgccattttttaatttacgaatttttttgttaccatatttaaaattcaaaaacgttctttatgttaaaaaaaatttggggaatcctaagtggctatttttagcatccctaccgaagacctgccagggcgcaggagcctgttcttgacgagagacccagcacgtcagggggtactgggttaactcgtcctgagcggcagtcccgccaatcggttcgtccttcagttgacctaactttgtcatctatagtggaacccccgcctcctcccggcccttacccgcttagtaaaattaagcgtttacccacttgtcaaattaaccaatcgcatattaacgagggtattgagtgctcaatttgtggggaactttttgttatggatagtattgtctctgctctacaatgcacccatctttatcatctcaattgtattaaaaaatggctcaaaatatctggttcttgcccattatgtaaaatctctctcgattaattttttattttcttttcaattatgtttcactcttcatataatggattactttgtgtgcctttcaaaatttatgatctttatttattttttgaattactttatttatttaatttcaattaagatttaggatgtcgccttcataatctttaaaattttatgctctttacctatttttgaattatttttttgttatttttaatttcaattaaatttgatgtacgtctttattattttgaattatcaattaaatctttaaactattttattcaattatttttttaaatcatataattgtccatttgatttattatgttattatgatgctatgtcatattttggtgcattaattaattgatgataaatactgctggtaatttaacaattaaaaaattacctatgattaatatttgagtaaaaaaaacggattatttagttagtaatttaaatgtttaattggacttaaattaatttagttaaaggtcttttggtaacatattttgcaataaaagttgaaaattcggtaattccttgtagtcctatgttaatcttttattaaacattttaaaataattcttttataatattttgttttgtaaagccttttggaaaatttattatgttattatgatcctatgttatgttttgtgaattaattatttgactgctggtaatttaacaattaaaaaattacctatgattaatatttgagtaaaaaaacggattaattagctagtaatttaaatgtttaattggacttaaattgatttaattaaaagttttttggtaacatattttgcaataaaagttgaaaattcggtaatttccttgtagtcctatgttaatctttattaaaacatttaaaaaataattttacggtttttaatctattaaagtttttgtttcttgtataattatattaaaatgcttttattttacttattttttaaatttatttttttaaataaaagataataaatttgtttgcgttattgttgtaccatatttattaattaacaagaaaattaattttatttaattatcataaatttataatttgtataattttatgtaacgagctaaaaactatgtgcttatttgccaattattatttttttcatctctataatcaatgcacttgcgttaataatgatgatgaatatgttaagtaattgtcgagaaatttattaatttttttattgttattgttaaattatctaaaatttatgaaatgaatgacaaacttggtttaatctttaaaaagtggatcatgttgattatagttaagtattaaaaaaaaaaaagtaaatttaaacaaatttggttcttaaattcatatttgaattttttcaatatttttgaatgcttttttttgaattaaatgtcaaaaatgaataataaatctttcttaacatgtacacttttgctaaaaaaaaaaaaaaatgtttattacttattattattagcaaagttcccaaaataaatcagctttttttaattttttttttttttgctgtttaattttgaaattatgattgtttaaaaaattttcgtcttacgtgttgtgttaaaacataattatttaaaaatctggtatgaacaaagttttggatttcatagttttttttaataaatttttcttgaaagtttaattttttttttcattaaagatggcgcgtcaaaatctaaacgaatgctttgtccttgaaagaacgacaccaatgagaaatgttatgcgcaacacgaggggagaaatttgtgaattgcgatttatgccgcttgaggaagcgcaccgtcccgatctcgtacttgaagcactcatccagcatttgcttgatagagttctagctggccatcctcgtccactcatggtcggattacaacttcatccgccaggattcgacagaccatatgtcatccgactccgtccaccggaacaaaataatgcagcggcgctcgcagctgccattgaacggctcaatgagcagtccgcggccgggattgatctactttctggcacaacgatcacaaaagtgctcgctgtgtggccactcgatcccattcgtggcgatccgcagagaggcggtttttaaacaaattttattctaaagattaataaattataattaggagcatgtgatctaaacgatgaacatcatgtgtcgcacaacgtacaatccatcgtgcgcgtagagaatccagacgaccgtctttgtctagcacgtgccgtgctaatagggcttcgagaccgtgaaaccaggatgccaaatggaggtggccgtgacgcactccgtgcgtacgttagacatcaaaatcaacatggacctgaagcggtggctttgctgaggcgctctggaattccacaccacaaggacatgtacacgctgcaggacgttgggcaactgcaacggtggttgaacaatgcttatggcattgggcagattcggctcgttgtatttgagaaagagcatgaataccggatcgtgttcaagggagaggggtaagccttggttattaaaagtataaaattttcttgtccaaagaagtgcggcacaattcaatctgtgtctcttattggagcgaggccacttcaattatattggccgtattgagcaaatttttgacgtgccaaactactgcattgattgtgagcgcagagctgacgcgcgttatcattcgtcagggtgcaaaattgtgtgccgtctttgtttgcgatttggacctggttttccatgcaaaacagaaaatgtgaaattgtttttaaaatttaacaataaaatatatatttcagcttccaaacggcgtgacgagcgcgagacaatgcgcagagtgtctcttcatttttccgaacgacgactgtttcaactatcatctcgtcaatcgtggtcctgatcaaattgatggacgtggtaatcaacaacggatgccaatttgtcagtggcgtgaagtatgccgtttatgtggacgtgtctcctatattggaaagcatcgctgtcctcaagttcaacttggtgatgtttgtcgacactgcagaggccaacacaacgctgatctaccatgttttatccagccactcatggatagacctcaaccaatcaacatcatcgacgatcaagaggcgcatgacaatgaccttgtcattgatgatgatgaaaatgacgacgaattgccgcttcgtttgtgcttcttcgatgccgagacttcgcaggaacggccgctgcaattgaacaaccaagtggctcagaagcacgtcccattgctcatcgtcgcagaagtcatctgtgatccgtgcattaaggccggaatcagtgtcaatgacggtttcgaaagaagagcgcctggttgtgtttgtctatgtggaagagtgagggggcagcaaatgcgtcagtggtcttctccgccgtttgcaaacgcacatggagacaacacaccaactccagatggggcgccgaccttcaatcaacggcgcttctatttccattcttttgacaacggagaagctgaagaccctgtggagcaattcttggtttttttgatgaaccatgggtcaaggaaggcgcacactgtatgcattgcgcataacggcgggaagtatgattttcatctcgtactcgaggctctccatcgccgaagttacccgcctaaacggctctgcaccactggactaaaaatttattcaatgaagctttgtggccggaatcaacgccgcattacgttcaaggattccattaattacttcttctgtgagcttgatggactcgtgaaaagtttcgatctaccagctcacttggcaacgacaaagccatttttcccgtatctgtatatccaacggcaaaatctggttaatcgtctccaaggacttccgggtatagaattttattcaccgaatacaatgaaggaggagaagcgacagaaatttttgcgatggcacgccgataacaatgagggagcccaattccaattacgagaacagctcattatgtattgcgtaaacgacgtggcaattctacgggagtctgttctacgctttcgacaactcatcggagaacacacacagggattggatccctttttggtgtcgacaacggctgctgggttagctctggccacactccgtcgctgttttttgccgccgaatcggcttgtgcactcgccagagggtggatatctacgtggacgacgggcctctgccgaatcgagacgttacatccgcttctttgagatggaacaccccggagctcaagtgcagtgcgcggattggtcggtgggcgaagcacatgtggatgattccggataccgactcgacggactttggcgtcgagacccaccccttcgtccacttgccatcgaatggatgggatgctattaccacggtagttggttgttgtctgtttggtagaaaatagaaattataagggtgcccaaagtgtttcccgaaccggtggcagaagcttgccgcggggcgaaccgctgaggacttgttcgagaggacgacgcgaaggctttgggagttggaacatcagcatggattcgaactacacgtcgtctggggctgtgcgtggaaggagcagctccgccacgatccggcgctgaagcaaaggttcgagcaagtgttcgtcccatacccactggatccacggagcgatgggttgcgcggaggacggacggagcccttcaagctccaccatgtgtgcgcagatgacgaggagatcatctgcatcgatattgtcagcttatatccatatgtcatggtgaatttctctttaatgctcttctcaatttcgtttttcacttttagaaggtgaatcccttccccgtggggaacccgcaagtcatcacgcgcgaagtgctcctccaacccccgactgttccactcccttggaattgtgcggaaaacaacaccttccgtggtttgctgctgattcgggtcctccctccgcgacacatccgtgtgccattgctgggctaccgcaccaaagatggccgcttcacctttcctctttgcgcttggtgtgctgaccgccgacaacaaaggccatgtcagcacggagacgacaagcgttcgtgggtgtgcgcgtacacccacgatgagctgaacaaagctctggggctcggatacatcgtcactgacctctttgaggtaaatttaagatttaaatttgtttttttagctaaagaatcaaataggtctgggactacgaggagtgggacaacacgctcttcagctcctacatgaacacctttgtggggctgaaggtgcaggcgagtgggtggccggaggggtgtgagacggatgagcagcgccgagcgtttgtggatgacttcatgcacacggagggcatcgccatcgacccgaccaaaatggcattcaatccgggacttcgactcatcgccaagaccttggcgaactctctttggtaattatttttattttttcttttaaaaataactttaattaaaaggggaaagatggcacagcgcgtcggctacactgagatcaaatacacgcgcactccagcggagtttcacaagctcctggaggacccgacctacgacaaaatggactttgtccatgtctctgacaacatggaccgagtcgtcgtcaggaagcgccccgagtttggcaaggccccggcaaccaactgcctcccagtggccatttacgtcacatcgtacgcccggctccacttgtacaactacatggagcaggttctggccctgggcaatgctgagctcctctactgtggtaatttttcaaatttgtaattaaattacgtaataaaatttagatacggactccatctactacgtcaacaagattggagcaccgttcgtccaggagggggaagcattagggcaaatgaagcgtgagcttgtggaccgccgaattgtggaattcattgccggaggaccgaaaaactacggcatccggcacactgccagagacggaactgatgaacgtgcgaacatcaaaattaggagttttcgattgtcgtacgccactcaacaattgctaaattttgctgctgtgaaggaactgacgttggctacgtataatatcgacggacccatgtgagttgcattatatttgtaaaaatgaaaaaaataaaaatcaagtgatgatgttttggacaacgaagacttgtatgtctatggaggcgctgaacaccgcgccatccccatcagctttcctcaaattggtcgcaatgtttacgccgacctctacactcacgaggctcgcaaggattatcggccctactacgccaaagggcgcgtgcgtcccgggatgcaaacccgcccctttggctatgtagaggaggaagcccgactcattcgccaaacacaaatggtgcaccaacaactgccacccgcatcttctccaccacaaccgaggcccgaacgaagaaagaggcggctaattgagcccgatcccacccaggctggccattctgggtggttttcataaattgtgattttcaattgatatgaattttataaattttaacgaaaatagtttggaataatatttgacaaaaatttaaacgcatcactcaattcttcaatattcttggcgccggtgacaatcacttttcccgatatgtaaattaaacaagtagttccattttccattttacatcgtaaggccggaaaaattgatgggtcgtaaatgccacccaaagttgtcaaaagtctttcgactctaattcgttgagcaaaagttttcacaccaacaatgttgaccacccgcagctgatgaattttcaatgtgttgttttgagtgtgttgtattcttcttaaaatttttcgagcaaagtaattggctctgtctgggtgggaaacaccggtgaggacaacccgagctgattgaaaaataagagctgcgacagttttggcagaagtgcgaacacgcatgataatggcatgaaaacggcgagggttatactcagtatttattccacgttgagcaattgttaaaaactgttcaggagtaaacggacgaacatttattttaaaaacagcagtacaattagatatggaaatcatctaaataataatagacaaaacttcaattggaaaaaatgttttgtgatctccgcctccaaattctacaacacatggcaagttgggatgacgcaatctgatcccatgtttgatgtagtaatgcattctcacctaaatatttccaaataaataaaaattttgcatcaaattaccgtgattccgaggtaccctcggtaagctggagccgagtgggcatccagaatcgagagatcattgcatcgaacggggaagttccggattgtgggtcgaaggtgggaggttcgcaattgagcagagcgcaaatgttcaacaattttgcggcgctttgtcaaatccttgaagagcacgtgcaattcgttggcggagcattcaaattttttgcacaagtggtccacaagagggattgggcgttggcgatgctcattgcaagaacacttttttggcgtgtctaaacttgcattttttttttaataagaaaatttattcaaacttgttattggctcctctccaattgccccgagtggttctctcttttcctcctcgtcaatgaggctaatccaactcgggtcctcttttggcggttctttgtcctgctccatttctgggtacgcattgttcagccaatcagtagcaagaattaagtccatttttaaatgaatctaaattcaaaatttatatattatatatatatcataattaattagagtaaatattaaaaatggagcaaaaatttgatcatggagaattacaatttcgtcatccattcacaatgatcgtgtcggggagcacagggagtggcaagtcagagtggataatccgtcttttacaaaatttagagaaaatgatttcatttaaaattgaaagagctatatattgttatggggaactgaatcgaaatgttttaaatatacagcgcaatgggaaaattggcaatgtgccagtcactgttcacaatggtattatgtcagaagagcaaattagagccatggcgaaaaaagaaaaattgcttttaatattagatgatttgctagtgaatttgagtagtcgatatttagattctctatttacacgcgggtcacacaattggggcatgagtgtaattttggtaacgcagaatttatttaataaagaattgcgtgtcgcacgtggaaattctcattatttggttttgttaaggaatccggcaggtgcccttcagattaggacattagctacacatttattcccttctaagaccgcccactttatggaatcatatcgagacgcgtgttcaaaaaattttggatatctcttggtagatatgcacccggagagccaagaaatattaagattaagaacaaatatatatgataaaaacgttgttgtttacgttccaaaatgagagtatcccaattaattcaaaataatttaaaatttttagaaaatataggcaactcaaaaaaggtaagtgaggacatagaaagagccactgatgaacaaatattatgccttgttgaaatctgtctcaatattttaaaaggaagagttcctttaaaatacaaacatttgaagaaattaaaatcaaatgcacaattaatacgttgcctttcacgcactcgttcttcacaatcagcgaaaaaaatattattacaaaaaggggatgggcttccggctatagcaggactaattgcaaacattgctttaccatttatttcaaattttattgaaaaattataaatataagataggatttaaattgtaacaaaagaaaatgcaacatacaagacgttatttactagttcctgaggaaatttacgagagcctaatatcgtccccacaggatggatcaccaattggattggttcgctcaagaattaagcaaataaaaaatgataatgaaataaatgaggagcagagggcctttaaatatgaacaggaatttaaacggttcaataagctgaaaaatgacgaggaggaacgcccagttgatgttaaaatacaaaatttgcaggaagtggcagaaacttttccaaaaccttttaatctaataagaaaatctgctataccacgacgacataacctaaaacttggtaaaagaagaaaggattatgttgacgacgacgaagaagtctttgacgatgtcaagataccgaataaagatgatattttgaatttcatttacaaaaactctcaagccctgggaatctctgaacaagggcaaatacttaaggcagacggacgcccgtttataacaagtaacgttgaagatattgttgatcatttgacaaaaaaggatagaagtgccaataagaaagatcctacggcactcaaagaatttgtagcgagagcaaaacaaaacgcagtgttgagtaggcgtctcttttctgatggtcaaactggtaagggaatttataaaaagacaatgttaaaattcaaaccatcgttatggagatgaaaaaacaatgtttgttagagtttttatacaaagacctaaattcacccgtttcattcacaagcgttgaacccttgcttagagaagctaaaaaatatgaaacaaaaattagtcgttcagacattctaaaatttttattaacccagcgcacttatacacttcatagacaagctaagcgccgttttcggcgtttgccaactctcgccccaggtttacatattgaatggcaagcagatttggcaatttttgaccgtctttcaaagtataatcgtggactcaagtacttgttagtttgcattgactccttaagtagacaaatatttgttgagccaattaagtcaaagacaagtaaaaatatgattaaggcatttgaccagatattcaaaagaactaaatatattccatggaaaattttgactgatcaaggaaaagaattcacagcacgacctatacaggaatattatcgttcaaaagacgtagaacatttttgtatgctcacttctcctcaatttcatgctggcatggctgaacgtgccaacagaagtataaaagaacgattgtatcgttacttcactgagcgaaatacttacaaatggattgacgtaattcaagatatcgtaaagggtataaatcattccatgaactcaaccattggaatgagacctgtagacgtaacctttgcaaatgctgaagaattgagaaaaaaactatacaatgaagcagctaaaaaccctagaggaaatcccaaatttcatgttggagatcgggtccgaattgaaaaacacaaacacgtgttccaaaaaggttatttgccccggttcaccaatgaaatatttactattgcggaagtacattctgagagatcacctattgtttacaaaataagcgacgataataatgaaattattaagggatggttttatgcaaatgatttatgtagaatttttgaaaatgataataaattgtatgacattgaaagaattttgtcaaaaaagaaaagaaaaggtgttgaacatgcgttggtaaaatggaaggggtatagtccccaatttaatagctgggttccattaagttcaattactgtgaaaaatatataaaaactcttaaaaaactttttttttttaataaaatgccttctaattcgttttatattgtactcccatcaaatacaaatgttgaagggaacagaaccaattcttttcggacacgtataccacgaaaactacaattcaacacggaatgggaagtaggcctcgctgtaattgtttatccccattcttggccttcaatcggtactgcacaacaacaatttgttgaaattgagtggcagacaggaaaagcgttacgcattgaagttccaccatcaaatgtcacaaacccctacgaactaagcaagaatttgtacaaattattgggcgagggaagtgatcacttggcaaaacaactgagaactacgcaaaatgctttcctacttgtgataaataaggctaggcggtgggcaagagaagaatatattaaaagaaaggtgaaggagaatagaagtattcatgatgaagaaaaacttctacacgcgctgcttattgacagtgaatcatttatcgagttgaaagacgtggatcggggtcttattgctgaagagaaacatgctgaaacaagtaaagtaccgctgagaatttcgaccgatgataaagattcttatcagaagaaattgaacgaatacttttcaggtttaagtgaacgagatttgaaccttattgatgattttatcaaagcaaaagtgaaatcagagattaaaaaaatgacagaagacgaacgtatgatccttgaggcctcaaaggaagtgggaatgggagcatggcttcaagcttatcgtagaatatggcttgcctgtcaattcacctatgacaataatagaaatcgttttgatttaaattttgatacgcgttacgtaaagaaagtaaaaatcacagcgcaacttgcctatattctggggtttgacaacacagaatttttggaaccagaaaacgaggcaagattcatgccggacatgaacggaggagtttcttcatttaacgtatacgcacctaatctcattgaaccaatgatgattggagacgtaaccgctcctgttttacgaattgtaacaattcgaggaaaacccgatgaggtaattgaggaacaatttttagcgatacaataccataaaattttgctaaaagaaatttcggagatttttattgaaattcgtactaatagcggaagtctcatgccgttccaatatggaacatgtacattaactttgcattttcgaaaaaagtcctatttttaaatgaataccttagaaattaataaaattctatcaacaaattcattgaccaaaaatcatttccttggctgttttgcagctgatcaaatacccagtggggcaataataaaatttccacactgcatggtattcaatattgatccaataacctcaaaggggtcccactgggtgtgtgtttactgcacttcaccgttacacattgaatattatgattctttgggaatttggccaccaccaagtttttacatagcaaattatttaactcgctatgaacaaatacgttatagcacaatcccacttcaatctttaaattcaaatacgtgtggccgacatgttatattctttttgttcaacaggtgtttgggttcagcttttgaaaaaattgtaaatcttttacattttacaaaaacaactcctgatacaattgtgaattcttttatgaggaaattaataataatataaatagttgaaaaactttcaaattttaaaaatgcatgttgattttgatccccttcaagtggattggtccacattttctcaagaattgcacgttcaatatggtggttataacatctttcgcggagttccttatcaaagaggggcaggtgttggttcagtgtttagaagtctcatgcgatttcttttacctattggaaaacaaattggttcatcaattgcacggcagggactagaaagcggaaatcgagtgttaacaaatgtattgggaggtaaagatctaaaggagtcactcgtaaatgagggtaaaacggggcttaaaactctcctggaaaaggcagcaaataatattgaaaaacaaaaaggacaggggtttgattttaaacgttataaaaatgaaccaacacaaaaagttgggaaaaccaggcgaaaaaatataaataaactccaatctccagttgggccaccattggttgccaaaaccaaaaataaacgtatgcgtgttgactttttaggaacatattaaataaatgagttgcccgcaaaagattagtgaaagcagtcctcttgccataaacagtggtctgaatattttctcagttcctccaaccaacgtctctgtaattcgttcattttttcgtgagatacttcctcttgcgtcaataactcaagaatctccctatctttttcgtttatacagtgataatttatggactgatttatcacgaatttatctgtatcttgaaatctcaattgaaaagcacgacgctaatggtaaatggacatcaatagaagataccgacacaaatatagcacccattcaaggaattggacaaacctttgttcaacaactaaaagttacggtgggaaacactgaagtttacgatagtggaaatttgtttccctttaaatcttatataacaaatgaattgagctatccaacaagcgttaaagaacattttctcgggtccatgggatattatcatacggaagcacatgatgattcaacagataagggatttaaagaacgttgtaatgttttaaagggaggaaaacatgcgcaattcctctcacgtctcgattttgatttaggaaatcaagagctctatctgctaaataatttagatttacttttcacaatttacaaggccaaagactcgtttttacttcaaaccttaaaagcaaacgacaataacaaatatcgtttagcagttcatgatgtaaaaatttatgccaaaatgattgaggttcagccttctcttaatatgagtctttacaaaactcttgaaaaacagccggctacatattcagtacgtaaaactgaaataaaatcttcattcatcagtgttggccgttacgagtttgaatacaacgtcttcagctcaacaattcctcgacgcgtgacaatagctttagttggcaattcagctttcaatggagattacaaattaagcccatttaaattcgaaccatttgacttacgcgaaatttcagtacacactggagggatggtataccctgccgtcccttataaattagattttcccaagaattacttcgttagagcatttgtcgacatgtatgaagcattaagtatggcaaattcagagcgaacttttgatattaagatgagtcaattccaaaatgggtgggcattttttgttatcccgttgaattcgaccctggatgatagttgcgggtttgaactattgagaagtggaaccacaagcatacgtgccacgtttaattccccaatcccaaaaggaggcgttgaaatgattgtcatgggagaatttgatcaaatgatcatgattgattacaaccgtcacattgtttccgattcaaaactcgggtaaaatttataaataaaagcactacattcattcgcaaaaatgaataatacaacaaaaccctccatacaaatattatattcaatcgaagaacccaaagaaaccctattacatattttattattatctcattatttaattgcatttccaattatttttctttgttggcttataataattaagtttctcaaaaaacgtggtcatctatccacaagcgaggccgaaataatgttggaagaaatgaaaagtatacctaaacaacagccaatattttacaaaacaaagtagggtaggttttggttaagcagataaagtccttgtttaagcttaagtctacctttttggttcaaatccgtccaaccacatttattaactttttattttttgaagttacaataaaagcaaatttacttcctttctcaccagtgctacatggccgagtggttaaggcttcggcctgaaccaaaggttcgattccacagtttttgaatttttcttttaatttaataaaatttaaatttaaaaaataaataaaaataatcaaaatatttaaatatttaaaaaatatttcaaaaataaataaaaattaattgcggttagagactacatataggcaagagaaaaaaaaagctagagaaaaaaagctgcgaagccaatcaatcgataattgaagtagtctccctatgtagttccatcgaaatgctccaaatgccaattaattacacgtcttttttgaattccgaacctttgcagctgaaaatagtgggaaaaatgactacacaaatgaacactcggaaatgataattaaattaaaaaaaaaaaaaaaaattttcccgaaaaggtttcggtgggatattttttggccaaaaatgggtcaattttttgtgtggcagtcagttaatcagtgcaagggacacaaacggcagcgatttctttgccaaatcgtgcgatattttgcacaaaattcaacaaaggctgccaaaatcaaagcgaaaatttttaatcgaaatgattgacgcgtaagtgagaaagaaataataatagcacaagacttaaattgttacgaattgaatttctgaaatcgcttcatataaatcatacggcgaaagggcactgataacggagttgggcgaggagtcgttcgatgagcgattgtacgggcggcgatctgtgctttatgcgagcgattccgagaagatgagtgccatcagcgagttggcacagccgcgcgtcggatttcacaaaagtgccattgctatttaaaatatcatttacctttcgtttattttcttaattccctctccttttttcgttgccattcacttgggattgaagccgaccaattttatgtatgtgaaggatgatggcaatttggtgctgaaactgatcgacttcgaagatgcccaattctttttgacgtcgtccgaccacaaaatttgatatttggtcaattggaaaaattgcctttgaaattgtcattgataactgcgtttggaggagaaaaggcaccaatgaatggggtaagcatggacaaatgtatcatcagataatacgggagcaaatcccggatcattcccagattcttagtatcattcgatagctcgaacaagtgttcattattagcttgctaaattaagaaattccatcaaaattccttacgtaaggtattccaattgtcgaacaaatgcccagataaagaataagccagataaattttgggtgttggtcaattctttggcactgacttttcttagcttttggtggacgaattttcattgaataaacacacagaagaacaaaatttttttgtttgtttttttaagatggagcgaaggacaatgctttgcaatatcggcaatttgttcttcggatttaagcgaatcgcttctgtgattatcccggcaatattaaagaagtgccgcttttgtactcggaagacccaaattgggtgtggcaaaacggcgacaccattcacgcggtgctgcgactttggctcaaatttccaaagatggcacttttgattacggttaaaaaaagcatcattaattattcaaattagccaaaaatttttttttttaattttaagaatttgttggactttcgacaagaaaacatttgattgactgcttgagggttttggactttatcaacggcttatgctttcatgaagagctgaaaaccgtcagatactccaaaaaactacgcattttcaatcggttaaattttggcgaattcaaaaatattttagaaaaaattaagaaaaaattaattgcttaaacaaaattcacaaaattcatttcatttatttttaattgattttaattaaggaaaattgtcgagcaaaaacatattaatgacatattcacttaaactcaattgaattaaagcgccacttatttttattaattcaaaaaatatctaattgaaatgaagaaattcccatcagttgagaaattaaataatgaaaagaaaaatgaaatgattcagttaatctgtgcagaggataaaaataaacgataaaatgagcttaaatgaaatcgctaaaatttaaatggctattaagttttaattggataaagaaatgattgttttgttgttcgttaaccttgaagattcaatttgatttttaataaaataaaaaagaaatcctttttaaatttttgatcattgatcatttatttggactgttttttcccattttctcaatttcaataaatcactcctcctccgttctgctgctgctttttctgctgttcatctccatttttttgttccccatctttgtcctgtcctgtcattgtctttctataagttctgtacatttccctctcgtcttcttcggcatttctttgtgccatcgattgcccttcatgcgaattatgtgccggcaacgtgccgctttcggcatggccaagcagccaaaaagtctccatgacgccctttccctgaatgcatttactcgtaaaatttctcattagtcatcggtaattaacagtttatcggtctgatcgaccttaatgatcacttcgcctctgctctccaaaagataaccgttgaaatttgtgctcaacaaagtgtgcgtcgctttggagatgtgaattttgttagcttaaatggcccaatgagaatatttgacaaacaaaactgacggcttgaagagctttccattcgcgaggcggtgtttaccgtatcaccaaacagacagtagcggggcatggccaggccttttattaaatcgtcagctgtttttataccattttcatagaatataccgacaactcccgcaacgcatgggccgctgtgcagcccaattcggagacggacgcgctcatttggaaggtcgggaattcggaaagtgtgaaacgctttcaaaaagtccaatgacctgagcaaattgatgactattaacaattaattcaattagtaattgctgctcacatatccgcgcactctttggcgtgcaaattgccatttcgctttggcagtcctgacacgcacaaatagccatcgcctgtaattaaggggaattaaaccaaataatttttggtgtgttttctcaccgatggactccactttgtacacgtcatgctcgccaatgatggcgtccagcgtagtgtacagttcgttcatcagattaaccacctgcagcggccgcatttggttggacagtgccgcgaattggacaatgtccgagaagaatacggtgactgtatcgaactgctcgggctccacggtttggcctatcttcagacggtccgcaatttgccttgaatgttttaaagcaaacaattgccttttttttttttgtttttt

SEQ ID NO: 70 - DNA, 1312 bp, Heterodera glycines
atcaaattgatgctctgaccggcgttcatttgccgcaacctttgacgcactttttcaatggttagccgttcgtttgggacttccgtccaacagtcgcggatcagatgaatctgatgagtttgtacaggtaattgatttaattaccgaaaacccaacccttttctatgcacatgattcattttcttgttttagcatttagtcatttccttaattgtctttaattaccaattccgggtgcaaattgtccaacgcgggccgtatcatcggtctcaatggcaccaatccgccccgcttcaccaaataggcaatttcgtccgcgttgcgtccgagcgttgcgcctgcggtgtgccgcgtcgcggtgcttctgctccgccccatctcttccaagtcgcgcgccgcgccgaagtcctcctccgagtcgcggccctcctcccaacacggggccatgttcaccatcggaaatggcaaataaatgtgcaaatttagacaatgagttaatgtccattttgtgtacttccgtgaaaattaatgccattgtgtaaatgtccgactgttttgagcccacggccacatttatttcggcaccgtccgtcgcttttcgcaattgttcgggagacagccataaaagatctataaaagaattaattaattgattaattattgtaaatttttcaccttttgcttgcattttttgtggacttttcagccatcggagcccaaagtatgagattttcacttgccatcgttcgttgatcaaacaagcggaggatttcagccgaccatggaattggaggggcgaattgtgcaagaactgaaggccctggaaagggggaaaaaacgcttttttacttttataattttgaaattaataattttaattttcgtgagttccttggaataaaaccaattttaaattaagaaattgccaatttatttaattaccctcaataacaaaataaatccatctctcacttcgcaaagctccttgacggccgattggatgaacatcacatctttgaccatggcattttcggacaagatcacatctctgattgacccgcgcatgcaaaagttggggattcggtatcccccccccctccgccaattcaccgctcggcactcggccatttctgcgacagacaatggcgcggcggctgtcgttgacccaaacgtgcaaacaatgcacttgtccccgttgtaagtatacagagagaagtttttggactgggccaaactgtccatcgtcgaattggtcagcgcggaaacgttcgtttggttggagcggagagagtggtgaaaccgctctgcgcca

SEQ ID NO: 71 - DNA, 11379 bp, Heterodera glycines
aaaaataactctgggacttttatttgcatattttgggtttttctgcatatttgatgcatactttgccattttttgtatatatttaagattttttgcatattttgccatttttcgtcaaatattttccgatttgaatatcccttagtaaaaaaattttattatgcctaaaattaaatccaaattaattaatttgcatccctaattttcaaatttttttgcaattttttttttctaaaataatgaaatttgtggttttggatacgctaatttaaaaaatttgaaaaagtgggttcggaaatgccgacaagtggtgtcatttaaattttggaatataatttaattgtttaggaaattcttccaaacccgcactcattccctccctcgtgtgccattctcccctccttcttttatagccctctccgtttgctgtgaaaaatgcctaattcggcgccgaattcccattgcggcgttgagcatcagcacgggctaacaaatggggcaaaaaaggaaattaaaaatacaaacaaagaaatggcaaaatcaaattgttatgctttggctcccatggggtggagggaaatgaaaaattttcaagaaaaaatgtgcaaatttttttttttaatttaaaaaaaaattcttaacaaattgcattaaaatttccaaaaaaaaaagtttcccggcggcggaacctccatcttatcaaggggaaaaattttacacaaagagtaaaaaaacttccgaaatatttctggcatacgggccaaaatttattttttgcacaaaaatgggttatattggcgcgggttcgaattccattgggtgtgtgtgtggtcgtgcagagagacactaagaaaaattctcgttccatttctctttttgtatgctttctttgccgccgtctctcttacaaattagtgtactctctttctgcggaggaaaaaacgcagcgaaaagcgcccttttctttcctttaattttttactacataattttaaatattattttaaatctgatacatacatatttttcgcgccttccctagaaaaggcgcagttccaaaaattagcacttttattgttccatggggaacggttaatcaacggaagtgggaaaatattcgtgaatttaaaatactaatttatgatgggttataaatgaggtagggcagagaaaaatacttttatatttctcttttaatttctccttttgtatgtcttcttttccctcaccgtctctttcactttctcttttttctctctttctttaaaatagaggaagagagtgaggcgcgatggaagagaaagggcaaagaatatagacaaaagagaaatagcatagggaaagacagtgcagagagaagaatttagtgtgagtttttctatgccgctctctctccttttaaaacccatcataaatattctcttccatttgcctgttttttctgcctccccgcttgctgtactccgtgcaggggggcgaacgaattttgtacgccttgcgcgtgcaatttttggacgccctccggggttttaaattttcaaaatgaggctttttgtggttttttgagaaattttgatgctttttgaggtttttggggaaaattcgtcagattttttaaattttgattagttggcataatgtttttggccatttttgtggacaaatctgttaataaattgcattaataattacaaaatttttcccggctgcgcctatcggcaccgccggacccctccccaaaagttttttagtaaaagcgccgcaaaaaaacgattttttacgctcatcagaatttcataaaatgcttatttcaaataaaaaattgctcaaatttatcatggacaatcaaaaatatatcatttgaaaattttaagcgtgttttgaataaactttataaaaatgaggctttttgacacaaaatgaggttttttgcttgccaaatgaggcttttttgatctgggaaccctgtgattgcatttgttttaacgaattgccattctttcaaagacgtgaaaagttttcaaaaatgtctttctttctatccaaactataaatttaagtcctaaattttttgcgccttcccaagagaaagtgcagtccaaaaattaaggttttacccttgaacacatcgaccccacttgtgggtcagtaaagcagccgaaatgggcaaacatttgagaaaataaaaacaaaattatgatgggtctaaactgagggaagagaagagaaaacattcatttattttctcttttattcctccttttctatgtcttcttttccctcatctgtctcttgagtttattttttttctttttctctcttttctaaagaatggaggaagagaatgaggcgcgagggaagagaaaggacaaagaaaataagcgaagagaaataacacagggaaagagagttcaaagggagggagagaatgatgcgtttttctctatctttctctctctgtttttccaacccatcataaatagcctattccattaggctgttccctctccttttccttcgtttctttagccttgcgctcgggcaatacagcgagcaatgaggcctagccgagctgctgttattgctgattgaaaacttttaccaattacccgccttggcctgcgaaagcggtgccgtgtgcaatttttggacgccctccggggcttaatttcatttggcatcctaataaaataaaagccacttgtcaaagccaaaaaaccatttaaaatacattttcaaatgccagatacttccttcggctctattgcactttgtgagtccttttttttttgtaagtccgttcagagtgtataagtccaagctatttccaattaattaaatcaaattttgaatccaattacatttttgaattcccatggaatcgacggaatcagctaagtgggtgcagagttagttccgtgcaaatgtcgtaaatcatttttaagtgccctctattcgcctctcttccttatgtatgcgcacgtgcagcaggaataaaccggaaatgtttttgcaaattgaatcaaacccgttcaatttcaaaaagtgcgaatacaaaaatttgtttgaatgggcgcataagtccctccgtcgctttttcttacctaaatttcccagccctaattatagccaataattaaaaaaaattaaaatgcttgtaatcagaataatctacagaaaacttttgtctcacattgtgccaaacccagtgtgtatggttctgcgacaaatattcctacggttttggtgataccgtaggaattggcgtcaataatgctaattgatttttatgtttaaataatcaaaatcccgtaactttttcacagatacttctgattttatggttgatccatcttttgctgatggctcattttatccattcgttactttgtttgactctggtgacaaaattgaggcgaattttgggcccaatttcaaattcgatttggcaattctctgaaggaagaattaattattcactaatgttttcgatcaatttgctctttttaatcatttttgtgtctttcttcttcaattaaaatttggttttttgtattaatcggaaaattttgtcttttcccaggtgtttaagacttaaaaaacgaaaatttgcaacaaataaaacacattttttccaattatctgctaaaattcataatgttatttaaaaactcgaagaaagctaattaacatggtaaattgattccggagttgagcttaacgacttcgtaattagttggtatgatgatggaaatttccacccggtcaaacattatttgaatgaaatgggaatgatgttctgtattttgttaattgaaaattataaattgtatagtttaaatatgtttctgcgcatgaagaaatgtgctaaaaatagcattcctactttaaaattttgatttggtgagttttgtagtccatataaatccatatttagcgtttttagtccatataaatccatatttagcgtttttagtccagataaatccatacatccctgcttgatagtgcctattaacctgcaaagtttcaaaaaatgagctgagaaacaaaaaagttatggccaaaaaacctcaaaaaattgcattttcctggccattttggcgcagcgcgccatatcttttttaaaacccaatataattttttgaaattttgcaggctaataaagaacatttagacctattgattaatatcaacattattttatttggttgaattaaaaaaaagttatgaatctttaaacttgtctgcgccaaaatgaccccgaccccttagaaaatgcttacaaatatcttctaaacatatagagctttctaatgataaaaagtttgtttgatttggccaacaaagaaaaaagttatggcttcataaagttgtctcagacgcagttgaacccaaccgtgcctatgcaccaatttttcactgccaaatgacacgaaaattcctatttaagcttggcaaattgcattcttcgccccattccttcgatcattcattcagctcgtttcacttttcccttcaattcttaaatcgccatgcttttccaatattaatttttttttttctaataaatttgataacatccttccttccttttaagcctaaatgggtgaacaacgggatgaactcgtccaacgtgccaagctggcggagcaagccgaacgctacgacgacatggcaaaggcgatgaagaaggtggggggtggggggaaaagaggtcgctggcacggctaagcaaaatgtcattttttgtttttttttcagttggtcgaaatggacgccaagttggacgaagaagagcgcaatttgttgtccattgcatacagaaaggcggtcggtgctcgtcgaacatcacgacgtatcattacctcaacagaacagaggccgacactgacgaagaaacagaagcaaattgccaacgagttgaagaagaaggtggagcacgacatggaacagaagggcagcgaggcgttggtcggtggcattggcaaattgcgcactttggcaatctttcaaaaaatgaaatctccgtcattttgaacagtcaaaaggatggtcaaagtgttcagttagttcgtgtggcattttgttcgttcaccttaaaatgtttttgctgtttcaggacttgctggacaaaatcctcatcccgaaggttgacgagcccgtggcaaaagtgacctacttgcgaatgaaagccgacttccaccgctatatggctgagatcaaagaggccgaaaatgacggtaaaaagcgatcaaacccaaacggtttttggatttgtaaggtcatctcccactttttcagatccccagaaggcaaagcagtcgtacgaggaggcgtgggatattgcgcagcagaaaatacggccatcgcatccgattcgccttggagtggcgctcaattttgccgttttcctctacgaattcatgaaaatgccagaagagggtcgaaaattggctcaaaaggtggtggacgcagccgaacaaatcgcattttaaccaccaatttattaacatatcccaatttttgcaggctcatgacgacggaaatgctgatctgctggcggacacgagcggcgattcgtacttggagtccatcggaatcctcgagaagctggacgagaacatgcggatttgggcatcaacgcaagaacgggacggatcatcagaacgaggaaacttctaggatatgccgtcccatgtcacatatgtacaaatattgtaaagtaggcatttgtatcccatgtctgtatatattgtaataaagcggaagaatccctcctcatcacgttgatatgtaatgtaaatattcgttgtttggcggtgtgataaatgagaaagaaaattggtgtcattagagaagaccaaatgtaattataaaaagttaggtcagaaaaagacaattaaaaaaaaatgattctgaaataatttcattttattcgacaaaaactgatgggatttcgaaggtttctgtcgaaaatcaaaattttcgaatttcagatttttactctaaaaatggttaaaatgatctttttagaatttgaattttcagtgagctagtatttgttttgtcttttttaaattttaaagataaaaaatgataaatttgaaaaaatatttttggttttggtcaaattattcttattggaattgttggtgcgaggtcgaacctacatttgtttttgctggataattggtcgtaataatctgtaaacaataattctctctgctttttgctggcgaatccgaaaatgagagagctgaagtgttcattgttgtgggcgtaacccccgcaaaattcaaatgaatgttttgaacggataaaacatcaaaatgcgccaaaaaagcgcgcgcttttgcaaagtttcgaacggaatcccacgtagtgagaacaaaaaattggcgcaaaaaaagcgcgcgcttctggaaaatgccacgcagcaattgctttaggccccgcccatcctttttgggtgaataaaaggggccacaaatttacaatttttgccatttgctcattgcagatgtgccaggatgggtcccgcacccggcccaaaaacgaaggcgacgacggcacaacgacagcacgacgacgacgacaactcagcgacgcaacgaccacgacgacggctgcacagatatgacgacgacaggcgacggcacagcgacgacgacggcacaacgacgcggcgacacaagcgacaacgaaggcaaaactaccgacgacggcacacgacgacattttttccacctgcgcgacatgttcttctgcctctggtgttcttcaacaaatcgtccaccagcagccgccactcgtcgacatgttctccgcccaacgacatgctcagctcgtccaccgccattgtttttgttttttcgggcaaaccaagcccgttagccgtgaggcggcaacaagctcgggacagggtacgtgacactccctggctccgggtggtttgctttggtacacctatgaacggcatggcgggttgcgccgtgtatcagtaatttgtgcctcattgtgggccgatttttggcccctctggggcccgatcctggcgatgaaccggcggcactgaaatgtcccccgctctaaaagttgggaaattgtccagacttttggagcgggggctttttttggcccgtttctggcactgaactgtcccccgctccaaaagttgggaaattgtcccgacttttggagcgggggctttttttggcccgtttctggcactgaactgtcccccgctccaaaagttgggaaattttcccgacttttggagcggggggtttttttttggcccgtttctggcactgaactgtcccccgctccaaaagttgggaaattgtcccgacttttggagcgggggctttttttggcccgtttctggcactgaactgtcccccgctccaaaagttgggaaattttcccgacttttggagcgggggttttttttggccggtcgaagtttcgccacgaatcctcaattttacacacacataaaatacaatggaaatgtactaatttgtgagcaagcaaaggtcaaatacatacaaacaaaatatacacaatattgaaatgctaaattgccaacatattccgatcaccttctaatctaaatctatccattaatccttctgttgctgatcacttggtggagaaattttccgccgctttgtcctattggtggagacagcggcctaaatgaagtgcaaattgaatttgatgatgaataacagctattaattgggttctgagttgcatatatggaatataaagccgagaaatgtggccataattttttttaatgtttttaaaaatggatatttatactttcgtttttggctgaatgggaatcacaaaaaatcaaatgaaattttaaaaattgttcacccgtcgtcgaatccgccgtcactgatcaaaaagtgaatttgattcagtgggtcatcgatcaaaatggatctaagcttaagcttggctctaagtttaggcttaggctctaagcttagtttgctgcttttctcaacattcttttttgttcatttatcagtagaatctgctgatttcacctaattttttccactttttgctaggctaattttaaatccgtcgagaattgttttaattattttgctcaacaaaatgtcagacaaagcaaaagaagcggaggataagatggcaaaagcaatgtaaaattaaaatgccaatttcaattttaaattttgttttccttttttcttcagtttcgtctctgccgattgttggctcaaaagacattgttgctggattttatttataagatttgaaaaatgatcagaaagtgagtagtgattggacggcttattcatcatcgaccaatttgcgttttgtctatttttcttccaccgttaaatcaacggccaatgtcactttgtcctcgtcactgtcatacaaccctttgtccggatccataataaattcctgtgtttttacaaaaaaattagcaaagaaagtggtgtatcatgccaattcgtacaaaaggcaactcatacactgttgtacaaaggcaactctacatttttaggttaagcctaggctttaggcttaggcctaagcttaaggctaggccttagcttaggcttgctcgggcctaggcttaagcttaggctttatcttgtaaaactttattgatttttgtacgagttgcctttgtacaacagtgtacgattgttgccattgacccaaacaaagttgactggtgacacttaccatagaagtgaattttgggaagccccagctcttagctttgtaattgaaaattctgtcaaatttgtgagtaaaatccgccgttccgctcttttgtgaaacaattcgaagggttgccgaacattcgcagctccaacaaatgccatctttagcaatcaaaaactaatgaatgcaattagaaattctcatattttcaccatttttcgacggagggaagcacaaaagataaaagcccaaatttttgtcggtgccgtcttccttatccgttgttatttctgccgatattttccactcaaatcccttcatttgcacggcttcgctgttccgtctatttcccacttctttcgtaaattcagaaaatttctcaattttcatcgtcagtgtcccccagtttgcattggctatgatccaatcagaaactcgtccatgccattgaaattccaatggtttaagctccgtatttgcttcatctacagtgaaatcgatggccaatgttaatttgtcctcattttggttgaccaatgctttgctctgatccatcagttccttattaattaatgatcatttaatttttatttgggcatttatttatttgaattggcactcaccgtaaatgaaatgaaattgtcatatccccagctgttggatttgttgttaaaaaattggtcactgtattctcttcggtaatccgccatttgtgaaacaattcgaagaattgccgaacatttgcaactccaattttcgtcttaaaaactcaattaaatttatttgtcaaataaccaatgaacggatttttaggttttcacctattttttttttgcgaatagcatatgtgagataagcgcaaaaaaacacacatttttcgatcacttttcgatttagaagagcgactttttagcaactatttttgcttgtaaaattaaaaaaaaaaactattttttcaactattcatgcttttcaacaaaaaattattatgaaaaatgcaaaatcttcaaatatgtttgatttacaatttgtgcaaccgaaaaggacaaagatgaggaaattttggaaaattcacacatttattgacatgtttttccaatttttggcaacttttttagcaaatattttggcatttttcagttttttagcaactatttaggtacctatttcgcgttatttttagcacctaaaaatccattccctgcaaataacttttaattggcaccttttcttggcatatcgcaccataagtaaatgcccaaccatttctcattattgtcactgctttccttcctctgatttatttctgcccaaattttccatggcaatcctttgatttgtacagtttcactttgacgttcgctctcgaggatttccatcgcaaatcccgacactttttcaatgtccatcaaaagtgtccctgtcgctttgctttgatcccagatgaatttgtccatttttggctcatcaacagtcatgacatcaatggccaatgtcactttgtcctcgcatttggtgtaaaagcctttttccgggtccatcaattccttaattgtcccattaattgaatcatttaagggacactttaattgtcactcaccacaaaagaaatgaaattaggaaatccccggttggttgaattgttgtcaaaaacacggtcacaaagtgtcccaacagtggaattctcagcaccatttttttgattaataattcgaaaaattgctgatcgaacgcagcagcgccaatgcaaatcttaatggcaattaattatcgctaatgaattagcaataattggtagttaatttacaccttcttctggagcaccgcacgaaaggtaaatgcccaaccatttctcattgttaacgcttccattttttgttagaatttttgccattattttccatggcaatcctttgatgtgcacagtttcacttttacgatcacttccaaagacttctcgcgaaaattccgacgctttttcaatttccataaaaagtgtccctttcgatttgctttgatccaacatgaatttgtccatttttggttcatcaacagtcatgacatcaatgaccaatgtcactttgtcctcgcatttggtgtaaaagcctttttccgggtccatcaattccttaattagccataattattaattaaaattaattaaggaaacaattggcactcacctcaaagctaatgaaatttccaaatccccaactgtagttcatttgtttgttataatcacaaagtgtcccaatggaattctccgcttcgctcatttccgacacaattcgaaatgttgccgaaaaaacgcagtccaatgggttttctatcattgttaaaaaaatgattaattttaattttttaaattattatttaaattgttgtaccgtgttttgttcgctcataccataagaaaaatcccaaatatttcttctcatcagcagcagtgccttcccttatttctgctttaattttccatgccaatcctttgatgaatacggtatcactgaatcggtaacgccctacagactcttcagcaaattccgacactttttcaattccaacgccagtgtccctcttcccgtgcgcttggctgtgttccatcagaaattcgtccatggcttgggaatttcacgagtacagctcggg

SEQ ID NO: 72 - DNA, 3301 bp, Heterodera glycines
tgtccattaagatcgcaaaaaacaattatttcttgctaattattcgtcatgaagcgaaccacgcatcaaacatcactccacctcgcgcaaaacgttcaatggcacctgcactggacctggacccaaacactgttgcactcgcagagcaagaacgacaacgcactttggtgttcattggcctcccggaaagcaatgccattcgcccatcggaacgtgttcaggaagacagggaagccgccacaaaaatcctggaccatcttgaagttgaggcccaaccaaccgccgtctttcgactcggacgttacgacccgcagcgaacaacaccacgcccgctcaaggtgatcatgccaacaaccacacaccaacatatggcactcggaggatggaagcgcgagcgtgctcgactccgttctctacaaaacctgaaccgcctgttcgtccgcccagcgctgaccaaagaacaactcaaggaagaatatgaagcgcgcttccgaaaacgtcaacaaaaccctgctcccgtggcaccagcaatgcgacctcgccagacaaatgttccgactcccgtcaaagaaaatggaccaaaaccgaaggaggccagcgacgacatttccaaaccgccggaaatttttgaccaaacaatcctcgtatgttatgaagcattaaaatcattaccaccaaacgacaaaattgttcaccaaattcaatcactcgaaaaacaataccctcgtcttttcaataaatagttctgtcagacctccaaacatttcctcaaattaaaaaaaaaatacatttattccagtacttaaaatttctcaccaaaatttttcctcaaaaaaaaattttttttttctcttctacaaccctaaaaaaacaaacaaccacttttccatttgttggaggtctgacttttctaatttctgcttctccattcaaaatcaaaaatttggaatttaaaaaaattccttaccgtttgtttatttttgcggtattatgaatgaaaaattctgtttgacatctttatatacacataaaaaaaaaaaattttcaattttcgactttgtcgttttaagcaacaaaatttaaaaagaaaatcaacaataaaagcacgccaattcacacaaccgcggcacaatattatttaaggggctcaaatggatcaatatacggggtgggggaatcaaccgctccctgagtacctgaatttgcaataatgtctttcccccccccctgaaaataagtccccctttttgggttggtggctgttggacggaggctccgtgctgccggtgcttgcgctcgacctgcgcgatgacgacgtggtgttggacatgtgcgcgtcgccgggcggcaaaagtttgatgatccttcagacgggcaaatttggtcagttttttgttcataatgaattgaattattagtaatgcaacaccaaatattcatttagaatgcaaaggaaaggcaaatgaaaaaccccattttttttgagaaaaatgtaaattccttttgaaaaatttgttcccgaatgaacgaataggaatgacaactaaaaataagatttttttattttcaattgaagactattttaagattttcttgaattttgcataggctaataatttgaaccccttcaccgatttctcttttgttttgcaaagttttggcgttctgattcctaaataaaaaataaacttgtttgcgcttcgagcccaaaattatatgaattttttcagatcttttaatgcttaactcaaaaagttacagccttctgaaaaagtggtcctattctaatggaacaaccttttttcggtaaaaaattcataaaaaattcattttgactagtttcggaccccggacccgagttcgaaccaaagtcgaaaattcatttttcactaaaatccacctttattgagcaaaaacgattcaattagactgaaatgaataggaatggggattcatggccattccatgctttgaatcgtttttgggcaataaaggtggacttaggtgaaaaatgtattttcgacttttgttcgaattcgggtccggggttcgaaatggatattatattcgtgatcagcggccccgaatacccctggaaacacttttttatcattaaaaaaaacaaaaaaaaattttatgtggcctaaactgcataagtacccgctttttacccgaattcgaacaaaaagtcgaaaattcaaatttttcattttattttgttgttgttgttcttttgtccgtcactcattgtcagaagacgcccctttttcgctgctttgtcccgcttcttcttcttctgctgctggtggtggcggggacaatggcctaaataaagcacaatttgaataaaatcaaatgctttatatgtaaattgctcacacaatgcagctttggagatcggaaatggaaaagatgacagtgttcaaattgcccaaattttcgtcttcccactgaatcgactccgtcccctcaatttggcatcgcttcattagccattggcaaaccgacccatcgttggctgtcattgtcagcttttcgttggacatttcattcatccattcaaataaggcgctaaaacaaatcaaaacaaatgctactaaaaatatgtaccaaatggaagagatttttaatgcttaattaaatgataatttaaaaaacattttttttttaaattttcaataatttttattgatcaagtttcagaggaattttttttcgaaaaatttaaaattaggtaagcaaatattctatttcaatgtagtcggaaaacaaattttgaatttttcgaaaatttaaaaattgccaaaatgaaagggcaaaaaattaccgtactcagtgtaccgtgttgaatataaaaataaagtgagtacaatagaaaggatgccaattttgtataaaaaatatcaaaacgtattaaaatattcaatttaaaatttgaattttcaaatttgaatgaaatgggaatgatgttctgtattttgttaattgaaaattataaattgtatagtttaaatatgtttctgcgcatgaagaaatgtgctaaaaatagcattcctactttaaaattttgatttggtgagttttgtagtccatataaatccatatttagcgtttttagtccatataaatccatatttagcgtttttagtccagataaatccatacatccctgcttgatagtgcctattaacctgcaaagtttcaaaaaatgagctgagaaacaaaaaagttatggccaaaaaacctcaaaaaattgcattttcctggccattttggcgcagcgcgccatatctttttaaaa

SEQ ID NO: 73 - DNA, 9211 bp, Heterodera glycines
ataacccccaaaaaatggggtttttaaaatttttattctctttttttgtgggaccaataatttcttaaaaattgcacccgatttattactgtttaatagaaatgggtaacattttgcgaaataataaggattctcagttaaaattttataaaatacaacaattttttggcatggccaattgtttgttttggccccttaataataactcacattttttgtgccatttcaaaaaatgtgccgtgccgtgaaaaagagaattggaattgagctgaaagttggaaatgtgtaaagaatgaaaaatatgggtgaatttgtggacggacctcgaggaaagaaaagcaaaaattttcggcaacaaaattctgttgtaaaaaaaaaatttgtttttgagaaaatgaaatttttgatcaattatgatggcccataaggggtgagggggtcaataagcatgaaattaattttgctagtgaatataaaagctaaacttcaaaaaaggatggacaaaaaagctcaaaaattatcataaatttttatgaaattcgacggaattaattttaatgaaaattgataaaataaaaacatatatattattgaatcgatgttatgaataaataaaatcgaaaaatgcaagacacgttttttctcctcaaattgtggctgtttgatgtgtcaacaaatgtttttgtttactacattttgacaaatttttgtttaccatacaaaaattttttttctatgttttgccactgcgaaaacttcaaaaatgtaaaattgtttttgaattatttaataaatttgtcgaaatctttaaatttaatttactatttttaaaatcaatttgaaaggctggcagcagaaatgttgaaattaaacaaaaaaataaataaaatatacttcaaatttaaatagttttaatttaatatatacatacataaatatgccttttttattaaaaataattggaaaataaaaaaatgcaccaaaattagaaacattataattatttgctttcctcaatccaatcagtttcatcatcttttttcactttctttccactctaaagatagtaaatttattaaattaaattgctttaaaattttaataaaatgccattacattcaattcttatgccgaacaagcaattcattgtttcacatggcttctcatcaacagtttttgcttaatggatttaaatgttttacgataaaattgttcatatgtactgtatgtataattgtaaattgttcatactgtatgtgccaatcactttgtttactcggttttatgtgaggtgcagacaataaaggtatgaaatttgatgtcttaaaattagtaaaataggcaactcaactcgtacacaaaattttttatattttttaaaccaaaatttttaaaacaaaatttttcaacataaaaattatataggaattgcaaagaaattcaaatacatggcaagttataatattaagctaccacttattgatttttctatacatatttcgacaaatagcctttatttattgcttacatccacggatgcccaagccgaacaagtgttgttttaaggtagttgtcgtggttgtcggagtcgtcgtggtagtgggagttgtcgtcgtggttgtactggtcgaagtcgtcgtggtagtggttgttgtagttgtggttgtgggagttgtcgtagtttcctctgaactttccgtagtttcgtttgtcgccgaactgtccgtgtttccgtctgtcgccgaactgtccgtattttcgtctgtagtcgcggggattgtgaatgtgaatggggacatttgctacggaaaaaatttcttaaatattacaaaaaaaaattatcctcaaaaaagtaccgaaaatttccaaaacaaaaaaaaggatttattgtccttggattttaccaattttccatttaaaatcagcccgaatctgtccttgaaaattcatcttgaacaatgagggtaaaaacccaactctcctcctagcgaacgcgtgcttgctgttttttaaaatagtcataagtttcaacaaattgaatattcttggtaccatccgatagcttttaagattctctctgtacctaccaagtttttccaaaaattctatcgtttgaaaaaaaaagttttgggcaaaaaaaagatttttaggatttttttgtcgtatcttttttggaaagcaataaaattttatttttatttttttttaaatttgcagttagatagagagaagagatctttaagagctatcaaatgcggagtaggacaaaacgtcgtcagccgaaacgtcgtcgaacgaatttttcgaccataacttttttctttctcaaccaaattaaacattcttggtattattcgaaagcttttaaaaatgctattagcctgcaaattttcaaaaatttttatttatgcacaaaaaaatcagagcaaaaaaaagttcgaattactgggtttttgagttccaactggtcataacttttttgaaacttaaccaaaatttttgagattttgcaaattaataataaacacatagagctatcgaacaacaccaacaattcttaatttgattgacagtgaacaaagttatggttcaaaaagtcttccgacgacgtttcggccgacgacgttttggggtgcaccgtatcaaatgatactaagaatgtttaatttgactcaatttgacaaaagttatgaccattttttcccgaaaaacagtatactagttggcatactgtagacgaggttggttgtcgtccaacaatgagaggtaccatatttttttttgaattatgacagttttaaaccaagaatttttatgaagaaaaaaaatgttcagaaaactaaattttaggaatttttttcaattcttagggatgcattttctgaaatttttagatcatttcttaagggtgtattacttcgtttttatttcatttttggagttttcctttgtgtttatctgtgcgtatttgcagaattttttggaatttacccataaaaaacaaagccctaattataatatttcacttaaaaaattgatcgaataccatatttttatataaaaaatttttttttcgaatttttaccggttgagcaccaaaaagcaagtaggtattgcaattgtgtgcatcacatatgctacagttcacaccatagtccgattcattgaaagcgttattatgaaatgatgagcactgccttttcaaagtcgaatctctgcggtggaaatgaggggacccacgcgtttcggcgctcacatttcggcgctcgcgtttcagcgccagctcgtttttccactatagcatttttctttggcatataaatccaacaatcttggtatcagtcgaaagctcttccttcacatgctttattagccttaacaaaaagcaaaaagtttttcaaaacttagagaacttttattaataaaaaacttcaaaaatttcaacttttcacaattttcatgtatatttttgtaattatctaatcgcgaaacaatagcttagaaaaagcttctaaacatgttaagctttcgaatgatatcaacaattttggatttgggtgacaaagaaaaaagttatagtggaaaaacgagctggcgccgaaaagtgagcgccgaaatgggaacgcagtagacccgaaatgagagggcgagtcaattcagccccggaaacacagttccatcccgtaaggcttttaggtagtaattatgccgaatcaaaacacagacttttctctttctctacctgcagttgacccccgtccccccgtaccggttatcgttgctgcaataagattctgttgccgcgcagcctttgacgaatgcaaatggttgtccgacttaaaaaacacacacacacatgagatagagaaggagaagcttccccgaggggaaggctaatgaatcaattaaaggtgacgattaattaatctctaattggggagagcatggaggggagggtttgttgttcagctggtagaacattgggccggaaggccagagacgcgggttcaaagcttttcggcatttgctttttgttccctcgaaaattcttgagctcaactctgtgtcgcccagtaagaccaagccatatccgatttttacggcgtttttgttggatcgaaattctgatctaattcccaaaatggaaattaagaaaaataactatcccttcaactgagtaccgtattcacaaatcatggaatagcaccgtacaccctcgttgcacagattgaattcatcggcgctgcccttaatccatttgttgtggaagatttcatcaacgcattgtggtgctgaaaatacaaaaatgtaatgtatatattatagtatgtattagagctcgacttgctggatccagacctaggtttttcttggattcaggcccaggccattttcggcaacaattttttgtaaaaatccatgtccatgtcaaatatggaaaaaaactcaagtccaggttatgcatgaaaaaccctggatttcccggacaaaatttagaatttgttatccaaatgatcaatttttttattttacgtcatcaaaaaatgattatatagatttcatattgtcaatttaaatatttttaaatgtactactaagaaattaattgaattttccaagcatttatttgctttttaaaacaaatttcaaaaaaatccagctccatgcctgggtccaggccatgccatcaaaacacagcaaattataatcgtaccgtaagcaacatagaatatttgtgatgcgataattgagcagaagagcataaatgccatggaggatttcgttttgcttaaacaagctggatcagtttcgaatttataaattgggacctctatgtctgatttctcggaattttaatttaggtgcctgaaaatcactcggaaatcggaatttcgatgttcaatttcggaatattgaccaaaaaatcgaatttctcatgctaatccgaaataatgagtccgaatatctcaaccatccccactaaatatttttgcaaaaaataattttattggggaataaaaataatttagtaaaattattttaacagcggtaaaatgcatttacattattatattttacattccatttggtcaaaataaaataaattattcatataattttgcgttaatcttgtcgaaaacaaatcaatttgttaaatgaatcactcgcacattttcagccaattttttttgattaaatgcactcaaaaaataaaatgccgattctcaaatgaaagcaaaaaaatcaataaaatcaaatcaatcagaatgggattcgtcaaatcatttgattttacaaaacgaatttgccccatcctaccaattaaaaattgggacttttaaatcactttaaaaaaaatattttcaacatttatgacaacgaatggtggagcagacaaggcccaaaaaattgtttatcaccaagagaaaatttatttaaaaatgatttataacgatagggagcccaaaatatgcatttaaagtcaaaaaatatttatttattcgcaaagaaaataagctgtcagcagaagggcgaaactcacactttgacgactgtccaaaataaaattgattaccatagagtaaaatgacagaatatattatataccggtatatggatgatcacagtactagggctataaaaaatggaataaaaagctcataaagaatcagagagaatagaaagagcgacaaattaggtggtattgatgcaccacaataatctttaatagaattattaaaatattttttgattcaaaaatgcattttataagtccttacaattagtctatattaaaagtagagaccggacaagactctcggtcggtcttcggttaaaacccgaaaaacagaaaccgaaaaaccgaaaaactcaaaaaattctcggtcggttggtttcgttaaaaaaccgaaaaatttcagacagtatattgtgccaaaatattgctattaacaggttatatcgctccaattcgcgatccggttttttttttgatttttataaaagtcggtcgagtttcgtttttgattaattgaaaagtaatgtgcagggctgcaaaaaatatgcacgaaaaatgaccaaaatatgcaccgaaatatgcaaataaaattgccaaatatgcacaaaaaaacttgaaaattaggcgtgcaaaataattaaaaattttattcctcataaatgttatcggttgttttgtaattgcaaatcaaaattttctcaaggttttcggcagtgaagctcactgttgacccactcgcgcatccattcagatttggatttgtttaataaataatttttttccctaaggaatattcaaataggaaaacatttaagaaaaatggcaaaatatgcatgaaatatgtagaaaaaccaaaatatgcaaataaaagtagcgatttttatatgcaagcccaaaaaacaaagtgtttttcctactatttatagcatggagaagctaggaaagaaaatatgcatttgcatatttttgcagccctggtaatgtgatataaaaattttaaacaaaaatcatgatcatgatcatggtcttggctgaagatgaaaggtcaaaatcagcaatggctgatcaaatctcagaatttggggtcaaaaattcataattatctaaatatttatgtatttttcaaagctctcacaaacctttgctgttagcgtgttctctaccagtaactccgttggaattgatcacatctcttctctgttattgctgcccagccgtctgaaatgatcattgtgcctggctcgatgttttcagcaatcaatggcaaaagcgtagcggcatcacgatttgtgacagggaaaaaccgaactttattcgtgcctctctcaagcatcccgaacacccaattttactgtcgttgcaccattctgcctctgttatacttagccctgtaattgggtgctaatatcaaagaaaatatactcgcttttttaccgaaaaaactttgattcgtcaatttcaaccacgcggcccatcccgcccaaattctcatttgcttgcattcgaaccgcccaagactagtaaattagtaacatgcatatagttagacaccattccccatcatacttggcaaagatctctcataaagttgtaaaaatcgacgattgtcgcaatcgatccaatttcattttctctcattataacttccaaattgcttgttggatgttgtgcccaccattaagccaggcgaagcacttgtttgagtgatatgtgtgttttatcaaaaaacgagccgatccgaacagacattcggcttgacacttcagcaccccgggatgttcgacagtaattacatctccacttaaaaatttttgtattcggatactcaattgtattaatacagtaaatccttccggtgctagtgcatacttgacaagtgccccttggtgaccttggcattcacggcacaaagcagagtttgcgatcaaaccgtatcgcgcaagaaattttaaagttttttccacgccttaatatgaattttccacccgatttttgccaataattgccttcaattgagtcatcgcccagctggtccatcaaaagccgttcataattgaattcagcaagggcttccaatgacccaggcggcataaccggaccatcatttggcaacaaaatactgtgtcgagaacgcggcgctgccataggacccatgcttgcatgtagcaaccttgccgttgagtttccttgttcttcattacacataccgtgttccttacagataattgtcggattgagcttctcaagtttaatacaatttaatttgtttacaatcgtattcagtaaagcatccgcaaccaaacggtagcagtcggaactaaaaaacgggacgagccgacagtagctcttcagttgatctttgacccatccaatgccctcatttttcacttcgttgatcaagcccataaaagcggtgcacgcaaacaacgcatgctgggttcgacttgaggctacccgacttttggggatttgcaacttggggacccgacatttggggacccgacaattggggatcccgacatttgaggatccgacacttagggatcccgacatttggggacccgacttttggggatccgacacttagggatcccgacatttggggatcccgacatttggggacccgacttttggggatccgacatttggggatcaagacatttggggacccgacatttggggaccgaaggacatttgagcaaaagacacttaagaaaaccacggacatttggcaacccgacatttagggacccgacatttggggatttcaataaaacaaaaaaaaaatttaaaaatttaattctaagccacaaaattagacaaaattacgtctgctttagccagagttaattccattgcaaaaaaattaattaatattttaaaaataaaactgtttccggactcaccgcgaggaggcgcagaattttgagcccatactaaccacaacacaatagacaaaccacaatacattttttaactacagtagacctttttccaatttttatttaaagtgcctttcccaagggccaacgggaacagaaatccgtcaaggacattcaaaaagttccagccgactttgctgtctaattgcgtacagcaacaaaatgccgaggtcatcttttcggtttcttatctttcgggtgactttgttcggtgctttaaatgaattttttaacgaattaattttttgtggctgacctgcaaaacaaatctcttccactggtcgccctatttcggtatttatttttccaaaaatatatccagggttgtagtcatcaacattcacactgaattcataagaattcagagtgagcacaaacgggaaaaagtcctttaagatctgtttctcttcgcaagctaaaataattatatcttttcaaaaaataaagatttttaaccttttatttcttgtattagcaaataaatgttgagggaaactgagcccatttccatcaaaattgtcgaggcggtaatgtacgggtgggctttaatgtaggtgcttatacgtgataaagccacagtcaaacgagctaaagccgaaacttctctttgtttccgatgtctctgtttgttcgaactatgagtatttagtagcaacagaattataattgtcaaaaaaagaaattttttcattttctatatattcataattcgtaaagaaatgacaaaaacgggagaagagaattgtgccag

SEQ ID NO: 74 - DNA, 1924 bp, Heterodera glycines
caatggtaaggactgtcgcctgagctcctgtgtcgacattcatttcgatttttgtgccgttaatttcgaccaaaattttccaccgccgtccttgagtcgtgccaatttgtaggcatgttgctttgacttggaccgtgtgaaatgaacggcgttggttctttgtcgtgaatgctcccttccggcaaacattagcaatgtggccttgtttttggcacgtgtggcatgtctcttctcggaagcgacaatctgatctccagtgatcagtaccaccacatgagccgcacggctgggtcggttgtccacgaattgcttttcctcctgtggccggtttttgctgtgccgggtggttttgttgcacgccatttgctgatttggccttggtttttgattctctccactgttgagggcgagttcggatggcatttgtcgaagctggcgtggaaaggagtgacaaagcactatctttaacaatttggattgcttttaactcctcttccaactttttgagtgtgactgtggtgccacttttctcggcttcttccatcattttaagacatttctgcctctaatcgtgatgttcatccctcagtaaaatcaccaaaatcatgcatttgagctgttccttggtaaggctcaaattggcatactcacacgctgcgttgatttgagcaaccaaagaactgatgtcttggtttggatgctgtctgattcgaaagcattcatatcggcggacgaaaagagagcgcgtttcagcgaacaactcttttaatctgttgattgattcagcccacaaagctttgtcgggcaactccgggctgattgtgtccctgtacttcgtgtactcttcgtctccgagctttcccaacaatagtcggactttggcttgctcggttaagtctttgccatcctcttcaatcaatatgccgaagcgtttgtgccactgttcaaatgtttgaccattctcggggtcataaacaaactttgaaattctactgtcgattgagctggccaaattcgcttggcttatgcttgaagcggcatttccttggagcaaagcggtcaaaagttgttgaatttgttcggcgttcattgtccgtcaattgaaattgttgaaaaagtccacaaaatccacacctggtggatgcttacaccgtttggtgctaagctgacgaatttgttgaaaacccgcttcttgcggaacctcacccttcttaggtctattggtttttttttgttgagttaaactgcttcttagcagacctcacaccacctggatgctattggtttttgttgaatttgcagctgtccttgtcctcagtgatgaagaatggctgctgactgcgccaatttgttgtgttcttccacttagaacacacaaagaaaaagaaataaataaataattttattgattcggtcggagggcaaattggaaatataaataaatgaatgatgaaagggaagaacaaaaagtgggaggaggtgtccacttttatggacgagggagggggcggatggacatagaaataacaaataaagtcaataagtcagatcgccataaattcaaattattcactatccaacatcccccaataaacttttcataccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccatttttcgcaccgtgaatgttatttttattgaattctgaaccgttttgagtagattagactagaaaacattgaaaagttgaaatcatgtttcccactcccttctcccatgcgggtgtgaagtgtaaagtctttttttcccccaataaacttttcatac

SEQ ID NO: 75 - DNA, 4192 bp, Heterodera glycines
gggtcggtttagtctggccggtttagtctggccgttttagtctggccgttttagtctggccggtttagtcagagggtcggtttagtctggccggtttagtcagagggtcggtttagtctggccgttttagtctggccggtttagtcagagggtcggtttagtctgaccggtttagtcagagggtcgttttagtctggccggtttagtcagagggtcgttttagtctggccggtttagtcagagggtcgttttagtctggccggtttagtcagagggtcggtttagtctggccggtttagtctggccgttttagtctggccggtttagtcagagggtcggtttagtctggccggtttagtcagagggtcggtttagtcagagggtcggtttagtctggccggtttagtcagagggtcggtttagtctggccgttttagtctggccggtttagtcagagggtcggtttagtctggccggtttagtcagagggtcgttttagtctggcaagctgtttttgtcctacattgatccaattctgatttatttctcgaaaattcttttaaattaacaccataacagatttatcagtgttaacaacaaaaaaataacaaaacattgaaaatattacgggcgcatctcataattccgagaaataccaaggagaaaattgatgatgttataggggttaacattgataagggcatggtaattgtgatcattttggtgagcctggttattgttgatggcattgtagctctgcaagagtcgaagaattctcgcatcggtggcacgatatttgggcgccttttgaggaagggagatggtggacaggaagaaacgccatagaagtgatcattttgcttttttcagcaaagacggcatcgttgttgtatgtcttaaaatgaaaaattctattggaaaatacaaaaatgcaatcaatacctgtgttaaaccctcggaagcaattcgcttcttcatacttctcaccaagtgaaaaaaagcagaattgcacacgacaaagtggaaagactgtgcggacagcagcgaccatcgcttgctcgaagtccaacgatatggtgtcaggtgcaaaatttggccatctttggacaatcagttgaagcatccgtgtgtatatcacttcacattttgaagtgagaaggcagtacgcaatcggaaaaacccatttatcacgcctaaaaagacaaaaaaaagtggtagaaaattaaggttttactttgcaaggagaacataaatttgactgaacaaaagcggcgccaaactgaaagtgccatctgcgtacgcatttttcataataccggcccattccgaagtcgaagcgcgagcaaatatcaaaattcttaacacggtatttttaaaaattaatggttttattattttaagtttttacttgtaaataattgacagaaaaaaaaacatttgtaaaaacgacttgccagactaaaacgaccctctgactaaaccggaaagactaaaccgaccctctgactaaaccggccagactaaaacgaccctctgactaaaccggccagactaaaacgaccctctgactaaaccggccagactaaaacgacactctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaccaaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacgaccctctgactaaaccggccagactaaaacggccagactaaaacggccagactaaaccggccagactaaaacgaccctctgactaaaccggcagactaaaccgaccctctgactaaaccggccagactaaaacgaccctctgactaaaccggccagactaaaacggccagactaaaacggccagactaaaacggccagactaaaccggccagactaaactgacccagtccgcattagccattgttttggagtttttaaagtcaattctgaatttttacataatttttggcatttttttgaaggttaaaagccatttttgcagtttttaaggcatattttggtgcatatttgggcattttttgggtttttagggcatatttgagggatttgtagtgcatattttatgcgcatatttggcatttgctgatgtgtgtgcaatctaaccaaattttaaagtttctccatttgataactgtaattattatttacttttcagatttagctagttcactgcgtcaacaacgcaccgaggacaatcacatttcaattaatggacaaaattacgcggttgacggacctaatgttaatgttggtgttgaagggcatgatttgagtgtgaatgggagagtttatcaaaacagggccacagagcagtatctggaaattatacaagacaaaaacataagaaatgtaattgtcagtgtgccattatcgttattttctcgcgaaaacataatcgatgggcaaataaacgctaaatgcaatggaaatttatacatcgatcaatcgtcagatggatgttctcgcataatatgcgtcgacgataaaaagaatggcgttgaaaataactttggacagacacgtgatattttcctgaccggtgatgtcaatatttttgagtctgcaaatggaattatctacaactctatgatgggaggaactttacatatgcataattcgtcacttgagtgtgctaacattgaatgtgatgcatctttaaatgtaactcactcaccaatagaacgtaatgcgcaaatgaaatgtggtgggagtttaagtattgatgagtcaccaatgggaaatattcggcttaactgtgatggatctttgcggatcgaaaaatcgaaaatggaaagcagtcagattgatgttggtggaagcattgggattgttaagtcaccaatggcaaatattcggcttaactgtggtggatctttacggatcgaaaagtcgaaaatggaaattggcaacctagacagtggaggaagttcaaccattgtagaatcgccagcgcaaagtctaaagttaaactgtggaggaagtttaaatatgaatgagtgttcaatgaaaaatgttggcattaattgtggtggaagtgcaaccattaagaagtcgaaaatggaaagtggtcgcattaattgtggtggcaatttttctattgatagttcgccaacgggaagtgttcgaattgattacggtggaagaagaattaatttatgaggtcaaacgaatgatcttgttcggaactgatcaaaagttctgaatttctaacataacattaaagatagaaaaatataattattttcctttgtatcttagtatggataaaactataattttaagaattttattcgagatttttactactttatggtttctaattcattagaggatttttttatttttggataggtaaaaaccgaattagtggcgcgcttgcccctttttagtctgagaaaatgccgggaccgaagtgtccaaatcagggctggacgtaattacggattacgtattacggattacggaaattacggcctttttggagttacggattacggattacgggttacggatttttgggatttttccgtaattttgatccgtaactggctttttagattatttttcgagacgatttcttgcaagattattttttataaaatgaatttatttttcaatttttattaaaagactacccatatttcgatttaatctgacttattcttggtaatttgtagtattattaacatacataaagggggggaggaggctagcaaaggggaaaagaggaaatgctaaaaatttggctatttttaacaaaattcgttaaaattctgaaaaaaattttcctcggcggcgcttatcggcaccacccgccccaaaaattcctaattatttttaaatattagctccaaaatcttagtcatttttagacaaaatcttatagcaaattgcataaaatttttcaaaattttttccgg

SEQ ID NO: 76 - DNA, 962 bp, Heterodera glycines
  misc_feature (758)..(758): n is a, c, g, or t
  misc_feature (820)..(820): n is a, c, g, or t
gactaaaccgaccagactaaaacgaccctatgactaaaccggccagactaaaacgaccctctgactaaaccggccagactaaaacgaccctctgactaaaccggccagactaaaacggccagactaaaacggccagactaaaccggccagactaaaacgaccctctgactaaaccggccagactaaaccgaccctctgactaaaccggccagactaaaacgaccctctgactaaaccggccagactaaaacggccagactaaaacggccctcagactaaaccggccagactaaaacgaccctctgactaaaccggccagactaaaccgaccctctgactaaaccggccagactaaaacgaccctctgactaaaccggccagactaaaacgaccctctgactaaaccggccagactaaaccgaccctctgactaaaccggccagactaaaatgaccctctgactaaaccggccagactaaaacgaccctctgactaaaccggacagactaaaacgaccctctgactaaaccggccagactaaaacggccagactaaaacgaccctatgactaaaccggccagactaaaacgaccctctgactaaaccggccagactaaaacgaccctctgactaaaccggccagactaaaacgaccctctgactaaaccggccagactaaaacgaccctctgactaaaccggccagacttaaacgaccctctgactaaaccggccagactaaaacgaccctctgactanaccggccagactaaaacgaccctctgactaaaccggccagactaaaacgaccctctgactanaccggccagactaaaacgaccctctgactaaaccggccagactaaaacgaccctctgactaaaccgggcagactaaaacgaccctctgactaaaccgggcagactaaaacgaccctctgactaaaccgggcagactaaaacg

SEQ ID NO: 77 - DNA, 3267 bp, Heterodera glycines
cctgtcccccccccccacattccccagttttttgggaaaagcacaccgcgaaaaaaaactattttgggattttcacctcaaaaaaacaagcagatattctgatcataaattaatcttaacaatttttagattggattttttaaatttaaaaattttttaaattaaaaaaaaattttgaaaattacggattacgccaaattacggccttttttgacccccgtcatgacggattacggatggccgtaactgaaaaaatcgccgtaatgacggattacggatggccgtaactgaaaatcagttacgtccagccctggtccaaatccaaccgggactctactgaccacaataaaatcgccacaaaagcctttataaaaaatattttttatttattatgactagggaccggatttgtatggatttccatatttttttaacactcatttcggcctaaaaaccacgtaaatagtatttttagcttaggcttctaggatgcctttttacttccacccccggtccccgacatttttgggcctattccccgccccgacccccgacatgtcgccccccgaggttcccgaccccgactttttgcccccccgagggctcggagcttaaccctaatttaaaaagaaaaatcaaaattcaataatatgccttaataaataatagggctaattgatttcattgtttatttggtaatatttaaaagaaagatagaaaagcaaatttaatattttcaatttcattcatttggacaaaaaatgaaggcacggcgaattcctttcattcaactgcaaattctgctgctgaagctgatcggagacattgtcaccactgatcaacagagagaagaagcgactgacgcgaatggcacaacggagggggaggcggcggaggaagcgaaagacatggcattggcattggcaatgagcagccgccaattttggcaccaaatgacggacgaatggaattacaaaaatggcaaatttcaaaagccaaaagaagaaatgttttccaaagtttcttaccatgactttggtgagttttgtgaaaattggaaaacaaaggcgacggcagtgaattcttttgtgaaaagttggcaatgcaaaaagggagggaaaagcggcgacggcacaacggacggaacgccaacaaaaaacgatggtaatggaaagcggacattttggtgaaaacccattttttccttctgtccgtttcagtgaataggtacatattttttgatttagttttggaatttgacggaacgaattcaagagggactttcaagaattaacaattcgttggaaggatggcattacatttggggatcagttcttgagccaaaaccgctgtttagcaaatttgcaaggtggcaacacatcgttgatgattatgaaaatgcgccagcaaatggcattagagggaaaggtattaggcgaaatccctctttgttgatcaggacaacaatttgcgtcagattttgctgaatttgagcagcgagcagcacaataccccattcgttatctaagagcatgtgcataccatttggggcagaataattgaaattttaaaatatatgtgacattttgccaacattttttaaaaattatttctcatttgtcagtgacgaaatgataggtaaccttcatgtctgccattttttaatgtctaacttagtttatattagggttgcaaccccgacgtcggggttggaaaattcggggttcggggttgtcggggttggaagtgtcggggttcggggtcggggttgccaaatcgttcggggttcggggtcggggtcggggtttttcaatttttgccttatgccaaatagtcaaaatttttttaatattttttcggaaataatatttattaatttccataataatatttgtattgtttttatatttttttatttcttttttatcagaaattttgtatagaattaatttttttttcttgaaattttaaaattttttattacttttttgttttccaaaacatctttttttcacgtcgctcttttctaaagacttaaggagaaagggtacggcgtccggcggtgccgataggcgccgccgggaaaattttgaaaatttggttagatctgttaacagattttgtccaaaatatgctaaatttttgcgattttgagccaatttttttaataaggtttatgactttttgggccctgtgatgccgataggcagcgctaaattttggaattaagctctattttctaagatttttcaccaaaaaaatttatgaatttcggtaaatttttgtttatttatttatttatttatcgataaagaaaaattgccatcagaagggcggagaccacttactctgatgactgatcacagtaaaatagtctcagagtaagtgaataaatatcgagtgagatcacaggttaaaacaaataataatgaaaaatttttgtttgttaaaaggcataaaaaatgggtaaaagtggggtttttggtgtcgctgatcacgaatatgacatccatttcgactaattcagaatcatggactcgggttcgaacaaagtcaaaattcatattacaccaaaattcacatttatattccaaaattaaaattcatgtggcctaaactgtataagtaccgcaatagcttagaaaaagcttctaaacatattaagctttcgaatgataccaaaactgtttgttttgatgaccagtaaaaaaactatagaaagttaggtacttatgtgtagggaagcaacttttagtgacaaaaatcccgaaatagttaactaaaatagtgagtaaaaatgccaaaatagtgaagaaatagtgacaaaaagtccgaaatagtgacaaatagtgataattttagccaaaaattatccaatgagcttcatttcctttataaaattctcttaacagaattttttgagaaatttttttcatttcttaggagtgtatttttgaaaattttagggtcgatttttagggggtgtatttttctgaaattttataagtcgattcttaggagtgtgtttttaaaaatttttgggtcgatttttaagggtgtgtttttctgaaattttataagtcgattcttaggggtgtatttttcgtttttattgcatttttgttgagaaattttccaaaaaatgtcaaaatagtgaaaaaatagtgacaaaacgccaaaatagtgatttttaactattttagtgacgaagtagccaaaatagtgatttctagtgaccgatactgacatcagaatcgaaaattttta

SEQ ID NO: 78 - DNA, 949 bp, Heterodera glycines
agtacagtacaaaaattactcacctcagcatggcctctacacggattgtacgcgggcggagcggcggttacccagcggcgccggcgtcggcgcgggcaaccgcaaattgggacgcgtttgtggaccgctcgccgttgcattgcacctacaaatttgaccagcacgcgttagacaacatcgaagcgcaaatgcacgaaattgactcaaacgcggccgccgctgaggcagaacaacaccaattccatggtgaattgaatgaatcaatcggctaattttgccttttgaactgactaatcgggctcgattatcgttcattcctctctcaccctcctaattagtttccccgcatcatcccccgctcgaaaaaactaaaatttttacgtctttctaagttcttacaaaataaatttttttctaataaaaaatctgtaaatattcttcagttttagtattaaaaaaactgaaattaaaatttcatttttcggggggggggggggggaggagctgctcccaacaattgtcgatgcttgagaatctctgcctcgtgtcgagattaaagcgattattctcataaaaacctaaagactttggcttatttgagtttccttttaggttggaaaaaggctgtccttgtcttcatcggtttatcacttatcgcttgcgctttttcaatgctgtaatcattaaacataaaaataaataaatcaatttaaaattattttattttttaaacgcaagtttgccttattaaggatgggtctgtgtgccccgtgcaccccggcatgcgctattcttcacagcatcgccagcttttttgcttgtgaatggcttatatattaattattccaattttaaatttatattataattattattattatttttattgacaattaaattaatttattagcatgtaacaaattatgtgccctttttttattagtgtcca

SEQ ID NO: 79 - DNA, 7099 bp, Heterodera glycines
aaaagtgggaaaaaagaaaaaacccaaattcatcgttaaaattaggaatgccattttcgttggaatggaaatggacggattggtggataattttcgatttaattattccgtcataaattattctattcttgccgatcgtgaaaaaaaattgacaaatggggaaaagcgatgtaaaccaggaaaagcgaaaaaatagaaagtgccaaaacatcgctgaagttcagcttacttaaccggagaaacctgcacttctgcttcgtgatcaacgaaccccgaaaaaggttcaagtccactccacaactttaattttgttcaattaaattagataaaataaattatatttttaaaattattttttaagcatttcgcagtacgtaacccgcgtgtcccccccccccccccttgggaccgtcactgggcctatatagtaaacattcgatagagcttcaatagctctagaattttggtccaaggtgatctttcgtttttctgttaatgtaaatggtttatagcttttaaagccctaaattatcatcaactcccgctaaacctttaacttttaatggcaggatgaacttctggctttgtaaatttttatctcggcaaagaaaatttctttttgacaagaatttaccggaaattttgatttgtgtccattttagcatacatcttggctttttgggttttaatctgctgaaaatattttacaaattaaattcgatacaatcggctccctttttatttttttatttagcagaaacgcgaagcggcagtgtctgcgccacaagcgttggccaatcaaccgactgacgttcgcagcagccggaggagagaatctggctgttgaagaatgtaagtgatgttctcataggggagcaagcaggtcgtggcccgacccagaaaaataatttaaaatttccaaaataatgcgcattaactagacaagtagcagtttttttccaaaacaatttcgcataaaatgaccaaatttcgcgattttgctcaattacaaaaaaaaattagggttacggcactgccttggaaatttagtagatttttacaaaaaaaatagtaattttggtgaggttggtcttggaggggcaaatcaacaaggaaacccgaaaattttcgacaaaatactatttttcccttaaaatttcagcttcgtaggggtcttcccgccccccttgggaccgtccctgccaaaccgatacagtattttggaatattttattactgttaccatatgaagtgtttgtttgtgtattcagacgagccgctaacgcccaccctggagggcatcgtgattcttcgcgaattggccaaaaaaagtggcggcgccagcattggcccaacaaccgaatgaccgattgaagcagccgacggaagggacgaatgatttatttattcattcattcttttttgtgttttattattgtgctgttataaaaatctgaacacatggatggatgggtaattaattgttcgggcgggtgatgggtgggaaactgcagttaattgcgactgatctcgaccggcagaccctagaaattcttatttttccttaaaaaattagcttaaaatcgaatttagccatcttttggacaacatctgtcaactaatcgcattgaaaatacaaaaaaaaacaaaatttccggcggtgcacatcggcactcttggaccttccttcgtatgaacaatcggacctgagacaccggtatggcccttggctgagagcccttttatatatattatgtatgatgcacaacggtgctatgtcgaaggacaaaaattgaattgcaaaatttgctaaatttttgactaaatcaactcataacttttctcagacgcaaccaaattgcacaatcttggtgtcatacgatagccttttaattgctttattagcttgctaaattttaaaaatcatataaagtttttcaaaagttatgacaattttttcatttttgcgtctgagaaaagttatgagttgatttagtcaaaaaattagcaacccattcacgaactatttcttaattaaaatactaattagaaaacaaaaagtctacttcacgcccaattttgggtggtcatatgtttacgaccactttttgtatctcaagttaaagtgcacagaaaaattccgaaaaaattcctgctagtttgacttttgatgctgatcaaaaaagtcttttacacaaacttgatcagatcactccttcatagtgatcgggacacccaaaaatatactgaaaatcgggaaatttttcgaaaaaaattcctagggggctggaaaaatttttctgaaaaaaatcattatctccatctgaaagagaacaaactgctctacaatattcaaaagatcgcaggtctctatgaccaaacatgctgaggtatgggcacttcaatttcggtgtctacaaaaagtacagtatttcttaaggaaatagtgcattttacagtagaaatggtcaacattagcctagcaggatgaaatgcataaagtggtcgtaaacatatgaccacccgaaaatgggtagcgacacacaaagtcaaaagtaattcgggcaataacccatgtttcaattaatgaatggtagcattggaaagcccattaaaaaggctaccaaaaatggaaagaatgtacgtctatcaaatagcttaaaaaatttatgaaaggttctttattggaatggcaagtggtcgtaaacatatgaccatgactgtatttggcatgaaattcaaatgatgtttttaagctcatttgtccaacctggcaaaatagggtccggcggtgccgataggcgccgccgggggaaaatggagaattttaccatgtttttagtagattttcatcaaaaaattcccaattttatggattttcataaaaaattggtaatttttggattttagaaaaaattaagcaaaattttttggaaaattgttactataaatggtttcttgcttttttctcccgcctaaacctttaacttttaagggcaggataaacttctggctttgtaagtttttatctctggacaaagaaaatttgtttttggcaaaacttttaccggaaattttgatattcgtccagttttagcacacatcttggctttttgagttttaacatatgttttagtgtttttataatatatatatatatatattgtgtttcctaaaatagagcccggggcctttatttttcaaattgtcaaaaaatcagctgaaaatatattaaaataaatttgatacaatcggctcccttttttatttagcttagagattatttatggtgtgcctgcgccgcaaattccccggcggtcaccgactcgaccgtcatctcgatgtcgcgcaagccgcctgcccggctgttgcgtcagccgatcacttgcaactgcagcttggaggtatgtcaatgatccttttatgtgaaaattctctccccaaaagtgaaaattccctcctcaaaaaacaaaaacttgataaaaaaaaatgatgtattaaaaactcaagtgtaatacacccgttctacaacggcaacgggaggactgctcggcttctaatgaatttcgttctgatgcgccgttcattgcaaccgatcttcttaccagtaatgcaaagcggcggtgtctgcgccacaagcttggcccatcaaccgactgacgttcgcagcagccggaggagagaatctggctgttgaagaatgtaagtgatgttctcataggggagcaagcaggtcgtggcccgacccagaaaaataatttaaaatttcaaaaacaatgcccattaactggacaagtatcagttttttcccaacgaatttcgcataaaatgaccaaatttcgctattttgatcaatttttaaaataaattagggtcacggcactgcctgggaaatttaatagattttcctcgattttaatagattattaccaaaaaatttggtacttttgtgaggttggtcttggaggggcaaatcaacaaggaaacccgaaaattttcaacaaaaatactattttcccttaaaaatttcgggtgcggtcttcctccctggggtatatttgattgttttactactgtgaccgtatcataataatgtttattttgtgtgttgcagatgaacctttgacgcccaccctggaaggcattgtcatccttcgtgaattggccaaaaaaagcggcggcggcgccagcgttggcccatcaaccgactgaccgaacacagcagccggcggaggggactgataaattaaaaattgttttttttttgtcaatcgcgtgtttattttgaaaaagttttgtgctgttataaaaatggaaacacatggatggggcggggctggtggtgggtgggtgggtggtcattattgtctaattaacattgcttttcgagctcctcggaaattttcggtctcgaatagcgctacgaatttgctcgtatgattgggtaaaactgcaattaattgcgatcccgccaataaaaaaagtgcgctctgatcttaaattttatttgaaattatcaaataaaaatgatggaaattttgattagtgacgcacaaaaaaattttattataggcaaataaaaaagaaattttattctttgttttttcaaataatttttcgtgaattttcttacgaacaattaaatattttccgtattttcgacatgtgtgagtccgaaattgacttttataacgtttagtgataaagcggtctcctattaaaaaaagataggccacctgaacactttttggaccattcattagcaatttttaaagatatatgaaaaattgcatttttggaaattgattttaaaaaatttaaaaaatccataaacagttcaagtattcaagtacccgctatgacagaacttattcctctcccaaatattatgctatatttaattaatattttattaatttatttatgcctttttcgtcgaattaaatccaatacaattcaaaattcaagtttcgaatgtcggtaataaaaaatgattgtgagcaggaccgaatttcatttcacaatatgaattaggtaaggagcagggctgggcgaaacttcgagcttcgaaaacttcgcggtttttgggcttcgaacttcgagcttcggcttcgggtaatttacccgaagtttcgggaaaaatacacccctaacaatcgggttttcaaaagtaaagtgcacccataatgattggcttatgctaaactaaatttaaatctcattattagtcttttgttttggattagtcattacatgggtggtccagtgtgttgtgctcttggatccgttcttgatttttgcgttggatcagttcccctcaaagtaattgttttcttctcatttttcaaaattagtgttttttagatgggaattcaatcacaattttaacaattaaaatcataaaatatgtcctttttgaactttttttgttcacaaagtgcactaaaaagttcaacattttccctggcgtcgcctattggcaccgccgacacccaaaactactatttttctttaaaaaaattggctttaaacaacaaaaaattttggacatttttggacctaatctgttaaaaaaattgcactcaactttaaaaaattttcccggcggcgcctatcggcaccgccagacctctgtcccgaaatatgtaagaaaattttttggaaaaggtcccggtctcgactcgataaaagtctcgtgttttttgggtctctgtctcgagtctcgggaaattttcgatctcgaacagcactagtaaatataaattttttaaatataggttgaaaatttgcctttttcacccggagacgcctacccagcccccaatttatcctaaaaataggcttaaagtcgcattctttacattttttgcttaaaatttgttacaagattacgctcaaatttcaaaattttccccgatagcacatatcgtcacctccctaccaaatgcgtttttgagctcctttcttcaatacaattgagcaaaaaaaaaaaataggttttcactagaaatctcgaccctagaaatgactaattttcgttgtatcaaaatcaaaaaaggaaaaatttatctggaaagcctcaattattaatctttttaatttatagaaagctttaattaatttttagtgcatacgaaaaatttgtgaaaaaaaattttgtgttagggtaaaataattttttcaaaaacttcgagcttcgtgcttcgaaaacttcgcggtttttgggcttcgaacttcgaacttcgtgcttagaaaaaaattgggcttcgccttcggcttcggcttcagtgctaagccgagcttcgcccaaccctggtaaggagagaagggtttggaaaagaatttaaaataaattttaaggaccaattcttaagaaattattttaaagaaaataggaattatttataatttcttactatgtatataacattaacatcgatcgaaatttataaaaatatttacaaaaaatatttggcaggaaattcaaatgatgtttttaagctcatttgtccaacctggcaaaacatgaataggtatgatgattgacatttttagacagatataaattgtcatttatttaattttatttgccaaaacaagtgcaacttattatatatttattaaattctctttaaaatctttaaaatgaaaataatttctattctcatcaattttattctggctatctatgaagcaaaaggtggaggaattgtttctttactatcaagaagacaagcaccaaagcgtcgtatgcatttatttgataaaattaaaataattctaaaatatgaaacaataaaatttcattgtaattagacaaaagggtgtttggcctatttggcagcagaatcaaatagtgccctagttataatcttgttgaagtctgattatcgcatagagcggcttatacagtcatggtcatatgtttaacaacactcaaaattttctaccaaatttgatttaaattgattataaaatctcaatatgactatattgtgtatatatgttttatatttcttatagcattttttgtgggctttataatgataccattcactatcccctgacaagaatgtgtacattacttacaaaccatttt

SEQ ID NO: 80 - DNA, 1323 bp, Heterodera glycines
aaatgttattattagttacaaaccgttttttgctacaagaaatataaaacatatatacacaatatagtcatattgagattttataatcaatttaaatcaaatttggtagaaaattttgagtgttgttaaacatatgactagggctataaattgtatgcttttgcatattttttctgcgcacatgctatgaagaaaggggctcaaaaatagcatttctacgttaaaattttttgatttggaggaggtttttggtgcatataaaagcatattttgggggttttcgacaataaatgcatatttcgccatttttgcgtttttatagaatattttggcaattttttgtaaattttcataagaaaaatgtaaaaaaggcgaaaaatacacccctaaggatcgacttttttggaaatagaaaaaatacacccttgaaaaccgaaaaatttgaactttttgtaagaacttttgaaaaaaaaatttgatgcaaaagacaaaaaaaaaagtaattttgttttagcataaaataaaaattcagcaaaaaaattcaaaaatgcatatataaattttgaaattcaaaatttttacaattgcctaaaaaagttcattagccacggtgggggtcggtttagtctggccggtttagtctggccgttttagtctggccggtttagtcagagggtcggtttagtctggcaagctgtttttgtactacattgatccaattctgatttgtttctcgaaaattatttaaaattaacaccataacagatttatcaatgtgttaacaacaaaaaaataacaaaacattgaaaatattacgggcgcatctcataattccgagaaataccaaggagaaaattgatgatgttataggggttaacattgataagggcatggtaattgtgatcattttggtgagcctggttattgttgatggcattgtagctctgcaagagtcgaagaattctcgcatcggcggcacgatatttgggcgccttttgaggagggagttcaccagcgatgcatcgggcgatgcctgcatcaattgatttttgctcacatcgaattgtgttgatgatccaacgtccgttgatgcacactccattcatccggtgcgaaccgaggcgctgtcaaaccaccattgaaccgcggccttccggtgtaattgtccgtgaacctttaaaaaatattgttgattttccattcctaaaaattcaccaatcgaagacgccaataagctgttgagggagttgtgcctccaaagcattgaggccagcaggaagatggtggacaggaagaaaagccaaagatgtgatcattttgctc

SEQ ID NO: 81 - DNA, 2425 bp, Heterodera glycines
aacgcaattacagccaaatcgagaaagaggctttggcactcgtttttgcagtgcaaaaatttcacaaaatggtgtttggcagaaaattcactctgctcaccgatcacaaaccgctgctggccatctttggttccaagaagggcataccgatttatgccgcgagccgactgcaaagatgggccttaattttgtcaaattacgagttcgacatcaaatatgtcaacacagcagcatttggacaagccgacgtcctttcccggctaattgcaaattacccaaggccagaagaagacattttgattgcaaacatttgcacagaaacggaatgcttcatcaacagtgtattccaagtccaaattgatcaattgccattgacagcggctgagattgcggatgcaacagccaaagacgaaattctctcagaaatttcgagactgtcaaagaatggttggccaaacaaatgcaacgacccaaacatcgctccattctttccgaaacgagacgaaatcgtggaagtggaaggttgtttgctgtaccaacagcgcgtcatcatcccaggaattttacgggatcgagcattgaaggctttacatttgtcacatccaggaattgtgcgaatgaaagcgctcggacgccgtcacatttattggccaggattggattcggaaattgagaaaaccgtcaaatcctgtgaagaatgccaaaacgcacagaaaaatccgacaaaaagcacacttgctccatggacgccaacaagcaaagtcttcgaaagagttcacattgattttgctggtccatgcgacgacggatttatgtattttattatggtggactcctactcaaaatggcccgaagtctgccaaatgaagagcataaattctcaggccacggttggtttcctccgatcgatcatttacagactgggagtcccggaagaaattgtgtcagacaatggaacacaatttcattccgccgattttgccaaattttgcacagaattcggcatcaaacacactttcaccccgccataccatccacaatcgaacggacaggcagaaagattcgtcgacacgttcaagcgtgcaatgaagaagtcttcgaaaaacgacaaagattgggccgagaaagcgctcctttcttatcggacgactcccaacgcgacatcgaacggctactcacctgatcagttattctttggacggaagctccgtaccaaaatgtcgcttgttcacctgaggggagagccaattgagcatattgatcatgaactgatcagacaggcgaaaaaggaatatgcttcaaaaatgtctaatcaatttgacaagaagcacggagcaaaacgcactgattttggtccgggtgaccccgttttactcctcaattacaggaacaacaaatcccactggctgcagggcacaattttggaaagggttaaaaattccccaacttttcgagtcgaagtaccgatcttgggaggaagaattgtccaccggcacacaaatcagctgcgccgacgtttcatcttcgaagatgaacaaaaagtgatcggaatcaaccgattcacattgatcgtggacaaaatgatgagcaacagcaacaacccgagcagccagctgatgatgttccccaattggcagtgcgcagatcagaacggatcgtcaagccgcggcaattttactcgcccagcccgatcaagaagcgccgccgccactgatcaggagtgattagaatttaagaagggaggtgttagagatagtgaccattgacatttgtgatctctgaccctttgtttgtcccttcttccctcccccatttctgtctatttaatgttgactcccttccccacatttggacttccttcattcattctccaattttattgtggcataaagccaatcgatattcgcctctctccgtcaccaatttattattttattttcttcaataaactttattgcttatatttgttgtcgttcctttgggtaaggacacaacagtttcattagtattttataattttgttagaaattttaaaagtgatataccaataatttagaaaataagcaatgacaggcagattattaaggcaaaaaaattaatttatattatttattaattttgcgtataggaattaaaaaaatttataggaatggataaatataaaaatttcattaagataatattcattataattaattaataattaccaatcaacaataataaattaaaaatttcataaatttgattaattgcttaagttataaagcagtgaatattttattttttgtcatggtcatgcaaatatatttataaacattcttaatagtttatattatttttgttttatttatacttttcatctctttttttctgtcatttatattttaatgtttattttattataattgaacagttcggtaaaaga

SEQ ID NO: 82 - DNA, 6128 bp, Heterodera glycines
gggggggggggcgccgaattttgaagccaaaccaaacaatgtggggcgtggcaaatcgatggatggataatgaagcaggttagtgccatgccgtggatgaatgaatggccatgcaatgccaaaattgggcggggaaaggcgaatttgtggccaaattaaaatgtggggctgtggcaaaatcgatggatgataatgtgatcgctacagtgaggcagactagtgccattgtgttaaatgggaaataatctggctcttttatactccactcactcaaatttttgcgtcaaaggtactcactcggccgcttcgcggcctcgcactcttcttttggcattttcttatggcataacagttcttccttgtttcttgactttttcttacgcacaacatttttcttctatacaaatttttcaaacaaattctcattcattcatttaaaatttcattactatatacgttatattgacaaggagtttcgtttcaaaaactaatttgagcttaacggctaatgggacgggtctgaaagtagtggaagggtcttacaactttttgaggagaatccgggaaaactatagaaaaaaattcagcgcggacgactgagtcccggggaccgatttctcactttttcttgcgtttgacggcccataactttttttctgaaaatcggatcaaaaaattcccgctgtgagggccctaagtgaaaatgttgcctaaaagttaaaaaaaattctaggcctctagctctaaccccctgggctgggtgcttctagaacttttcagtaccaactttgtccagttcagtccccgttgaataactcattaggctttgacctgagcgcagggtggccagcagacttattgtagagctttaaaagcccgatttttccaaattttaaaatttcgaaaattttcaaaatttttcgagctaggcctaaaaatcggttttcgggtttttgaattttaggattttttaacgatttttcccagagaaacgaagaccacttccaaaacatagtttttcgagctctatcgattggtaatttttttggaaaaatttcgattttttcccggaaatagaaaaaatttttggcctcagcgggacatttgagtcctgggcccataactcgtcaggggttgattttagcgaaaaattgtcttagaacatttttgtagagcattttaaatgctatcgaatggtgtactacatgatgtaaaattttcggaaattttcgagctaggccccctagaaattttcggaaattttttttcggacgaaaatgggggtgaaaaatatttttctggggtaaaataaggtgctgagtacgaatatgatgtctattttaagtttcataatttttggaattttttaaaaattctttattttttggcaattttttggcccttggaaatttgggctaatattggaaaattcatatctagcctaagggttgactaattttgagcaaataaagctttaaaaatagagaaaaatcaggagaattttatgggatttatttaggttttctaacatcaacatgaaaaaagttattccagaaattctggaaattttagatttttcagaaaaaaattcgtaactgccttctgaaaagctatttgagaaaagtaaaatactacaaaaatccgcaatttttttctctataatataaattttattttacatttttatcacatttttaaaaaaagatataaaaataaaagtgattttgtgattcgggtccaaaggggtgagcataggatttttgagttgaaaaattttttcaccaaaaatcttcaaaaaatatgtctttaggggttatttgggccgctgatcacgaatacgtgataagattttacttttaacatagtcaagacctcagaatccctgtgtgattggggattctgagacatcattttgaggggggggggaagttcgaatccgggcggtgtacattattttctatgcatttttgggttattttgactgtttttaattaatttgaagatttcttttaaattatttaaatttattttttttaaattaaagaatttcattatttatttttgaatttgaaaaaaaattaatttaatttcaaattaaataaatattcaattaataaaattttttttttgataaataaattttataagtataattaattatttttttaattgatagaatttcatgtattttttaaattaaatttgttaaaaaatattttcattttaatttaatgaatttactaatcactgttgtaccacttttaaatttttctatttatttttgtgttatttttcagtgcgtttaatttatcacttttgtacctcttttaatcactgttgtacctattttaatcacttttgtacctcttttaatcactgttgtacctcttctgatcacttttgtacctcttttaatcactgttgtacctcttctgatcacttttgtacctcttttaatcactgttgtacctcttctaatcacttttttacctcttttaatcactgttgtacctcttctaatcactgttgtacctcttctgattgttttgaataaaaaaaataaaattttctcttcaatttccttactattttctcttctctgactcgttgctgctaccatttttagcggcgggcagagaagagaaaaatagtaaggaaatttgagagaaaaacttctctcaatttaacttgatatttccaaattgggtttaaaagcggaaattatcgcatcgattttttccataatgttccttttttcatttatttttattctcaatcgagccaattttttttaatactttattttcattcaaatttagaattttgcctgccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcagtaaatttttttaaatttaaaaatgttacaaatttatttttaaaataagtccgaatctttttcggactattttataaaattattatattcaccagcctttccatatttacagttttcaactcttcctcaaattggcactgtttcggcccgtttcgaagcgctggtggacaaacattttgatgacaggacgattttttttataattccggcaagtttttttttttttttgtttttttctgttcttttttgtttttgtttttgggttatggtcccaaaagccttaacagccccaaattttcaaaattcttaataaaataaaaattttggaaattcaagaaaatttatttgtaaaagtgaatagttttttatgtgtttttttgaaggattttatgcgtaaaatatttaatggcctccaagtaggcaagttttattgttttttttttgtgtgtaaaaatgagaatgtttcaattttgtaaattatttttttaggatttttttccaaaaaacgaacttcaattttcagaatatcaaagtggtggacattctaccctttttgaccgtccatatcttaagagaacattttttcttaaaattaaaaatcttttttttggaaattttacatttttaatttaattttttggccctttttattcattaaaaaatctttttttttggaaattttacatttttaatttaattttttggccctttttattcaattaagcctaaaaatgcattttctatgaacaaatttacatatttaactaacattttttcaaaatttcagctgggtttgcatggtgtttggatggacattctccccttttgaccgtcctcaactcggcctcaaattggcattgctttctccccgtttcaatgctccagtggacaaacatttcaacggctgaaggcgtaagtttcagtttcaaattggccatgaaaatttttctaatctctacttttgtttggattcggtatttaaaaaatttaatttgaaaattttttttgagaaattttttcgatttatgacctcagaatccctgtgtgatttgtacctcttctaatcactgttgtacctcttctgatcactgttgtagctttttttcccattttttaaataactagagcgcaaaaaaaacctttttttcagcgacgaatatcgattatattttattattcattttctcagtatacattttgttattgattcccccccccccctcccttttgttaaataattaaaaacaccaaacttccaatgcttattaagtttttcctttgtatacaattttaatctatatttcaaacattttaaataattctctctttatttttttgttttttttcagctggttttttgcaacactttggatgggcatttctgaccatcttcaactcggcccaaattggcattgctttcgccccgtttcaatgctctggtggacaaacatttcaatggcaaagcggattgctggcaagtttcaatttttctcaaagtaaccggtcaaatgtttaataagctttaaaattgtgattgcattcggcagttcaaaaattgaaaaaaggaaaaaattttctttgttgaaaaaacttattttaaaaaatttatacttcaaccatatgaaatagccggtcaaatgttttctgagctcaaaatttttgattgcattcggcaattcataattgaaaacggaaaaaattttctttgttgaaaaaatcttaaaaattgtaattttcaagcctatgaaaatcaattattgtaactttttgaaaaaccaaattcgctcaacattgtgggcttatatcaattgcatcccgtaaataatttgtgaaataaaaaaatgttctcaagcaattgctatgtttggccggttaaagtcttaaaactgaattgatttgatcatgaattgaatacaagaaaacattttcagatgcacatatatacaaaaatcatgacaaggtgtaccactaagcaaatagttttactaacccaaatctgaggttagatagaaaataagtttcgtacactttggcacgtataagcccctatgaatttaagaaatctttacaattgacttaaacttaatatgtacttacttattttttaaatattagaaaagtcaatcaagtcaattgtaaagatttctgtccttatgtccattttgagactcacatttttatttgttttcaaatcttatcggtctgctttgcgaccatgatgagatttgtgcacgtgccggtctgctttgcgaccatggcaacatatcggtctgcttagcgaccatgatatgtagtgcacacgccggtctgctttgcgaccatggcgaggctggtctgctttgcgaccatagccaaccgtgtcggtctgctttgcgaccatgacacagtgccggtctgctttgcgaccagggcacccatatcggtctgctttgcgaccatgatatggaaataacgcccagacttgcactggcctttgccatgcatgtggctgggccgcctaatgggaacgccattttctggccttgtatcccagctaactgtttgtaaaagaggattgtcctttgattaattagcagtgctaattgttcgaagttccctttttccaaacagaaggttggctacggtgggattgtcctctgttcatcagcaacgcgtctgttgttcggagttccctgcccctggacatttaggaattggcgcaaacaaagggcaataaaattggttcgcagacagatcatttgggtctatgtagccgctgcttgggtatgtgacattcccgtaggtgtttacgtcgtacctatatggtagtctggcacgctcttccgttttttgcagagcaaatgtggttatttgtcacgccattagggcctttgtcatagctttcttttcggtgacttgctcttcggtacactgtcagagtcttttgactttcttgtgggaggtgtgtgagtggttacagggaaatggggttagtgaataagttgattcgtaagacaaggattgataataatgataaaaaaaagatgtgcgttggaatatgtttgatttaatagtgctttatcgaattcttttgctttatatttggctccgtccacgtcccaaatcattgtgaatgcatatgagaagtaaaaaactagcatacagtttttacgtgga

SEQ ID NO: 83 - DNA, 1472 bp, Heterodera glycines
  misc_feature (1451)..(1451): n is a, c, g, or t
atttaactaacattttttcaaatttcagctgggtttgccttgagtttggatggacattctccccttttgaccgtcctccactcggcctcaaattggcattgctttcgccccgtttcaatgctccagtggacaaacatttcaacggctgaaggcgtaagtttcagtttcaaattggccatgaaaatttttttgagaaattttttcgatttatgacctcagaatccctgtgtgatttgtacctcttctaatcactggtgtacctcttctgatcactgttgtagctttttccccattttttaaataactagagcgcaaaaaaaaacctttttcttcagcgacgaatatcgattatattttattattcatttctcagtataaattttgttattgattccccccctcccttttgttaaataattaaaaacaccaaactaccaatgcttattaagtttttcctttgtatacaattttaatctatatttcaaacattttagataattctctctttatttttttgttttatttcagctggttttttgcaacactttgtatgggcatttctgaccatcttcaactcggcccaaattggcattgctttcgccccgtttcaatgctctggtggacaaacatttcaatggcaaaccggattgctggcaagtttcaatttttctcaaagtaaccggtcaaatgtttaataagctctaaaattgtgattgcattcggcagttcaaaaattgaaaaaaggaaaaaattttctttgttgaaaaaatcttaaaaattgtaattttcaagcatatgaaaatcaattattgtaactttttgaaaaaccaaaatcgctcaacattgtgggcttataccaattccatcccgtaaataatttgtgaaataaaaaatgttctgaagcaattgctatgtttggccggtttaaatctttaaaattcatcgatttgaccatgaaatgaataaaataagaaaaaatttttagatgctcatatatacaaaaattatggcaaggtgtacactaagccaatagttttactaacccaaatctgaggttagttaggaattaagtttcgtacactttgtcacgcataagctccaaaatagaattaagaagtctttacacttgacagaaaaaaaatgttcttaaatttttaaaaatattattcagtcaattgtaaagatttctgtccttatgacccttttgagactcacatttttatttgttttcaaatcttatcggtctgctttgcgaccatgatgagatttgtgcacgtgccggtctgctttgcgaccatggcaacatatcggtcagcttagcgaccatgatatgtagtgcacacgccggtctgctttgcgaccatggcgaggctggtctgctttgcgacatagccaaccgtgtcggtctgctttgcgaccatgacacagtgcccgtctgctttgcgaccagngcacccatatcggtctgcttt

SEQ ID NO: 84 - DNA, 1642 bp, Heterodera glycines
  misc_feature (1504)..(1504): n is a, c, g, or t
  misc_feature (1544)..(1544): n is a, c, g, or t
  misc_feature (1577)..(1577): n is a, c, g, or t
tggttcgcagacaggcccttcggggccatgtcgcaccaatgtggttcgcagacaggcccctcggggcatgtgtcgcaccaatgcggttcgctgacaggcccttcggggcacgtgtcgcaccaatacggttcgctgactggcccctcggggcacgtgtcgcaccaatacggttcgctgacaggcccttcggggcattgtcgcaccaatgtggttcgcagacaggcccttcggggcacgtgtcgcactaatacggttcgctgactggcccctcggggcacgtgtcgcaccaatacggttcgctgactggccctcggggcatgtgtcgcaccaaaaatggtcgctgaacctaccccttcggggattgtggttcgcaccaaataatggtcgctggacctaccccttcgggggattgtggttcgcaccaaaaatagtgactggtcctgcccttttgggttatggaccggacatttttgcatctgcattcttaatgggatgtgtgagccctgactgatggatttcagcacaggacgactacactccacagcgaagaatgatgtctttgacatttatttgtgcattttttgttaataataaatttttaacatatgtgtgcatttattagttaattacctcatatttttgccacatttgcaacactttctgatttgttgtttcagatgccttcaaaacaaaagaatttgagaaagaagatgcaagatgtgtatcggcgacaggcagagcgatctgtcagtcgggataactcacccgtctcagacgggagtgcagatgggaatggagaggcatcggcgtctctccggggcaccagcaccccaagcttaagtgctttgcaaataagcacaccggcttcttccattggaagtaaaaagaggggaagacccttgagagccggagcgaagccaatcttggctactcaagaaagggtgtctctcattgacacacctcgaactgcggtcactcaaagtgaccagggttcgccgtgcaaaaaaaggggaaaggtcgccgagtgtggtcaacccatgtttgccaatgaagctattgctttgacgcctgtttcgactcaaagtcgtggagggcgtcctgccaaaaaaattagaggcccaggccgaggcagactcactgattccatgagcaaaagctctgaaatggatatcaatcttgaaaatgccccaattccggcaaccttgcacattgtgtctgaaaaaattgacttcagcactgtgccaattaatttcgccacatcgcgaaattttgcctgtaaaatttggagatgggcagcaattggcctttacgagcgtgatggcgaaacagcatttggcccacgctctggcccaagattcattgagacctgttggaacaggccaaatgaatggctaaatgacagctttattgttgcctatttagcttacattgcaagcatttcacaacgaaaaacagtagttggtggattctttggcatcgagaactgatgtttctcgattttccnacgtgaagaattacactttcggctatgattccgatgcggntcccctgaagttgtgcttatgccgcttcacttncccaatcattggactccactcggtctacgatggtgcacatggtgcatacttccttgactcgctgc

SEQ ID NO: 85 - DNA, 6190 bp, Heterodera glycines
  misc_feature (8)..(8): n is a, c, g, or t
  misc_feature (51)..(51): n is a, c, g, or t
  misc_feature (53)..(53): n is a, c, g, or t
  misc_feature (96)..(96): n is a, c, g, or t
ctgactgnccctgggggcatgtgtcgcatcaaaacggttcgctgtgactgncncctcggaggcatgtgtcgcaccaatgcggttcgctgactggcncctcgaggcatgtgtcgcaccaatacggttcgctgactggccctcggggcatgtgtcgcaccaatacggttcgctgactggcccctcgaggcatgtgtcgcaccaatacggttcgctgactggcccctcggggcctgtgtcgcaccaatacggttcgctgactggcccctcggggcctgtgtcgcaccaatacggttcgctgactggccctcggggcatgtgtcgcaccaatacggttcgctgactggcccctcgaggcgtgtgtcgcaccaatacggttcgctgactggcccctcggggccatgtgtcgcaccaatatggttcgctgactgacccttcgggtttatgtcgcaccaatgtggtttgcagactggcactccgaggcatttgtcgcaccaatacggtttgctgactggcccctcggggcatgtgtcgcaccaatatggttcgctgactgacccttcgggtttatgtcgcaccaatgtggtttgcagactggcactccgaggcatttgtcgcaccaatgaggttcgctgacaggcccttcggggcatttgtcgcaccaaaaatggttgctggatctaccccttcggggggattgtggttcgcaccaaaaatggtcgctggacctaccccttcgggggattgtggttcgcaccaaataatggttgctggacctacccctttgggggattgtggttcgcaccaaaaatagtggctggtcctgcccttttgggttatggaccggacatttttgcatctgcattcttaatgggatgtgtgagccctgactgatggatttcagcacaggacgactacactccacagcgaagaatgatgtctttgacctttatttgtgcattttttgttaataaatttttaacatatgtgtgcatttattggttaattacctcatatttttgccgcatttgtaatacttttctgatttgttgttttagatgccttctaaacaacgcaatttgaaaaagaagaagcaagatgtgtatcggcgacaggcagagcgatctgtcagtcgggataactcacccgtctcagacgggagtgcagatgggaatggagaggcatcggcgtctctccggggcaccagcaccccaagcttaagtgctttgcaaataagcacaccggcttcttccattggaagtaaaaagaggggaagacccttgagagccggagcgaagccaatcttggctactcaagaaagggtgtctctcattgacacacctcgaactgcggtcactcaaagtgaccagggttcgccgtgcaaaaaaaggggaaaggtcgccgagtgtggccaacccatgtttgccaatgaagctattgctttgacgcctgtttcgactcaaagtcgtggagggcgtcctgccaaaaaaattagaggcccaggccgaggcagactcactgattccatgagcaaaagctctgaaatggatatcaatcttgaaaatgccccaattccggcaccctcgcacattgtgtctgaaaaaattgacttcagcactgtgccaattaatttcgccacatcgcgaaattttgcctgtaaaatttggagatgggcagcaattggcctttatgagcgtgatggcgaaacagcacttggcccacgctctggcccaagattcattgagacctgttggaacaggccaaatgaatggctaaatgacagctttattgttgcctatttagcttacattgcaagcatttcacaacgaaaaacagtagttgtggattctttggcatcgagaactgatgtttctcgattttccaacgtgaagaattacactttcggctatgatccgaatgctgttcctgaagttgtgcttatgccgcttcacttcccaaatcattggactctcatcgtctacgatgttgcacatggtgcatacttccttgactcgctgcatatgagcagcttgagtgatgagagaatggcactcatccagtcaataattgctgagatagtgcccgggactgcgtcattcgctgttgaatacgtgcagcaattgacaaagcaaaatgatggtaacagctgcgggtacttcgtgtgcctgtatgctgaatcctggctgatgaacaaccgtacatttgttctgccggatttgaacatcaattatgagaagaagcgcattttatggcacataaatgagctttatggctcagatattgtgccgtttcatccaagggaaggtgtttcaacatctttcgctgttgtgtctcatcacaatggggatgtagcgcaaacttcctccaaggacatagtgccaattgaagtggatgattcagcagtacttccttcctcggaagatactgctgttcttgcgcaagcaccagtgatcggcgaaaatcaagctgacacccacggtgttgttgcggacacaattgtccagcaagaaccaatcgcgcaggctgatgatgtaatctttgtcagacctaagacgccaccaaggcgatcactgcgcgtgcaaaaaaggctttcagcttctgttagccgttcgccttcaccggcgccaaaacgacccccgccagcaaattcgctgggaatggcaatgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaacaaatgatccaagtgcatcatcctgctgcgcaggcatataagcaggcgcgtgagcagctcactgagcttctccaacaacaaaatcaggaagagcttcgtttcttccgcatgactttgttggatagccgcagggctccagctggtcttaaagacccaaaattgcacccacaccaaataatcaccccttctacgggtgaagggatgttcgctattcatgcggaccccactggtgctcctccgcccaaaggaatttgggtagagaacaaacaagggcaattaaatgaaattgctcctttcagtccgtggactgatagtcttacgtatccattaatcaagccaatgggcgatgatggatacacaactggcattaaatatgctaagccaccatcgcgtaagcgaaaaggtgctcagaatgcatctggcctatttgactcggaagccgagtcagataatgagtcgtgcgagactcagtcaattgcatcatctgatgcggggtcagtcgcagattcagatgctgaatctgtagcatctgtttcatcgcagcaccggcggattgacaaatccaaacaatttatctccctgcgagattattgcaagtattatctcgcaataagggatgaaaatgtggagttgcaataccaccacattctttcatgtggtggaggacttggtcagcgctggatccttgaccaggctgcaaaaattgattggcaaatagcaacatttttgcgtagacctgacatggatctgcggatcagcactccaaaaaatctgctgcagtatttggtcaaccaatacaacaggcagcaagcacggcaaaaccccaatgcccaacagaaaactgttgatgacattggcagtgttgttcggctttccgaacacaacgtaaattctctccaatattggaagaaaatgtatgaagattgcaacaccgtttttgcacggtgccatgacgcgaagaaagcgcgtctcttcattactttcacgaacaacagggaatggcctgagttcaaagagaatttacacaaaaacggtcaagtatttactgaccgttttgacatgtggatgcgtgtctggagcagcaaaatcgctgagttccgagaagaactttatgacaaaaagttcttcggaacaatccttggttacggtgaatcaatggagttccaaggccgaggaggcccacatgcccacattgtggcgcaaacagacctggacgcagttccatatgtcattcaggaatacatatgggcgcacattccatctttgcctgataaagatgacgacacgcccattgcaaaaatgcatcgcgaaatccgcgaaacaatgcatatgcaactgcacagatgcagtgacagttggtgtggtcctagcgacccaatttacgggcggtgcaagaaggggttcccagccccttactcaaaatgtacgattttgcgcccggacaggcccgcgatgtatttccggccttcaccaactgatggtggtgcccaattagaggtaaacggcttaatatacgacaactcacatgtcgtgccgtataatccttatattctgctacgttaccgagtacaccataatgtactgtttgcatatggtaacaaagcaaatattaaatacgcactcaagtaccctttcaaagggccaggacattgttatgtcgagtgcaaagaagagtccggcaataaaattggaattgatgagccggctcaatatgccaagatgaacttccgtggtgcaacggaagcatatgccattgttcattcaatgccatttgcccgtctttcgcatcatgttgtcaaattggcaattcatttgccaaaccaacagcccattgtatatagggcattccagctggtgagcaaagctcaacaaatccagcaaggcgaactgccagaaacgcagtgttcagcctattggaaacaatggcaaaatgagtggaagaatgatccaaagtttaaggatattcttttcgaaaaagtcccagagcggttccgatgggcaaaggacaaatgggtcctgtacaaaaggcagcaaattaaaaggccacctatcggccgaattgttcctgtacccccatcggacccggaaaggttcgcgctctattcacttatgcgtcactttcctggacacccagaccatcttaagatggttaatgggttactttgtacctcattcactgaggctgcaataatgcatggtcttcttgaagacgacaaaatttgggacaaaactctggcggaggcagctctgtcgcgctggccagatcagatgagatggctctttgtgagcatcctggtctatggccagccgagtaatgccatagaattgtggaacaagtacaaagaccaaatgtacaatccacagggcattatcagtgcggctatacgccaagcacgggagcaggaagcgctagccgacattgattggcgattgcacttctttaactcaagctgcatgcactgtggcctcccagatccaccaaattcaaaagccaaaaatatcaatttggcagttgaagaagctttctttggtgatgatgatcttaatatgccgcctggccagccaaatcctaggcagcagcaaaacgctccacctccactcaacagcgaccagcaaaaggtctttgatgctgttgtgagggctattcaatcggatccgaaggatccgactgtgccacgccgtttctttattttcggcgatggaggtacaggaaaaacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcacaactcatcatcattgatgagatcaccatgcttcacaa

SEQ ID NO: 86 - DNA, 1838 bp, Heterodera glycines
atcttgacctctttcccgttgttgtaactcttctgatcacatttgtacctcttctaatcacttttgtacctcttataacttttcgagttgttatttaaataatagatcttttattcgtttcttcttcggatgaatacgcatttttatgtaaaattaataaaatagaaatattattaaaaaaattatttaaattttttgtctaattttgccaaaatcctttttcgttttcttaatgttgttatgccaatgccgatctttttacaaaattgtttcggttggtgaattgccatttagcgctcaacccaataacgtgccaacgcctggactaagggagggaggagggccatgacgtgcaacgttagggcacttccggtttccattgcattatgcgatgtgtcaactccaattatttgaggaaaccaagtgcatgtcggctgacgcaaagaccctaacagactaaaatcactgttgtacctcttttatcacttaaaacgggcgcgaagcgcccgtcgagcccaacaaaatttgaaaaacgggcgctaaacgcccgtataagcacaacaaaattttaaaaacgggcgcgaagcgcccgtctgaggccgcgaagcggcccaaaaatcccagataatcttttaaaaattccaaatctcttcactatggataggtcccatccccctaaacacttatggggatggatgccatccccctaaacactcttatggggattcacagcctaggtagcgaagctcaagaagcgcgcagcgctttcccaagcgccaccctcgcatgcacacacccgctagtttaaattatttatattcatttctacaaaacatagcattaaataatttacttcagttatagattttcaaatattttatttatttacatagatattcgtatttttagtaaaaaaaaaattaaatatttttatatattaattaaaataagtttatattaatatatctttattatataattatttaacattcttatttttaacagctaattaaaataaattttataaggtataaaaataaaaatattatttcttatttaatcagaatcgatgaaaattgaattttttggataaactctttaaattatttttagaattagataattgaaaataatattgcattacattaatcaatttacttctatcatttatattgtattttttacaaatatttaatttgcaattatggctgcataattttgaatttattcaaattatacattaagttatttatataatatttctatcaaattgtgtttaaaaaactgtgatatatattttattaaaataattgttttcttatatgtttatgataaatattaattattccatacttaattgtcatcctgtagttatttatttatgttttcactttttttaatttatttattttaattaattactaatcttttaaatttactaaaataattttagtttttacttagtttagttccgattccctattaaagataacaaaacattttttgcctaaaataattacaaaaaatttaaaatttttcaataaaaagattttcatttcgcacttatagaaagaaattaacattttccagttactcagatttctcatttgaattcatatgcacgtgaaaaagattaactgtataataaattcgtacaatttggatcaaaaatcaaaatgactttcttgcatataaattgaacatttggcaaatctgcagaaagacagaaaaaagaaataataatgctaataaaaaaattccaatatttatatatttaattaaaaaattgtgaagcattaagttatcaattcataaaatcaattttagaaaagaaagga

SEQ ID NO: 87 - DNA, 6158 bp, Heterodera glycines
tgccaaataaaatttatattatagagaaaaaaattgcgcttccttgtagtattttacttttcccgaatagcttttcagacggcagttacgaatttttttctgaaaattcgaatttttccagaaattctggaataacttttttcgttttttagatagaaattccaaataaagtccataaaattctcctgatttttctctatttttaaggctttattcctgtaaaattgatcaacccttcgatttgttatgaattttcaaatattaggccaaaatcccgaggccaaaaaattgccaaaaaataaagaatttttaaaaaattccaaaaataatgaaacgaaaaacaaacatcagattcgtgctcagcacatcaaaataccccagaaaaatatttttgacccccattttcaacccaaaaaaaattttcgaaaatttctagggggcctagctcgaaaatttttgaaaatttcctgccatatggcacaccattcgatagagcttaaaaagttctacaattttgccctaaggcattttttggctaaaaccgacccctgacgagttatgggcccgggactcaaatgtcccgcttaggccaaaaattttttctatttccggaaaaaaatcgaaaattttctaaaaatgtcaccaatcgatagagctcgaaaaactatgttttggaagtggtctccgttttcccgggaaaaatcgttaaaaaatcataaaattcaaaaacccgaaaaccgttttttaggcctaacttgaaaaattttgaaaattttcgaaattttaaaacttggttggatagcctttcagatactacacatttttgctcagaaacaatttttcggtcaaagcaacccctggcgagttattcgcctggtactgaagtgtacacttttgggtaaaaaaaattagccaaggctacagccttgggcgcccaacgtagggcttaggttttgctggcaaagttgtcggggatagtctgacttaaaatcctaccagcaagagctaagcgatcccggtccaaagaaaaaatttcgtagaagaaaaactgcacgaaaaaatgagaaatccgtccctgggactcagtcgtccgcgctaaatttttttctatagttttcccggattctcctcaaaaagttgtaagacccttccactactttcagggcgctcccggccttcggccgggagattttgttttttgaaacgaaactccttgtcaatgtaacgtatatagtaactagcgggtgcgtgaaccgtcggctatttagctgggaaaaagcgcttcgcgctttgggagcttcgctacctagataagctatgggttgtgaaaagatttggaatttttaaaaaattatcagcgatttttaggccgcttcgcggcctcagacgggcgcttcgcactacgattggtttggggagatatggagggagttcatatttactcttttaacatgtattataatggtgaaaagttccaggaatttgaaaaattattgaaaaaaatctctttctaaaaaaaactaaaaagaaaaaaatttaatcctttcaaagaaaaaaaataacgtccccgtaagatcgtttaggaggatggtatccttctccatgagagtgttcagagggatgggttccatccccattaggccttgtgttagggtctttgcgtcagccgacatgcacttggtttcaccttgacacactgcatttttcaatgcaatggaaaccggaagtgccctaactcgcacgtcatggcccacctgcctccttcagtccagctggcagcacttttttgaatatgtgtccgttttaagtgcagatgagaacggggtgacatcttagtgtgcacgcgctggacctaactcgtttgctttattgcaaattgagcattttcgttgcaacaatattcagcactttgactctgtcttgtgcatcggtctcccttctgggagcgtacactcggacgttgctcccgtccgttgctcttgaaaatgcagtgtacaattgaccgtgggaaaatacatccctttcgaggtcaattccgaccgtgctgattgtttggccttgacctttgagaatggtcatggcgaaggcaggtttgatgggaaactgcaaacgctcatattttaagccgccaggcgttttgtcctcgtagacattgcgtgttctttcgatgaagaacttaacttggccaccaacagcgttgctgttaatgacgcgaccgaccagacgatcgtcgccaagttcttcaagaacgatgcgcgtgccgttgatcaatccttccttatcacttttgtttataaggaggacaacgacgcttccgaccttgagtcgcagacggtggggaggcatcccagagtctgtgcgtcggttcaacgctgccacttcggactcgatttcatcgatgtccagtggccgctcgtcaagaggcttgtccgtggacaaatattctcgcacttgaccaggcacgttcgccatcataatttcgttgatctcatcgcacgtgtcaatgtgaggtgcgaggatcagccgattgagcagttccttgtcatttccaaggagtttttggaagtcgggatagacaaagtctatcaactcttccctgctctttacgagaaactgcggaggaatccagaagtattctccggtctccccgaggcctatttggcggcacatttgcaagtaggcttgctgcccttggcccaacctctggtttattgtcaatttcattgtagtgaattgacaaaacagtggagaggtttgaaagcaggccgtaacttgtgcagttaggccttcgtgaggcacgaccggcagcgactgtttaaagtcaccgctgaatatgaccgtttttcctccgaagaggaggtccttgtgctggggaattgccatttctttgcacactcggtcgatgacctctatcaccgtgttgtgaagcatggtgatctcatcaatgatgatgagttgggcctcacgtatccgtcgagcaaagaagctctccaagggaatgcttgggagtttgtctaatgacacttctctacccagacggaaagtggaatgggctgttttcccataaggcagcaaaatagccgcacacccagtggatgccgtggcaagcactttgtaggtgtatgggggcttgcgcaagcgcttgataatttggccaaacaggaatgtttttcctgtacctccatcgccgaaaatgaagaaacggcgaggcacagtctggtcctttgggtccgactgtattgctctcactacagcatcaaagaccttttgctggtcgctgttgagtggaggtggggtgttttgttgtggcctttgttttggctggccaggcggcatattcagaccatcatcaccatagaaatattcttcaattgccagattgatatttttggcttttgaatttggtggatctgggaggccacaatgcacgcagcttaagttaaagaagtgcaatcgccaatcaatgtcggctaatgcttgctgctcgcgtgcttgacgtatagccgcactggtgatgccctgtgggttgtacatttggtctttgtacttgttccacagttctagggcattgctcggctgcccaaagacgaggatgctcacgaagagccatctcatctggtccggccagcgatgtaaggctgcctcgccgagcgttttgtgccaaatttggtcatcttcaagaagcccgtgctgtaaagcggcctctgtgaaagtgttgtactgctgcccatttaccagttttaagtggtccggatcaccgggaaagtgacgcatcaaagcataaagtgcaaatctttcccggtccgttggagggacaggaacaacacgaccaattgggggcctctttgtaggcttccttttatacaggacccatcggtcttttgcccatcgaaattgctctgggactttttcaaaaagcatgtccttgagcgaaggaacatgctgccattcgttttgccattgcttccaataggcagagcatggcgtctctgggagttcgccgcgctgaatttcctcagctttactcaccagttggaaggccctgtatacaacgggctgctggtttggcaaatgaatggacaactgaacaacgtgatgtgagagttttgcaaattgcattgaatgcacaactgcaaaagcttccgtagcaccacggaagttcattttggcatattgagccggctcatcgataccgattttgctgccggactcctctttgcactcgacataacaatgtccaggccctttgaaagggtatttgagtgcatatttgatgttcgctttgttaccataagcgaataacacattgtggtgtactcggtaacgcagcaaaatgtatggattgtacggcacgacctgtgagttgtcgtatattaagccgttcacctcaattttggcaccaccatcggttgggctaggccggtaatacaacgcgggcctgtccgggtgcagaatcgtacatttcgagtacggggctgggaagccttttttacaccgcccaaagttggggtcacgtggaccgcaccaactatcactgcatctgtgcagttgcatatgcatataatctcgtacttcgcgatgcatttgtgcaattggggagtcatcatctttgtctggcaaaggtggaatatgagcccatatgtattcctggatgacttctgggactacgtccaggtcagtctgggctacaatgtgtgcgtgtgggccaccacgcccttggaactccattgactcgcctgagccaaggattgttccgaagaaactcttttcatagagctcctggtggaaaacagcaattttgctggaccacacacgcatccacatgtcgaaacggtcagtgaacatttgaccatttttgtaaatgttctccttgaactctggccactcacggttattcgtgaatgtgataaagagccgcgccttttttgcgtcatggcaacgcgcaaaaatggtgttgcagtcttcatacatttttttccaatactgaagagaatttacatttctctcagaaaggcgaacaacgctgccaatgtcatcaacactcttttgttgtgcattggggttttgccgagcttgctgcttgttgtattggttcaccaagtactgcagcaaattttttggtgtacttacgcgcaggtccatgtctggacggcgcaaaaaagtggcaatttgccagtcaattttggacgcttggtctaagacccagcgctgtccaagaccaccgccacatgaaagaatgtgatggtattgccactccaaattttcatcccttattgcgagatgatatttgcaataatcgcgcagggagacaaatctttttgatttgtcatagcgactggtcactgactgcgtcgatgtttcagatccggtatcagaaaatgcaattgactcggtctcgcacatgtcatcatcggacattgcttctgtgtcaaacatatcatcagaattatcgcttttccgcttcctttgtgcgggtttagcatatggaattccaaatttgtatccatcgtcgcccttaggcttaattaatggataggtcaagctatcagtccatggactaaacggggcaatttcgttcaactgtccttgcttgttttcaacccatattccttttggtgccggggcaccagtgggatccgcatgaatcgcgaacatcccttcacccgttgagggggtgattatctggtggggatgcaactttgggtctttcataccacccggagcagagcgctcatccagcaaagtcattctgaagaatcggagttcttcagtcctttgttgttttaacaactcttggagctgttcccgagcctgcttgtaagccgacgcagctgggtgattttcttggataacttgttccaaaatttcaagggtcgcctcattaagctgatgaccctgcacaaactcttcatcgtttgtgattttttcaccagtaaaggtgggattttttcgtcgctgctccatggcttcgactggatccagaatgtataactgaccgaagccaggaatctgggttgtgccagcctgcatgctgcttatacggcgatggaattctccattgagaattactgccatcggtccgcctgcaggacttggcttattgccagccgaaacactcgcaaattggagcaaattattgtaccgcgacatattcctaa

SEQ ID NO: 88 - DNA, 9294 bp, Heterodera glycines
ggcgcaaaaaactggcaatttgccaatcaattttgcctgcttggtctaagacccagcgctggccaagaccaccgccacatgacagaatgtggtgatattgccactccaaattttcatcccttattgcgagatggtacttgcagtaatctcgcagagaaatgaattttctcgtcttatcaatgcgatcaatcaatgattcggtcgattcgaccgactcagcatctgatgcagcaattgactcagtctcgcaacagccatcgtcggacattgcatcagtgtcaaacatttgatcgacacattgatcgcttctccgctttttttgtgcgggtttggcatatggaataccaatttgatatccatcatcgcccttaggcttaattaatggataagtcaagctatcagtccatggactgaacggggctatttcgtttaactgcccttgcttgttttcgacccatatcccttttggtgccggggcacctgtgggatccgcgtgtattgcgaacataccttcacccgttgagggggtgattatctggtggggatgcaatttagggtctttcataccacccggagcagagcgctcattcaacaaagtcattctgaaaaaacggagctcttccgtcctttgttgtcttaacaactcttggagctgttctcgagcctgcttgtaagcagatgcagccgggtgattttcttggatcatttgttccaaaatttcaagggtctcatcattaagctgatgaccctgcacaaactctttatcgtttgtgattttctctcccgtgaaggtgggattttttcgtcgctgctccatggcttcgactggatccagaatgtataactgaccgaagccaggaatctgggtcgtgccagcctgcatgctgcttatgcggcgatggaattctccgtttagaattactgccatgggtccgcctgcagggcaaggcttatttcctgccgaaacactcgcaaattggagcaaattgttgtaacgcgacatattccgaacaaactccttcccttggcggggttgtttgtcgcacacgatgagctcttcaagctcttttgggtgcgggttaagctttggcaaaacaacccttccctgtcgacagcaatggctgctgtcctcatgcgggaagagcagtgccccacaatgagcgcactttttttcgccaagtttacctgaatcggagtattccggaaaatgttttgctgctgcggcagcacagcaccaacccttgtggacaaggtagcaacgcttcgtaaatgctgtgactttctcaacagcatttgctgatgagctgcgtctcggtgcgggagaaggagaacggctaatcgaagtggattgccgtctgcctatgcgcgttgatcgcctcggaggcgtcttcggtctgacaaatattgcatcgtcagcctgagcaattggctcttgcggaacacaagactccgaaaccaaaccaagcgtgtcgacttggttttcaccatccacttgggcttgggtgagaatggcattagcagcctgtccacttgtctgtggttcgatgatcattatgtcatttttatcatcaacttccattgactcagcggccttggatgtcgactgcgcttcatccgtatgtcgatagacaattgggcaaggagttggcaccccttcccttggatgatatggcacattatcagagccatacagctcgttaatgtgccacaaaatacgcttcttttcataatttatgaataaacttggtagaacaaatgttcgattgttcataagccaggattcagcatacaggcaaacgaagtacccgcagctatttccatcgtgttgtaccgtgagattttcggcattaagaatcccggtcaacactgtcgacggcaaaatgtcacaaatgatctttttaattttatccgtcagttgcggatccaacctgccatatggggtaggcaaagaatcggcaaaatgagtgccaaattgcacatcatggacaatgagagcccaatgtccagggaaatgtactggcaaaagtataacttctgccggaacattagggtcgtacccaaatgtcatatttttgtaaggcatgactctgtccaggccattgctccataccattgggtcaacaacgaccacttttcgttgtgatatggttgccaagtatgccaagtatgtggcagcaaagccgtcattgagaaactgggtcagatcattccaacaggtctcaatgtatcttgggccagagctcggggcaagcgctgtttcgccatcacgttcgtaaaggccaattgctgcccatttccaaattttacaggcaaaatttcgcgatgtggcaaaattaattgacactgtgctgaagttcatgttttcaggcaaagctggcaaaacgaccaataatgtggtatcttcagagccgtggttcattgaggagccattgctcattgaataatttgtttggcccctgcctgggccgcctctctttttggtcggccgccctccacggcttttttgcctggaaacaggtgttgaagcaattgctccaatagcagacatggatcggtcaacttcgccgaccttccattttttgctgctaggcgacgactcaacattttgagtggccaaagtgacttgtgtatcagcagatgacacactgtgttgcgaagtcataattgactccgctccggcttttgggggtcttccccttcttttacttccaatggaagaagccggtgtgcttaattgcaaagcactaatattgggcgttgtggtgcccgggtgtgatgccaccccattctcatctgcacttccgtcagggacgggtgagcgacctgggctgacagattgctccatctgcctttggtaccgctcttgctccttctttcttttagcgtgttgttttgaaggcatctgaaaacaaaaatgaagcaatgatgtgtacatgcggcaaaatatttggggaaaacaaccaataaaccacattaatcaaatatttatcaaaaacattgaaatgtgaaaaattaaggtgcatcttccttgttttccacagtgatgccgctgcgaatcaaacatgtccaatttcgcacaaaggtcattgagtgcagaaattgatcgctcacacatcccattaagaatgcagataaaaattatgcattttttgccgaatctttcccaagtaggggaaagatcagcatagtgcgaactacaatcctttaagggactggccattgaaccacaatcctcaaaaggcagtccacatttattttgatgaactcagatttcctacgttacttctcaccagtccactggtcttgacaaagtgcgggaccagcttcgcaccggatgttggccagtaacgataaggaattcatggcgccaccattgagcggcccagccacatgcatctctaggcgagagcaagtctgggcttgctttccatatcatggtcgcaaagcagaccgatatgggtgccatggtcgcgaagcagaccggcactgtgtcatggtcgcaaagcagaccgacacggttggctatggtcgcaaagcagaccagcctcgccatggtcgcaaagcagaccggcgtttgcactacatatcatggtcgctaagctgaccgatatgttgccatggtcgctaagcagaccggcacgtgcaaaaatctcatcatggtcgcaaagcagaccgataagattttgaaacaaataaaaaatgtgaatctcaaaatgaataagaggacagaagcctttacaagtgattgttcaaatattttaaaacaaaaatgtttacttaaatattaatcaagagtaaaggcttcttaaatactattgtggagcttatgcgtgccaaagtgtacgaaacttatttcctaagtaacctcagatttgggttactaaaactatttacttagtgtacactttgccataatttaatatatatgtgcatctgaaaattttttcttattttattcaaatcatggtcaaatcgatgaatttgattttaaccggccaaatacagcaatttcctgagagaattgttttaatctcacaaaaagtttgcgggattgaaacagcatcaccgcaacaatgttgagattttcaaaaattcacaataattgattttcatgtttgaagatacaattttgaaaatttcaattttttaattgccgaatgcatccaaaaaattagagcataaaaatatttaaccggttaattcgtgaaaaaaaacttgcgcagcaatccgcttttgccattgaaatgtttgttcaccaacgcatcgaaaccgagcgaaagcattgctaatttaagccaagttgagcaatgccaaaaaagggaaaaactcctaaaatccaaaaaaattttaaaaaatgattaacaaaaacataaaaaaaaatggtacttttaaatgaaaaaaagtaaaaatatatttgtctttctggctttatgggggttttccactaacaaattgctaaattatcttttaaaatgaaaaactttctaaaaattaaagtttctataattacgtgataatttaaaatcaagcaaggtttctgctaattgtaattgatttttttcttaaataatttatgattttgccacagaaacttaaaaattctgcgattttagagaccaattttaaattcataaggttcaattttatgaaaaaaatgaaacttacgacttcaattaagtaaacaaaaaaaaccaatcacttacaaaaaaagcaaaaacaaaagacttaccgaaatttgaaaaaattcgcgtttgtccatcgaaatgtttgtccactaaaacatcgaaacggggcgaaatcagtgccaatttgaggccgagttgaggacggtcaaaaagtgggaaaatgcccatccaaacatcgctgaacaccaactgaaattatgaaaattaataatttagcggaaagggaagcaatagggttggacaaaaatttgttgaccgaaactctgagcaattttacacgaaacaaaaatttttctattaaaaatgcaaaaacatacaaaatttccaaaaaatttttttatgccatgtaattgccaaacaaagaaatttatgactataatggaaaaatataaatgtaaggcccagcttaaaaatcattaaatccaaaaatacgtaacaataagacactaaaaaaacctgacacaaaaaaaaatcaaaaaaaattacgaattttgaattttttttatttttcgggccatttttagaaccgagaaaactttaaatacttaccacatttaagttagtcctttcgatttgtggcccacagtcattttgctttttcatcaaaatatttgtccaccagctaatcgaaacgggcgaaagcagtgccaatttgaggccgagttgagcatggtcaaaaaaaggaaaatttccatccaaacgttgttgcttatgtgctgaaaaagtaacgaaatattttataaaatacaaaaatatgattaacgaaaacccttaaaaagttactatttttacatgaaaaaggtaaataaatctgtctagctggagttggtaaaaatgtatgtgattttctaacataaaaaatcagcaaataagcaaaaaccctaaaaaaaaggttcacttttacaacaaaaaaaaccgaattttgcttttaagcaaaattcgtttgaaattggaggccccttttcgcacaaaatccttaattaaaaaccctaaaaaatcactttttttgccatcaaaatatttgtccactaaaacatcgaaacgggcgaaagcagtgccaattttaaaccgagttgaggacggtcaacagtgggaaaatgtccatccaaacattttggcggttgctgaaaatcttaagaatataaaattacaaaaaaaaagcaaaaacactaaaatagttcacatttacaaaaaaaccgaattttgcttttaggcaaaagtgtttgaaattggaggcttcttttttgcacaaaatcattaaaaaacaacaaaaaccataaaaaacaatcactttttaccatcgaaatgtttgtccaccaaagttcgaaacatggcgaaagaagtgccatattcatttacaaaaataaattaaaatttgccaaatttggaaaatttttatttttagagcaattttgaaatgtaggccccgtttgggcacaaactccttaaaaaatattcaataaccctaaaaaaacttgccgaaatccgttttgccaccgaaatgtttgtccaccagctaatcgaaacggggcgaaatcaatgccaatttgaggccaagttaagcatggtcaaaaaaggcaaaacgtccatcgaaacttcgtggcacacccagctgaaattgtgaaagaatactttagtaaataagtaaatttgcgcttagaaaaatggcttaatttggcaaaagcaaccctgaaaataaatcaaattgcaaaattactcaaaaaatttgattttctcttaatttcaaacaaaaatgttacaatttattaaattgctcaatctatcaaataattttaagcacataaaatctcaatagggtgcttaattgagtaaaaagagcgcaaaaatctaaatttaaaattgcaaatttcccaaaaaaaatttctgatttaaaaaaatattttcgttttttatttacgatgctctgaaacataagccaaatagaaaattcctcaaaaaaatttcactttttttaagtgccaaccaaaaattgtagagcttagaaaatattttaatggtcaatttggaaagaaaataaaacttacgacttaatccactttcgccatcgaaatgtttgtcgaccagcgcatagaaaggggcgaaatcagtgccaatttgagttcgagttgagaacgttccaaaatggggaaaatatccatcagaaatatcgttgcatacaaagctgaaaaaagtgaaaaaaattgcatgaaaaaagccaaaaaatgaatatggatattttaaacaaaaaattttttgcaaaaaaaaagctaagtaaggcattatcagactgtgtttttattacttacacaaacaaagggtaaaaatcaatttttcaatagacgtaaaagttgagtaaatcaataacgcacaccatctcaaacatgagaatttttttaaaaaccctaaaggaaagaaatttcacagcggttttttcaacattaatgctgaattacaagtttttttcaaaaattaaaaaaaaacgctaaaatttttttccagaaattaaaaaaaaattctcaccggcaaatgcttaaattcgtttggctcaagtccaatgtgtttagctgttccagccatgaaattgcacaaaattggcgccaattgcgttctgtgcaccattcgtccgagcccatttgttggcagcaaacgaaagttgttgcaaacggcgcatgccaaaccaacggatgtccacggcacgaaagtcaatcccgacaatgtcgaggcgttggagataggccgatgaggctgtaaaagcaaatgcctatgattaatgaaatctggccataaatttggggaagggtgggagggaaatgcattagtagcaaatttcgttaaaactgtattcaaaaaatgaatgcttatatttagtatgagctgaaataagttctttttctatttttcgccttgcctagtaattttgaaaaattaaagcaagaaaaaatgggtgcaccccaaaatttcgccgccataatttcgccggctgaaatttcgccggccaaaatttcgccgggacataatttcgctgccaaaatttcgccgaagaaattttttttttaatttgaaaaatttcaagaaaaaaatcttagaaaacttttttatatagaaatttcaaggtaaattttagaaaaaaaatttttaacgatttttgggaaaaattttcgaaaaacttataatttaccataaatttcaaaaaaaatcgctgaaaaatttttttcttgaaattttcttataaaaaattctaatatttttttcttaaaaaatttctaaatttaatttttttttaaatttttccgcgaaatttagtccctgcgaaatttcggcggcgaaattatgtcccgtccacgaaaaaataggctttttaaatgctttttcatttcgtaaacaaatactgtaccactattcgaactaaaaaggcaaaaaaaaatttaagctttgcctataatttaaaaaattacaccggaaaagttaagaattgttaatttttttgatcaaaaatggtcaattttttgaattataaacgttaattgagggttattgctagaaaatttcaaaaaatttttaagtcgctatttatacatcgaataaattaaaaaattgcaaaatttatccatttttttaaatttcgtcaaatctgtcggtacctcatttttccatcttcagaaaaattttgttaataaaaggtttgagaattgcaagatttatcccagcactttgaaaagccaagaaaaaatattcatttatttaattagaaaatcggtaatctcagcccaaaaaagcgcaacaaactttgcgtagtttttccaaagctgcgatcagatcggcccattcgttggtcgactcgaacgagttgagcgctttgtccacggcggacgcgtaggcgtagtatttgctgctgttttggtgcgaagagaaagtccgagcagaaaattggtgctggtcgaagcctcggaattatgtgcttaaatattgaaaaattaaattggaaaatagggaaaattggggaggaaaacttaggtcgcccatttcgaagaaagtcgattttgttcctccccaatttacgcattcggtccgtcgttcgtccgaccgacgacgacaaatgggcgacagaaagcgacgaattggcgagaatttagcattcgttggttggtggcgggacggaggaggagtagtgaaggttggggtcaactgaagaagaaagtgcctaattttaaaaaacacaaattttcttcaaacattcatgagaaagttgtttaattcggccttgaaaattccgtcttgcatagctttacgcttcttcgttatcgcttgctggtgtgccattttttagcgtctttaattattaaatcgcaaattgttgagtaaagagaaaaaaatctgcaatattttatggcaaattataaaaatttaattaaaaaggagctaagccaaaattttaatggaaatgcaataataaaaattttctttctgtttgttaaatcaacaccaatttttgcatatcgatagaaaaaaatttgcatcgattaatgctgaattatttttgtctatggtcaaactcaaaagttacataacaaaacataaattatttctttcctctccttttggcgtacta

SEQ ID NO: 89 - DNA, 1106 bp, Heterodera glycines
atcagtacaaagatgattagaacaggtagaaaagtgattagaagaggtgtaacaatgattagaaaggtaaaacagtgattaaaaagggtacaacagtgattagtaaattcattaaattaaaatgaaaatttttttaacaaatttaattaaaaaaataatgaaattctatcaattaaaaaaataactaatttaaacttataaaatttattcatcaaaaaaattaatttaaatataattttttatttattaactcaacaaaatattttaaattaatttaaatcactgtaaataacgtaaaaatgcacagaaaaataatgtacaccgtccggattcgaacctgccccctccccccccccctcagaatccccaatcacacagggattctgagggcttaacgatgtaataattgaaatctgatcacgtattcgtgatcagcggcccaaataaccactaaagacatgtttttggaagatttttgtgaaaaaaaattttcccactcaaaaatcatgtgcacccccctttggtctcgaatctcaaaatcatttttaattttgtaacaattttcaaaaaagtgataaaaatgtaaaataaaattcataaaatcgagcaaaaaattgcggatttttgtagtattttaattttacagaatggcttttcagaactgagttatgcaattttttctgaaaattcgaatttttccagaaattctggaataactttttttcttttgaagatagaaataccagataaatcccataaaattctccttatttttctctatttttaaagctttattgcatgaaattcatcctaaattgaaatgagttacgaagtttcaaaattttacccaaaatcccgagggccaaaaaattgccaaatatttttgaatttttaaaaaattctaaaatttcctaaactgaaaatgaacatcagattcgtgctcagcaccttaaaaatacccagaaaaaaatttttcaccatatttttcaaccaaaaaaaattttccgaaaatttctagggggcctagctcgaaaatttttgaaaatttccggccatataatacactattcgatagcattttaaaagctctacaatttgcactaagg

SEQ ID NO: 90 - DNA, 3286 bp, Heterodera glycines
  misc_feature (1360)..(1360): n is a, c, g, or t
agcagcttttcttaaacaaatttcagaaatcttataaaatttcgttatattattacttcctaattaataaccttttatttaatttaagagttacctaattcaattcgtaaattataatattaaaatctatagtaggtgagttattttaagcctttaattttcactataataaagtggtttatgtttattattgttgaaaatatattgtataatttcaataaatattttaatatataaagctcaggttttaacatcctttttgcaattctaaaaattttttattcttaattttgaatatcttcaaaataagtgatttttttttaatttaattcattattgtcgcttcaactttttgtaattttgggtggaatcaataattcaaattgtctccaaaacttatttaatttttaaattttattttgatatattttattaagcacgttattattttttcatttttattcgtctaaattcaagctgagttttaacatattcgtattttatttccgttttattttaaaattttatttttgtatgaattaaatttcttttagccataatattttagtttattaaatttcgaaatattttgtttttattacaacaacaaaattattcgagatcctaaaccttttcgaactcaaatatttttatgagtgtcttatcactagacaaaaaaaaatttattcttaaaactgagtattgtatattttaaaaattaaataattttagatttatatcgtgctcggaaagcagaccggccgggtgctatcgtcgcaaaccttttctttcaacaaaataactcaagattaatatttagtaattaacatatatataaaattattaaaatttgaatttgatttttttatttgattggatgtgtgaatttattaaattgtctattagtaatttacaacagctttgtttcagctttacgcatatttaatataaatttattatacttatagttttaatatttgctttttactttgaataaggattttcgtctaattttaaaaaaataaattttttgaggtgtattaattatttgtttaagattttatgcccatgcttaaatactatctacgactaataactacaaaattgaaatctcacttcacaatgtatttttgtgtctattaaaattaatgtagctcatatttatttaaaatgtatttgtccacatgccgattcttccgggtttattaatatcatttaaagtccgtgtttgttttttttagtaaaaatataaaaatgtattatgttgtttgtataaattaaaagaaatagtttttttaattctatatttttattttttcggtcttaaataatgcttttaaaattctattttttcaggtcntaaatacggctctttatccttttatttaccctgattaaggctttagatttttaaatattttattcgcagaacagtttctattaagcagcttctatacataattgtaaaaatttgttagtttgttttaaattatctttgatgctatcaaagtacatatatttttatttaattatattgttaaatatttcatttaagcattaagctttaatatttaattgaattgcttttgctgaagcttttctctatattcaaattttattttgtgcctttcaattttttacttttttcatgaattaattttaaaataaatttcttataagctttgaattgactaagaaaaagtcacggatatcataagatagatgtattcaaaccccgaataatattttttcgttttttttaccaacattaaaacatcttgaatctcatcccattgttatggtttctcgagtaatttaaatcaatattttatatttttggtacacagaattataaaaatgtttatttttcttcgaacgtataccaataatattatttctttgaattgttattataaagtaaatagtctttcttattcctcgcggttatatttatgacttattttattataaaaagtgaagttatctaatatttttccttttcatatatatatatatatttttgtttaaaaacttttcatcagtattctccaatttaaaaattttattaatgcaattgtcaatttttttaaatacttttacgttaaatctattataataataactgttttattgctctactgtttattcacttttatttgcttaataatcgtgcaaacgacttattgtttggtatgtggttcgttaacaagcaaatttttatagacttatttttacgttcaatttttggctaattttcaaataattccctttatctattaaaattttttctcattaattagaatctgttttaattaagggtataatttattaaatgcaaaataaaatttttcgacaatttaggtagtttttttttatttaaaactttttttaaattaaacattaagatgttttcaatttggattttaaaaaaactttttttgaattttttttcttgataaaatttttaatctgaatttatttaaaaaaaaatattaaattctataacctgcaaaaaaataaagaacatttattggcaggatacttacatcaataaaagaaataataaaaagaaaattcaaagaatctagataagtaatggaatattaagcacgcaaaatttttgcaaaagttgccaaaaaaatttataaaaaattaagaaaacaattgctaaaatatccaatgtgaactagagggtgctcgagacaagtaatacaaacctaattaatttgatataatttatcttaatcttgaatttaaaaataaaatttaaaatcacaaatttgatggcagagttacaataacaaaataaaagtttatttaaaaaaacatcaaatgggctttagtcaaaaaaccatcaaaagaaaatattttttgatatatctttgctcaaaagcaaccaaatttaaaatattgataaattcgatagccctatgtttgttcaattctcctgaaatgtatcaaaaaaaatcgttaagtttcaaaaaattatgaccaaaaatgttcaaaaaattttattacgttcaaaagcaaattaataaaatttcaatttaaaaatgaaataaagtaaaagtaaaagtaaattaaaaatgataatccaaaaaaaatgattagaactatgtatataatgtataaagttaaacaaataatttagtattaggataaaaaaataccaatggatacaaatttatttgtaataaattataatagaaagtctttcattttaattcacattgtttttcaaagtttgcatcgtagtgtttaagaaaattatcaacctcttacaaat

SEQ ID NO: 91 - DNA, 4057 bp, Heterodera glycines
  misc_feature (3719)..(3719): n is a, c, g, or t
  misc_feature (3785)..(3785): n is a, c, g, or t
  misc_feature (3808)..(3808): n is a, c, g, or t
  misc_feature (3830)..(3830): n is a, c, g, or t
  misc_feature (3839)..(3839): n is a, c, g, or t
  misc_feature (3845)..(3845): n is a, c, g, or t
  misc_feature (3856)..(3857): n is a, c, g, or t
  misc_feature (3868)..(3868): n is a, c, g, or t
  misc_feature (3900)..(3900): n is a, c, g, or t
  misc_feature (3921)..(3922): n is a, c, g, or t
atcgttaaactccaagagaaaaattaaaaaaaaatttatagaatagtaaagtaaatttcataatttatcattaaaaacctaattttaaataaaataaaggaaatttttctaaaaagaactcgttttatatatttaaaatgaaagataaatgcgtagctaatgcaattaaaaatttttgtttttttattaatattaatatttaaagataaagagatttattgaaaaatgaattatttttattttattaaattagctataaaaataagtaaggaaaagtgaaaattaattttcaaactatcagcatgtaaagagcaaaagcaaaattaatgaaacatttccgcgcataaattgagcaccttgtaatttatgatattgatagacaaattggatacgttcgaattgatcatgagatttagtgaatttaaatacaaaaaatgtatcaaaaatttttaagttgaattcaaatttcaaaattatatcaaaaaataaatatttttaaatacattgcaaaaaggaagaaatgaagcataattattcaaataaattaaacaagatagcaaaataaagaaaatattattgagttttggatttatatctgagagaaaaaaaagtttttttaaaatccaaattgaaaacatcttaatgtttaatttaaaaaagttttaaataaaaaaaaactacctaaattgtcgaaaaattttattttgcatttaataaattatacccttaattaaaacagattctaattaatgagaaaaaattttaatagataaagggaattatttgaaaattagccaaaaattgaacgtaaaaataagtctataaaaatttgcttgttaacgaaccacataccaaacaataagtcgtttgcacgattattaagcaaatattcggcaaaaaggttcggctaaattataattatggaatatttttgctttagctacttttttaagtaagttcaatgaaaatccgcattatttttggcccgcataattactcaattaaattctttttcgtaagaaagaagaaattttcgttttgatgacatttatttttttgtataaaattttctaaaggaaatcaattaaaatttattgcaaaatgaggattttacgaaaaaatgtttaagatttgaagaaaaagttcgaacattttgccaaatatacctaatttttcaaaagaccacaaaaacccgcaaatcctcagtttcaaaaaatcctctttgaccctctaaagtgtagccgcaactgtccgtggaacggacacaaaggggagaaatggacgaataatgacgaaaagcaaaaaggagggcgcgcgaccaaagggcggggaaaaattcgagaaaggaaaaggagaaaatggggcgattggaattgaagggcgatgggcacgtgaaagagcgaactgggaagggatgaaaaaatggacgtcacaccgtttccgtgtcgagggaatgcaaaaagaggtcatcgacagtgacggaacgagtgacaaacaagtccgaggcggacgactaaagggaaaaaataatcattttgtgatcatttggcgaattgtgaattcgctcttctcccccccccccccccttcattgcccggacccttcccccattttgtgcccttcccccattttcatgccctgttcactactccctaggcattctcccaatttccatgtattattccccccttttttcccccaatcttttgtgccattcctttgtccccattttccctcttttgccattttctattgtccaaccccaacccccatttcacacattttgttgtaaaagtttggtttaattacccaagtttgagggcataaattggtagcattttttgtgtaatttatggcggcaaattgttggaattgggcgacagatagagatggttattcataaatattaaaaaaataaattgatagcgatcgttattcataaatatttaaaaaataaactatgtctccaattactaaaatgtataactaattgaaaaaataaaaaaaactgaaagcaaagaaaaaaacttcatgaaataataataatttgtgaaaattctaaagtaaatgtgtggcttctgttatgtaaatttaaattcacttcataaacaatgaatggctaaaacatacaccattgaaagaactaatgctttgccgaaaattgaacagtataaatatttgaacgaataaattatcgaattttaaattaatatgcgcagctcaaaatgaagttcttatggcacagaatgcaatataaataattgaattaataaaaaaataaataaatttaaaaactaaaatgtcaaaaaactataacgataaaacagaaaataaattttagataactacatttgaaaaagcataatatataaatttttataaataatatgaaatatttttaatttagtataaagaatgctaaaaaagaaaatataaaagtaatattcacttcattgccattaagaaacgtttttcaagaaagaaagaaatacatgtagatttgcacttgaaaagatttttaaagacttttattgttcaaaagatttttaattgttcaactctttctttatcagctgattttaatgaatgtcagaaattaaaaatttcacaattaagtagactcttttaaatatttctcgcacatataattaatacgaaaaataaaaactgctagtttacattaaactcttgagacgacaatataaattttcgactaaaggtaattatttgtaaacattaaattacgaaaaacaatacatataatagtttatattttaagttcaacaagcaaattttaatattttaaataatctaaacttaaattataataacaaatatttatttgaaaataataattctaaatccacatcaaatatcaagcttattatttaaaagtgcaagcgagagattgtataatttataaaatttcaaaacaatttttaaaattaaagacgaaactggccaaatatttttcctccaaattggcagaatgcaggatgaagtttaaaaatataagaaaatattaaaagaaaaaatgcaattccatgaacaattttgattggagcgactttttagcatataaaaaacatcaaagcgtgggttagcatctattttggcattttaatctgtagtacctattttggcctttttgccgaaatttcatagcaaacgtgcaataaaacaaaaaaaaactcccccaagaatcgacccaaaaattttcaaataaatctctacgaaaaagaaactagcggggttagcgcttcagcgcatcccccgctaggcagtacgattgtcttgtagaattataaatgataaaaccgaaaatggctcggccgcttcgcggcctcgcacgcttctcttggcattttcttatgacacaacatttttaatattctaatggtctttttgtttcttgtcatttcttaaacaacactcagcatctcaatcactgtgagtcaagtttacggcattacaatcactgggactcaattctccggcattccgacactgtgactcaattttacggcattccaatgaccaggactcaattctccggcattacaatcactgggactcaattctccggcattccgacactgtgactcaattttacggcattcaaatgaccaggactcaattctacggcattacaatcactgggactcaattctccggcattccgacactgtgactcaattttacggcattcaaatgaccgngactcaattctccggcattccaatcactggaactcaatccaccagaattccaatcacttttttaangtaattgtttaatggcaggctgncaaatttttccgtaatgatctnggttttctntgattnaaattccactnntcttttacctntaggttttaatcattagtgtatttctcttatntattgtatttagaggttatanngtaaataattggtttcattttaatattttcagtctctatttagaatattaactattaataacgatgataatgctacagctttttttgttgtatttattataataattcacgtttagtacatatactcgaaaaaga

SEQ ID NO: 92 - DNA, 5396 bp, Heterodera glycines
  misc_feature (2737)..(2737): n is a, c, g, or t
ccgaaacgaccctcgcgccgaaacggcggcgccgaaacgatacagactcgccgataggcgccgccgggaaattttttgaaaatgagtataatttgttaagagaattttgtccaaaaattgtcaaattttgtgattttcaagccaattattggtaaaaacaaaaatttggagttttgggaggccggcggtgccgataggcgccgccgaaagtttttcggaattttaggaatttttaattaattttattaagaaaattgtacaaatttaaaaattttcaagagtccccaattccctgagttagtgtcggggggtcgggggataaaaagtcggaggtagggggctcggggtcggggagcaaccctattataaacccccaaaataggtgctaaaaatggaaatgagataaatattttaaaaatcaaaaatgtagtcaagtaaataaataaataaataaattttgaatatgaatttttgataaaattttccatttctcaggggtgtatttttcgtttttattgcatttttgttaataacttttttcaaaatagcagaaaatattttacaaaaaattcttcaaaatgaaaaaaagcacaaaaaagcaataaatttattattattaacaggttatatcgctccaatttgattcggttttttttcggtttttcataaaagtcggtcggttttttcggttttttgattatttaggtcggtcggtttcggtataaaaaccgaaaaaaaccgaaaccgaaaaaaaccgaaaaactcaaaaatttctcggtcggtttttttcggttaaaaaccgaaaccgaaaaccgaaaaatatcgaaaaaaaccgaccggtccgatctctagtgaatacctcccctcccccatcctttccttcgcttcttcatttggccaccactcgccctttctaaatttccctccatccgatagcgctaatcgatccataatgttctacaccaaatcttctccagtaccattacatcacatctataatttcaaaattaactaaaatattccttgtaacaattaaacaaataatttattgcaatttatgatttatataagtttttttttatattgtgatagtcataatattgtttttgcttaaaacgataaattattcataaatttcaaatataaattctcctattaacaatatttttaaaatattcataaaaataataattagtgttttttataaaatcaaatccaattatttcagcttggcaagtaaaaaaaacattaaaaatttaagttattaaacttaataatatagagaatgaccgtggaaagaaaaatatatagtctaaacttaaaaaaatgaaaaattcatcgcaaaatttgagaatagcttttacgaacttgagcacaagaaattttgcgtaaatcgacaaaatattcataaatttagaagtaatgtactaaatcaatatttttattagtctaatttattaacattaaaattaattaaggtttaaatatttgtgtttgtgttttttttataaaattaaatagaattatttcagcttttaataattaaaataaaaattttagcaattatgtatgctgtagaaaaaaagatttgtgctttaaatttttaaaataaatttatttgtaaatgtttttaaattatgaggtttaatttattaaaatatttgaaattgtaaaggttcttgtttaatatattctttcttcattctttacatgatcaaataaactttattatgaaaaaccaaagttgtaaatagttttttacataaagacgagtatcaataattacaaccaagaatttataaaatattattaatagaaaataaaatagtacaccattcgatagagcttcaatagctttacaattttactctcagaggtgattttctattttctattaataaaaatggtttattgcttttttggaaaaaaattaacaaattcttaaaaaatcgaaataaaccgaaaatttttcatcggttctaccgatttcggttttttttttggttttttaaccgaaaccgaccgaccgagaattttttgagttcttcggtttttttcggtttcggtttttttcggtttttaaccgaaaccgaccgactgaccctcttgtccggtctctagtctaaacttaaaaaaataataaaattcatctaagaacttgagcaagagaaatttggtgtaaaaaaattggttcaaataagaattgatgaaaaaaataattattaaatattacttcaaaaatgcattgaaatatgatgataaaagaactatttgaaaaaataaaacagaaggttttaatttatcaaattagataaaataatcaaagtttgacaaaatacaggaatttgacattccttcactaaaacttgaggttgtttcttgagttattataataattaaagttattttttatattattttttcttgctttggatatattaacaaaatataatcgatttcttttttttaatttttaataaatatttttgaatctttaaatacaattgaaaattagaacatgacgaaataatggacaaaaaaaaaatttcgcgccgtgctgtatgcagcgcattaggcttcaaaacctagcatcaataaatttaatacacatttactgaagaaaaaatataaaaaacaaaatcttcttttcacatatcacttaaattttcttataaaactttttaaaaatctaatcgcacaaaaggttatttcaaaacatagttttcgagaagtagcntaaaattaaaattgactaaaataaattatcgtactgtcattcaattaattaatgataaatatattagacataaataatttacctgcgtaatgtgcgtaacaaaagtctaaaaatttttaaacgactaccaaatttaaaaattcaaaaacaataataactctgtctactgtacacaactccggtgtcgaattactttggactgaagacatcaaagcattagggcggtggtattccctcgaagaaaaaaattctgggactgtcatctcgcggtcttggtccccgtctcggacaaaaatcgagttcccggtccagacttttcaggtccggtaatccttcacacaactctaatgtactaattaaattagataattattctttattatttttcatatattataaagatatctttgtttatttatattattttttacatacaattatttttatgttttatttaaaaaataagttcttgcacaaacgcgaactacatctgaatatttgtttaggctgtaattattattttatatatacaataaaatatttgatatttaaaatataataatttatatttattattttataattttggacttttttgaacttaggttattttgtgataattatctacaatatatatttaataaatgatcattttattaaaattttggatttaaaacatttaataaatggttttattttaaatcacatttgatttatttattgttcacttaaattatttatatatttttaaacatttcatattgaattttacttttttatataattaatttttctatgagaatctaaactaggaaattttaaatttcaatttcttcaatatttataaaaatcaaagttattattaactcataatatttggttattattcacatttatagatttaaaataaaaacatcatttaggctcatcatttcgacattgttcatttcgtctgagaaataattttataaaaacaaaaaccttcactgagaaagcataaagattcataaatccaaatttaacaaataatattataatttttaaacttaaatcaaataaatattatatatttttaaattttaatgaaatattattttattttaacattttgtttgcgtttaatgttttctttaaatttttttttattttacataatattgaaaattaaattggaatatgttacaatggagtacggaaagttgcctaggaaattttttgttgtaaattttactaaattttgttaacaaaatttaggtgatttagattttgaaatttaatgaataattctggaaatttaagttgtaaatgttttgttttattatttatttaatacaggaaattagtaaattgtttttaaaataagtttatggaataagtgaatttttattcatttagactaaatcaccttcactctctttataatttttctattattatcttaggttttttctgtgttaaatcttataattttaccgttttcataaaatttacaataatacttaagttttcgcatactcaaatatttttttaaaatgttaatttaatttcagtgacgataaaataaatttacattttttaattaatttttgttcacagcagctagaactatctcatggtctgcgatcttatgctattatcatccatgttttctaagccagtcaattccataacataatagtattgtaactaaaatttattgttagataattttatagaaatatttattttgaaatctttaaaaataataaaatttatattatgcaaaaatcttaatttttacctttagtttgcagtggtacgtttattcgcgcgcgatttattccattaatgtattataaaatcattattttcggtattttcatttcattacttttatttttaatttttgagaaattgtctctctctctctcttttaagtatagcagcaaaaaacaacaacaaaaattagcagttaatgtgagtgacattggccaatacgtttgttctttattgtttattgtcaataaagaaaaagtccacaaaagggaaaaatccgcttacattgaggacaaaacattaatttaaaaaatgtcctcaagaaagcgcaaaacaattaaaaacgagatcgccgccaaaaaataaaatataatatgaaatcaatacaaataaataaatagcaaccaaatcacttttagtttgaatggattaaaaattcgactttaatttttccggtctattttacgggaatagagatagttttaattttatttttaaattgatttaatgagtttatttcaataagctttttatcgagttggttccaaatttttgttacccgccccgcaaaagtataaattttttgcctaatttatatttcgagttaagtctataaaagggaatgttaaagcgttcagaaggtttaagtatttcaaagggattcagatctgttcggccataaattattttatgagccatgaacagatcagacagctttcgcctgctttcaagtgtcggcaattgaaggtattctaatctttgttggtatggaatgggtggaaggctgcatttgaaaagaactcttttggtgaaatatttttgacattttttcaatttttttaatgttttttagaagagatggattccaaacctcaggagcatattccaataacggtctaacata

SEQ ID NO: 93 - DNA, 7174 bp, Heterodera glycines
agaacgcatacgtaaatatgcattctttattatttgtgtgacatgattggaaaattgcaatttattatcaatatttatgcctaaatccctaattgtatccacaacatttattatatttccatcaattttatatatttctttggggtttttattccccaaatgaagtacaaaattttttttaattgagattctgatctgccatttatttgcccattctgataaattatgcaatgctttatgcataatttctgtttcggttcttgctttataacaaatatacaatttaacatcatcagcatataatttaattcttactcctgatggcaaagcatcaggaagatcgttaatataaatcaaaaataataaaggtccaaggacagagccctgggggacgccagagccaacttttttactggatgataaatcatccccaattttaacacgaaaagtcctattactcaaaatgtcctttatccacatcaaaagtttgccccttatacctatttttttttaaataaataattatatatttttaaattttattgcatttttttattttttattgcattgttaaataacataactaaattttttatagtttaattattatgtgaatgctttatgatttatttttaaaagtacaaaagatgctatttgataaaagcatattttttaaataaattatttttgtatttaacaggacggatatactcttttccaaggacaaaggtgtaaatccccttaaattcgagaacatttaaatttgaccataaacaatagaaaatgattaaattttatccaaattgtttatgtttttcgcttgaatcttataggcgtcgccgggaaaaaatacagttttcttgaaatcttaatttttttccgttttacaaaacttttaattttgtttcgaaaaagaatatgccatcatttaattttcttttttaattttaatttaaacttaagtgtataaatgtataataattccgcataaagattgttttattttatatcttactaaatttaattatgcatagttatttatttataggcattgtttatcggatgctagctacaatcgtatagccacttccgagaacgtagaagccaacgttatttagcttttttaaaatttattttcaattagcaaaagtaaatccatttaatttatttaatgtaattgccagaaaagcataatattgcataagccttcactgagaacgcatagaataattacataaattttaacaaataatattgcacttttacacttgcgatcatcagagttttcgaatcgatgtgaaatttcttgaagtaataattaaaaaaaattagcttgcttttgaacaagtgtttctttgaaattgatattaaataaataaatttatcataaattaaaagataattcaatatacttgaatttaaggggtcaatagcagttcgtacaatttgcagttcgtacaataggcagttcgtcaatgggcagttcgtacactggcgtttcgtccaatggcgtttcgtacaatggcgtttcgtacaaggaatttcgtacaatgtttcaattgcggatttcgtgcaaaaaaaaatatttaaagtcgatttattctttaaaactcatttaactacttgtttttattcccatttttgtgaatgtttgaaaattcaacaataaattgtatttcctttcttaaaagcaattatttattcaatggcgcactttgttaagtccaaatgagaccacaagaagcttgtttatcaaggttttgtctatcagcatcatcttacgcacaatgatgcgagctattagttttgcgagctgaagaagacggcgacgaactgtccaggtcgcacaatttaccgaaacggaattgtcactgtttctgccgcacacaaagaacacgcaccgtcagccataaatgtacaggttcaaaaggtacggtcgaatatgcgggcaaataacacgcctgacgctccgcgcacgtggtaaatgaatgcctggcgggtgatagcaatgaagtcattgctaatttgccaaaaatcgcaacattggagcaggcaattagtagaaagcataagaggcagggggtccagctgaacataccgcacacacttgccaatgttttttccccgaagaacttcgctacacccgaacgcatttggcagaaattatgttcttgccgacaccggagcagaagaccaacaaagaattattcttcttggctctgcgacggatgttgaacgcctcacacgatgtgacacttggcttgccgacggaagtttccgctgcgcgccggaaattatttttcaggtttcgagaatattttttcagagaatatatagcaaaaatggttattaagtcggggatgggttggaaaaaccaaggtgttttttgattaggtatacagcattcatggactttatcgcaatcgagttgtgccactaatcattgcacttcttccaaataaaactcgttctacttatgaacgagccatacaatcgctgctggactcgtttattgttcatgctgatccacgacttgatcaatcacgccgccgaccatcgactaccacttgccccctccaccgccaccaccacaattgccgaagagaaagcacgcagatcagcatacttcaaaagagtttttcgaatcagtttcggcagcaacgacgggattagacgttccacctaagcaaacaaagcaagcggaagtggagttgcattttttgaggcggcttctgcagcgaacatgggaatggaaactggtcaacttaagcctaaaccaaaaccgaaacagcaccagcaggcggacgtatcacatttcttttcttccatttctgcagcgacgatgggaatggaaactgatcaacttaagcctaaaccaaaaccgatacagcaccagcaggcggacgcatgatgagacctacataacttaacagaaaacgcaaagcccagcatgctttaaatgataaccgagaagtgaaaaaaagcctctaccccattgccggatgatgatgccgaagattttgaacacacacagcaacccgccacctcgtctcaggtccaacctctcccacctagacctctgttgcctagtaaaaccaaaaaacggaaaagcaacaaggcggaagaagagaatgaaagaaaaagaaccaaaattggctctcgaaagagggacttactggcagaggcagccactgccccattaccggttgatgatgacttggaactctcacaacaagcggtgacctcggctcaggtccacccacctggacctccgttgcctagcaaaaccaaaaagcggaaaagcaacaaagctgaagaagatatcgaaagaaaaagaagcagaattggttcccgaaagagattgtcttcacccactgttaccaaaaatgtaccaaaaagacaaaagaacccggctagtgaagcactctccgaagatcagcggcgtcagtttgcggaggatcaacgccttttcaccattccaaattcgcaactaaccaatgagcaaaagagaaggcggctttagttcgtatttaatcgtaacccaacaatgtacggtgttcacggtgacaccgttttaaacaacgcgggaaacccaataaccgacagtagtgtcgcccaagctctcggctatattattgaacgcagagctggacgaattccacagtttagacagcccccaggaacataattgatcatagatcggattaaccgtgaccttattttgcgaacatggacggctccaccagtaccaccaagggcaccgaaacggagattgccacaagtagagcaaacgccggaattaaaccaaaaatcccaaaagctcagaggaataaggcaggcgagaggcagggtgcaagaaggaatgacacttccgtttccaacgaggggagtcaagcggaagtcgacggcactgggaggctggacctgagacgagtggaaaggggtatataaaatcgaattcattcagtttggtaacattcttgatcaattttcaaaaaaaaatggctattaataatagtgacaaaaagtcattgatggagaatattttgccttctgttgagattagccaaaactcgaacggtatcacagtaagcagtgaacgaattgccgtgccgcgcacgattcagttcgacatccttggcaagtgtcgagagtgtaaggccaccgaatgtgaggcggagtggtgcattaccaaagaaggagtgacaatcccggtttgctgtctccaaacagaactgcctccgctgcatgaatttgttgtggtgaaagcagtttgtacgcggcgcgtacacattctttaggaatgcgacgtgaacacgttggcgtcttattggggtggggggtttacatttataggtaaatgtgggtttaggctaccgtttgcaaaacatcgcacaacggttgaggcgccggggcatcatcgagcgggacaatttggagtgccggaggcgcaaattgatgctgctgctgctggtgttgcagatacggttggaaagtgaactgtagcggaggaagtaccaaaggcattgtgaatggtgggaagacgggcagtggtggcatgcgcatttgcaaagtgctgatcgcctgttggacggcagctgaaagcatcggcgacggttgttggtgctgtgttgccgggacgcaatgtgtcaattgttggtattgctggtgctgctcctcctcgacatgttgctgctgctgctcctcctcgacatgttgctcctgctcctcctcctcctcgacatgttgctgctgctgctcctcctcctcctcctcgtcagagttcccctcgatgcgcactaccacctcctcaatgggcaatggaacccgggggaaaacctggtcctaaatcaaaaatttggctgttgccatgtcatgactcatcattaccaagggtaccctttctgcattgcgtagcccgaacacctcaaagttctcagggtgggcaccaccgacccgtgctatttcgctaaattcctgatgtttatttgctgattttcgccccaatttcctcacatttggcgtgctctcgttatgttgatggcaccggcaacagctgcatgggtatacacagcttccatcagacgagcgagggtatacccaatctataaaatgcatttcaattcttaaatccccgttctcgctaattttacatggctgagaacttcctcatctttgaggtactggtgatcggatgattggtacctaattaggtaccaaaatcgaacaacgccacagacggtgcattgcgccttgtcgtacaagaccaaagacgtcacatcatactcagtggtgccatcgtcctcttctgctcgatcgtcagcgtcctgatccgggtgtcgatgttggcactaataaataaatttgtccattaaaaatgaggtagtcgcgaatggcttctaacttattttgcactcaaaattatcattttttgcctataatccataatttcgcaattaatttagacttattagataaaaattaccccgaccgtcccctaatcacaatttcaccagtttttataacgcattcattaaatccaaattttgccgccgccaaaacatgtcaatggggcgcttaaagtcacttattcttttctgtccaatattcctagcactaatctttgctgatcaccccgaaccaaacaaagaaagataacatctgtatggccattttgacaatgagtcaataggacggaaagaatttcgtttcacccggattataaaacttgactagaagtcattgatggacatcgagtggtgtagtccttttgatataaatttacttggttttccctatttaattttgtgaaattttaattttttatttaaaataaatatgaatttattttgagaaaataaaattatttgtaaatttctttatttatcttaattattttttttaatcatgacattttcgcgttgtcattcattttgttaaggtgaggctgagtttctttttgttaattatctaaattatttttagttttattttccttttatttatggcttttttcttttttaaataatttaatttatttgtgttgtttatattttttctgaaaattaattaaattttgtaaaattttaaagaacaaaattcattttttttctttttttaactggtatgtattaaaaattaataaaataaattgggaccagaagatttatttagcaaatattaattcatttcttattccaattatattaataaattagaaatttattttctttcttcccttttttatataatttatattttatatatttaaagttaaaaatcaaataataaaaaatgaataaaagcaaaaacaagaccaattaagtatgaataaaataaatttaaggaaaatgaaatagttttaattttatttttaaattgatttaatgagtttatttcaataagctttttatcgagttggttccaaatttttgttacccgccccgcaaaagtataaattttttgcctaatttatatttcgagttaagtctataaaagggaatgttaaagcgttcagaaggtttaagtatttcaaagggattcagatctgttcggccataaattattttatgagccatgaacagatcagacagctttcgcctgctttcaagtgtcggcaattgaaggtattctaatctttgttggtatggaatgggtggaaggctgcatttgaaaagaactcttttggtgaaatatttttgacattttttcaatttttttaatgttttttagaagagatggattccaaacctcaggagcatattccaataacggtctaacataagttttgtacaaaataatccaaatcctagaagactttgatttaataacccgaaataaagaacgcatacgtaaatatgcattctttattatttgtgtgacatgattggaaaattgcaatttattatcaatatttatgcctaaatccctaattgtatccacaacatttattatatttccatcaattttatatatttctttggggtttttattccccaaatgaagtacaaaattttttttaattgagattctgatctgccatttatttgcccattctgataaattatgcaatgctttatgcataatttctgtttcggttcttgctttataacaaatatacaatttaacatcatcagcatataatttaattcttactcctgatggcaaagcatca

SEQ ID NO: 94 - DNA, 5732 bp, Heterodera glycines
aagtcaatcggtcaagggggggcgcgagttttgctgcgtaagtcttggggtgcgcgaggggcgggggcgtcgggaatgtaccgctcaaaatggtgctagaggcaaaattctttcaccgttcagtttatggggtggtgggttgactgactgtaaatttgaagtcaatcggacaaggggtgcgcgagtttaactgcgcaagtcttggggtgcgcgaaggggcggggcgtcgggaatgtaccgctcaaaatggtgctagaggcaaaattctttcgccgttcagtttatggggtggtgggttgactgcccgtaaaatttgaagtcaatcggacaaggggtgcgcgagttttgctgcgtaagtcttggggtgcgcgaggggcggggcgtcgggaatctaccgctcaaaatggtgctagaggcaaaattctttcgccgttcagtttatggggtggtgggttgactgcccgtaaaatttgaagtcaatcggacaaggggtgcgcgagtttaactgcgcaagtcttgggggtgcgcgaggggcggggcgtcgggaatgtaccgctcaaaatggtgctagaggcgaaattctttcgccgttcagtttatggggtggtgggttgactgactgtaaaatttgaagtcaatcggacaaggggtgcgcgagtttaactgcgcaagtcttggggtgcgcgaggggcggggcgtcgggaatgtaccgctcaaaatggagctagagatgaaattctttcgccgttcagcttaggcggaggtggattgacgaccgacccaatgtaccgtctgaacttgctcaacaattcaaatgcccccccctcctcctctgttctcacttcactgtgtacaacgacgctgacccttcccatgccccccccctagattcttatctatagttcatctgcaacggccctttctccaccaacccatcattttcatttttccacttaatattgattcgttcttcattttatgtgtttgtcccgtcctatttttatatttgttcatttattttgttaattgtaacttactaacaaattaattaattaattaaactaacaaagaaaagaaaagcaaacaaaaacgaaaagacaagcaatgaaacaaaaagacatgctaaagaaatttttaagctaagaaaagaaaagcgggcgaaaaagaaacgcaaacgaaaagccatgaaaaagaaaataaattttaaagataagaaaagaaaatcagccgagtattgaaaagaaaagcaaaacgaaaagccaaacaaaaagccacgaaaaaaaaattttaaaaactaagaaatgaaaagcagtgcagtattgaaaagaaaatcaaacgaaaagccatgaaacaattttaactgctaagaaacgaaaagcagtgcagtattgaaaagaaaagcaaaggaaaagccaaacgaaaagccatgaaaaaaaattttaagcaaagaaaagaaaagcgggcgaaaagtaaacgcaaacgaaaagcctaacgaaaagccatgaaaaagaacataaattttaaggctaagaaaagaaaatcagccgagtaaaaagcaaacgaaaagccaaacaaaaagccatgaaaaaaaaatttaaagctaagaaacgaaaagcagtgcattattgaaagaaaatcaaaccaaaagccatgaaaaaataaattttaatgttaagaaaagataagcagacaagtattaaaaagaaaagctaacaaagagctatgaaaaaagaaattttaaagctaagaaaagaaaaaaaaaaagaaaagcatatgaaaaaaaaaacgaaaagcccagcaatgaaacgaaaagccatgaaaaagaaatttttaagctaagaaaagaaaagcgggcgaaaaagaaacgcaaacgaaaagccattaaaaagaaaataaattttaaagctaagaagaaaaaaaaaaaaaaaagcagtccgagtataaaaaaatgccaattcaaatgttgtcactcacataaaaaaaactttcgttccatactaattttctactatattgcttttttttttaagcgaaaaaattaaattgtgctttattgttatggctcaacaacaacaacaacaaaatgtcttggggcaaatggcaccttttggccaagtcataaaaaaataataataataataaataataacattcaattatttaaaggttgctcagttagtgcaaccaatgctcgtcaacgcggcacgtcagcaattggcggtgctttattctgttttacatattaaatttatgccaaactgtcatttcaggagcctttctgtgcggacggcacgcacagcattcaatttttgaatgactgcgtttcttcgttggggcaaccattgccgtatgttatttaatttacaagtgccatttcgtaatgtgctgagtttttttttttagcccgctgtgcctgatcgtcgtttcgattgatcatcgaccagctcagcaaacgccagcgggtccgctcgcggtctccaactgcgtcctgcgcaccggcgaagggcagcgtgtggaagcctccggatggcagcagcatgctggtgtgctggcttccctgtccgtcggcaccgcatattggttgttcaactgtgtcgcgcggccccgctacaggcagctggactgctggttccgcattggggttggaggccccaatgcgtttgtggtgccgcacgtggccccacaggtaagttttttcttttaaattttaaaatgtttatttttttaaattttaaaatgtttattttttaattatgtttaagcttccgccaaacattccaccaacggtgtccgttcagactggcgccgggcgtgatgcaattcatgtgtcgccaaacgtgaccaatgctggtgctgaacaacgcgcggacctggacaacaacaagaacaacaacaataacaacactgtgaggaattgatcttttatttaatttgtaattgctttgttttatattgaataaatttttgtctcaggacaatgttggtcttgttgagccgcgtccaagaggtgtgcgaccgccacagcggcgcgcagctgaaccggttcgtttgagggtccgatttgatttgtgtccagaagtagaagaaattgggggtattgaaagacaaagaccctatcctgcccgtaaaattcgtgcattgcccacctttgatatttcgacaattcacgttgaaaaatgcctttcctgtcccatatgcatgtgtccttttgtgagtggggagtgtgccacctcactccattgtttccatatttttcatgccccatgtattgtaccatggcttaggattcagcgctcatgtcctgtttgtaaatttttattgccatgaataaattttttgttgttctctgttaaggcgattgaggacagtttcgtcattgagcgcaccacgcaaatgaggaatgtgccacggaacactcgtggcgaaatttgtgaactgcgcttcctgccgctggaggacacacagcggcccgacttgttgatggaggtgctcatccagcatctgctagaccgtgtgctggacggtcacccgccgccatccctggttggtctgcagctgcacccaccaggctttgaccggccgtacgtcatccgccttcgcccgcccgagcagaacaacgctgcggcactggcggcagccattgagcggctcaatgagcagtcggcagccggcattgacctgtttgctgggacaacggtcgccaaagttctggcggtgtggccactcgagccaattcgtgcggacccacaaagaggaggtttgttcttcgattttcaagcacattacgttgaaaaaaaaaacaggtggctgtgatttggaggcggaacaccatgcttcgcacaccgtgcaatcattggtcgtgtcgttaacccaaacgaccgtctctgcctggcgcgtgccgtccttctgggtctgcgggaccgcgaaacgagaatggctggtggcggtggccgtgcagcatttacggagtacgcgcgtcatcaggagcaacatgggcgtgacgcagaagagctgctgacgcgtgccggcattccccttgacaaagggatgtacacgctggtggacgtggctcgactacagcggatgttaaacaacacaaatggaattggccaaatccgcctggcggtgtttgaaaaggagcgggaataccttattgtctataagggtcaggggtaaatttctgtcttaaataatggatttcaaatttctggtctaattaaagcatggcggccaaattcaatttgtgcctgctgttggaacgcggccatttcaactaccttggccgcgttgaacaactgttcgatgtccaacgctactgcatcgactgtgagcggcgagcgcacttgcgctaccacttctccggttgtaaagttgtgtgccgcctttgtttgcggtttgggcccgaatatccgtgtcaagcacaacaggtactttcaagataattaatgaaaacatataacaaaaaaactaagcttacaaacggcgcaagtactgcccgacgttgtggtgcgtgccagttcatctttcccaacgatgattgctacgactaccatctgatcgaacatgctccagctccaatggatgcccgaggacagcgtcagcgtcagccaatctgtcaatggcgccgagtgtgccgtgattgtgggcgcatcgcctaccagggcaaacatcaatgcccacgtcaacaaacagccgacaacgggaactgtagacgttgcgacgggcctcacaccgccgaagagccctgcttcatccagccaatttgtgatctgtctgctcggcaacgcgcatcagttgctgttgacaacgacgacaactcagatgacaacggtgacgatgacggcgaagacgacgtattgccgcttcgactttgcttcttcgatgcagagacgtcgcaggacagcccgctccagcttaacaaccgattggtgcagaagcacgtcccgctgttgatcattgcagaagtcatctgtgaacgttgtcttcaggttggcatcagcgtcaacgatgggcttggaagaagagctcctgactgtgtttgcatgccaggaatggtgaggggacaacagttacgccagtggtcttcaccaccgtttgccaacacacgcggagacaacacagctgtgccaatggaggccccgacattcaaccagcgccgtttctactttcactcattcgacaacgaagccgacgacccagtggaccaatttttggattttttgacccatcacggtccaaaaaaggcacacacggtgtgcattgcacacaatggcggcaaatatgatttccacctgatcctggaggcactccatcgccgaaatcagccaccaaagcgcctgtgcaccaccggcctcaagatttactccatgcgtctgtcagggagccaccaacgacgggtcacattcaaagactccatcaattacttcttttgtgaattggatgcgttggtgaagagctttgacctgcccgaacatcaggcgacggtgaagcccttcttcccctacctctacatacagcgacaacatctgctgcaacgcctcgacacactgccagctcgggagttttactccccggacacgatgaaagcagagaaacgggccaaatttttgcggtggcatgccaacaacaacggcaacgggtttcaactgcgtgagcagctgatcatgtattgcgccaacgaccttgccattttgagggaatcggttatccgatttcggaagctcttccccgac

SEQ ID NO: 95 - DNA, 8396 bp, Heterodera glycines
cagctgaaaaccgattggtgcagaagctctcccagctgctgatcgtcgctgaagtcatctgcgagcgttgtcttcaggctggcatcagcgtcaacgatgggcttggaagaagagcgccggattgtgtttgtctgtgtcgtatggtgaggggacaacagttgcgccagtggtcttcaccaccgtttgccaacgcacccggagacaacacagctgtgccagtagacgcgccgaccttcaaccagcgtcgcttctacttccactcatttgacaacgaagccgccgacccagtagaccaatttttggattttttaacccatcacgggccaaaaaaggcccacacggtgtgcattgcacacaatggcggcaaatatgatttccacctaatcctggagtcactccatcgccgaaatctgccaccaaagcacctgtgcaccaccgggctcaagatctactccatgcgtttgtccgggaatcaccaacgacgagtcaccttcaaagactccatcaattacttcttctgtgaattggatgcgttggtgaagagctttgacctggctaacgaccaggccacggtgaagcccttcttcccctacctcttcatacagcgacaacacctgctgcagcgtctcgacacactgccagctcgggagttttactccccggaaacgatgaaagcggagaagcgggccaaatttttgcgttggcatgccgacagcaacaacggcaacgggtttcaactccgtgaacaactcattatgtactgcgccaacgacgtggccattttgagggaatcggctatccgatttcggcagctcatcgccgacaacacgcagggcctcgaccccttcctcaacgcatccacggctgccggtcttgcgctcgccacgcttcgtcgttgtttcctggccccgaatcgcctggtccactcacccgagggcggctacctgcgcggacgccgcgcatcggctgagtcgcagcggtacatccgcttcttcgagctggagaaccccggagcgcaagtgcagtgtgcgcattggtccgtcggggaggcacacattgaggacaccggctaccgcgtggacggtctttggcgacgcgatgcgcctcttcgtcccctggccattgaatggctcggctgttactatcatggtaatttttgttgtttgttttccaaaattgacaaaaaaaaaaaaaatcaaggatgcccaaagtgcttccccgaccgacagcagcgactggcggcggggcggactgcggaagacctgtacgaacggacggagcggcgtctatttgagctggagcacgaacacggttgtgagatccacaaggtgtgggcatgccagtggagtgaacgactacgccacgacccggagctgaagcgacggtacgatgccgtgttcgtcccctgcccactggacccgcgcaacgatgccttgaggggaggccgcacggagccgttcaaactacaccacgtgtgcagcgacaacgaagaaattttgtgcatcgacatcgtgagcctatacccatacgtcatggttggtcatttgaactgttcccttaatttttatagtcaataattcagaaggcaaactgcttcccggtgggcaacccgcgggttctgacgcgcgaggtgctgctccatccccccacggcacccctcccgtggactgcgccggaaaacaacaccttccgggggctgctgcttgtccgagtgctggcgccacgcgacatccgtgtgcctctgctcggctaccgcacaaaggatgagcgcttcaccttccctttgtgtgggtggtgtgccgaccgacgacagcagcggccgtgccgtcacagtgacgacaagcgttcgtgggtgaccgcctacacccacgtagagctgaacaaagcactcctacttggctacatcgtcaccgacctatttgaggtaattagttattataaattttgtataagaaaaaaaataggtgtgggactacgatgagtgggacggcacgctgttcagcagctacgtcaacactttcgtcggtctcaaagtgcaggcgacggggtggccagaaggatgcgccacggacgagcagcgtcagacatttgtggaggactttgagcgcaccgagggcatccagctggaccctgccaaaatggaattcaaccccagcctgcgcctcatcgccaaaactttggcaaactcactttggtcattaataataataaaaaatttatttttaaacgaaaaatttacaggggaaagctcgcgcagcgtgtgggccgaaccgaaattcgctacacgcggacgccggctgaattccacgagctgcttgaagacccgtcgctggacaagttggattttgtccacgtgtccgagtacatggaccgctgtgtcgtgcggaagcgccccgagttcgccaaggccccgctgaccaactgtcttccggtcgcttcgttcgtcacttcatatgcccgcctgcatctgtacgactacattgagcaggtgttggcgattgacggagctgagctgctctactgcggtatgctgttttttcacaaaacatttggtgtacacgcttatgctttagacacggactccatctactacgtaaacaagatgggtggtccgtgtgttgctgagggcgaggcactgggccagatgaagcgagagcacactgatcgcagaatcgtcgagttcgttgcgggtggtccaaagaactacggcatccggcatactgcgcgggacggtacggatgagcgtgccaacctgaagatccgcagcttccgcctgtcgtacgcggcccaacagttgctcaactttgaggcgatgaaagagctcacgctggccacgtacaaaattgacggaccaatgtgagttttgcaatttatcattaagtttgtaaataataaaatcttagcgacgacgtgctggacaatgacgacctctacgtgtacggaggcggtgagcatcgcgccattcgggtcaacttcccacatattgaccgcaacgcttacgccgacctttacacacacgaggcacacaaagactacaggcccttctacgcaaaggggcgtgtccgccccggaatgcagacgcgtccctttggctatgtggaggatgatggaccaccgaacgatggacaacggacggagcgacgaaagagaaattttgttgatcatgaccccgcccaaccagggcattccgggtggttttgatgttgtctttttattttttgttcatttcattcaaataattgtaaataataaatttattcaacgataataatttggtaaaataatagacaaatcattaaatgaatgttggatgacatccaaagttttggccccagtgacaatgaccttacccgaaatataaattaggcacgtgactccattcgacaatttgcacctaagggctggaaaaatagtggggtcatatgtgccacccagagtgttttgaattcgctctacaccgattcgctgggggaaggtttgaacaccaacaatgttgaccacacgcagttggtagattccgagtgggatgctctgtgtgtgttggatgcgccgcaaaacgcgtgccgccattttatttgcgctgtttgggtggggtactccggtgaggaccacacgcgccgattggaagatgagtgctgccacagttttgcccgttgttgtacggattcgcatgatgatagcgtggaagcggcgtgcgttgtactccgtgtttgcgccacgctgtgcaattgccaaaaattgctttcgagttaagggttcaacatttattttaaaaacaacagtacaatttgaaattgaacacatctacaaaacaatggacaaaatttcaagagggaaaaaagttttgtgatctccgcctccaaattcaacgacgcacggcaagttggggtggcgcaagcggatgccatgctttatgtaatagtgcatgcggacctttaattttttgttaccgacaaacaaaacaaataaaaataccgttatgccgaggtagcctcggtacgcgggggccgagtgggtgtccaggatggacaggtcattacagcggaccggaaaattgcgcacggacgggcgcaggtgggcggtgcgcagtggacgagcgcaaatgctccacaatgtcccggcgtttctctaagcttttgaaaagcacatgcagctcgtgagcgttgcatttgaaccgcttgcagagatggtccacgagcggaacggggcgacggcgttcggcacatgcacatttttttggagtgcctaaatttaaatttaaatatacgtttaaaacaaaagcaacttgttgctggcgtctcctcaccaattggagcgagcggctcgcgcttcatctcctcgtcaatcaggctgatccaactgggatcatccgcctcctcctcttgctttttcgttggctctttgttggcgtcctgtaaatccatttcgggataagcgttgtttatccaatcggtggcaagaattaaatccatttaaaatctgtgaaaataaaaaaaaaaactataaataaaaagaaaattacataaaaaaaagtaaaatggacgccttccaacaatttaaaagggaggatggacaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttgccaatgtgccagtcactgtacacagcggcgtcccacgcgcggaacaagtgcgggagtgtgccaaaaaagaaaaaaccttgctggtgctggatgatttggtggtgggtatgagtcaacaatatttagacgcactcttcacccgtggctcacacaattggggcgtcagcgtaattttggtgactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagatatccgccttcgaacaaatatatatgaacaaaaacaaatagtttacctaccaaaatgaaagggtcacaaataataacaataaataaatgctttttggagacactgtgtaatgccaaaaaggcgaaagcccttattcgatatgcatccgatgagcaacttttgtgccttgtcgaaatttgcctaaacattctaaagggccgagtccctttgcgtccccggtatttgaataagctgaaagctcatgcacaggtgcttcgtcgtctcgccagcacacgctgctcgcgctctgccaaaaaggttttgctacaacacggagatggcctcccagctattgtggggctcattgcgtcaattgctctcccgcttattgctgatgtcattgaaaaatataaatagtttccaaaaaattaaaaacaagaaaaaatgcagcatacaaagcgctatttgttagtccccgaagagatttatcagagtttggcagcaccgccaccatctgacggaacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatcttaaagttgggcgtgcgcgaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaggcagaatccgctcttgagtaggcatttatttcccgaaggccaatccggcaaaggaatttataaaaacaccccacttaagtttaagccatcattatggatttgaaaaagcttcgcttgcgcgagtttttgtacaaggacctaagttcgcctgtcgcattcacgagcgttgaaccgctgctgagagaggcgcggaaaagtcaaccaaaaatcaatcgaaacgatgtccaaaattatttgaccagccaacgtacatacacactgcatcgccaggcgaagcggcgctaccgccgattgccaacattggcgcccggcttgcatactgaatggcaggccgatttagctatttttgaccgacttggtaaacaaaatcgtggcttcaagtacttattagtttgtattgatacccttagtcgacaggtgtttgttgagcccgtaaagaccaagacgagcgctaacatgatcattgcctttaatcgtatattcaaaagatcaaaaatatatcccgtggaaggtgttaacagatcagggaaaggaattcactgcccgggcagtacagcagttcttccgcacaaaagacgttgaacacttttatatgctcacttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgagcattggaatgcgcccagtagacgtgaactttaaaaacgcagaagcattgcgacaaaaattacatgatgcagctgaaaatgttgtacgacgcaagccaaaataccgtgtgggagatcgcgtgcgcattgaaaagtacaagcacgtgttccaaaagggttacctcccacgcttcaccaatgaacttttcacggtggcagaggtacactctgagcgttcgccagttgtttatcggttacgtgatgacaataatgaaattattagtggttggttttacgcaaatgatttatgcaaaacgctagaagacaaacaacaaaaaatgtttgacattgaaaatattttgaagaaaaagaggcagaacggtgtggaatatgtacttgtgaaatggaaagggtacagcgctcgctccaatagttggattcccgcaaattcaattagcgagaaaaatatataaaaagcattatttaataaaatttataaaaaaaaaaaaatgccttcaaattctttttatgttgttcttccgtcaaacaccaatattgaaggaaataggacaaattctttccgagtgcgtttaccgcgcaaattgcaattcaattcggaatgggaggtgggtcttgccgttattgtatacccccactcttggccctcgataggcaccgtggagcaacaatttgtacagattgagtggcagacagggaatacggtacgtatcgaagttccgccgtcaaatgtcaccaacccccatgagcttagcaaaaatttatacaggctactgggtgagggaagtgatccgttggcaaaaaaggtacgatcaacacagaattctttcatgcttttgataaacaaggctcgccgctgggccagagaagaatacattaagcgaaagactaaagaaaaacggggcgtccgtgacgaagagctgctcctacaggccatgttgacagatactggaacattggttgacctgaacagcgtggcccaaggctttctgacacgcgaaaagagtgctgcaacgagtaatgtaccgttgagaatgccagctgatgataccaattcgtaccaagaaaaattggatgagtacttttcaaaattaagtgacaaaaatttgaacattcttgatgaattgggcatgacaaaattgaacgccgaaatcaaaaatttaacagaagaggaacgcgtgatctttgaagccacaaaggaaatgggaacggaagcatggattcaggcgtaccgtgagatacgtcttgtttgccaatttaactatgacgtccatagaaatcgttttgtcctgaacatcgacccacggtacgttaaaaaggtcaaagtctcgcttcaactcgcttacattctcggtttcaacaacacggagtttattcaatctgaaaacgagacaagattcatgccggacatgagcggaggggtgtcatcattccacgtttacacgccggatcttattga

SEQ ID NO: 96 - DNA, 5747 bp, Heterodera glycines
aaaaatttgcggatttttttttattattttacttttccccgaatagcttttcagaaggcagctaagaatttttttttgaaaaaatcgaaaatttccagaaattctggaataacttttttcttttatgtgataacaaactcaaataaatcccataaaattctctttatttttctctatttttaaagctttattatagttaaatcgatgaaaccatcaccgagttatgaatttttccaatattaactcaaatttccaagatccaaaacattctcaaaaaatacagtatttttacatgattccaataattatgaaacttaaaatagacatcatctttgtatcgaacacatcaatatccaccagcataatgtttttgaaacgccttcgccgaaacgccatggacccaaattaataaggcaaaggaattcaggggttgctaaaagcaatgagttctgagtaggaaattttctgtgccacatttacactatattttaatcgcctgtgaatttttaacctttgatttatttttattcatttttattacggtattcattttgtattttttatttgatcaaatttatttgtttgttttcatttttgcaccatgtaagagtactaatgtgccgttggtttgctcgataaataaataaaataaaaaaaaattaaaaagaaaattattcgaatgggaaagaaacattcaacgagagaatggaataaaattgaaagaaaaattgcaaaaaaattgggtacaaatcggaacaaaatttatgaatggaaaagagaatttggaatgatcaaaaagcattattatacggatgaggaaaagcgtaaaatattaaagcgatttgatcaattatatgacaaaataaatgaaaaattaaataaaaaattgaagggaaaaagaaaaatatgtcaaaaaataatagcaaaacatttgggcacaaatatcagcagtatttattattggaagaaacaatttcaaaaaggaaactcatcagtgaacaatcaaaaaactggtgatgaaaaaagagaaattgttgaaaaatattttaaaacaaaaataaaatttatgcaaaatggaaaacattcactgaaggaatggaaagaatttagagcaaaaattaaacaaatgtttggtgttaattattggacaattgaaagataactgtcaaaaaaataagtgaatttatcaaaaaaatcacattttttatccatttcgctagtacaattctaatcaaacgtgctaaaatttgaggccaattggtcggagggggctcgtctcttttgctttgcttcgttcggcttttcctcttctcggtccaaataattaattagcacagaaaggacaaacggggccaatgcttattaattaaggacggcgaaatagtcgggaacagttcaatttatttaatttaaattcaatgcgaagacgacggcaattaagagtccacacacaaaatatttaaaggagaaaaagtctgaggtccaaatttttgtgaacaccaaataagaatgaataaaggaaagcaaaagggagaagaaaagcaaaggaatatcgattgagaaaaataggaataaattagagagaaaaacaaaaggaaaataacatataattagagaattgaattaaaagaataaaaggcagtcagaggcaagggaaatggcacataattagagaagaaaaatattatagaaaagccaaattatttcccatttaacacatcacaaccccccaaagaaaaggcgtccctgccgataagttgattcggcatccgatcggtggtggtctgagcaagctagtgccggcggtcgcgcgtcacatcatctcgacggtgtcctcctcaaacgaatggttgtgattggcggttgtcgcggcgtctaaacggcgatcgagaacgagaattcgggcggcggtcgcatagacccaacccatagactctcctagtgaccgaaacgctggagcggaccgttcgaatcctcccaagttgtctgttgtttggccatttcggaatttgtgtgctgatccacgccgacaatgctttaatgccattttcagtcatccatccatctgcattgacactactccgatcaaaggaatcgccataatgccagatttcaatcaaactcctaccaaacggagtcacgaaaacaaaccaatcgccgagcagttcagaaagacggccgatcatttcgtgataggccaaatcgtactgacgaacatacggtggaggcagccaaatgaacgaaacggacggaaaacgggaacacagttgttggatccgttggcactgttccatgatctgatcaacggtctcgtctttgaccagcgaatcacgaccgaggatgatcattgcggcgcgcactttgcttgagaagacgcattcgctaagtggacggatcacttcagttaacagccctcgttccgtgcaaaagccaaattatttcccatttaacacacaaaaacatttcaattctttgtgacgtaaatatttttctcgctctccaagatttacttatttttctgtttttcatcgataaaattcaaattttgccttaaaaatgaaaaaaagtcattaaaaaaatatcaaaaattgcaaaaagaaaaaaaagaaaaaaaaggaaaatttttgagcatttttggatatcttgccaagaatttgagtgcaaaaaagctactttcgtaaaaaataaaaataaaatttccaaaaaatccccaaaatatgtgctaaaaaaattagtgaattaatgacatcagatgagaacgaaaatgtgatatttgtgatagttaccttaaaaatctccataattatagttatctcatattaattactacccaattcgctgataaaaggaaaatttaataattgaattattataaaaatgttgtatcaaattaatgaaataatgattaaatgtggttaatattgattgaagaaaaattaagccatgctataaaattaataattacaaaattcattgcgaaaaatatttttataaaaataattcattatatttttacaaaaaaatgaaaatattattaatatttttattattatgcgcattaatattcaaaaaagcaattaaccaaattgaggctggcaaaattatccaagaaaaaagttttgctgaaatatttggccaaagatgggacgacggagcagaagaagaaaacatctgtcaaaatgatcaaataattcatggagaaattgctgatcagaataaccaatttggacaaaatgttcgtcaatttgatcagaattttgatgaaaatgtggaagtgaaagaagaggagagtgaagaaatgtccacagattatgatgaattgggcgaccaattgccaatgccaacaaataatggacaaagttgtgataaattttcaaatgaaactaataaaaataaaagagaaactgtggaacaatttcataaaattaaagaaaaagttaagcaaatgggaaagaaatattcaaagaaagaatggactaaaattgaaagaaaaattgcaaaaaaattgggcgtcagtcaagagaaaatttacaaatggaaaagagaatttggaatgatgaagaacaaaaattattcagttgaagaaaaaagaataatgttaaagcaatttgatcaaatatatgcaaaattaaaaatgaaattaaatgaaaaattggagggaaaaagaaaaaaatgcaaaaaaataatagcaaaatatttggacattgatattagcagtatttataaatggaagaaagaaataaaagttggaaaaatggtgaaaaatcaaaaaaatgatgatgaaaaaacggaaattgttgaaaaatattttaaaataaaaaatgaatttatgaaaaatggaaaacattcacgaaaagaatggaaagaattttatataaaaattaaacaaaagtttggtgtgatttttcagacaattgaaaaatgggcaaagaatttaggaattgaacaaaataattcaaaaggtgaattttaaataatgttttaaaaatttttttgtttttttttcaatttacagagcgaaacatgttatcaattgctgaaaaaatggaagtcattaaacaatattatcaaatcaaaaaacaaaatccaaaattcaaagaatacgaaattgccgcaaaattgggaattccaatgagctcattagacaaatacaaaaccaaatatggcaatgaatccaaaaacaaattgctataatgaggacaattattattattatcccaagaagattaaatgaaaaattacaatgaaaaaaatttgaaaatttcatttttttcttgagaatttgtttaaatttgagtttgtgataaaagtttaatctctttttttcatctgtttacaaaaatattttaatcattaaaagcgtcgaatggtctaatgttttaggtgattaagtttaaaattatattaaatgttcatattattttaatcttgaaaaattggcaaaatatgtaaataaaaaattgataattcaatcaattaaaaagtaaaaaaaaaatttataccaaattaaactcactcaattaaattaatagttttaatcaaacttaaattaatgcattaatgcacccatctaataatataaattattgcttttaattgaaattgaacttaatgcacccatccaataatataaaattaattattttaaattaaattctaacccattttttctattttacctttccaatggcgagcccatccagtgaaagttggccttccccaacaataaatgccaatgtcgtcctcaccttggcacaaattttcggacaacggaatatgttctttgtcctcaaagcctggacagttccacagagagtcttaaatttcaaaaaataaataaaattaaatttggcattaaaattttttaattttcccactttggcgttgtgtacatttgggcgccggcattacaaatgggtaagtgtcgttgttgcgctgaaaaaagcgccaaaatgcgccgtcatcatagcccatggtacggcacgcggtgcccgtgtcaatactggtccaatttgtcatttgggtacagacggaacgccaacggtcccgaaagcgaatctaatcaaaaaaaaattttcaaaaaatgtattacgcatttttaaaattaagtttaaatgataaaaaggcgttacgaaattaaaaattaaattttttttttttgttacttaattacaatttttaattttttggaacaaaaagatgaaaaaatcatttaagaatcttagtggtaaacgaaaatttgtttattagtttttttagactgtaacattcatagttaatttcaaaaaattccaacattgatcaaatcttgatgacaatgaaaataattctgaaaaatacgctttttttatttttgagcaaaagtcttttttttgtaaaatttcagctcaattagacaattattttaaatggctttaaaatgtaaacctcgtattttttatttttaattcatggtttttttataaaaaaaacatttttaattgaaaacgaacttttattaaatttcgtaaattattttttgaaaaaaaatattaaagaaatttgcctgcagacggccttgccctggacggtgggaccgtcaattagcccgtaattctggcaatttgctatcgtacaccagctgctcttggtacggtagcatttgaatgtgcgcaaattcgttgccaactgcttgcagagggccaagaatgaaattgatggacacccaaatcgggcacaaatatgccaattaaaaatttgccccggac

SEQ ID NO: 97 - DNA, 8672 bp, Heterodera glycines
ttcctaagacaataaattgacttttttttttaaacattcgtttgcttattaaaagaaaattcaaaaaaatccaggtccaggcattgttatccaggccatgacaagcctggacctggaatttgctggatttttgtccaggaattccaggtccacatacaacatagaatccaggttaaggcatttttaaaaatgccgatcaaaaatgccgattgtcacattacacccacctttcatgccaacgcccgtgtcaaaatacatttgtacgcccgtctcaattgtgattgttgcgcccgattcgacaattaattcacgctcaactctagaaagaaaaaattttctataaatttcagaatattttagttaaaattttacaaaattttctttccccggcggcgcccatcggcaccgcctgggcgacaacatttaaattttaattttaagcaaatcccgatgatccagcgggattccgaaataaaagccacgggattggtcaggatcgggatttgaatgggaccacgactcgggatccctcccgatcgtttttccaaaatcttagggattgttcggtatcggaatttgaatgggaccacgactcgggatcgctcccgatcgttttctcaaaatcttagggattgttcgggatcgggatttgggtgggatcacgactcgcctgcgacccaaattttacattttgtgtccaatttacctatttcccctgtcccgcccttttttgaataaatttcccatttttttcatggcacctgtacggcgagttacggaagtacagtgtcacattgcccgagtagaaaccgccgagagtgttgcgaattcgttgtcgagtcggctccaacccattggccagcggcggttgttgtccattaattgtgccacagaggaagaaaaatgccaacaatgacaaaatgccaatattccgcagcattttagtgccaaattatttggaatttttatttgagttgaagcatttgctagcaaaatgttttacagaaaattatgatgttaaaaatagtaaatgtaaatataaaaataatatttttacaaaagaattttaaatgcaaatgtttgaaaattaataagtgattcctggtttttttacaaaatccttaaaattttgcacaaatttcctttaggctggatatatttatttggcaattttttgctttaagcctctataagtttatttttttctattctaattttaattgattataaatatttaagttgaaaataataataataaaaaaaaatttttttctttattttcaaaaataattaatttaaaattaaaaatcgatgaatcattttgttgtgaatattttatatttttttgggtgctttggattggtcttagctgttaggccgagcataggccttttaaatttttatgaattttgaaatatttaatgatgataattatttaattatttgcccacaaaaataataaaataaaaggtggaaaaaatgttttgttgggaaaatatttatatacattctaaaaattctcaaaaaaacttgtactgaaatttctcggcctttttttttgggggggggggggttgggtcttgatctcgagtctcggaaatttcgactcttaagcagccctactaattactttttcaataaacaattagttatgggtcgattaaaaaacattaaaaaaatatacatttaaaattaaaatataattattttttacatcgatgagtcattttattgtgggcattttatttttgggtatgttagccttagcgctgtttggcccagcacagtcatcagaggtcggacggaggatgacgatagataaaatgtgaatgggaaaaatgcatttatttgtccactgttgtgagacgacgccggcggggagaaagggcgaagaattaaagaaaagcaaaaacggagacagatcgatttggcttggattttccatcggaaaattcaaaattttttcagcaaaaaatgtctgtaaaatgaaaaaatttttgtttaaaattttaatattacataccaagacataattcattgttgagttatgataatagattttttttagaattttagacaccaaaagaataaaaactccctcccatttacacacattttgtttcacaaaaaaattaatttttcattgttttatatattaaaaaaaacagttggtgtctaacaaataaaatgctaattagaattaatcaaattagtgtcaaaataatttttaacccaaattgaagtaggaagcattaattattttgtgacgaattttaagcaatttttttttaacttaatgtgaaccaagaaataatttcaggtattttcatgggcaccaggcgatgctgccgagaaattttttgaaaaactattactgaattcacagtaattaatagaagagagtttcacaaaattttttgctaaaaagtttccaatttttcatttttttttttacactaaaataaataagtacaaaaaatgaaacgaattaaatttaattaattaatcaaaataattacaacataaatatttatttttcaattaacgcaaaatcagtgttaaaatgttgtgcattgattattattttggtattggtcactcattcattcattaatcgttggactttagtcgggcggtggttgagcgacttgacgacgttttgtgtgggcaaacaaaacatgacccgacagcagcacaacacaacgggcaaataatatatgagaaggaacaaaatggtggtggaaaatgtgcaaataaaccaaataataaggttattatttagaatggattatgacataaaataatttgaaaataatgcaaaattcccccaattttaaatgaattaattattcataaaattcattgaaatgacaaaattggagttgcgtcttaaagtagtattaaaaagatacaaaaattaattttgaattatttggaagggattattggctaaaataattcgaaaataatcaaaattcatccaattttaaattaattaatttcataaaatttcattgaattgccaaaattggagcgaaattggagccaatgttaaagcagtacttagaaagacacaaaattgaatttaatgaaaagagttccaaataaagcaaatgatgaatttgcagagaacgggacaaaagccagctgatttttgataataatatttcaaattatatttgtccaaaaatttttgggttcaatcgaaacaattgcctatattttttaattctgttgaattttttgtccaaaattgagagcggaatgccaatttcaaggccaagacggttttgcattgacgacaatccgtcatgcttttgacgacaaaaaattccgtcgccataattggcctaaaataaattaaaattaattaccaaaatattacattttaatttttaaattgctacctcaattcgactttggttgtttatgcgaaaatcaaatcaaaataagcattttctatggaaaatctattactaaatgtgccaaaatttcttaatcttcgaccgacgaaaagtgcaaaaatcaaacacttgctttatgtaattgatttttaatctaattaatagatattaaagccaagaaatatttagagcaatcaaaaagttaattagtaaatttttttgctaatttttaaatggaacaaaaataagaaaatattttatggaattgatttttcatgaaactttaactgaaaacatttatttatttattattgacaacgggcaaattgtatcgacattttttgtagcgtttttttggatttttaatatttcatttaattaaagagtataatttataaaataaaacattagtaatatataaataattaagtagaagtgtgaagaaaatcattataaaaaaacaagtagaattttctgatgtgagtgaagccaagtaataaataataatcagcataaatatgggaataaaaatgaatccgtaaaagtatttgtattagattttaatggttttattcagaaatataaaaattaatataaaatgagtataatttataattacaaaaaaaaatcttaaaaaattaattgatttttttggggttttcatcaaaatatgattactagaaagccctaagtagaattttgaaaaaatgaaaaaaatcatattaaaaaataagtagaatttgcttagataattagcaaaaatttgagaataaaaccaattaataaaagaattagtattcatttaattaattttattcagaaatatgaaaattaaaatattattttcaattttaattttcataaatgcaatttttaatatttattctggaaagataaacgaagaaaaaagttttgatgaaatatttgtccaaaaataggacgaaaaattggaggcaaacagagagaatgaaactgatcaaaatgcaataattggacaaatggatggccaaaatgaggcaaattatggtgaaaatatttcaaaattaattaattaaaaataaattttaaaaaagttaattaattaaaaatattataaaaatatagcaaaataaatgccataaattctttttgtttttttattattggaaaataaataattaaaataatacatacaaattaatagaaataatgaaaaaaaggaaaacattttttaaaaaaccattattcaccgaaattaaatttttcaaaatttgttaaatgatcaataatcaaacacttaaaaaatgatattaatgaacaaaaaataattttaaaaaaatttgaaaaccgataaaagttattttttttcatttaaataaattaaataaaaaatagggaaaaaaccgtaaacgaaaataataagatgattctcttaattaatttatttttaaatcctgttttaatagtaattttttaataaaaaaaaatttattcacttaatgccgattttttgtccaaaattgagagcggaatgccaatttcaaggccaagacggttttgcgttgacgacaatccgtcatgcttttggcgataaaaaattccgtcgccataattagcctaaaataaattaccaaaatatttcattttaatttttaaattgctacctcaattcgactttggttgacaaatgctcgtccatccaatgtgctctcaataacaattccatggccacgattatgtgaaattgttgagttggcaattaaaacgggaccctaaaaattcgaaaattataaaaaaaaatttatattatttatgctttttttgaaaaatagaatttttaattcaaaattttcttaaaatgacacctttcaaaataattaaaaaaatataatataatttcatttaatcaaaatgagtataatttataaaaaataaaacattaataagtagaatttcgaaaaaatgtaaacattattttaaaaaataagtagatttgctgagtaaagctatgcaataaatcagcataaatatgggaataaaaatgaattcgtaaaagtatttctaatcattttaatgggtttattaagaaatatgaaaattaaaataatattattttcattattaattttcaaaaatgctgataatatttatgctggaaagataaacgatgaaaaaaactttgatgaaatatttggccaaagatgggacgaaaaatcggaggaaaatggagagaaagaaactgatcaaaatggaagaattgaacaaatggatggccaaaatgaggcaaaaaatgatcaaattaatgctcaattattacatgagacacaatttgatcaattatttgatgaaaatttgcaagtgaaacaagaaagtgcaacaaattgtgatcaattggaacaattgccaataaattttggacaaatttctgatcatttttcaaatggaattgacaaaaagaaaagagaaattgtggaaaaatttgataaaattaaagaaaaagttaagcaaatgggaaagaaattcacaagaaaagaatgggagaaaattgaaagaaaaattgcaaaaaaattgggtgaaaatcaaaggaaaatttacaaatggaaaagagaatttggaatgatcaaaaagcattattatacggatgatgaaaaatataaaaaagtaaaacaatttgatcaaatatatggcaaattaaaaacgaaattaaatggaaaattggaaggaaaaaggacaaaatgccaaaaaataatagcaaaacatttgggcacaaatatcagaagcatttatcaatggaagaaaaaactaaaaaatgggaaaactatgaaaaatcaaagaatttttgagcaaaaaattgaaattgttgaaaaatatttcaaaataaaaaatgaatttatgcaaaatggaaaacattcacgcaaagaaaaaatgggacaagaaaattggcttaaatcaaattctttcaaagggtgaaatttttaaacaaattgttatttattaattaaatttaaaaatttttattatttaatatattacagggcagaagcattatacatttgcggaaaaaactgaaaaaataaaacaatattatcaattgaaaaaccaaaacccaaagctcaacgatcgccaaattgcggaaattttaaatattacaaaaagatctttagaaagatataaatctgaattcaagagaaaaagtgaaggtgtcacggattgactgagaatatttttaagctttcagggccattcattgttaggttttgataaatttaaatttcttaaaaatttatatattattcggcatttcattcattttccaatttgttgcttatgtaagttaaaagtattatgcataatgtttgaaggttgttttttttttttctattttttgttgtaattgccagggaacggatttatatgtgccaaaaattgaaaaaagctccaaaatatgtgctaaaaagctcaaaaaaggccaaaatatgtgccaacaattgaaaaaaaaactgtcaaaaaataagtgaatttatcaaaaaaatcacattttttatccatttcgctagtaattaaatgaaaaattggaaggaaaaagagaaaaatgcaaaaaaataatagcaaaatatttgggcacaaatatcaaaacaattttttattggaagaaagaaataaaagttggaaaaatggtgaaaaagcaaaaaattagtgatgaaaaaagagaaattgttgaaaaatatttaaaagtaaaaaatgaatttatgcaaaatggaaaacattcacgaaaagaatgggaagaatttagagcagaaattaaacaaaattttcgtgtggcttatacggcaattgaaaaatgggccgagaaattaaagataaatcaaaacatttcaaaaagtgaattttaaataatgttttaaaaaaaatttgtttttttttcaatttacagagagaaaaatgttatcaattgctgaaaaaatggaaaagattaaacaatattaaatcaaaaaacaaaatccaaaattcaaagaagacgaaattgccaaaattttaaacattccaaaaaactcattacgcaaatacaaagctgaattgagaaaaatggaaaaagcaaaaaactgatgagcaaaaaagagaaactgttggaaaatatttaaaaacaaaaaatgaatttatgcaaaatgggaaaaagcttttcgagaacttttcaatcgtgtcgccaaatccaaaatcagtgactacagatggcaaacagatcggctgtactccaagaagcttcgagaaggcggcgttctcaccaaggaattatgtcttgaacgtgttgaggttggacgacggccggtgcagcaccagcaaccgcagctgagttattgcaaaattccaaaaaagccattcttaagggtgtaaaattgtttcgtcttttttcctccaaataccgtctgacgaaatcgaaaacgaaacgaaaattttaaaaataataatgaatttatatttaggcgtttcaaaagtaaaataccccttttgaaaaaattttttcactatttttgtcctgtttttttaccaaattttttgacaacttttttggcatttttagcataattaagtcgaagccatttaatggggctcgaaaagttggaaaggttggtggagcggctcgtggagggcgagaatcgatatggacatctatttggtgacccccagcacacctcccccacttcggctcccacccccacaaacggcaattttcaatggggtcaaccgccgccttttgctggcaccggagcagggctgcacgcaactggatttgcaattacggaaatccgtaatccgtaattacggcgattttctcagttacggaaatccgtaatctgtaattacgggggtccaaaaaccccgtaatttcccgtaatccgtaatttttaaaaatcaatttttgtcagaattttagaaaaaattttttaaatagtgattaataaaaatcaaaaaactgattttcttgatggagtttctaatcgacaaaaaaaatttaaaagtcccaatttttcctgtaaaaatttttaatttttcatttcgggcgggggaatggggggggggggggaattcctcccctcacctggctaaggttttatgaattttcataaaatgcgtgaaaaataggtgtgacaaaaaagtgatgcctctattttctaggcgaactacccaaataaccttaacaacaacaaataaaaaattataaatctattttaattcttaaataaatcgaaatacgggtagccctttaaataaaaaatagaaaaatttgtt

SEQ ID NO: 98 - DNA, 3488 bp, Heterodera glycines
tttaggttctaaccagggctgcacgcaactggatttgcaattacggaaatccgtaatccgtaattacggcgattttctcagttacggaaatccgtaattacgggggtccaaaaaccccgtaatttcccgtaatccgtaatttttaaaaatcaatttttgtcagaattttagaaaaaaatttttaaatagtgattaataaaaatcaaaaaactgattttcttgatggagtttcttcatttttatttaaattttacaaataatttataattttgtgtctgattaaatcattctttttgaatttatgggttgatttttgaaaattttttgaaagtctgatcattataatcggatttatgtatatgtatataattatttcaacattttaatagacagaaaaaaaaattacggagggggtgggggaatccgaagaattttttttggtaaaatttatttagtgttatttaaaaaagttcagcgctggacagcaaaaacaggaattgtaaccatttttagccaaaaaaagactaatttttgccattttgtagtcaaaatttaaaaaaataaggtaaaatcgagtaaatcgtggtccggcggtgccgataggtgccgccggacaaaatttttttttaaattttaatgattttattaggaaaaatcgacaaaaaaaaaatttaaaagtcccaatttttcttgtaaaaatttttaatttttcatttcgggcgggggaaggggggaattcctcccctcacctggctaaggttttatgaattttcataaaatgcgtgaaaaataggtgtgacaaaaaagtgatgcctctattttctaggcgaactacccaaatagccttaacaacaacaaataaaaaattataaatctattttaattcttaaataaatcgaaatacgggtagccctttaaataaaaaatagaaaaatttgttttttataaaaataatcttacaagaaatcgtctcgaaaaaataatccaaaagtcaaattacggatcaaaattacggaaaaatcccaaaaatccgtaacccgtaatccgtaactcccaaaaccccgtaatttccgtaatccgtaatccgtaattgcgtgcagccctgcaccggagccgtgtcgcggatgataaccgacgccatcatcaactcagagcagctgaaggagaaggcaaatcgtgtggtcattgagaaattgccggaggcagtcgatgaacgggcactggtggaccaaattgccgaagaatgcggtgtcaaggacaaactgtcgccagacattcatcgccacccaaggaccgcagcctgatggaggcgtaaaaaaggaccgaattctgaaagttccatttttggacaaattttcgcgagacaaatttatctataatttccgtaatgctctgaaaaaattgactaatttgccccaacatatcaaagtccgcagggacatgacccaaaacgaactcaaaattttatattcccttcggcaacaagcctatcaggccaatattgctgctggtgaatataaatattttgtggttgatttggaaatcaggtccctgaaaaacccccacccgctcagaactcgctagggacacgcgagcaaaccaaccgaaaaaaaatagaaaaacggtaaaaacaatccctggatttcctgccttttaataaatgcccgatcaatatcaaataaaatagctgatttagaacatttggctaaaaaatacaatccgtctataatcctaatcaatgagacctggttaaactccagaaatacggtagaagcggaacttacaataaattgtcaataccaaattgtttatgcgaaccgaacagaaaaaagggcggaggatcggcaattctattaaaaacattgatcccttatcagacacttttctctgggacaaaattccaatgcgaaattatacccattaaattattttttaaaaaccaattcaaattataaatatatatcggccaccgaattgtaccgttcagaatactaaaaagctattcaaatttatttcggatcaaagcgattctgaaaatatcatatactgtggggaatttaacatcccaaacattttatgggatgaaaataaggtaaaacatataaattatcctatgtcaaatatgctgattgagtttatgaaccaaaaacaattgaaacagcatgttaaagaaccgaccagagaaaatacgattttagacttagtaatgactagtgaatcagaattaattaatgaattaattgtattggaacatttttcaacttccgatcataaaatggtcggatttaaaataaaagaaaaattccggagtaataatcccagtgtttatagaagagattttaaaaatattaagtcgggcgatacttgaaaatcgaattgatttatcaataaactcagtgtacaccgttgatcaaaaatataaagaattcttaaataaagtactgaaattatatgatacttttataccaaatagacctcttaaaacaatcgtatcctcaaaaaataagagatttattttcagagaaattacggttacataagcttgtaagaaaatttcctgaaaaaagtgaaatcatttaaaaattacaaaattatttctaaggaaatgaaaaaacaattgtacaaattaagaaatgaacaagagtcaaaaattatttcccaggggcaaaattcaattaacaaatttattagaaataaattctcaaaagttaatgaaattcctacgttaattgatagtgctggaaatatgttttccagtaatgagcaaaaatgcgaaatattagcagaaatatttcaaaaatcttttttagaaaattcagttgttaatggttcattgactcaatcagcacagaataagactaagctttcggatattgaattaaatgttggcataatttggaatatattaagaaagcttcccaggcgaaattccacttcaccggataacatttcgtacattttattaaaaaattgtgctgagccaattacaaaaatattagctgacatatttcgacttgctttgtattccggtcaaattccggaaatatggcgaacatcattagtggtaccaattttcaaaaaaggcgaaaaaactgatttgttaggcgtttgattctgtaccaattgatttattacttcaaaaaatcaaaaagattgaaattgaaggaaaatttttaatttttataaatgatctgccgccctttattgcaaatgaagcatcatcagttggcataaaaatctatgccgatgatgttaaattatattatgcccatgaaaatgatgataaaacaaatcatttagataaagcagttgaggctttggaaaaatggtcaaaaataaatgggttagaaatttcaactggaaaatgttttgttctttatttagggaaaaataatatgaaaaaagaatattttattaactcaaaaatgatttcagaatctgataatgtacgtgacctgggaattataattgactcgaaacttaatttt

SEQ ID NO: 99 - DNA, 236 bp, Heterodera glycines
atgtgttttcgagtattttcacgatttttgccttgcgctttgctttgtgtttttgcataaaattcaagcgagcgaagcgagcgacacgacgtgcgcgagcgagcgagcgctgcgagcgtagcgagccgcgagcaagcgagtgcacggagctatttaacggcatagtagtgctccacgggcctggtacgggcggcgcaccgggggggggggggggcggggggcgtatcggggggggt

SEQ ID NO: 100 - DNA, 15043 bp, Heterodera glycines
taaaaaattacaatgagtcgtatagatcgagtgcataattttcacttgaaaatgctaacgaaaaatttattatcacccaagtctttttggtcgtggtgggcatattgattgtaattcaatttgtgctctcccctgcacacgacctcttgcttcccccacctccccgcaccccacctccccgcaccccacctccccgcaccccgcctcccgcacccagcttccccaacttacaagacctttttgcacgaattgattgcgcattttccgtttgtaaaacaccgactgaaaatgcgtatattatagtaaaatacaattgtaaagcaccgaatgaaattgcgtgttttatagtaataaaaatacaattgtaaaacatcgaatgaaatgcgtgtattatagtaaaagaaatacagttgaaaaacatcgaatgaaaatgcgtgttttatagtaataaaaatacaattgcaaataccttaccagaaaatgtagaaattccggttattaaatataattgttaaacacaaccggtaaattctggctttacgtaaaaaaatttcaattaaaaaacacaactggacatgcacaaaacaatttctgaatttaaattttacttttccggaaaacactctgtttttgtttttaattttccggaagacaagaataaaagaccgaaaaaatgtattttatttcatataaccaaaaaatattcattttaaaataaaaaaaaatcgaaaataatgtcttttctgagaaaaaccggaaagcataattgtgctgaagagcttttgaataatttagccttaaatttggaattttattggttcttatttggtggaatagttctggattttatcaagacaattgtcttttcagacaaaaccggaaaacaattgtcctttctttataaaccagaaaatacatgcagtttctgttaataaaacggaaaaacaattgcaatttctttataaaccggaaaaaaaggtattttctgctaaaaaccggaaaacatttgcctatactttataaaccggaaaataaatgtattttctgttattaaaccggaaaacaattatcatttctgttaataaaccggaaaataaatgtattttctgctattaaaccggaaaacgattgtaattcctttatataccggaaaatacatgtattttctgttaataaaacggaaaacaattgtaatttctttataaaccggaaaataaatgtattttctgttattaaaccggaaaacaattgtcatttctgttaataaaccggaaaaaaaaatgtattttctgttaataaaacggaaaacaattatcatttctgttaataaaccggaaaataaatgtattttcagttattaaaccggaaaacaattgcctatattttataaaccgaaaaacaattgttttttctgttaataaaccggaaaacaattgaaatttctttatatagcggaaaatacatgcattttctgttaataaaacggaaaacaattgaaatttctttatataccggaaaatacatgcattttctgttaataaaacggaaaacaattgtaatttcttcataaaccgaaaaacaattgtttttctgttaataaaccggaaaacgattgtaattcctttatataccggaaaatacatgtattttctgttaataaaacggaaaacaattgtcatttcttcataaaccgaaaaacaattgttttttctgttaataaaccggaaaacgattgtaatttctttataaaccggaaaataaatgtattttctgttattaaaccggaaaacaattgtcatttctgttaataaaccggaaaaaaatgtattttctgttaataaaacggaaaacaattatcatttctgttaataaaccggaaaataaatgtattttctgttattaaaccggaaaacaattgcctatattttataaaccggaaaataaatgtattttctgttattaaaccggaaaacaattatcatttctgttaataaaccggaaaataaatgtattttctgctattaaaccggaaaacgattgtaattcctttatataccggaaaatacatgtattttctgttattaaaccggaaaacaattgtcatttctttacaaatcggaaaattaaattactttttattaaaaaccaaaataaatgtattttctgttagaaaaccaaaaagtaaatgtattttctgttattaaaccggaaaacaattgtcatttctgttaataaaccgaaaaataaatgtattttctgttattaaaccggaaaacaattgtcatttctgttaataaaccaaaaagtgtctttatcagtagggcgaggattttaagggtgaaaaagtcacaaataaggacgcaaataatggccaaaatagtgacgaaaaattcaaaatttaggatttaatttttcaaattgctctttttatatgaaaataattcaaattaaaataaacaattttattcactgattgcagtacttataataattatttaaacttgacgctagcaatgacttggctttacatttttcatagttaaaatattttgtcattattactctaactgtcttcatttctgaagtctctcactctccctctctctcacactttcaacatcaatcttttcttctctttatttttctctctctctctttaactattttccgtcctccctctcctctcccctctgcctcgcaccgatcctttttcattgtgattccaccacccatttctctgttgctgcgtcacaaataatttttgcagcaacaaaatgcgaacggaaaaagcggcgatgagaacccccttccaattggccatataatattgatttcgggttcaacaaaatttaatgtattttaataaagttacatatttttaagtcaaacaaacaatgcaaaaggaactttttaaatattttaatttaacaaaattaaattgaatttatttactgtaaaaaaaacatttaactttcacctccccaactaactcatgctaatattaatggccaaatttggttgctttgattgaaacccaagcattttaaatcttttttgtattccatcaacacttctctattactcttgcacaattactttatcaataaccctctgaaatgaaatgaattaggcccacggcggcaaactttctcagcttttttgagcagttcacactgagcccaatgttccacagctcaccccatttttgcaatcaattcgtaattaattaaaagttgattcataaacaaccatttttgcaataaaaaacatattttccgtatattgtaagcaccgccggcattaaaattacttacatatttttaaatttaaacaaaaaattccattgatcactgtataatttcaattcatttattgtcaaacaaataaattaagttttattttggttacagccctacgtatttaatattaattatggtttcataattattttaaaataaacttactacccatttctattcttggattttgttttatgctctaaataaaatcctgtgttttggcttgagctttccggataaatttcttttttgctgttagtttttccggaaacattttgctgtttttggttttgtataaacaaaaacaaaattcacatttctgatttatatttccaaagattgtttttaacatttttatttgtgctttacacaaaactcaaatgttttttttaaaaattttccgcaaaaaattcctgatttggttgagattttccggacaactatttatgttttggtttgtattatcaggaaaataatttctgaattggcttgtgtttttccggaaaactatttctatttttcgcatgattcttcttggttctggcaattttttttaaattttattagctttttttttaaaaattcgcccaaatgttttattgttagctgtcggaataccgatttcgattgcctattttttaacaagcatgcttttccaattgtattgatcgtgccctttctacattttgtattgatcgctatttacaattcacagatctattaaaaacgagatgccggaggacagcaaaaacaaataatctcaaaatttctgccgtcacaaaatagacaaatttgaacatcaaaaacaaaaaaatgacggttccaaatattggggagaggagcggcacgctgacgcggcttatgccgtcatgctcaagaaggtgcgctatatgccgccaacggattacgaatgggttccggtaaggagaatgttgaaaaatttgtgcctgtttgagtaccgaggttgggcaatgggggatgcctattttgcgggtccggaattacataaggtaccattttttgtggattttagggccttttaaccgacggttaatccagcttttaagataaatttttggcactattcaaattaacacgaaaacaaaacaaaaaaaaacacgaccaaaaaataatttgacacattttaaagtaccataactttttctagcagcacccaaattaaacattgttgggtccatccgatagccacaagaattcctctattagcctaaaaattttaaaattaaaaaaaaattatgcccacaaaatttcaaaaaaaaaaaaaaattctttgaacatttttgaccataactatttgaaactttttaaaattgccaaattattttttggttgtgtctttttttatttttgtaaaaactgtaataaacccaaatttttgcaaatattttttcacatttatatttggcaattaaaccaaaaccgatgtggggttttctgccagaatttgtcaaaaaagagttaattttgatgaacttttggtggaacatttggcacatttaatgactaattactttaattgtggacaaaaaaattttaatgtttaaaaaatttgctattaaaaatggactatcccctgaaaagtccaccatttaaacaaatgataaaaaaattaaacattttgttctgctctttaaaatttccatttttcaattaaaataaacaaaacaaaaattttcatcaaatatttagcccaatggccaacaacagttagcgctgactgatggttctgccgtggcgatggaccacctccaatgggagaccatccgggagcgggtgatcaaggcgggcactgtgccaagactggtggacagtctgatcgacgaggacggacacatggacttgaaacaggttttttggaaatgcggtggaatgttgagggtttatacaaaacattggccctgatttaaattggggtccatttttggttaaattttgtttctggggttttttgaggttcgctgaccacaaatccgacatccactttggcgccaattctgatgcttaacccgaactaactcgaacaaaatttcgattttttttgttttcgaaatcgggttaagcatcaagaattttgctgaaatggatgatttcctgttttttagccgaaaatatttgctattctggggtcttatattaaaaaatttaaatgagtattatccaacaaaaaaatttttgaagcggaaattttaatcatttaacaatttttcgcaaattacatcaatatcgccatctctcaacataacaaatgctggcaattcaattttgactgccaattcataaaaacgaattttaatttttgtcggagtcaaaaattaaaaaaaatttccctccccccttatttagttcaaacgttttcttcgccatttgtcgcgccttttccaccgtggccaaagtgttccgactggtcaccgatttgtacacaaaaagtgattgggcaccggccgacgatcaggagaaaattcggcggtatttttgcggaaaatatggaatttgtttaataaaaatttaaacctgaccacaaattcaatgtctttccttttttgtcggttcaaaatttgcacaaaaaatttgtcgtactttttaattcaaataaaactaatgccaattggcgacggcgtcgcgcaaaagtggcttttttgaatttccatctcacattttccaaaaaaaaaaagcatgttaaatttttcttaaaatctataaatatcatttcctggcaaaaatctgttaaaattatggccaaaattctcatttttattgccggcactggcgcactgtcgtgccttcctcacctaagtgtttttattttttccacaaaaaagttaacccggaatttgtccatttgtttcgagttgcaaaatgaccaaccgtctctttgcaacgaattcagacccaacccaaatgtctggacggttcgaattttttactttcaactttcatggtttttaataaaatcagggtgcatttgaaactaaaatcctaaaattttattaaaaaatgaatattccggataattagtgttaaagaaaattctacaattttcaggcgaacaaatgcaaggagcaaattgaggtggcaaaacgcgagaatcgcacattccaatgcaaaacgttgaaggcgcacctggtccatttgctgaacaaagagcccaaattcaacgagaccatccaattgggtacggaaggtaaacatgattcgaacaaagacaaccttttggcgactaaatgattttacaccgacccattaaaaatagggatctgaccaacgatttcctttagaacgagccaaatacaaatatggaaaacggctctgttgcactttagacgttcaattcagcttcttaggccataactttcctttccccatttttgttagccaaaacatattatggtcagaaatttgtggtttaagatttttaataagaaaattgtcaaaagcacattttgtgtttatatctggtaaacaattttatggcccggaaaattttgaattacaatctgttaatcggacttttcatttaaaatctggcaacaacttgtacgggcccgggatttgaggtttaaaatcaataaaccaattataaggcccgggattttggtttaaattcggttcagaaattttgccttttgtttagtttttacttgtatttttttcatttgcccgaatatttctgatcctctcaaattcactatcccttccatttaaaaaggaacagaatatgagccaacagtgctgcgacaaccgagtgcttttcctgcaaaatgtcaaagtgccgagcgcaaatgggttggccaagtcggcgaccgtttcctccttacaatgctcgcctttgaccgcattttgcccgtccttggtgagaacataatgggcagacgcactgagtcaaaatccattgggattacaagtcaaaaacgtcacaattttggcacaaaaaacgccagaaaaacaaagatggtttttaaactattagtatttcaagaaggcccgggattttaatttttaaataaagaataataatgtttcagacatgagatggcattaacaaaccaaggcaaccaaaaatgataccacaaaaaatgtaaaatttagagcctaaaaaaactaaatttacgaaattttgagtgttttttgggtaacattttgcaaaaaaggacttatgggaaacaatttagccaagaaattgttaatctgagcaattagaattattttaaaaaaactattttaaaatttgccactttttttgccagaatatttgatggtcggaactaattttaccaaaaaatggctaacattatttgctgtttgcgcgcttatataaatattgtaattttggcttaaaacaattaaatagtcttggcattattttaaatggtttgatagtgtctattatcctgaaaagtttcacaaaaaattagatgagcaacatattatggccaaaaaaactcaaaaaatgcatttttctggccaatttgccacagcgagccatatctctttttaaagctaatatatttttttcttttgcttttcaacaaaacaattatatttttgacttttgtttttccacaaaacaatttctgatttgtattcaaatatttttggcgaaatttgttggcaaatcatttctaaaaaaaatggttagcctaagcaatttaaattacttttttaaaaacaattttaaaaattgccccattttttgtcagcatttgcctttgccacgtgttgtccgtcacttccacctgtggcgtctgtacaattgcggaaatttccctttttatttgtccagaatatgtgccattggtgtcaatgatgtgagttccaaacaaaattgaattgaaaatttatttatacaagtaacttacacgtgcaaaaaaaatgcctttctccccacaacaaaatttgggtttgggcaccgggcgacgctaacattgttaaaaaggtttccctgtgaataataaaaaatttaaaaatttaatgcactttatttgcacataatttaaacggtcttgtaacattttaacttcttttttgtttccatgtattcaagccgaattttaatcaaaaaaatcttaaacgcataatttattcaaatattttgtttgattcaggtttcaaacattaaacgggggaggagggccaataggtggccttaaaccaattaattccaatcaaattttaataaaaaatgaaaagttgtcattaaatactcactctagaaattcaatattttaccaaccatccaaaacataacaattcccatttttgcatatattttttcaaaaaacttttttaatttttaatttgtgttccaaaaaactatttctgtttgttttttgtatttttccagaaaaccattcctgttttggtttgtgttattaaaaaatcaaaaactgaggcccgacggtgccggcaggcgccatcgtgaaaaaaaattgaaaacttgagtgcggtttgttaacatatttcgaaccaaaaaatgccaaattttgcgacttttttgcaagtcgacgacttttttttaaaaaaaccgtttttgcggcgtggtttttccaaaaacttcgagctattttcgaaattttaccaatgcaaccagaaatgctaccactaaaaatgccaacttcagtggcgagaaaaaacaaaaattacgtccaattttgcccattttttggattacaatttgcaaaaaaaaggattaatattattttggcacaatttgtttggaaataattttaccaaaaaattggttaaccttagcaatttatattcattgaaaaaacgatttttaaatttgctccattttttgccagcatttgcctttgccccgtgctgtccgtcacttccatctttgacgtctgtacaattgcgggccatctcaccaaactctttgatgctgataatgccatttttgtgggtgccgttttttggcatttcagaatttgaaaattgtcccttttttttgtccaaaatatgtggcattgatggcaatgatgtagttccaaacaaattctcgtctttgaggaggtcggcccttccatcaacatcaccacggtagggatttaattaaggctaaaatttagttttacaaactctacatttcttaataatgtaattttttttaatttattgtttgcgatttacacaaaacctatgctttttaaatatttttccgcaaatcaattcctgatttggtttgtgtttttccggacaactatttatgttattcccgacctcgcctctgagaaaaaattattttgaaaattgtttaattggaaaatattgtaaatattattaaatttttcaaaacatttacacggcatcacggcaccataacattctcgctactatgcttttcaaattctgaacacttctctctgattacaaaaatcgtaaaatcaactaacagccattaaaattatcctttattttttaattttcagaaaattactcaaattttgtttggtggaaaattttttttttattaaaaaacaatttatacatatactttttcatccattatttttaaattaaataattaaaaataaattgattttttccaaatttttctgcaattattaataaagatatattaaaataatatatttttaaattttttatttttaaaaaagggtttcccaatgaatattgttttctaaacatttttaaaaaggcttccaagtgattataattttttaaacattttttaaaaaggtttcccggtgactaatatttctttgaaccttttaaaaaacagtctcccagtgcaaattgcttttctgaacatttttaaaaacggtctcccaaaaaatattgttttctaaacatttttaaaaaagcgtttcccagtgattataattttttaaacatttttaaaaaagggcttcccaatgaaaattgttttcaaaacatttttaaaaaagggtttaccaatgaaaattgttttctgaacattattaaaaaagggtttcccaatgaatattgttttctaaacaattttaaaaaagggtttcccattgactattattttttgaacattttaaaaaattgtttcctgcgaaattttttgaaaattcgtttaaaatatttttgattacgttgtttacagcaatgggcagcttaaactcccttctttttaaaaaaattttcattaaaatatggtttcagctaaattgccttccatcggtcgctattcctttgccatcaccggatacgacctcaaccaaccaacgaaaacaacaaaagcaacaacaaccggggttagtttctcacaaaatttgttcccttgagctaaattaattgcaatttttcaatttcctcagcctcaatggcctgctgcgcactgcacaagttggacgaggcggcacacccgtgtctgagcatgatcaactacgttgttcgatggcactgaacgacggcacagaaaaccaaattggttggcaaaaaagcacttacacacaaacaaacacattgttaccctttttgcatgctcataattaaacaaacatgcttttaaataaattgctgcacccaaatcaacggcttttgataaattgcattactacaccaaatatacacttacacatttttaaattatactgccttttaatttactctaaacaatgaaacatttataaaatatggcattttcagactgttacaaaagttataagtaaaacaaatatacagtttagtccaacaactcttaaagcaacaaacaaatgcgaatttttatgcacaaaatactgttttttacaaacaaattctctatcataaacgcatttctattatttttttaaaaaattgatacattcacattgttttttgtactatgagtgaattttgatattaaaattttgaaaaaaataagaaaatgccatatacgaatactttttgggcgatactatagatggtggatggtcaacctttttgaaaaaaatgttttgttttagaaagtcaagaaaaattgttatggagtttttttgggtaaggaacataaatcaaatattcattttgaacaatttcgaatgccggacccgcattttgaacaacatttcaaaaacaaaactttttaaatttattatttttgttagcaaaattgatcaaaatttgtgttccctgacccagaaaactcccaataacatattttcacgaacttttgagaacaaaaaaaattataaaaagattgcccaaacaccatcaatagtattactcttttttgtttattaaggcacgtgttaagggctacaaaacggttatttgacttaaatttacagccctactacaaatataaaaatatttttttttacaaataaatttagaaatataaaataatatttcaagtgagttaattttagattttagaaaatatttattataaaacacgagccttaaaaattacttccatatactcagttttgcttcttttttgttgcacaacacttttcacaaaaaataattttttatgctcaataaaatttatttttaaattcccattgatttaagtcaatcgaaaaacgaaatacttaagaaatatccattgacaacaaacttttgtaatagtacggatggtaccccccccctttttagaaaaacaaaatttttgcaaatagatataaaagtgtcatattagaggtttaaagggtcgggaacccgaatttgacataaatttcgacctatgtcgaacctcgaacccgaattcgagcaaaacgtcgaaaattcaaatttttgaattttttatttttggtataaaaatggttgaaatgaagtttttattagcgcattgtcaaatttagtttgtttctccatatgtaagcctttttaaaccataaataaagaattcataaatttgaattttcgacgttttgctcgaattcgggttcagagtacgacctagatcaaaatcaatgtcagattcaaattctctgactcattaaaaaccctaaatgattttttttgaaaacttttacatttatccagaaaatgctaatgagtcagaaacaacttttaaaaattcttatttttcaaattaataaatgtttacgttcacttgcacttatgtacacttattaaattaaacacagcttgcttttgttccctttcctttgttttttattgcgcgcgcgaatttgtatttgtagtactttcactttttttgtccatgtccaaatcacaccagattttgtcttaatgtctttttttgtttgtattgtccattggcccgcgacatgtgggtgctcgggcaccactggattacctaccaagctggggccgcgggtcaccaattggcttccgagctggttgaacccagctggacaacacttcccacgtccagcgctttgtggaacagcctggtagggatgtgccagtgtagtctgagcaaccacgggcccggtatcccgttctgctgcgatggtgccccccatcgtggaacaaccgtattgcacctgtggtttagtgtctaccactatgcggcttacggtttcccaggccccaagcgctcgggtctggatttaccaggccccttgcgctcccgggtctgaacaattcacttaaaaagagtcatgttgaattaatagaaaaaatagaaattttatggcaaaaagcgcatgcaagaaacaaaaaattttagtttaacaaaagcaaacaaaaaagtgcagttttttaaaaacaattacaaaaaatagtaattagatgcgatatgaattgttcagcacccgggtttcctggcccgtgttccgactttcaattgagccgaaagtcggacatccaaacccttccccccttccccttctgtagagcaaatatttttttttcctttatttctcttacatatttcttttaaaaaattcttttcccattcccttttctttcactctccctctccctttccctttctctttcctttttttccttctccattttcattttccctttccctttccctctccatttcccgttctctttcctttttcctttgccgtttcctttccctttttcttttccttctccttttcatttttcttttccttttccttttcaattcctaaaattcccaaactctaaaatcccattcttcacttttcctttcataattttcccaaatcctaaaatcccattccttttaacttttcctttccaatttaaaccaaattctaaaatcctattccttttaccaatttcccaaattctaaaaccccattcctccaattccttttctctttcccatttctaattttcccaaattctaaaatcctattccttttcccgttccctcttcccattccctttcccattcataattttaccaaattctaaactccttttcctctcattccttttcctttccctttcataattttcccaaattctaaaatccattccttttcacttcccttttcataatttttcgaattgctaaaatcaccgttccttttcccgttccttttccctttccctttaataatttcccaaaatcgaaaatcccgttccttttcccgttccttttcataactttcccaaattcaaaaatcccgttccttttcccgttccttttccctttccctttaataatttcccaaaatcgaaaatcccgttccttttcccgttccttttcataatttcccaaattctaaaatcccgttccttttcccgttccttttcataatttcccaaaatcgaaaatcccgttccttttcccgttccttttcatatttttcccaaattctaaaatcccgttccttttcctttcaaaaatttaccaaatgctaaaatcccgttcctttttccgttccttttaataattttaaaaaattctaaaatcctattccttttcctttacttttcataattttctcaaattctaaaatccctttccttttcccgttccttttccctttccctttaataatttcccaaaatcgaaaatcccgttccttttcccgttccttttcataattttcccaaattctaaaatcccgttccttttcccgttccttttcccattccctttaataatttcccaaaatcgaaaatcctattccttttcctttacttttcataactttcccaaattcaaaaatcccgttccttttcccgttccttttccctttccctttaataatttcccaaaatcgaaaatcccgttccttttcccgttccttttcataattttcccaaaatccaaaatcccgttccttttcccgttccttttcataattttcccaaattctaaaatcccgttccttttcccgttccttttcataattttcccaaattctaaaatcccgttccttttcccgttccttttcataatttcccaaaatcgaaaatcccgttcctttttcgttccttttcataattttcccaaattctaaaatcccgttccttttcccgttccttttcataatttcccaaaatccaaaatcccgttccttttcataattttcccaaattctaaaatcccgttccttttccctttccctttaataatttcccaaaatcgaaaatcccgttccttttcccgttcattttcataattttcccaaattttaaaatcccgttccttttcccgttccttttccctttccctttaataattttccaaaatcgaaaatcccgttccttttccctttccctttaataatttcccaaaaccgaaaatcccgttccttttcccgttccttttcataattttcccaaattctaaaatcccgttccttttcccgttccttttc

SEQ ID NO: 101 - DNA, 10349 bp, Heterodera glycines
  misc_feature (81)..(81): n is a, c, g, or t
  misc_feature (10171)..(10171): n is a, c, g, or t
  misc_feature (10230)..(10230): n is a, c, g, or t
ggtagtcgcgacggaaaacgatgtccaaatggaaggtgcctccttcgtacggcgactcgggcggtccttgatgggaggccncccaatggtacaagtctctgccgtcatccatcggtgccgcggtgtaacccgtcgtgaccagttcctgatgcagctccgccagttcctgcaaattggtcaaaacatttaaagcattggctgatcagtgttgtaatttcgttccaccttttggatgcgtcgacgtgccattgcgaaaacggcgagcgaattgatgtgaaggacggacggacgaatgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaaaatttttataaatttaggttcaaatttggtagtataggccagggaaactctgataaactttcaggtcgatgtcgataatttttggaattcgggttgggtatttactggttaagataagaaatatgtctttttgaaacagtgaagtttatgaaattcacaaaaaacagagtaaaacactcataaaagaaaaatgagtgaatgaaaagggaggaaaagggggcacaatatttatagtacgacgcaacaagggagggcaaaagttaggtaggaacgtaggtaggtaccattgcccaaattccaaggttttctctctatataaggaggtgtttttctcactggactgacattttttgcattacgcctatatgcttttcttacttgttccctcctctattcagtccttaatgttctgatttaattttttgtgttacagagtacgcaaaatataattaacccgaatttttccaattgttttttcaatcaaaattgactgtttctcacagaattttcctgctggacaatctaaacttggaatttaatcaaaaaaccccaaaaaaatgcttttccctatttgtaaaatttataattcatttcattatttatgtttttatgctttttcattttttagaacacaactatttgcgtttatcatcatcatcccttcattgtgcaacaacaacaacacttcaaaagcgacctcatcgccgtttctcatcgttcgttcgtccgtccgtccttcacatcaattcgctcgccgttttcgcaatggcacttcgacgcatcaaacaggtggcgaaatgacaactctgatcagccaatgctttcaatgttttgatccatttgcaggaattggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccatcgcgactacccattcactccgccagttgtcaaattcgaaacgcccgtttaccatccgaacgtcaacaagcagggtggcatttgtctggacgtcctgaagatgtcgcattgggcgccgtcgttgaccatttcgaaaggtgaaagcgacgcgggaaagagcagacaaaatatcgacaagacaaaacgatccaattcaaaacgaccaccaaaaccggactttttggaaaagtgtcgatattttgtcgtgtaaaatgggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatgagatgacaaacgaccgatggatgggagaggatgcagaagacaaccgccgaagagggaggaggatacattcaactgaccctattcccatatatgatcccaactgtacatattgtattattgtatctcactgtatgtacagtatttgtcgcccggttattgtttacgcgaccataagtgtctgttgttggttgatcaccattatcaatgtgttgtatctctgtgttatcatttcaaccaatttgtgatcaattgttgcgcctaatatgtgtaaataatgtgaagaatccaaagatttgtttatgtttttgatccctttttcgtgccttttcatgactttttttctcttgggcaaattccaggtcgaaaaacttggtcccggcctctcaggtccggtcccggttttgtcaaaattaaacagaaactttcaaatagcacttcaattgctttgatttttgatttctcattaaagggcagtcaaaatatgcaagtgcatttttttccaggcttttccatgctctaaattagtgttcagaccccgacccatcccccggggacgggacaggttttttggcctgcctcccccctgctcccgtgactcagactcccgcgaccttcgcccccgcgggggtgagtactctttcaagtttctaccgtaaactgaaccctactgattttatttatttttttataccgaggaaagtctcaagcaattagtgaattttcaagaaaatatacccttaagaatggcatttcttgggataaaaggcaaacaattatacttgtattttttaactttttaaaccacttttgataaaattttatgtgataaatagggatgccaaaaatatgcacataaaatcgtaaaatatgcactaaaaatcgtgaaatatgcacaaaaaattttccaattgagggtgtaatttctcaaaattactccccttttaagcaaagcaaattgagagaaacaatcaattaatgtgagaaaaaaggaaaaacgacgacgaatgggtcgaataatcaaatgaaaggaacgaatgaataaatggcaaatgagctgattgtttgttgttttgtagttggccgatgagatgaatgtatctgttgatgttgccaattgagcactttctgagtttgtgggaaagtgagggacggacggcacaaaatttggggtaattaatggggggggggtaattgaaaagccaaaattaaaatggataatgggaaaatgtgaaataatgaagaaaaaaaagccgacattcgaggacggagtgacaaaagaaattcaatgagaaaatgcaaaaaatgcgaggggaaaaaagtaaaaaattttcagtaaattttttaaattttaagcaatcttcttaacaaaattgtattaaaatactcaaaaattttcccggcgacgcctatcggcaccgccggacccccattttaccatatttttaaaaattgaggccaaaatggcaaaaaatagtaattttttggcgaaaacggcgaaaatttttgcaaaatataccccctaattcgggatttcaaaaaagcaaaaatacacccctaaaaatcgaatttttgtcttcagcctcccccccccccgaagccaagggtctggctacgcccttgggtcaaagggatgggccaatcaaagcaatgaatgaacttcccgcgcatgcatattcccatcaatccaaaacatgcgttttttgagcacttttctcaagttttttggttatgctccgaattgacggctgtgggaaaatctgtccgttatatctcatctagagcttttaaatgataccaaattagtcatttttcgatccttttaaaaatcccccctctatataagtcagaagtgccgaaacagccaaaaagtgacaaagtgaaaatttcacattttgattagtttatatatgcgcacacatcaacaataatacatatacatacaattcaaatgatcgggtgtattgacaattataatatggggcattatgacagtttatgggcacgccgacaaaacaatttcaagtgatcgggggtattgacaattacaatatggggcattatgacagtttatggacacggtgacaacgcaatacattcgcaaatgatcatattccatcctgacgatccctccgtcatcggccggcccggcgacgtcagcagcagctcagccccgtcgcatggtggagttcagtgcctgcacgagggcgttgagcgcgttcacgttgatgttcagctttgacgccttgttttgtgcataactgaaaaaattaaaatttcatttctggttgatgaaaatttgaaaacccaccgaagaatcacgaagtaaatgtagaggtactggtcgagtgtctgtatgctttgcgatcgttggcgccggaggtcacggatgagagcgaagatgttgagaggctggccgaggtgcagcgtttggttggccaagtacaccgccacgagcgttccagtgcgtccgatgcctgcaatgggaaaaatgattaatttttcaatgtttttgtttccgttaactcaccagctgaacagtgcacaaccgctcgggggacgccgatcacatggtacagcaggcgcagtggggccaggtcgctgtggggcactccgcggtcgggccattgtcgccagtggaagtgttgaacgcgcaagtggccctgtcgcatctgcggtgctccaacgatgaggtccgtcctgtagagcgcgccttccacgtggtgttcgcgcccgaatttgacaatgatctggttgttggcgaagcgcatgagctaggagggaaggggaaatgattaattgttaaattgggtaaatttcaaaccccaccttgttgtccgcggtcggccagtactgatgacacttgatccgattttgttcgatggtgtcgcagagcatcacaatgccttcgatgttctcctgcacgatcattgtccagaagtcgtcgcaggtcgtctcgagcgggccttgagtgcagatgaagcggttctcgccgaacgtgctgatccagttggcgtggatgtagcgtccgctgtggagtcgcacccggttgatttccgtgcagatcacatctcggtagcggttgcattccaagttcctgcaattgaaaattgggaaaattagacatgcacaaattgaaaacgacgccaaaacccaccgtgtaaactcaggcgatggctccggtcgtggcgctgcgttgagttcggtgaattcgctgaccaggtcctgcacggagcgcggcgttgtgtcgttgacgaagcgttccagggcgaagaagaattctgccgtgtcctcccatctgcgaagagttggctgcgcgagcgcactccgttcctgcgttggtgttggacgcctttgctgctgctgagtgccgggctgacgagtctgctgcgttcgggttgggcgtcgcggtgcttccgtcttgcccctattttggcgtccacttccaccgccggacatccgcgtttgctgtgtgcgttgaggttgaaatgcgcggcagagcgttgttgatcactgtaaaaggggaaaaaaattaatgatgtgcaaatggagggggtgaggggaaaacgggcgatggtgaagaaggcgcacctcagtaattaggcgcgaggcgtgtcgaaaataataggcgtgaattgaaggaaatggaataagtgagaattttgggcattttccgtccttttatatcaatttttttccaaattccttccagcagaattggatccgtataaaaggggtcgtctttccctccgcttcacatttcttcttcttcttcttcttcttcaccacactccaaccaacgaaccgcttcagtgcgcaacgcaacgcaatggccacttacctattcatcgctgctgctgccttcggagcaggaattgtaatgctgcgctttcttcattttttcaatttgcatttcattacatttttgtccttttcagtactgttggaaggcgtacctcggcccgatgctcgaccaaacgaagagcgacgacgaggagaagcccaagccggaaggaggcgaagaagcgacgaccgccggcgacaaggaggagaagaaggctggcagcaagggcgacaagcacaagaagaaggacaagaagggcgaaggcgcagcagcagcagcaccagcggcggacaaaaaggaggagaagcgcaaagacaaacaccgatcgaaggaggcggggaagagcgacgacagcaaagcgggcaagaaggacaagcacgggaagaaggacaagaagggcaagaagaaggacaccgccgatgcatccaccgtggacgaagcgctgggagaacagagcacagcggagacgagccaagcagaggaatagccaggccctgctgcgtgcaaatgacagtgttcgacgacgacgtctcgcgacaccaacacacccgtcccttgctttcgaccattcccttcccatccgattgctgtgttttgtctgttccaatgcttcttaaatgttccccttgtgaacagtgatccttccttatgtggcctgaatatgtatatattgtatacccattaatatattgtgcttcgcttgttcgatatttgtgaaatctcattcatattcatcgtcattgtatttatatgcacatttgatatattaataaaatggcatatcggttaggcataaattgtatagtttaattccgtgtttcatcgagatgacctacccgttttggtacttatacagtttacagggtacttttcacatacattttttttaaattggctgtgcttttctaaattttgtggagggcaccgcccaactcgccgcacctttgttttatggctttctcgccgccattgaaaaaatgaatgtgaaaaatttggattcgataaatcatttaacgaaatattcttaatcagaactttttccctaaaatcgctgctaaggaaagccgaaaattctagctattttttatcgggacaacaaatttagacaattgccagttgctgatgcgagcaaccccgaaaatccatgaatgaattttcatgatttattatggaaacattttttgcaatcaaaaaggtctataggtctttaataaaattcacgtttcatcacagttaatacatattaggcgaaacaattgatcacaagtcatttgaaatgataacacagagatacaacacattgataatggtgatcaaccaacaacagacaattatggtcgcttaaacagtaaccaggcgacataatactgtacatacagtgagatacaataatacaatctttacagttgggatcatatgtgggaatagggtcagttgaatgtatcctcctcctcctccctcttcggcggttgtcttctgcatctctcccatccatcggtcgtttgtcgtgtcatctcatcgcgtggttcttcgtccattcacgggcaattcggttgtactcctcgcggttgtcgcggtacatagtcgcaatgtcctgccgcagcgcactgttcggattcgggtcacagagaagcgaagagatggagagcagcactgaaatggagaggggataaggattaaaacggcatttccgaatttgaaaaatcccattttcaaacgacaaaatatcacacttccaaaaagtacagttttggctgtcgttttgaattggaccattttgtcttgtcgatattttgtcggcgttttgtctgctctttcacctttcgaaatggtcaacgacggcgcccacatctgcttcagaatgtccaaacaaatgtcgcccctttctccaacgttcggatggtaaatgatcgtgtcgaatttcacatttggcggagtgaatgggtagtcgcgacggaaaacgatgtccaaatggaaggtgcctccttcgtacggcgactcgggcggtcctttgatggaggccttccaatggtacaagtctctgccgtcatccatcggtgccgcggtgtaacccgtcgtgaccagttcctgatgcagctccgccatttcctgcaaatggatcaaaacatttaaagcattggttgatcagagagttgtcatttgccaccttttggatgcgtcgacgtgccattgcgaaaacggcgagcgaattgatgtgaaggacggacggacgaatgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaaaatttgataaatttaggttcaaatttggtagtataggccagggaaactctgataaactttcaggtcgatgtcgataatttttggaattcgggttgggtatttactggttaagataagaaatatgtctttttgaaacagtgaagtttatgaaattcacaaaaaacatagtaaaacactcataaaagaaaaatgagtgaatgaaaagggaggaaaagggggcacaatatttatagtacgacgcaacaagggagggcaaaagttaggtagtaacgtaggtaggtaccattgcccaaattccaaggttttctctctatataaggaggtgtttttctcattggactgacattttttgcattacgcctatatgctttgcttacttgttccctcctctattcagtccttaatgttctgatttaattttttgtgttacagagtacgcaaaatataattaacccgaatttttccaattgttttttcaatcaaaattgactgtttctcacagaattttcctgctggacaatctaaacttggaatttaatcaaaaaaacccaaaaaattgcttttccctatttttaaaatttataattcatttcattatttatgtttttatgctttttcattttttagaacacaactatttgcgtttatcatcatcatcccttcattgtgcaacaacaacaacacttcaaaagcgacctcatcgccgtttctcatcgttcgttcgtccgtccgtccttcacatcaattcgctcgccgttttcgcaatggcacttcgacgcatcaaacaggtggcgaaatgacaactctctgatcagccaatgctttaaatgttttgatccatttgcaggaactggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaatatcgacaagacaaaacgatccaattcaaaacgaccgccaaaactgtactttttagaaaaatgtcgatattttgtcgtgtgaaaatgggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatgagacgacaaacgaccgatggatgggagaggatgcagaagacaaccgccgaagaggaaggaggaggaggatacattcaactgaccctattcccatatatgccaactgtatagattgtattattgtatctcactgtatgtacagtatttgtcgcccggttatcgtttaagcgaccataatgtctgttgttggttgatcaccattatcaatgtgttgtatctctgtgttatcatttcaaatgatttgtgattaattgttggcctaatgtgtgtaaataatgtgaagaatccaaagatttgtttatgtttttgctcccttcgtgccttttcatgactttttttctcttgggcaaattccaggtcgaaaaacttggtcccggcctctcaggtccggtcccggtttttgtcaaaattaaacagaaaccttcaaatagcacttcaattgctttgatttttatttctcattaaagggcagtcaaaatatgcaagtgcattttttccaggcttttccatgctctaaattagtgttcagaccccgacccatccnccccgggacgggacaggtttttttggcctgcctcacccctgctcccgtgactcagactnccgcaaccctcgcccccgcgacctcccgcccccgcgggggtgagtactcttttcaagttctaccgtaaactgaaccctactgattttattatttttttataccgaggaaagtctcaagc

SEQ ID NO: 102 - DNA, 4914 bp, Heterodera glycines
cattatgacacttggacattttgacgggcagcgaaaagcgcgtgctcaactgattgattagtgagcagaattccgcaagaaaataattgtaaaaggaaaaagtgatcagaaaattacttaagtgatcaatcgatcagaggtgaaaatgctgcggtaaacgattgattgccttacgccaatttgtacgcttcggttggtcaaaagtcctgcaaattgcctaattaaattaggcggcggttgcgcactctttcccaattctgcccaaatttttgcactttcatcaaattcccaaatgttagtaaaatttcctcaaaatgcacttctttccatttttgctgctgttttgaccctctcacaaaatgctcctccaccgatcggtccctttttgattgactcatgcgaaaaggcccaaatgattggtctccaaatcgaaaaggcaaatggcaaaatctgcggggacaaaaagtaaaaaatggttataaaatccggaaaattggcacaaagggaggggagagattccatttggcaaaagtggaggaaatgagcgacttaatcgaaccggacaaagtgagggcattttggccgcaaattctttgactaaatctgtgcaatttatgccaaaaaggaatttaaattgaggcgatacatcgactaaaagaatttggagccaaacacatcattcataaaaattagttttttttttgtgagatatttagaagctcgcacctttgttttatggctttctcgccgccattgaatggccagacccaggggcagtggaagagacccattcaaagcacgcagtgccagggaaagacgtcgcatgggcaacaaaagaaaggcggccgcagggactgctgcaaacgtgggttttattctgctcctgtgctattcggccttcaattgttttttcttttcactttttggcacttttccagcagacagagcgaaggtcgaaatttcatttctccctttttcaggtgcaagctgccaacaggcgccccatttgtctgatctgcttgaagaaaatgacccaagtccgtcaggtgcgcaccatctgtgaccacgtgttccactacgtctgcttccaccgttggctcaaatatcgtctgttttgccccgtctgtctgctcaactttcgcacggaattgtatcattcgggaaacgccgtgtttgagggcgcgtacaacgatggacacgttgtgctcatacctgatggtgaacaaagcaacagtggataagtgatcggcactcatctccaattgtgatcggacaaaagcgatatctaattttgtattgtacataaataggttattcggacaataaaactgtaatgtgcatttttaaattggctcgtggttttctaaattttgtggagggcaccgcccaactcgccgcacctttgtttcatcggctttctcgccgccattgaaaaaatgaatgtgaaaaatttggattcgataaatcatttaacgcaatattcttaatcagaactttttccctaaaatcgctgcaaaggaaagccgaaaattctggctattttttatcgggacaacaaatttagacaattgccagttgctgatgcgagcaaccccgaaaatccatgaatgaattttcatgatttattatggaaacattttttgcaatcaaaaaggtctgtctataggtctttaataaaattcacgtttcatcacagttaatacatattaggcgcaacaattgatcacaagtcatttgaaatgataacacagagacataacacattgataatggtgatcaaccaacaacagacattatggtcgcttaaacagtaaccaggcgacataatactgtacatacagtgagatacaataatacaatctttacagttgggatcatatgtgggaatagggtcagttgaatgtatcctcctcctcctccctcttcggcggttgtcttctgcatcctctcccatccatcggtcgtttgtcgtgtcatctcatcgcgtggttcttcgtccattcacgggcaattcggttgtactcctcgcggttgtcgcggtacatagtcgcaatgtcctgccgcagcgcactgttcggattcgggtcacagagaagcgaagagatggagagcagcactgaaatggagggagaacaatgaattaaaacggcatttccgaatttgaaaaatcccattttcaaacaacaaaatatcacacttttccaaaaagtacagttttggctgtcgttttgaattggaccatttagtcttgtcgatattttgttggcgttttgtctgctatttcacctttcgaaatggtcaacgacggcgcccacatctgcttcagaatgtccaaacaaatgtcgcccctttctccaacgttcggatggtaaacgatcgtgtcgaatttcacatttggcggagtgaatgggtagtcgcgacggaaaacgatgtccaaatggaaggtgcctccttcgtacggcgactcgggcggtcctttgatggaggccttccaatggtacaagtctctgccgtcatccatcggtgccgcggtgtaacccgtcgtgaccagttcctgatgcagctccgccagttcctggaaattggtcaaaacatttaaagcattggttgatcagagagttgtcatttgccacctttttgatgcgtcgacgtgccattgcgaaaacggcgagcgaattgatgtgaagaacggaagaacgaacgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaattttgataaatttaggttcaaatttggtagtataggccagggaaactctgataaactttcaggtcgatgtcgataatttttggaattcgggttgggtatttactggttaagataagaaatatgtctttttgaaacagtgaagtttatgaaattcacaaactgaaaattgacgaggaatcagaaaaacagagtaaaacacccataaaaaaaagtgtgaatgaaaagggaggaaaaaggggcacaatatttatagtacgacgcaacaggggagggcaaaagttaggtaggtacgtaggtaggtaccattgcccaaattccaaggttttctctctatataaggaggtgttttctcattggactgacattttttgcattacgcctattgctttgcttaattgttccctcctctattcagtccttaatgttctgatttaattttctgtgttacagagtacgcaaaatataattaacccgaatgtttccaattgttttttcaatcaaaattgactgtttctcacagaattttcctgctggacaatctaaacttggaatttaatcaaaaaaacacaaaaaattgcttttccctatttttaaaatttataattcatttcattatgtattgtttttatgttttttccttttttagaacacaactatttgcgtttatcatcatcatcccttcattgtgcaacaacacttcaaaagcgacctcatcgccgtttctcatcgttcgttcgtccgtccgtccttcacatcaattcgctcgccgttttcgcaatggcacttcgacgcatcaaacaggtggcgaaatgacaactctctgatcaaccaatgctttaaatgttttgatccatttgcaggaattggcggagctgaagcaggaaccgatcacgggttgcaccgcggcaccgatggatgacggcaaagacatgttccactggaaggccaccatcaaaggaccgcccgagtcgccgtacgagggaggcaccttcaacatggacatcgttttccgtcgcgactacccattcactccgccaattgtcaaattcgaaacgcccgtttaccatccgaacgtcaacaagcagggtggcatttgtctggacgtcctgaagacgacgcattgggcgccgtcgttgaccatttcgaaaggtgaaagcgacgcgggaaagagcagacaaaacgccgacaaaatattgagacgacaaaacgatccaattcgaaacgaccaccaaaaccggactttttggaaaagtgtcgatattttgtcgtgtgaatgggatttttcaaattcggaaatgccgttttaattcattgtctcccctccatttcagtgctgctctccatctcttcgcttctctgcgacccgaatccggacagtgcgctggagatggacatcgcgattatctaccgcaacgaccgcgagcagtacaaccgaaatgcccgtgaatggacgcagaagcacgcgatgaaatgagacgacaaacgaccgatggatgggagaggatgcagaagataaccgccgaagaggaaggaggaggaggatacattcagctgaccctattcccatatatgcccaactgtatatattgtattattgtatctcactgtatgtacagtatttgtcgcccggttatcgtttacgcgaccataagtgtctgttgttggttgatcaccattatcaatgtgttgtatctctgtgttatcatttcaaccaatttgtgatcaattgttgcgcctaatgtgtgtaaataatgtgaagaatccaaagatttgtttatgtttttgctccctttttcgtgccttttcatgactttttttctcttgggcaaattccaggtcgaaaaacttggtcccggcctctcaggtccggtcccggttttgtcaaaattaaacagaaactttcaaatagcacttcaattgctttgattttttgatttctcattaaagggctgtcaaaatatgcaagtgcattttttccaggcttttccatgctctaaattagtgttcggaccccgactccggggacgggacagg

SEQ ID NO: 103 - DNA, 8214 bp, Heterodera glycines
caacaccagcaaaatttttcctttttggcatttcctttaatgtagtcttcagcaggaactccattgtgaacagtgactgttatattgtcaattctcccattgcgttgtaaatttaaaatattcggattcagctccccgtaacaatacaatacacgctcaattggtactgaaataattttgtccaagttacgtaataatctcattatccattccgactttccacttcccgtacttcctgacacaatcattgtgaatggatgacgaaactgtacatccgtatgatcaaaagtttcctccatttttaattacatttagatttaaaactctatatataacttttaattctgttaatttaaaaaaaatggatttaattctcgccactgattggatgaataacgcttacccggaaatggaacaggacaaggctaacatgtcaccaaaggaagaccctagttggattagtctcattgatgaagaggaaaagcgggagcctatagctattgtgcaaatcgatgaggaagaggagaaacaaagaaaaagtttgtcttttagtgttatttttttttaattaaaatttagatcctcccggaaattgcgactgtcgagagaagcgtcgttgctttattccgcttgttgaccacttgtgcaagaaatttgagtgttccgcccacgagttacacgtactcttcaaagacttggggaagcgtcgcgccatcgttgaacacctacgctcttctcaattgtgcacctcccacctgcgtccatcgatacggaatttcccagttcgctgcaacgatctctccattttggatgctcactcagtccctgcataccgtggttacctcggaatcacggtgtttattctttttattttttttatttctcaaaatattttaggttcgaatgcactattacatcaaacacggtattcgattgcgtcattcaaatttgccttgtgttgttgaatttggcggtggagatcataagactttcttcccattagaagctttgaatattgttatttagatgttttctgtatcaaattgtactgttgtttttaaaataaatgctcaaccactaacaattgaacaatttttgactattgcacaacatggagccaatactgagtacaacccacgccgtttccacgccatcatcatgcgaatccgttcatcaaacaaaaaaacagtggctgctctaatttttcagtcggcacgtgtcgtcctaaccggcgtaccccacccagacagagcaagagtgtttgcgaaacgagttttgcgaagaatacaacatacacaaaacaccatcttcgatatccatgagatgcgtgtggtcaacattgtgggtgtgaaaacctttccacaacgaatctatgtggagcgcctcgtaacaagactgggtggtgtttacgatccaagtattttcccagcacttcgatgcaaattggaaaatgatgcaacttgtctcatctatatctcgggaaaaatcattataactggtgtcaattcaattgataatttacacaatttatttcaatatctctcaagtgtgattcccaaattttttcgttgagattataatttttttattcattgataataaattttcaaaaccatccagaataacccggtcgagttgggtcagggtcaatcaatgttctctttcttcgttcagccgtaggttgtattggtggatgtgatacatcctccacatatccaaatggtcgtgtttgcattcccggtcgaacacggcccttggcgtagaaaggtctgtagtctttgtgggcctcgcaggtgtatacgtcagaacggacatttcggtcaatttgcgggaaagttactcggatgcaacgatgggctccacctcctccgtacacgtagagatcatcgttgtcgatgacgtcatcactaaaatttaaaattattagttgtgaaaattaaaaaaaaaaactgacataggtccgtcaatgttatatgtagccagtgtcagatccttcattgcttcaaaattcagtaattgttgagtggcgtacgataatctgaagcttcgtatttttaggttggcccgctcatcagttccgtctcgtgctgtgtgccgaattccataattttttggaccaccagctacaaattccacaattcgacgatcaacatgctcacgcttcatttgtccaagtgcctcgccttccggaacacaccgcccacccatcttgttcacgtagtagattgagtcagtgtctaaaattatctaacatttttttttctattgtattcgcaaaccacaataaagaagctcagccccttccagtgcaatcactttttccatgtatgaatagagatgaagtctcgcgtacgatgtgacgtatattgcgactggaagacagtttgtgaggggtgcctttgcaaactcgggacgcttcctgacaacaactcggtccatatgctcggagacgtggacaaagtccagtttgtctaatgttggatcgtccaagagttgatggaattccgctggagtgcgcgtgtactttatctgcgtgaaacccacgcgctgtgccatttttcccctaaacattttttttttgttcaaatagaagtttaaaaacgtataccacagagaatttgccaatgttttggcaatgaggcggagccctgggttgggtgtcattttcgttgagtctaattggatgccttccgtgcgcatgaaattatccacgaattctttacgttgttcatctgtctcacacccttccggccacccagtcgcttggactttgagaccaacgaatgtattgacatatttgctgaacaagtcgtcgtcccactcgtcatagttccaaaccttttttttttatattttttttttcgttatttttaatgtacctcaaagagatcaacgacaatatagccgagttgaagtgccttgttcaattccatgtgcgtgtatgcgcacacccaagaacgcttttcgtcaccatgttgacatggacgttgctggcgtctgtccgcacaccaagcacagagtggaaaggtgaaacgtccatctttggtgcgatagcccagcaacgggacacgaattaggcgcggtgcgagcactcgtacaagtaaaagtccccggaacatgttatttgacgaacatgtccagggaagtggggccgtgggtggatgaagcaatacctcacgcgtgagaacacgtggattccccactgggaaaggattcaccttctaaattcaaatttaaattcaaatttattgagaaaaagcaccatgacgtagggatataggctaactatatcaatgcacaatatctcttcatcgtctgagcacacatgatgaagtttgaagggctccgtacgaccaccacggagtgcatcgtttcgtggatccaatggacacgggacaaatactgcttcgaaacgctgcttgagctccaaatcgcgtcggagccgttctttccactcacaaccccatacgacgtgaagctcacatccatgggtatgttcgagttcaaagagtcgccgcatcgtcctttcgtataaatcctccgcagttctcccagcagccaacttttgtcttcgatttggaaaacagtcgggacatcctttaatcgtttaagatttttatttgaaaattaagacgataaaacaccatgatagtagcaacccatccactcgatggccagtggacgaagcggaggctctcgtcgccagaggccgtccacacgatagcctgtgtcttcaatgttggcctctcccacagaccaatccgcgcactgcacttgggctccagggttttcaagctcgaagaaccggatgtatcggcgggattcggcggaagctcgtcgtccacggaggtatcctccctcaggtgagtgaaccaaacggttgaacggtagaaaacaacgtcggagcgttgataaagccagaccagcagctgttgaagacaccaaaaagggatcgaggccctgagtgtgttctccgatgagttttcgaaagcgcaacacggattctcgaagaatggcaacatcatttatgcagtacatgatcagctgctcacggagttggaaacgagcatcaccattgttattacaatgccatcgaagaaatttttcccgtttatcagctttcatcgtgtttggtgagtagaattcgataggcggaagcccatcgagtcgttgatgtagatgttgtcgtttaatgtacaaatatggaaagaatggtttcacagttgcgagatgttgtggcagatcaaaactttttacgagtgcatccaattcacaaaagaagtaattgatggagtctttaaaagttattcgccgctgattcatgccacgaagcttcattgaatagatttttagaccgctggtgcacaaacgttttggtgggtaactccgacgatgtagtgcttcgagtaccagatgaaagtcgtattttcctccgttatgagcgatacaaatggtgtgtgcttttcttgatccatgatggataagaaagtcgagaaattggtctacggggtcagaagcttcgttatcaaaagaatgaaaaaataaacgacggttgttgaatacaggagctccttccggctgaggagtattatccccaggagcatttacaaaaggtggtgacatccattgacgcatctgttgacctctcactcttccacataggcaaacgcaaccgggtgcgcgctgaccttgcccatcgttgatgttgattccagctcgaatgcaaggttcacaaatgaattcagcaactattagcaaaggtacatgtttatgggcgacttggttgttgagctgtagtgggcgctcctgggatgtttcggcatcgaagaagcaaagacgaagtggtagcagttcatctcgctcatcatcatcatcatcattaatatcatccccgttttcaacatcatcttcatcttcatcaccttctcctcccagattgttgattatgaaatcaatatcattttcatcctcattgttgttgttgttgttgttgttgttgttgttgtcgtcgttgttgtgaacaggaccaagcattggtaaaggtggtgcaacaccaatcggttggatgtagcaaggttcatccaacatatgtggacctttgcaacgaaagcaatcaactggcccaatagcacgacgtatcgaggggcattgatggattccaaaataggcaacacgaccgcatgtgggacaaaaacgtcgccattgacaaagtgaacgccgttgtctatgtccgcgcccatcaattggagcaggggcatcattcgccaaatgatattcataacagttgtcatttgggaaaatgaaaccacattcggtacattttcgtgaactgatctgaccatcagacaactaaaaaaattttataactgaaaaaaataagctcaaattaaaacccgttctcgttgacacgggtatccacccccgaatcgaaaacaaagacgacatgccgccttgcaaccaatcgcatggtaacgcgcgtctgctctccgttcacagtcaatgcagtatccaggaaccttgaagagctgtgcaattcgtccaatatagttgaagtgtcctcgttctagcaggatacataaattgaattgcgctgcagttcttcaaatgtttttttttaatttagataaacaaaaaaatattacccctctcccttgaagacaatacggtattcttgctccttttcgaagattacaaggcgaatttgtcctaccccattctcattattgatatattgttggagttgcgcaacatcctccagtgtgtacatgtgtttgtcaacagaaacaccggctcttgtaagcaaatgaacggcctgagtcccatgttggtattgacgacttgcgtatgtgttgaacgctccacgaccacctcaatttggcatttgtgtctcacgatcacaaagtccaagaagaacagcacgcgcgaggcagtaacgatcgttggggttcacaacacgaactattgactgcacgttgtgtgataagtgatgttcgttatccaaatcgcacgcacctatattttattttatcaaaattttaaattttttttttatcaaccccctcgctgagcatcgacacgaacggattccaaaggccacacagcgagaactttggtgacggtcgttccagaaagcaagtctattccagcggccgattgctcattgagtctttcgatagctgcagcaagtgctgccgcgttgttttgttcaggtggccgaagtcggatcacgtagggtcgatcaaaccccggcggttggagctgcagtccaactaggattggactcgggtgcccctctaagacacggtcgagaaggtgttgaatgaggatctccatcacaaggtcgggacgctcattgtcctccaaaggcaagaacctgatttcacacacttcccctctcgtgtttctcagtgtgtttctcattggtgttgtacgttcaattacgaaggagtcatcaatcgaacgatccaccttttaaaatatcgttggactaatttgtaaacaatgatctctgatcctggcctttgttttaagagcaaatcagttacaataaaataaacgaacactttcacccacccttctctcgggaggtcgcgtacggattggtatgccaaaacggtgatgaagtgtctaatataatttttattccacagaaattataaaaatgctgagaagaaatatcatttcctcacgttgttattgttcacatcctcttcattggtttggttaaaacggagctgattacgtgaaccattcaaatttccatttacctatatattttttttaaatttttttttaaataaaatcagaccacttcattgcgaccacttcccgtctgaatttgcaccggttgagccttaattaaattatacacaactttagttgatttttaaaaacttgaatttgttcccccaaaatagatgcgattgagtgacgaagtccaactgattcattaggacgagcattggttgtttgctaatcagtgatttttttttaataataataataataataaaaattacctggtgtattgggtgaggaattatggtagcatttctaccatcaacgccaattcggtaccaacaatccagtcgctgataccgtgaacgtgccatacagttcatgaaccagtaagcagttccaatggacaatgacgccaaaacacccgcttgagtttgccatcccgaagcttcaatccgatgaccatcggcattgcgcaacacaacattagtcacagaaagcaatcctgcgggagtctgttgttcgggccggtgatcaattgaaacaacgatcaggcagagcggtcttggaacacaaatttaaagtcttcaccatcaaaaaaacatacggtaaaggttggccaatttgggtaacgcatccattcaagaactgaatattgtgcgttccatcggtgcagaatacattcttgaacaattatggaaattaatataaatgacaaatctatgttggctagtcagatcaattgagtaaaacaacccattttttttaatgatatattaatattaaatgtgccaaaatatacatttccaagtgctgactgtccttgctgaagttgattatgattggagtttgccatggagaaaaatttaaatggtaagttcactaattcttataaaaataaaaataaattattaattattattattaatgaattcataaaataaaatggaacgaagtaaaaattcaaattttttttttattggaataatagtttaataactctggattaataaaaggaaaatagtattaaggttttagtgatgctaataaaattaaaattaaatgtaaaaaaatcataaaataaaataaatgggacgaagtaaaaaaaattaatttctattggaataattttttattagttttttaaaggttaataaagtgaaataacaaaaaaaaaaaggtggggggtatggtatggtatgctatggtatgatatggtatgttatgttagttatgctagttatgttggtatagtattaagtagggctaggatttttatgttttaacatattttttttgcggcttagttatggcgagagaagcccaaaaatagcattttctccgaacaatttttggtttagagcgacttataaaaacataaaaacacatattttggcgttttggcacatataatatgttagcacatattttggaatgtggcacatattttgcgacatattttggcatttttgagaa

SEQ ID NO: 104 - DNA, 3878 bp, Heterodera glycines
attcatttccatgcgcacctccccaaatttcatgcgctcattgtcctgtcccaattcccctcgcacacatttacttgttgtactgctccaacttcatgtcctcccaatttggcccaatttttaccatttcatttgtgatttttgtgtgatcagccaatagggccattttgcattcacattttattttgtggcctttggccggattttcctcccccatttgtccgcccattgtccactttttcggtttaattacccaagtttgagataaaatttggtgtgaattttcctctgcacttgcccccgtttgacccccggcacatttcccgtcccactttctgcttcctctcctggcaatttcaacgcccgaactcctcgggccttgtcgacaccaccgcggcgacctgcaccgcactcaacgtcaagcgcacacggccaactccaagcagctcaacggagctcaactcaatcaatcaatcaatcaacgggtggtgatcggacaagtggcgaccctggcaggacaaaccctcgacagcaccagcacaactgagcgacttcaagcagtattggaactgcaactggtgggaattttttgaggaaaattccaaaaaaagtatcaagtttgcgctctccgtagccaaacttgaatacatcaaaaaggggggatcaaaagtgggaaattgtggaatactgcttggtctccgtgccagcagtagtttcacaggggaaacagtgacttactattttggtcttcgtgccattagtatttcactttcaaattacttattggtctttgtgccataagtaatcggtaaaattactgatcggtctctgtgccgtcagtaattcaagtactgctcgctcttcgtggtagcagtacccaatccaagccaacaaaagggggatcggtgtgaactgtttgctctccgtggcaacagttgcacattcaacacaaacaaacaagtcaaacggcgggaaccccaaggtgtactgcttgacctctgtgtcagcagtacaaccacgcaagtgcagcaagttcagcaagccaacgaaaagcaaagcggcaaacgaaaagtacatcaagcgacacaacaaaagcagcaaagcaacgacaaacaagcagcagccgcacacgagctgatcaagcagtacagcaacagcaaaccaacaatcaatggccgcaccaattcaacagaaactcggcgctgcactcaaagttctctcccgcagccgaactgcggcggagctgaacatccaagccgaccaagcggcatcaaatctcgaaaatgccctcaacttcgaaattcaattggagaaagttcaaaaagatgccaaaacgatggacatcttcctcgacgatgtgcgcgaagcactcactgcatgggcagatttactgcgcaaactgcctgcactggaacgcgatccggcagaagcagacttcaacaaattcgagaaaaaagagcgaatcaacgacaaagtcgacgaagcagcactgaagctgcgcgacttgcgcgacttaatcggcacactcacgtttcaagcccgactcttccgcagcaaggcggacaaagaagaaagggacgctcaagcagcctatgcacaagcaacacaacataccgcacagcaacaaacaacaaagacgccgtccttcactcctccgttctaccaatttcaacccattcagctggacaagttcttcggcaacaaacgcaaatggccggagttctacgaatcgttcaaatcggcaatcggcacacatgcgctcagcaaagcggagaagttcaatctcctgcgcaacctgctcggaggagaggcccgtgaactcgtggccggatttcggctggaggacaacaattacgacacggccctccaattactgaaggacacatacggcgcaccggacgaacacatcagggcacttcatttcgaattggcaaacctcaagccctgcaaaaacctgcgcgacacaaaagaattcctcctgcaactcgaaaggctcacacgcgaactcaacaactcaggagaagacattgaaggcccaccaaccttccttatgcttgaaaagaagctcactcccggatttctacgcacaatcctcaccaaaaagggagaaaatccggcacactggaacaccacgaagttccgagacgtactcaacgaagcggtccgcaaagaaacacaaattcaagaagtcatgggcgagtacggacactcgcagcaacaacggccgccaccgcaaaagccaaatttctcggcatcgaaattccgagaccgcgcaccaatcccgcagcaaagggaacgtacattcatcacatcagcagtggatgacaatcacaaaaggctgtatggcagacagcctcaatataggccgcagcaacaaaggcctcgcgcaccacaaacgcaacaaagaaactcgcgcactttcaacaatcgaacgcaaattccagctcaacaggcaaatgcgacattcaatcaacgcaagcctccaagtccgtgtattttctgtggtaacgaccactggaacgaagaatgccggaaattcagcacaattcaacaacgaagagaagtgctgcgcacaaaggcattatgcttcaaatgcctcaaaaacaatcaccaagcaggaaattgcccgcaaccaaaaagatgcttcaaatgcaaacaaccacatccaacggcattgtgccacggcgacagcaagccaccaaaccaaatcacagcagcaatgtttggacaaccacaacaaaacgtgccaagtacaagccaagcggaaagcaacgaacccgcagcatcaacatcacaaatgtgcaatgccgtaaacggaagcgacactcgcgcactgctgatgaccgcaacgtcaacggtcttcaatccagcacaaccgcatctcagcatgactgcggcaattttcatcgatccaggcagccacagatcattcatttcggcaaaggcagcacagctactggacctcccggtggtccacaccgaagaatgccatttgaccagcttcggagaacgcgaaccgaagagatacatcagcgatctagtcaagctcggatttctctgcacaagcggggaaaagctcatcttcaatctcaacgccatgaaattcttggtcaacgacatgccaatgattcaactgtcagagttggacaagacagaattgagacaacaaaagctcaatcctccacatgagcaacgacaaccagacatcatgctcggaattgatgtctggcacgaactgcaggttcaaccaatcgaaaaactgccaagcggcttcacactgtgccgttccaaaatcggcaaaatcttaagcggatcaggacgcatcgaaatgcaccaaacgccgaacgtgacattcgtcatgtcagtccatggcactgaccaagaaggagccaatcaatctgttacgttcgaatcaaccaaagaagataaggaagtcttcacatccgaagatgatgtcaaaaaggacgagcagctcaacaacttcttcggattaaacctgatcggcatggacgacacatcaacaccaactgatcaagatcaagtgatggtctacttcaaaaagaacctcacattcgtcaacaaccgataccaagtcgccttgccttggaacgacagagtcgatgctcttccaagcaacatacatcaagccaaggccagactcgtttcattgatcaaaaagctgcgcagcctcaacctgattgacgaatatcagacaattttggacgaacaaagtcgacagtcggtcatcgaatacatcggcccacctgagtcaccatcaagtgcatggcgcactgcatttttgccacacagagcagtcatcagagcggataaagcaacaaccaagatccgaatcgtcatggatgcgtcagcaaaaccaa

SEQ ID NO: 105 - DNA, 3765 bp, Heterodera glycines
tggccgcacacgacggcacaattccaaagctggaactccaagcactgactctcggagtcaaggcagtcaaattcatccaagcgcaaatcaaatttgccgatcatcaagtcatcatgtggacagacagtcaatgctcagtcgaacgacttcgagaaaacaagcgccaagatcgatttgtggtaaatcgattacaaaaaatccgagaagcgaacttccaagtccgacacgtcagaaccgactcaaatccagcggacatggcatcaagaggagcggatcctcaatgccttcgatcatcactgctttggcactttggccccgtttggctttcgaaagcagacaaatggccaaaatcaaacgtcatctaccggcccggagatgaattcaaagaagtggaagagccaccaatcatcgaactgacaacacctgttcatgtcgaagaacagttcaaaccatcaatccacttcgaacgattttcgaattggaacaggctgaaagccaccgcagcacacgctatgcgcttcatcaaaaagcttcgcacaatcgaaaacggcacaattagtgaaccgcatcaaaacaacaaaccactgaccatggcacaactgcaacaagccgaaaattggatcttgaaagaagcacagcggcttcatccaccatccaacgaccaaatccgagaattgcaactcttccgacaagaaggaatttggagatgcggtggacgactcgaggaagcaccggatctgccatacgacagtaaacacccaatctttctgccgccacacgcatggataaccaagctcatcatccggcattatgacaaacagctcaaacattgcggtccgagaatactcctgtcaacattaagagagaagttctggataccacgcggacgcaaaacagttcagcaactgctcaactccccgcaacacggatgtcttgaatgtcgtcgagaacgagtcaagccgtacatatatcctgaggcatcggatttgccaaggggaagagtcagcgaagcacgaccattcgacaaaacgggagtggactacttcggtccactcaaagtcaaacaaagcaatgacgtggtaaaaatctacgtcgcactcttcacctgcttggccatccgcgcccttcatttggaagtagccgaagactactcggctgaagcattcctccgagcctttcggagattcacggccagaagaggcataccatcacttatcatgtccgaccaaggcacaaacttcgtggcaggagcaaaagtcatcaaagaaaactggaccgacacgttaatgccggaggacatgcaacaacaaatggctcaaagcggaatccgttggattttcaacacagcccacgccccttggaaaggcggcatttgggaaagacttgtcggcatcaccaaaaacgcactacgaaggacagtcggcagaaaccttctcacattggacgagttcggcacaatgctctgtgaaattgaagcgatcatcaacaatcgaccactcacgttcgaatcggatcaggaaccgatcaaagtgttgcgaccaatcaacttcctgataccatacagcaaagcaaacaacaacttcccaatcatcaatgacgacacagacgatccaacatacgagccaaacccaacaaatcgcgacaaaatggtgacaacactgagccacgttaatgctcggctgaacaaattctgggaaatttggaaaagtgactaccttctttccctgcgcgaacacgaccgaccaaatgcaacgacaggactacaaaccccaaataacggcgacatcgtgatcgttgaagacgaccaaatgccgagatccttgtggaacttggcgagggttgagaaagtcctaataggaaaagatgggagagcgcgcagtgctttgataaaaatcaatggaaaattaagggatagggcaataaaccaattgtacaatttggaattgagccctaaggttccagagcaaccaattcaacaagtccactgcctcatcgcatcaatcatggaagactcagtctccttagccggcagtgacgacgaagaacaacgaccacgcaacaccgaagacttcaaaatcccaaaacgccgctcagcattattacgacccatcggagaacaacaaagtccactgcaaggacaacacaaacgccgcaagcaacttcacgactccggattgctaaaattgttccatgcaatcgcggaccaacaaggaagcagcaaggccacgattcaggccatcgcagaaaacagagaagtgcgaaaagcgccacaacatgagcaaatcgaacacgaacaacaaatggtgcagaaagcgcaaaaagaagctaaacgacaccttcgcactgagcaacacgaacgagaaatgccgcagccacaaaaagaagaacaacaacgagaagccgaacgtcaacaaatcgaaaggcaacaaaacgacgaacaacgtgccaccaatcaacaagcacacagcaaggcatggcaagaattagcacaacaatttgactatgatctgatggatcagccggatccaacagagaagcacgcggaagaaacggatcagtcaacgaaatcaaagcagcaatcagcaaaggacaaagagcttgaacgacatcgaatcggcagaaaaaagactatcgacatgcaagagaagcgacaacggtcaagagacgaatggccagaggaaaacgaaacgctactcagctacgttcaacgcatttacggaccggagaattggacgtcagcatggcaaagaggacgtgttctccgagaactccatgaactggaggaccaagggcgatggatgattcatcataaaaccgatcgacttcaactcagcgtctcacgactgtatggaggaaaacgaccattcgccgagttccgttttgtggacggcggatactactcacacatggtgccagaagatgtgatcttcctccaggccgtgccaaccgaagaaccggaaatcataacgctcgatgacacgccaacaacagaaaaaacggccaccgacaacgcaaagcagccaaaccaaccaaaaacatcggcacccacaatcgaagagtaccgaatggccgaccccaagccgaacaacttcaatgaattcaacctgtttgagccgtgtgacgactctcacacaacctgcgcaaaaacggcaacttacggatcaatcgccagcaaccgatttcaattggaagagttcaacaactgccgcgcgaccaacttcttccaagccctaatcttcaattggctcacccggaacatgaacctgccagctgatgaaatttgggcagctcacgacaactacacacaactcaacgtcgtaacggaagaaatcgccaaaaagtttcaccaacaacaagtcgtcagcaaaagacgacaaatcggacgcgaccagcacttcacagaggtcatcaatgtctggcgcaactcatgcgatcgcttcggcgagctctacaatcaaccggcacacaaacaagtcaagtttcgaccaatcataccagaaaaggagcaaccaagtgactacgaggaatggatcgagcgactcaacaaccgaacggcggaaatcctcacaaaagctcgagcaaaagtgcagcacccgaccttcttgaactacaattgcacaaccattctcatcggagacaacgtggcagaagtgtttaagccactcttctatgacgccaagtggttcacccacttcccagcagacgaattccgacttatcccgggaccaaaggtcaaacacatgatctttgcctaccaagcaactg

SEQ ID NO: 106 - DNA, 5747 bp, Heterodera glycines
acgtcagcatgtcaaagaggacgtgttctttgagagcgccatgaactggggggtcaagggcgatggatgattcatcataaaaccgatcgccttcaactcagcgtctcacgactgtatggaggaaaacgaccattcgacgagttccgttttgtggacggcggatactactcacacatggtgccagaagatgtgatcttcctccaggccgtgccaaccgaagaaccgaaaatcataacgctcgatgacacgccaacaacagaaaaaacggccaccgacaacgcaaagcagccaaaccaaccaaaaacatcggcacccacaatcgaagagtaccgaatggccgaccccaagccgaacaacttcaatgaattcaacctgtttgagccgtgtgacgactctcacacaacctgcgcaaaaacggcaacttacggatcaatcgccagcaaccgatttcaaatggaagagttcaacaactgccgcgcgaccaacttcttccaagccctaatcttcaattggctcacccggaacatgaacctgccagctgatgaaatttgggcagctcacgacaactacacacaactcaacgtcgtaacggaagaaatcgccaaaaagttccaccagcaacaagtcgtcagtaaaagacgacaaatcggacgcgaccagcacttgacagaggtcatcaatgtctggcgtaactcatgcgatcgcttcggtgagctctacaatcaaccggcacacaaacaagtcaagtttcgaccaatcataccagaaaaggagcaaccaagtgactacgaggaatggatcgagcgactcaacaaccgaacggcggaaatcctcacaaaagctcgagcaaaagtgcagcacccgaccttcttgaactacaattgcacaaccattctcatcggagacaacgtggcagaagtgtttaaaccactcttctatgacgccaagtggttcacccatttcccagcagacgaattccgacttatcccgggaccaaaggtcaaacacatgatctttgcctaccaagcaactgccgacaacatggcggctcaaatcgcaccgatgctccaccgatttctgcgatcagacatcgaaatcacactgatcgtagccaaggacgacaatgcgcaatggatcaacaacaagaagtacctgatcgatatcacccgcgaattgaaagcgggcttcttcgttttcaatcgagaaatgggagaagcaagacaaatcgccaaccggatccgacaagccattccggaaccaatggatttggaacaagagctgggaccatcgtcgtcaacaaacacgtcccgacaaggtccatcaacaagccgacaagtgatcagctcgctaatgctgatcagcatgttttgcctactcttcaccggcacggcacaaggactaccaagtcgacaaaagcgaattacgcaagtcaaagcatggcatggcggccatgtttcaaatttcctcaacatcttcacggagcgcgaccgacgggcatcaacaaaatacagtccttacgtccagcgatacatagacaaggttctagcactgaaccgaagtctgagccaatcaacaaatccgccgacatcgacaactccgccatggacaacgacccaacccacaacaaccacaagtcgtccacgcacaacgacaacaaccgcgactacaacgaccacacgcacaacaaattggccaaccagatcaaccacacggccaaccgcacgcacaaccacgacatcgccaatgccatggtcaatggaccaccgaacgacaacagtatcgagggtacggcaacaacaacggccccgtccaggaatcaaattgattcgctggcccaagagcacaatcacaaccgaaaaaggacgcgacgtcttctggtgctcgaatcacggcagcactctctgggaacttaaaggtccggaaaactcgccattctgccgtccaccaccggcacttactgcgcaatggacaccactgaccatcacactgtacaccaagatccaccggccggaaccaatcgcaacggcatggcactgctccatcaaaacgacgacggaaaattattacacaaacatcgtcggcgataagttcgtcgaaatcaacaaagaatttccgttggtctccaaacgactctgccaacgaatggcacatcagcaagaatgcccactcgccaaaacggaaatgcaccacgatgataacaatcgtatttgggcaacaaacgaccaactccaagtggatttccctggaccaatcaccggactcttcaaagggaaacaaaccagctcggcaacaaattgctttgcgcaaccagcaacactgttcgtcaaatggcacagtctccaactcctgtcgccaatccatcgcgcagaccactgcaattacgcctccgagtattgccaactgcaagacaacaactcactcatctggacttcagcatgtccaaacgacaactgcttcatgtgcgacttccaagaagccgaagaaatccacggagaattcaccaagctcaacggtcaaacaacagcattttggatctcggaagaccgacaaaaggcactgaccttcaccgagacacatgcagttcaagcatgcgacgggagacaaatcgtcctatcggagcagaacttcggcattccaaaagagcaatatgacatcatcatgagcaaccacacaagagagagacgcaacgtgcaacccgagcaactcgcttcgcagctttcagctgctcaacttgccacaacaatggcactctcgcagctctatttgaaggaatgccagcgtaatgtgcgtgtcagcaacccaacgcttcagacacggaaactcctcaagcgcgataatctgcaagctcgatggatcagcgaaacaacaatcgaagtgtttccctgcgttccaatctccctctcgaacatcagctaccgaacaacaaaggactgctacaagttcattccggtcacaatacatttgccaaacgcaacaagagatgcattcctcgacccggagatgcgcatcctctcactcatctcaaagatcgcaagttgctcaccatttcgctaccatcaccttcaagtgcaacaaaacccaaccttgtgggttcgaatcgactcacgaaatggaaacgtccaacgactgtcacaaacagtcatccatgagctctacgagacgatcctcaacaaaacggacaacgatttggatctccacccactgatcttccatcagtggcagctcgacaacgacaccgatttcgccagccttccgcacatcgacgaattcgaagattcggaagagttcaaaaacaagctggaacagcaaacaacgcaacgagcgcaagcactcggcgccttacccggcggaatcgaaggatggaccatcaaatggttccaagaacggctacaggaaaccattcaatggtggatacgtctcgcctcagcatactccacattcctccttttccgagacgtcatcctaccatgcttaatcgcctacttcctcaacccaatccgcatcacactcatgactctgattggatttcgaccaaaaaatcagccaacgcctcaaatccaaccacaatacgaggacatgccattgcgggagatgccaagcactccgatccggcggaaacgacgacaattgccagagcaatcgactccgccaatccgactggacacgacgacgggaacggcatcattccgaacacgagcgagagcgcacagcgcaacagaggacacgcccttcggacgcttgcgaccgatgaaactggcggacgactgatgggcccaaaacaaagaaccaagagggaagaagaaagagagaagaaggaagaacggatgagcccctttttcttgccgctcgggagtgtcgaaacacgggtttcgaaaatcaaattatttgatttgtgccaaaatgcacatcgaacaaaaaccaaaaatcaattcaatttaaaaatggtccgatgtgcaattgccgccttatcagcggctgtcactcccccccgcaaattccgttccttatcacccaaaaaattctctccccattttccgtccctttttaatgtgtgcttaacaaacagcacttcatttccccaaatcaacaacaatttgttggccgaacagctccaacccctcggcccccgttcaccgccatatttgtcccattttttggccccctctggccaattcatttccatgcgcacctcccccatttccatgtgctcatttgtcctgtcccaattgccctcgctcacatccccttgttgtactgctccaacttcatgtcctccaattttggcccattttcaccatttcaattgcgattttttgtgtgatcagccaatagggccatttgcattcacattttattttgtggcctttggccggatttttcctcccccatttgtccgcccattgtccactttttcggtttaattacccaagtttgagataaaatttggtgtgaattttcctctgcacttgccccccgtttgacccccggcacattcccgtcccactttctgcttcctctcccgtcaatttcaacgcccgaactcctcgggctttgtcgacaccaccgcggcgacctgcaccgcactcaacgtcaagcgcacacggcgaactccaagcagctcaaaggagctcaactcaatcaatcaatcaatcaacgggtggtgatcggacatctcccgcttttttgtcacggtgaacattttggacaacatatggtaatttgcgtttcgatttccatagcaaacagttttttctcctaattaatttataattttggccaaacatcgcgtttatgcacatcaaattttttttgttataaaagaccaatgggaaaaataaaaaaatcatttaaatgaaaattgttttctcctaataattaaaaaaacagaaatttttggcattcctgatcacatttcatcgtctttggtttatggaaaaggctccaacaaacaaccatgataaattgaaaaaattaaaaatttctatccctaaataagtatataaataaaagacacgtgcaacatttaattcagcgctggaaaagtatacaaatttttgttatctcccgcttttttgtcacggtgaacattttggacaacatatggtaatttgtgtttcgatttccatagcaaacagttttttctcctaattaatttataattttggccaaacatcgcgtttatgcacatcaaatttttactatatatgttatattgacaaggagtttcgtttcaaaaaacaaaatctcccggccgaaggccgggagcgccctgaaagtggtggaagggtcttacaactttttgaggagaatccgggaaaactatagagaaaaattctgcgcggacgactgagtcccgggaagtgatttctcattttttcgtgcatttgggggcccgtaactttttttctaaaacccaaatcaaaaaatgtctgctgtgagggggctaagttgaagtgttttctaaaaaacaaaaaaaattccaagcctctatctgcaataggaaaggctgtaggttcgtggactttttcagtaccaactttgtccagttcagtcccggttgaataactcattagggtttgatctgggcggggagttaccagcagacttattgtagagttttgaaagcccgatttttccaaatttaaaaatttcgaaaattttcaaaaattttcgaattaggcctattaaacggttttcgggtttttgaattttaggattttttaacgatttttccccagagaagacct

SEQ ID NO: 107 - DNA, 1699 bp, Heterodera glycines
ctatccctaaataagtatataaataaaagacacgtgcaacatttaattcagcgatggaaaagtatacaaatttttgttatctcccgcttttttgtcacggtgaacattttggacaacatatggtaatttgtgtttcgatttccatagcaaacagttttttctcctaattaatttataattttggccaaacatcgcgtttatgcacatcaaattttttttattataaaagaccaatgggaaaaataaaaaaatcatttaaatgaaaattgttttctcctaataattaaaaaaacagaaatttttggcattcctgatcacatttcatcgtctttggtttatggaaaaggctccaacaaacaaccatgataaattgaaaaaattaaaaatttctatccctaaataagtatataaataaaagacacgtgcaacatttaattcagcgctggaaaagtatacaaatttttgttatctcccgcttttttgtcacggtgaacattttggacaacatatggtaatttgtgtttcgatttccatagcaaacagttttttctcctaattaatttataattttggccaaacatcgcgtttatgcacatcaaattttttttattataaaagaccaatgggaaaaataaaaaaatcatttaaatgaaaattgttttctcctaataattaaaaaaacagaaatttttggcattcctgatcacatttcatcgtctttggtttatggaaaaggctccaacaaacaaccatgataaattgaaaaaaattaaaaatttctatccctaaataagtatataaataaaagacacgtgcaacatttaattcagcgctggaaaagtatacaaatttttgttatctcccgcttttttgtcacggtgaacattttggacaacatatggtaatttgtgtttcgatttccatagcaaacagttttttctcctaattaatttataattttggccaaacatcgcgtttatgcacatcaaattttttttattataaaagaccaatgggaaaaataaaaaaatcatttaaatgaaaattgttttctcctaataattaaaaaaacagaaatttttggcattcctgatcacatttcatcgtctttggtttatggaaaaggctccaacaaacaaccatgataaattgaaaaaaattaaaaatttctatccctaaataagtatataaataaaagacacgtgcaacatttaattcagcgatggaaaagtatacaaatttttgttatctcccgcttttttgtcacggtgaacattttggacaacatatggtaatttgtgtttcgatttccatagcaaacagttttttctcctaattaatttataattttggccaaacatcgcgtttatgcacatcaaattttttttgttataaaagaccaatgggaaaaataaaaaaatcatttaaatgaaaattgttttctcctaataattaaaaaaacagaaatttttggcattcctgatcacatttcatcgtctttggtttatggaaaaggctccaacaaacaaccatgataaattgaaaaaaattaaaaatttctatccctaaataagtatataaataaaagacacgtgcaacatttaattcagcgctggaaaagtatacaaatttttgttatctcccgcttttttgtcacggtgaacattttggacaacatatggtaatttgtgtttcgatt

SEQ ID NO: 108 - DNA, 10042 bp, Heterodera glycines
aatttgcaggctaatagagcatctgaagggctttcgaatgataccaacaatgttggatttggatgacaatgctcctcccctctagaaaattttcatttggactaagtttgaaacagaatttttcatgtttctttcaccctgttttaggtgtttttttgctgtacatttgctaatttttcaacaaattttcccattacccaaacaatttgaacgataaaatgaatggccaccaaactcatcatacaatgacatcaattgcggtcaggatggacagagtaaggagagggtgggtgaaggtgaaaactttaggaacacaacttttaaattttgtaaatttttcataattttgattcccccccccccccatacaggcggcacagaatcgcattgaccgtcacaatcaggtccgactgcaccattatgtggtgccaacggttagttttatatcattgcatgcggatttggtataatttttacaaaaatacggccattttagatttgtccaaaaacactggcaacttttttttaatataaatttttcaaaattggagagtgttgccctcatccattctaaaaattcaagaaagtgctgaaatttaattaactgtcaatagaagagcaaagaatttcataggtgacaaccaataaaataagcccgtcaattaggttttttacccgctatgggcaatgttaaaaatttcatgaaatgataatttatcaaaaaaaaaatttttttttgttattcaagcgagagaaactgcgggctcccgacaagtggtccgaacagtccgactgcatgcatttgtgcatcaacgtgggcggtgcggtcgcggaagggacgcacgcggagagtgacggccggcgactgactgtgacggtggtgcacgcattcgggggcaaattgagtgtcagaaattacgcattactcgctgaaattgtgccgtcgcaaagcgaggttggttatgcctgtatcagccttagatcgtataggatgccaccagggagggtccaggcacatatccagaatcggaagacgaatccgaaaacctttttttttgctctggtctgaaaattttttctccgatgctatttttcaaaaattctgcaccaaggcgaaaaaaaaacaaaattttacgcccttttacaacaaaaaatgacaaatttcgccattttggaatcacatttccaacaattaatggtccaatgggaattgcgatgcggttattaggcgccgcccggaattttttttcaaatcttaatcaactatgataagaaagccaatttttttttttaatttgcccaaaatttttttttcatttcggtaagcggggggggggggcgtccccaccctttgtctcctggccaggcctgatgcttgtgccagcatctaatgcgtaggctgccaccagggactgtcgaccgttttttcattccactgccacccgaaaacccaaagtggacctttatatttgagaattttctaatttttttcctgttatcacgctctgactttttaattttaacttatttcagcattaaattgtttatttccacagatgctgatcaccgtaaaagaggtgacgttggtgctgaagaagcgaatgcaacagaagacaccgccaagagaatggtatgaccaatgtgccgagttggaggacaaaatgatgggccaaattgaaaaaaaacgggagaagagagagaaagcgaagagttggaaactgcgcgaaatggacgacgaatgaatggatgaaatgattttttggattccatcttttttaatttacttttcaaattctacgcaattatcactgcaaataaaaatatatgggtagtgttgttaaacatatgaccaccccaaaaagggagtgcagttggtaaaatggtttgtaactaataataacatcttgacagggatagtgaatggtatcattataaagcccacaaaaaatgctacaagaaatataaaacatatatacacaatatagtcatattgagattttataatcaatttaaatcaaatttggtagaaaattttgagtgttgttaaacatatgaccatgactgtagatacgcaactaaataactgatcattgatcacttttccgatcactccccccccccccccctccgtccgttcgtcccaatcagccggcaaaactgctctttggcccacacttttccttggctcgtgcgccgccgaccgcgtccatttcgtccgcgcggagccaatagcgcagcgcggacaccacaaacaacgccttgccgaccgcggcaaaaaccgtggcatgtgccatgttttggaggaaccattggccctgttttaaagttggattaaaaaataaaatgcataacaactgataaaaagatgtataggattaaaattttgcaatcggattattttcaaaaatatttaaataaatatataaaaatttagcaaaaatattttcataattttcaataagtaaacccttttttaatatatgcttttgaaatattatttaagtaatggaaaaaacatacaattgaggcaatgaagtatttggagtgttccaatgcacaaaattgatgtggctaaaattgggattggatgggttaagccaatgaatttccaaatgaatttttgtatccgaatttaaaatgcttacaaaaaatattcgttcgtcagataatgagcacgattcaagataaaatacaaaaaagtgatcaaattcggatagtttcttggcttttggtttattttatacaagagcaagcaaaagatttgctgtactgtcactttgaaagaatggatactttttgcctcacctccaatcggctgatcagccacagctcggagtacttgaagccgctcatgaacacaacggacatgcccatcaacagctgaaaatgatcaattttagagatggtttattaatagcgcttttaactttttagatcgttccctccctcggtttacattttatgccaagcgacttaatttttagtcagagatttgctaaccgatcggttgataagtgtatcaatgtcttcaaccaaggtttttggccaagaatcagtgggtcgggaatgatccgtttgtcttttggcaattttttttgaaaacattcttttcaatttgattgggccattattggctttgttttacatagtcaatggattcccacgaggcgtcgtacggcaccacggaatttgcgtaggaatggagcgcagtcggtgccaacaaagtgccgacagcgaccaaataacacagcgcaaaccattcgaacgtttcgtcgggcaatgccacgcgcgggcggtggtgcggatgagtgccatgctcacaacactcgcaaccctttagttataagtgggtaattagcctaattagagcaatgcaattagtagactataagaaattgacaccccccccccccccgccattccctcgccctaattgaaataaaattttgaataataccgtaacccaatggtatatgtcctgtcgaaaatgctttattgatactatattttgatgaatttgctgtgttaggacgctatttttgtcagaaaaagtatgtctaacaaaagcggtataattagcgataaattgtccgatttcaaggactgcccttagaggtcgaccacgcctaaaaaagtccttggggcaagtgtaacaaaacatgtcattcttgaatgcattcccaggatgtaaaagaataaaagccgtaatttttggccagaagttttattttcagaaaagtgggtccatttccaaggacgtccttgacatagataagtctggacttatttaagccaagttagttattggcccatagaattggcacattgttgccgttgggcatgccgagggcagcgaaaaatgccaactgcgcctgcttcagcaacagaatgtgaacagcttggacaagtgcgagaagtggggccaaaaacagagcccacgggtcccactcgatgttgccaaattcgagcctttgaaatcgaattttttgaaaaattttaaagaaaaaacaccatgaaagtgacacggagaacgcaagtggcccctgtaaatgaataaatgcataattaataaagaaaaagaattgaaagagaaaaacaatttctcaaattgatatttcgggttttggatttgttttttcgaccttttttgaagaaataatgtgaaaattaaatttaagagaaaggaaattcgataaaaaaaaactaattttcttctctttttgttatgtattaatttgaatttacaaatttattaattaaatgaaagaaaaaataacaaaaaccatgaaaaattagcattgaaatgaattggttttttcggaggcgcactgaaaaattattataaaaatttttttattttatataaaaaatacaaaaatttataggaaaataatttttaccaaaagggcccaaatggccgcgcggcccctccggcgctgcgtctcctctttgttgccccgggcaatgtttgcgttgttcaaaaagttggcgccaaagcgaatgatcagaaaagtgccgaggaagtcgaaaattcttgaaaatatatacatttcaaaaatcaggcatataaatcccaattaacatttcggtcaatcccgggactcgagaccaaaaaatctcgaaaaagctaatgtagaattgctctgttccgattaattatgctttttaatgccgtgccatcattacctgcacaagtacaatgcccggcccggttgtgcacgtacacgcgggcggacaacgcgctgaccaacagttgtgccgcgacgggtcgccacaacagcgaatagtcgagaatttgaaacgaatccttcagcagaattcattgaacgtaagaggaaagggtgtcgaacgcagaaaaattggaaaaacggtccccgaagttaaattcgcacccgccgaaattaacggcacaattacggcatatggaaaagagtttggcaatcatgtcgatcatttgtctcgaaattttttcttaatttttttctgaatggtcgaaatggaggccgggttcgtgctcagcgcctcaaaacacccctataaacatgttattagaatttacagaaaaaaatttccggaccaatgatcgacatgattgccagatattcagaaattcacgctctgaatttgaatttcctccggttcgctcggtgcaaaggcagtgcaaaaaatgataaaattatgtatggtgctaatggaaaaaatggtatacggtacaaaatagggatgggcagtcagttttggtgatctgaatttttgtgtgacttggatggagaggaaacaaaactacctacggtataccaactacagtatacttaagttttggaacaccgtatcatctgcgcattttccacaaagagtcgccaattatgcaataattattccttgtcaatttgcactcagaaaaaagttatggcaaatgaatccatttctttctccaattattgtacccaaaataaaaggaaactttcgcccatttgtccctttccctaccactggaccaaatggctggtgcataccagggatggcacgaaattcagaattttgaaaatttttggagctcggaatgccttgcctggtgttatacttcagactcaagaaaatgcgagaaaattacatcaacaaattttattttaaaatcatttaatttacgctttatttaaacaatccaaaaaaacattatggcaatggattttctgtcaaattttgccgtgcccttttctttcccttttgttccttcattcgtcgtttgctttcgttctttttgcggctggctcccctccgttttcttctttctccaaaatcggaggatcaatgggcggctaaataaaaatttgttatatgaatttaattgatgaaacatgtttttaaggcaaaaaaaaattttcaaaaaagggggggggggggacaaactacaaaattacctaaaattttgacaaaaaaataagaaaagaaagccaaagtaggcggctctgaactgaccaagggccaatgtaaaatcgggagcagctattccccccccccgggctcagttccccgcatggtttccccgccaagcaaaaaaaaaattttttgcaactttgaaaatttttcaaaaaaaaaacattaaattttacaatttttgaagttacagtaccgaactgacgggctgttgactcgtactttcgctttgctgcggcaagaccggcatagtcatcgtatgctgtgtttggaataaattagtcacttggatagaaatgaaaaatgtaaaaaaaggagaccatggtagaacggtgctccttccaatattcgatacgagcactcgcatcggcaatagctttttgcgaatcggcaataactttttgcgcatcggcaatagctttttgcgcatcggcaataactttttcaagaactcgaatttcttcatcagctttctgcaagagcaattaattgggagtataattgtaattaattaataaaggcattggaaaaaacataaacggatttgaaaaaggacccaagagaaaatgcttaagttaaaaaatagtacccaatgtctaattagctctgtaatgggctttccttgttctcatttccaattatttaatgcagaggaccaactcattaccttaattttattgtgacgaattttattttgatttttggcgagaaaatggtcaaaggacaaagaaattcggatgccataccagcgaaaattgtaatgaaggcaattggccaactccgaaaggagttcagggggaagtttaacttttttgggacagtccatggcttcagggtaacaattatacgaaaatgggaataattttaatattggtttgggtaaatggtggctatagcagcagagatggtgaattggtgggtctctcctccccttccgcgggttggaagagggcaaatcgaacaacggaaaaaatcaatccaatggagagcaaaatgtggacaattttttttctcataaacgattgttaataacgcattcatatggggtcggacggattacccaatttcaatgagaacaaccgaccgcgatgggcgaaggttggtcgtcgtcattctgctccgcttctttggcaacaatctgtaaaaagtaatacactttacaattgagcagccataggatgcattggtgaccaatgaccagtggtcatcaattccaatggaaagaccaaaaatggggacaaattgtttttcacataacgaacgataaacgcattcacatgcgatatgtctgaccatttacgaatggatgtcaggggaggtcaattaatatggggtctcaacttcgagttcaaggacctttttttgcttttgcgacgggagggcccaaaaaaatagtgaccaaaaattattcaattttaatgtaaaacaaccgaccgtgattggcggcgtgtccacacggtcagcgactttcgctgttatttccactctctgctcgtgaagcaatacctgtaaaaaggtcatacgtatattgacaactgagaagcgataggatgcattggtgaccaatgaccagtggtcatcggcaactgacctcggagcgggtcgttcctcagaccccgaaaagaataaaaaaaatttttcaaaaaaaattttccaccataaaattttgaaaaaaattctggacatgaccccggagcaagtcatcccccctcatcgttcccgaaaataaaatttaaactgtaaataattgttagaaaacttttataacaaaagttcaaagaaattttcgaaatttttcagtgaatttttgaaaatttttgtagaaaacagtaattcaccataaaatcttataagtgaaaaactttgatttttttgaaaaaataattgagttttttttaagaatcagtggtggttggtcatgaccccggggcatttcattccccccgaaaacgaaaactcaaaagttttaaacttgaatttgtcaaaaaaaaaaaaaaattttttttttaattttttcttcaagtttcattatatataacactctaatttgtaaattaatttttgttttaaaattttctgggggaaacgacagaggtaatgaagtgtgaaaagcaccccactaaccccccaccccccgctctgaggtcgctgtttcattcttcggtaatactgtggctttgccccccccccgctcccatttaaaaaaaaaaaattttttttcaagagtcatgaaaacatatttcaagggttttcggggtcactgatcgtgaatccggcatccatccattcgatcaattccggaccccgggtcaattcgaacaaaaaaaagtcgaaattcaaatttgtcaattttcatgtttagtctaaaaatagtttaattgaagcattaatggactttaagttcgttccgtgtacaaatttgaaccaaaatttgaaatgcgaaaatttttttaaacttcttatttgaattcgggtccggggttccaattgttagaaattgatgccatgccggattcgtgaacagcaaccccgaaaatcgctgggacatgttttcccgactcttgaaaaaaaaaattttttttcaaaaattgctggagcgcctttcttcgtgtcttgtaaaaaaaaaaaattctttttgagttgggcttccccacccatttttgtttatgatttaaaaagaactcacttcatattggtacggcaaaaaattctctggcaaatcgaattctttctccgtcttctttgtgccaaatgcgtgtgccaccgtcaacgtcagtttttgggcctcaaccttcgcttctgttccttccgcgattggatcaaatacgaaaagattgatgtggacggttccctcgtggtgtgtgaattcgtcattggcgtgaacagcgcgaggctaaaacaacggggggaaattactgtgtttttttctaagcgctgataaactaaccacgggtggtggcgcgccggagctgttttggcgaggctcataaaaagtcttgaagtcgtcaatgctctgttgcgcattctgagaaagggaatacgaatgatttaaattttcgtcaaatttcaacgcggaaaaccaccgaaaggggaggggggggggtagatcaaaagaccaaaaggtaatcttcgggtttttcggaaaattagggaggggaggcaaactttactattccaggtcaacgtgttcccctgattttgtctgccgaataatcataaatcggaaaagatcgcttcttacatttttggaccggtaaaacgaattttttgccacagtttccctttccagtcacaccaatccccgttcgtggtcacaaaattttttggtgattttgttttaaaaatgagcaaaaagacccctctgtaattactaattaggctttatgatcctccgcccactcacttttgtaagccggacagtgagaaatacaggattcatttttttgatcagcgtaattgaatcaagaaatctgagaaataaaatttttaaaaatgtgttaattatacatatcgtttatttttgttataaatgtacatatgccttaaaagccccgacaatggtctctttatagatatgatgcaacaataacagctaaatttctgataattgggtacttattttttgggttttgacccttaaaaattgttaccattcaaaaattgtgacctaaacgtgtgaattgggtcttattcggacgaataacctatgtggaacaaaaatattttcccattaaaaaaaactaggtacagacaaagtacacacctccgatagaccgaggtaatactaaaattattctaaagatgagaaacagaaatgacgaactaactttttttcagtaaattttttgaatacaaaacgccacctttttgggcgttaatttaaattttaccaggcaatgtaagacaatgtaagagacgggccttaacattttctgcaactgttttcatgcggccgttttcgtatgagcgtttacaccaaaaaaacaaaacataatactgtaattttttaaaatacaaccccttccccttaaattagagcgctgaaaaagcccctcttttgaggtggttgaaaaatatagtccccccccccccggaacccgtcagt

SEQ ID NO: 109 - DNA, 2965 bp, Heterodera glycines
aatttgctgaataaattttaatttatttttgaattcaaattttaattaagaaatctaagatcactgattaatatttaatataccttgttataaaaacatttgtttctttctataatttaaattatagaaattataattattataaagctgattgatatatttattgtcgatgataaagatttttagtttcaaaatgttactttaaatggtctaattgagaaagaaatacaattgttttttctcaattcttcataaaatctattaatttttgctttaaataaaaattacattaaatgaaaccgaaagatgcagaagaactttattataaaagacgcgtgtacgacgtgaaaataagaagaatcaagaattcaagtaaaatgaaaaaactggaattatataatctgtaaataaattggtattttgtcaaattaaaagaaattgcaattaattataaagatttgaaatgtagctagctgccttgttcaacaaaaaggtatcttatcggacatggaatttgaagcaatcgactaaattagttagcaattaaaataagataacaaaatatttaatgaatatatcatattattagaagtattcattgtagaaaacaatttggatcaaaaagcgaaaataaatgttttcaaatttcaatattataaatgcttctataatatattgagatataaaataaaattacttttaaaaaataaattaaaccaaaaataaggaccttatgaagaatcgggggatatttgaaggtgccaagatattgaaaataatttaataaaaggtatagagaaaaatatcattttaaaaacaatatatttttattaaataaaagaataatattaacaacccccccccctgccctcgcccttgggtatgctcctcccctctagaaaatttttccaaaatgaattcaaattttgtatgctaatttttgaaaattttcattggacggctgattcaagcgagagaacctgcgggctcccgacgaatggtccgaacagttggactgcgtgcatttgtgcatcaacgtgggcggagcggttgcggaagggacgcacgcggagagtgacggccggcgactgactgtgacggtggtgcacgcatttggtgccaaatggagtgtcagaaattacgaattggtcgcagaaattgtgccgtcgcaaagcgtggttggttatgcctgtgccagctttatatcgtgtccaagcccgtccgtattcagaaaaaacaaattaaatagaaaattcgaagattttttgctctttacattaaaaaatttaaatttccaccatttgtggatcactcttcaaaaaattaatgctgcaaaatggcgtttcctttagtgccgttaggcgccccctaaaaaatttttggaaattttaaaaaatatgacaagaaaatatgccaaattttcaaaaaaaaattgcctattttccttaaaaaaattttttttttcgttgaagggtggaggttaccgcaaaacatcgccggccaaaacgtatcgccaaaatttttttaaaaatttaaagaaaattttgaaattttttcgttccccccccataccaaaattttaaaattttatgggtacatttttcattttacagacaattttttgtaacaaatagcactcaaattttcaaaaattttcccggcggcgcctattggcaccgccggacctccattttacatctgggactgtccctgggtcccacccgaaaaaccaaaggtgacttttgaattggagtcatttttcatgggatcaggcccgtatccagaaaaaatttcggggagggcacccgaagaatttttttttttgtttgttcctcttcgggtcaaaaaatttttcctccggtgtttaatttgttttctagttttttcctttttattcattccttagctttttttccagcatcaaattgtttattttacaatgcttttccacagatgctgatcaccgtagaaaaggtgacgttgatgttgaagaagcgagtgcaactgagttggaccgaatttgtgaagacaccgccaagagaagaattggcttggtatgaccaatgtgccgagttggaggacaaaatgatgggccaaattgagaaaaagcgggagaagagagagaaagcgaagagttggaaactgcgcgaaatggacgaccaatgaatggatgaaatgattttttggattccatcttttttttaatttcaaatttttacgcaattatcactgcaaatacctaaactgttttctcataaatacattaaaaagtcttacaacaaattaaatttttataagccttcatgaattttgaaaaatggtgggccgacggtgctataggcgccgcctgaaaaccttggaaattcgagtgcaatttgttaagaaaattgactataaaattcaaaaatctacccataaaattttgtaattttagtttgggggattaaaaaaactccattattagctgagaatttttaaaaaattttcatttcggtggggggagctagctagataggcaaataaataagttaccatccgtacggaaaatagaatattatattaaccgaatattcactcaattaaccatgcttattttgctagactcattacaattcttatggatcaatgtcatataaatgcataatttgtatcattacaaggctaacgtcagtctgttgaagatttaatattttatataaatttaaaaaaagatgggtcttcttaatattttcgagatatttttaaaaaacaattaaaaaattaccgccggcccggcaaataacaatggcattaaatacaataaaaacaattgttgtgtataacaatgagatgggaattagggaatgtgatttgttccccgaaagtgagaaaaaagcttatattaaccatcacataatttaattaaaaaaacgaatttttattatttcaaagagtgatcagaaatgttttattgatcattgacact

SEQ ID NO: 110 - DNA, 1739 bp, Heterodera glycines
cccccctccgtccgtccgtcccaatcagccggcaaaactgttctttggcccacacttttccttggcccgtgcactgccgaccgcgtccatttcgtcggcgcggagccaatagcgcagcgcggacaccacaaacaacgccttgccgaccgcggcaaaaaccgtggcatgggccatgttttggaggaaccattggccctgttttaaaagttgaattaaaaaataaaaatgcataacaattgataaaaagctgtataggattaaaattttgcaatcggattattttcaaaatatttaattaaaaatttagcaaaaattgtctcagaaaataattttcaacaaaataaacccttttttattgaattttaatattatttattttttattggttttgaaatattttttatgtatggatataaaaacatacaattgaggcaatgaagtatttggagtgttccaatgcacaaaattgatgtggctaaaattggaatgtgatggttagggatgcaatttataggcactaaaaaccgccaaaataggtaggctttaggctctaaaaaatccccaaaataggcactaaaaaatggaaaataggcactaaaaaaccccatttttaggggtgcaaaatgtattcaaaaaagaaaaaaattaggccaaatcagtattgagataaataatttttaaagcacaaattcttgtcaagaaaataaataaataaattttggagatgaatttttgaaaagtttttcatttcttaggggtatatttttgaaaatttcgggtcgattcataggggtgtttttttgaaaaatgtttgggtcgtttcttaagggtgtatttttcgtttttattgcatttttgttaacaaattttgggcaaaacgccaaaataggcaaaaataggctctttcaaaatttattaggctttttaggcgctaaaaataaaagcctagaaaataggcactaataactcgaaaagtagcttaacaacacccgaaaaaaacatgtttttcgtgcgtttcaggccatggggagctcaggaaaaaaataggcttttgcctaaaaattgcatccctagtgatggtttattatacattacaagggatttttgtatcggaatttaagattttagaaaaaaaattttcggttcgtcagataattagcacgattcaagataaaatatcaaaaaagtgatcaaatttggatagtttcttggattttggtttattttatacaagagcaagcaaaagatttgctgtactgtcactttgaaagaatggatactttttgcctcacctccaatcggctgatcagccacagctcggagtacttgaagccgctcatgaacacaacggacatgcccatcaacagctgaaaatgatcaattttagagatggtttattaatagcgcttttaactttttagatcgctccctctctcggtttacattttatgccaagcgacttaatttttagtcagagatttgctaaccgatcggttgataagtgtatcaatgtcttcaaccaaggtttttggccaagaatcagtgggtcgggagtgatccgtttgtcttttggcaattttttttgaaaacattcttttcaatttgattgggccattattggctttgttttacatagtcaatggattcccacgaggcgtcgtacggcaccacggaaattgcgtaggaatggagcgcagtcggtgccaaacaagtgccgacagcgaccaatagcacagcgc

SEQ ID NO: 111 - DNA, 3057 bp, Heterodera glycines
  misc_feature (2822)..(2822): n is a, c, g, or t
  misc_feature (2972)..(2973): n is a, c, g, or t
  misc_feature (3028)..(3028): n is a, c, g, or t
attggcccattggtataagcgtatcaacatttttcaaaaagcgcataacccactctgattttccacttcccgtactgccagatatggtcaatgtaaatgggtgtcgaaattttgtgtcatccacattgaatatttgaaaattttgctccattaaaaaaagttgtttttcttaaatctaaacatttatatatattctggttcaatttttattgtctaaatggaccaaatcatggccactgactggattcataatgcttatcctgaacaagcattaggaggaggaggaggagatgaacccgtcaatggcaatgtaaactggcttcaaattatggacgacgacgacgatcaaaatgagaaaagagagatgcaaagcgaggtggacgaggaaaacaaaatgaaaaaaggtttttgctaataaaaacgatttttttaacattttttattcagcggaaattgcaaaagtcataccaagaaaatgtagctgcggtgggaatgggcaatctcaacaacaacaacaaccgcaacaacaacgagaaaagaccgaaatgccattaattgagcatctgtgtgaacggtacaagtgttcaaccaaggaactggaagtgttgttccagaacctgaaatcgcggcgccaaatcttacaacacatgcgcttcaatgttcgtctccgtacaaactacttacatccggcaaatcgaaactttgtggtgcagtgtaacgatttgtcatccctttcggcaagtgaagcatttgcaatgcgtggatatttaggcattacggttggtcatataaattggattttgtatattaatattatattttattaggtccaaacctacttctatgttaaacatggagttcgtcttcgtcatccaaatcttccatgtgcgattcgttttggaggacgcgaccatcatgatttattcccgatggaatgcttgaacgtagttaaacagatctgagaaaaaatatgcaatcaaccgaatctataaaaacatattttgaaattgtatgcccattttttaagaaaaataataaattgatgcttgacattcaaaattgcacagttactttcaaagtacttaaacggccgttgaacaaaaccgagtttttggcaatcgcgcacaacggcgtgaatgttgaatggaatccgcgccgttttcatgccataattatgcgacttcgttacaccccgagaacagtggctgctctaatttttcaatctggacgtgtggttttaactggcgtgcaacacccggaccgtgccaagaaagaagcaaagcgcgttttgcgccgcctccgtgcttcacttcgatgcgccaacattgaaactacccttttgctgctgattttacgtgtggttaacattgttggctcacatacatttactcatcgaatacatattacgcatctcgtgccaatcatgcattcttcgactagcttctgctctgttcattatgacccaacaatatttccagctcttcggtgtaaaataaaattaaatgatgatgatgatgatgtttatgcaacatgtattatgtattattctggcaaaacaattctgacgggggtacgctcaataacatatatagacagtgcattttccattttgtcatcatttattagcggaaacaataaaaaattaccatgacctataaaactttttctcccattattactattatggttatgcgctttttgcttatctcactccccgcccatcgaagcacgtcattagcaagtaagcgattttttttttgattgattaaagtatgaatttttaagcatccgagaagtcatggaacagtattgcggaatcggttgatcgcaaagccagagataacaattttcaatggcctagcacacatgaaaaaggcacatgggcagcagttgcagcaactggagaagaatcaagggcgagagcgcagacaggagcgaatgtaagggatggtaatgaaatggtacaagcagaagcgataagcgaacgagaaggcggggttgcacttgctgctgcgacgaaaaatgcattatcggaacgcgggagtgaggttgaacaacaacatcagcaggtcgtagtgatggcccgtggaggagcaataagcaatggggatggtgcccgtgcaaaagcagaggccactggtggcgctaaaagtgttgttgaaacgaggattacggaacatcacggtgaagagaggctagctgcagctacagccgtcatacatagagaggaaaggagagaagaaagaagaagaaaaatacgcgtaagaaacagagaccgacaacaaggaggagaagagaggcagcgcggagaaggacataggcagtctcacccaaacgaaagacacaacgacaactttcacagttcgctacaattgaatttaccgcccaacagaatgaaccgaagggaacaggatgaacacatgcatcattcacgagatggtttgatgggacagtcgaacaatcaacaaggagaagagaggcagcaaggaggaggagggcataggcagtatcgcccaaccgaaagtcccaacgacaactttcacagttcgctgcaattgaatttgccgcctagcagattggaaggaagggaacaggaggaacgcatacatcattctcgagatggtttgatgggacagtcgaacaatcagcaaatgagaaaacgaattcaacgagaatgtttttgcacgtgctaattttttttgatgtttggtattgtatgacttatattaattttttaaataaaataacaaaaaaaaaaagaatattaatttttttcaccaatgagagcaaccaggcaaattggaaagacggtcttggtctanatcatcattatcatcatcatcatcatcattagtttcttcttcgtcatcttgttctgttctgtgtcgtggttgctggtgcgcatttcggaaaccaaaggcaggtcctcatacccttctcagtatctggcagaaccgccgccttatcctttnngctgtacacgcgccatcctttgcctgtaccgctgccccatccttgcctgtaccgncgccccatactttgcctgtaccgttgccc

SEQ ID NO: 112 - DNA, 1595 bp, Heterodera glycines
aaaaaggtaaaaagaaatggaacaaaatttgggctttttcccttttttttttttttgttaggagaaaaaaaacccttttaaaagaaattaaaccaaaaaccgggtggggttttttcggggccgaagggttagggcccggaatttaaaaaaattttggggtcaaaaggcctgaaggaaaggttaaattcctaagattattgaaatatattaaaacccatgaaaccaaagtgaaaatgcgcaacaaaaagggcaataaatgaatgaagttataatgcgcaataaaaataactttataatggtcacaatttgttatgtacaaaggctaaaaaaaaatcataagaatacataattatggatttataaagccaataaaaatgaaataatgaaagtaaaccaaggcaacataattattatgtaattagcgcgcaatacgttgctagaaatgaaataaaagcacgaaattattgaataaatggttgtaaaaaaaaaaaaaagatcgtaaattaatgcataatccaaaaaatgccaaaaaatgaattataataatattcttttgtaaatgccacttaaaaaaggaactggtgaactatgtcacaatttttttaatttattaatagtcaatttaaatgggggttgaatgcgaaaaagtgaaaaataagctgaaatttctcagttactcaaaaaaacattgtaataaatgtattctaaaagatgacgattaataaaataataataaaataaattttaattataaaatcgatatttttttcaattattttataagtgtttataagaacttttgatagcaaatgatcataaaaatgttttttggctctttttctccataaatttttatttattctacgataatgatgatttcattgtatagcaaatgatcataaaaacgattttttggttcttctgcgccataaaatggttttttctaccaaattcggcgaattctataataatgatattttattgtttaccaaatggtcataaaaaccttttttttttttgccttattcgccataaacgattattttttctaccgaattcggcgaattctatgagaatgatgatttcattgtatagcaaatgatcataaaaacgattttttggttcttctgcgccataaaatggtttttcctaccaaattcggcgaattctataataatgatattttattgtttaccaaatggtcataaaaacctttttttttttttgccttattcgccataaacgattattttttctaccgaattcggcgaattctatgagaatgatgatttcattgtatagcaaatgatcataaaaacgattttttggttcttctgcgccataaaatgttttttttttctaccaaattcggcgaatgataatgatttttttttcaatgccaaaaatagaaatcgtattattttttattgccgtattaaatgatataaaaggggggccattcttgcaagattttcattaattcattcattattttctttcttttattaattatttattctatttttaatatatttaaatatctttcaaggcctagagagttttccataaaaaaatgtccctttcccgttccaaat

SEQ ID NO: 113 - DNA, 12810 bp, Heterodera glycines
aaaatattaaagaagttattagttatgctggggccggggacctttttaattactggaaccattgctgatttgcattaccaggtttatgatgtgcgtttgtttggttgtttgtatatgtgtttttttaattaatttgttaccaataagtcgtgtccgctaaaagtccgcggaatcggaatcccatgtcgccgtaaactccccgtaaatttattgtgcgaatcctgtggccaaagggtggaaaagccgaataaaacgatttacttaaaaatcgttttacaagatggggaagatagcacatgtacacagcgagcaacgctgttttcagcggtgtggggatttttttttcaaaaattttcataatccataggttgccgaggcctttctcggattaaaagcaattgatgttaacgagatgaatgaacaaaaattgtatcagcattttgaagcaaaattggggaccactatcaatgccaaagtgacaatcaaggttagttttattattttatatttttctttctatacttttttttacatttttaggaagatagccaaaacttcactggatttgattgggtcataacgcgcatttacaaggcgggcaaaaaaagttcaggggagtctgagaaaaagaatgaggataccaatggagctgaacgcccttcgaccgcaaagaatgctaaatttgattaattcatccaattattgggctgtattgccatacaaaaaaaaatatttacattcattattacgatgaaaaaaacatgattatgttccatatatgtcctatgctattttttttatatttttaaaattaaaatttctagatgttgagacacaagttacaaatggaagacgatgttggggctattctgttttttttgaaggagttgacccaatatagtgcccgcataatagttgtatgccgcaatagtcaaaaagtcacctttttagcattatgtcccccaatggaatgccaaaagcaaggggaattatttcaatcaattaaacaaaatttaattgaaagtattgggccgtattcatttgtggggtaagtcttttcgtattatattcaaattattattattaatattattattaattatcttttttaattttagtttggacgagccgcctgcaattaaaaaatgaatgaagtaatctattgattgtttccatgttgtacccattctaatcaacgtatatgtggtaattgaatattttgtagttcactgaccatatcatttgcttcactctgggtaatatgccctaaacgtttcataaaatttacaattgaaatccagcagagcagtaggatgggaaatattataagataaaggccaaaaaataaaattattttttcaaaattggttattgccagaggcatttcatcgttatatccattcaaaatctggattgttggcggtgtgttattacttatgtccattttttgccaatttacaaaacttttgggaatatttatgtattttcaaccaagttttgagtccgaaactatatgcctgttgtagtcaatcattatcatttgatcaaactcgccaagcactatcatttcaacccctccggccggaattgcagagttgaaggttgcacggattgttgttgttccacttctaagcaattcatacccaacgctgtcatccagagttgatgtaagtggaatgacaaacaatgtccagccatttttgaattgttgtcgggtgatgtcacatgagcgatcagagttagccatgcctagcgcctcgtagaagtcaacatacgctctgacaaatgcatcttttttgaaagccaacttatacggtaccattgggtatatgaaaccgcccgcgtgcaccgcaatatctcttatatcaaaatgtttgaaattgaaagggtccaattttgagtttccgttaaatgccccattctccaccattccaattgttaatcgtcgaggaattgttgcactgaacgcgttgtattctacctcataccgcccggcactaataaaagtggattttacttccgttttacgcacagcataggttgctggttgtttttcaagcatcttgtaaatgtttaggttcaacgatggttgaacttccaccattttggcataaatcttaacatcgtgaacacgcagtctgtattcttgagtgtcatttgctttaagcgtttgaatgagaaaattatcttttgccttataaattgaaaacaataggtcaagattgttgagcagatacaattcctgatttccaagatcaaaatccaaacgcgagagaaattgagcctttttcccaccctcaaactgtttacaacgctctttgaaacctttgtccttatcactatcatgtttctcgctatggtaaaagccggtggaggttaaaaaactatttttcacatttttcgaaaaagacaacgcatttgttagatatgtcctgtagggatacaagttaccgctgtcatatatttctgtattacctactgaaactttaagctgttgaataaaggtttgaccaacgccctgtattacacccacattctcttcatcagcattgctaatatctacccaattgtcatctttatttttttcaatcgacagctcaaggtgaaggtaaatacggcagaggtcacaccacaagttatcgctgtatagcctgaacaaatatggtgattcttgggtaatggtaacgagtggaagaacttcacggaaaaatgaacgaacaaccgacacgtttgtcggaggagtcgaaaaaatattcagagcactgttgactgctaatgcgctttgttcacttattttttgcgagcaactcatttatgcgataatgttataatggtggttaataagtaccaaaaatgtctttttgcgttcgtttcttttttttgctcgatttgttcttttgttttccaccaagtgtggtggggagaaattgtggaggtccaatgtttgattttagtttatttataccttttttgggcgtttccccacctaattttatcgcaccaaatttattgctgttagagttttggtctgcttccttcgttttgtaacgtttaaaatcaaaaccctttcccttttgggtgttaatattagtggccgccttttccaataaatttttcaatccaacctttccctcacttatcaatgattctttgaggtccttgccctctaaaacatttgataaaacacgattgcccgactctagtccttgacgaccaattgttgaaccaatttccctcccaattggaaccaaataacgcattagactgcggaacaccgctccaattccattcccacgttggtatggttggccacgaaaaatattataacttcctactcctcctccccattgattaagagccgacgacaattctagtgatgacgcggaattgttaagtggaaaggatgaccattcaacctttaaagggtcaaaatcaatatgcattatcattattattctaaatattgcagtaactaaattctttgttttttagtttatttatattctaaaaaaattctctctcgggtaaatgtgttgacaattgtgtcagggggttgttttgattgaactaaatattgcaagatttcttcaaatgagtagtgaaggcatctatggtgtaggaaaaatatggcatgtttaccacaagagcgagcgtaaggtgattgtaatggggcacggctatagcgaatagatgagaattttgacagaaaagttctaatatgttcgctgctcgggggccaaacaccactggaatcataatagtctacagttccgaccgattcacaatagaatgctacccagtgtgacccaattaaatcactgggatcaatgttggcaacaaaacagcgggggaacaaacccacacttggattgaaaactattttatcagccggaaaacaaccgagatatgcatattttgtgaccggatttcttgacagaattttattcagatcaatactgttcattattgttttttttaccaggatttttcaaaaatatgaagactttcgaaagtgtagtgttaatgtacacgttccgtattgaaatggcattagtgctccgcttgacgttcttatttctacgaaaatttctgaaacttctttgagcaaaacacgatgatattgaactgagtaaaattgttcctcaatcacctcatcggggttaccacggattattgtaatgcgcagtatgggggcgatgacatttccaatcatcattggctcaatcaaatcgggtatgtagacatgaagtgtggacactcccccactcatatccggcatgaattttgctggatttttatcttttttgaactgagtttggggcgcaaaaccaaggatatatgctaattgttctgaaagtttaacccgtttaatgaattttgtgttgattgccaaagtaaaacgattatgacggacatcaaaaatgaattgcactacactactcactttcttgtaagcctgtatccatgcttccattccaaggtccttaatagatttgttaagcgactgctcatctttgctcagtttgttcagctccacctccaaatgtttggcaattaggttttggaaaagtagaagatcatctgaatctctcattttcaaaaaaaagttatccaattttctttgatattcttcttcgctatcactctcttctcgcaaaggcacattgctggttgctgctcgcttctcgcgatcaagcaaagcaccggcaaccatttcagggtttatagtaccgtcctcattactaataagagcatcgtcaatagtgtcaatagcaatcagaagtgcggacaagagtggaagagcttcattctggtcaattatttttctcttcggtctcctctttttatcgtcacttttcatttttacatattctttctgtgccagtttacgtgctgcgttcatcgcttctttatagctttgctgagcgtcgtgaacctggtttgacagatgctcactgctaatatccaggagactgtacaaacttttgctcaactcataagggcgtataatgttggaagaagggaccggaatgcgaacaatattttcagtttgccattccagttctatgaattgttcctcagtggtgcccaaggatggccatgagtggggatatatgatggttgctagccccacatcccattccgcattaaattgtaattttcgcggcagacgcacacggaaggagttggttcgatttccatcaacgttagtgttggaagggacaacaacataaaaggaatttgatgaaatgggtggcattccttccgtttttctaattaaaattttttccgtatatttatatatttctgtgtgtaatggaactggttggaatccaactattatgctgtttggtgtaccctttccattttacaagcacatattccaccccatcctttttcttttggcccagcactttttcaatatcgtacaatttttcggcatcgctagcgctataactgtcattacgcactcgacataaatcgttggcataaaagcgacctttaatcagttcaccatccatatcacgaatgcgataggtaatcggagaacgcccctcgtctacagtgtctatcgtgaaaatttcactcgtaaaacgaccaacatatcccttctggaacacgtgtttatgtttttcaatacgaacccgatcaccaaccttgaagcgaggcgggcgctttggcctaagcaaatgggccttatcgcttaattttttcctcaaggcactggcattctcaaatgttacatccaccggacgcatttggattgatgaatggtatgagtgattaattccgttcacaatgtcctggatggcatcaacccagcgttgggtatggcgggcagtaaaatagcgaaaaagacgttccttaattgttctgttggctcgttcggccatccctgcatgaaactgaggcgacgtgtacatacaaaaatgtttgatattctttgcttcaaaataggattgaacgcgtttagctgtgaattctaagccctgatcggttaccagtttccatggtatgtacttggagcgggcaaacaaacgctcaaatgcatgaatcatttcctcactttttttgtttttcacaggctcgacaaacaattgtctgctcaacgtatcgacgcagaccaacaaataacgaaagccccgattttgtggtgctaaacggtctaaaactgataggtcagcttgccattcagtatgaagaccggaagctagcgtaggtaaacgtgtgaatcgtcggatagcctggcgatgtaaagtgtaactgggctgccctgccaaatattcttccacatctctccgtttaatagtactgtttcgttttcgcgcttcattcaataatggaagcgtgcttgtatagctgactggagaattgacatctttataaagatagtcgaaaattgcacgcttttttttatctaataccatagtgacggtttaaaacttactaaatttctccccttttcacactttttattcactttgatgtgatgaagcgcctggcttccagcaccgcttccaaactgatacggtctattggaaattaatttttttcgcaaataagcatcctgataggctctgtccacgaattcctttaggccaactggaaaatttttaaactgcgttctgctgtctctattaagcaaatatgaaacaatctcttcaatgttactcgttttgtatgtcgcatgtccacttgcggaagtctttcgcacaatcctaccttctgaattcacacctaattctaccccattatttttaatataatccaaaatatactgttgttttttcttttgtttggccgttttttgactgcctttttgtttttgttcatcagctgcgatagcaccagcccttaatccataaggaggcgatgaggttgaaggttgttgttgttggacatcgcctgatgtgttttcttctaatgcctcctcccattcagtttcgtcacttaaatcatcctcttcttcttctacaccaagtttttttgtttttttgccttttttttttgttccccgttttaagtttttatttttatttttcatcctaaactgtttttgtgggtggagtacgggttgtgttggcgactttgggcgagaaggaggtgattgaggtggtgcaggaacagtaggaggaatagcgctgataatttcgtttaaattctgtaaacgtacatccaatgggcgatcctcctgttctcgaaccattttgtttagtcgtttaaattcctggtgataacgtgatgatcgttcattctcatccatagttctgttctgctctatttgacgcaaacgctggcgaacaagtccaattgcgctgccatcttctgaagctattgtcgagggtttcatcatgctattgaacatatcctctgggatgaggaacatccgcattgtgtggcgcatttttaaaaaattcttaaacatatagccgtttatttatttatttattattttcattttttccactagaattggaaccagaatactggccaatagtcctgcaatggcaggaactccagacccaacctgtggcggcgaggcgcttaacaatatttttctggcgctttttgcacattttgtacgtgctaatcctctcaaccaatgtttgattgtataaagtttacgcaaatgtgactttcgccttactggcagttttcccctcaatatgttgaggcatatttcaacaaaacataacagttgcgcattcgttgctccctgcaacatgcgacgttgagtctgaagagcacgtgcctttgaattaaaatgttttaaaaaatcaatatttttgtgtattaatggtccaattggtataccaatttttttgatatttaagctgctgctgttgccgttttttttcattttggcaaataaattattgttacctcccctttatctgttaaatatatattgctttttaatcgtaataaatctgaagtttcgggatgcatatcaacaacaaggtagccaaattgcttttctgtcgcatccctgtatgcctccatcaaatgccctacacgcccagggaacaattgggtggccagggtgcgtacttgtagcgcccccgcaggatttcgcattaacaccatgtagtgtgagttgttcctggcgattcgcaattccttgctaaacaaatgctgagtcactaacacaacactgaccccccagttgtgcgaaccgcgtgtgaaaattgtgtccaaaaaattttgtccaatcccaaccatcaggtcatccagtaccatcaataactttcctttagcatcgcgtgacttttgttttaccatttcttcgtcgggagcccctgaatgggtgctcacttgtaccccgccgatcgatcccattttttgaagagaagcaatgttttggttaaactctccgtagcaatagaaaactttatttattggcccatttgtaataagcgtatcaacatttttcaaaaagcgcataacccactctgattttccacttcccgtactgccagatattgtcaatgtaaatgggtgtcgaaattttgtgtcatccacattgaatatttgaaaattttgctccattaaaaaaagttgtttttcttaaatctaaacatttatatatattctggttcaatttttattgtctaaatggaccaaatcatggccactgactggattcataatgcttatcctgaacaagcattaggaggaggaggaggaggagatgaacccgtcaatggcaatgtaaactggcttcaaattatggacgacgacgacgatcaaaatgagaaaaagagagatgaaagcgaggtggacgaggaaaacaaaatgaaaaaaggtttttgctaataaaaacgatttttttaacattttttattcagcggaaattgcaaaagtcataccaagaaaatgtagctgcggtgggaatgggcaatctcaacaacaacaacaaccgcaacaacaacgagaaaagaccgaaatgccattaattgagcatctgtgtgaacggtacaagtgttcaaccaaggaactggaagtgttgttccagaacctgaaatcgcggcgccaaatcttacaacacatgcgcttcaatgttcgtctccgtacaaactacttacacccggcaaatcgaaactttgtggtgcagtgtaacgatttgtcatccctttcggcaagtgaagcatttgcaatgcgtggatatttaggcattacggttggtcatataaattggatttggtatcctcatattatcatactaaatacggtactgaagccattataatagttttcccaaaattattttacattaatttacctaatgttttgtgctcctcttgtgtgaggaaagatttggaaaattataaatattttgaaaaaaagattattgcaaaattcttttaataaaataataaaatatttttaagtacatttggtgagttttatatttttcttttatgtgaatgattttttatgacattttgaaagaaaaattttttaactaaaatacgattcataaaaatttttaaagaaagaattggtaaatttacaaattaattgggtttatttttgtcctaattcattaccaaatccgatccgttttttaaacatccatttttatatgcactttttaatcgttttttaaaatcgtccaaacaattaatttgttttatcatattgatttgtttggcttttgttatttttcttttttattgtacatgcaattaattaaattttttaaagaatattaataacaatgttaagagtttaattatttttgatgaatttaccgtatttattatgtttttaactttattaaattgtttctcattctttgggttgtatgttgcatttttaaatttattttttttattttttatttcatgtgaatgcgacactgtcgattatttccattgattgccgcactttttattaattaattaatatttctaagttaattaattttattagaaatgttttaatgccttttaaatcgttcaactatcatatttaatagtgttaaattattttataatttaggtacagttatttgttttttaattttaatcgcggctcactccattaaatatatgttattaatttttaagtttcattaatgacttactgaaaaaattccaaaagaaatctcaattaaactttttgcagatgtcacaaaatttatcattgctattcaaatgaatcccaacgtaaagttttagaaacatctctaatttcagtttttgattgggcctaaacttttcagtaaaaaatcttccgtcttatatttaggtaaaaataacaaaaaaataccgtacacaattaaaaatgcaaattttccggaataacaaactaaaattcaacggacatgtttcaattattctccaaaaaatatttctgtattttttgttcttatacagttacggctatatgtttatgcagtaaaatatttttcaaagaaaaatgtcgataacttttttaaacacaaacaaaattaagtttctttatcaatttttgtagcattttttctcctctttctaatgatatcattcattagaaaaattaactgaactttttaaaatattttttatttgtcaattttcctcaattttgcgtggtcatatgtttatgcagtagtaacctttgtctttaacatttttcaatattttgtgggccaaaattttgtaaaaatttctcctatgctaacttttgatgctgaacaaaaaaagtcttttacagcaacttgatcagatcacttcttcatgttgatctggacacccaaacaaaatacagtgaaaatcggggaaaagaaaagttgggaacagaaccaagaaacaaccaactggaccacgcaaaaaatttcgctaagtttcaaaaatatttttaaaaatatcgaatatgtcgcaaattttaaaaaatatttatttttattttgctcttaatgaaaatctgttaagaaatcgtgccaagggcatctatctgcccgctagcccaattcattcttggcacataccaggctgttgtgaatcgaaaaataaaatgcgaaatacgaaaattacgaaactaaaaaataaatacgaatacgaaacgccttaaaaacatgaaattctggattgagttttaaagatttatagggattttggcttcggaggtagagcccggaaatttcaaatttgcggatcccgctgcgggactggaactcaaaattttttgcgggacgggatcccgcgggattaatcccgcaaatcccgcaatcccgcaaatcccgcatttaaaatttgcaggatcccgtgcgggattgcgggattttggaaaattcgaaaaaatttcaattaaatttaaaaaatttccaaaaatcaaaaaatgctgaaaaataaatttttaggggctgtcgggatgcattaaaaggggctgatgggtcgactaaggtttttcgattggatccgacggtaaaaagttgatcggaaatcaaattattaacgttcataaatttgactattttttttttcttcaaaaccacttttttgcggtgcaagaaatcgggaatttttcaaaaaatatacaatataataaaaaaatttctaaatattttaataggctaaattttttaattcttaaccaagtaaaaggtatttcacaaatgtttttagtagagttcgacctggacctggatccaggcctggatttttcctggatccaggtccaggggattttcctggatttttgtccagaaaatccaggtccaggcaaaacacgaaaaacctggattttcctggacaaaattttagaatttattatttcaagtgaccgatgttttttcacgttttcaaaaacagattaaataaatttaaaaacacattattattatttattagatatttttagatgcttctaagcaaataattaattttttcaaacattcttttgatttttaaaataaatttcaaaaaatccaggtccaggcctggatccaggtctcgaggagcctggatttttcctggacctggattttcctggatttttgtccaggaaatccaggtccaggtccaggcatttttcaaaatgtcgagctctagtttttagtagtatattcgcttgaaaaaattattcaattattttatcaaaatctctttttgtcatttttcattattttagaacattttgggaaaaggagtgactatttacacgttttttacagcgcgattttttcaaaaactttttgggaacttggaggagggtacggcggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcaatcccgcaaatcccgcattttccaaaaaatgcgggattgcggactgggatcccgcaaaatcccgcgccgggctctagtgaggatattggagggtgaaagtcattgatgtcaacatttcgtcttctaccacaccagaattgctgatgaagaaaaatataactttgctcaaaaaaatggcgtttcgtacaattccaaatgggaatggccataacttttttgttcgtcagttaatttcttcaaaattggtatcattcgaaagctctacgtgtttagaaactatcattaagcagaagctaagcgattaatcatctcaccaaaaagttatgatttataagacttaaaaa

SEQ ID NO: 114 - DNA, 3002 bp, Heterodera glycines
  misc_feature (40)..(40): n is a, c, g, or t
  misc_feature (142)..(142): n is a, c, g, or t
tcgtcgtgagtacagtcggtaataatttctcaattcgcgnatatcgtgacatttttgttaaatattaaatttatttaaaataacattctttttaattttactctcaaataatttagaaaaatatgctctttcgaataatttntaatcaatttattttatgttcagtaatttagaatctttgcataataaatttataaactaatttttaagtttaagtcacattttgtattatgatttagtgatttggaattctcatttaaagttgaggcacttaatcttcggcgagaattcatatttaaataaattaaaaatataacacatttgaatttccataaaatgaaaaggaggttgttcctgaaaattttatcctttttcttcacaaaccacgttaaaattaaacctttgttcttatcgcaagaccaaatctcttcatattgcaagatgaaaaagcaaaaatctcgaaaagaaagaacgaaaatgaatcaaagttttaaatgtattaaaatggaaatggaattaaaaaagaaaatcaaaaagaaatgaaagccaaaaatttaaaagatttaaaaaatcaaaaattaaaatttcgataattaaaaatataaaataaacacaaaaaatattttagtgggatcagacgccctcgatcccaatttattactatttattgtataacttaaaattaatttctttttaattattatgattggttcttaataaaattttggttttagataacttcttatttctacttttacgatttttttatttggcccctcgtcgtttcatcagtgttgttttggtggttgtggcggaaaaataaaatttatgaataatcataaatgttttaaatttgatcaaaatcagagatttaataaatgctgtctgctgggtatgacatttttcttaaatattttagtaaaacatgtgatccaacttttcttcaagattcattaaatcatatccaaattggtccagtaggatccaaattataaattttgaaaatcaaaaaacggtccacttttaaagagtacgaataaacaaataaagaatgaatttgtgagttcttttaattaaattttttgtttcgataagtaaaattattatttttaattataattagacaattttcacttatttttaattatttaaattataaagttataatttttttattacaacaaaattgcaataatcctttttaaaatatttaaaattatcgctttgtcgcaaacaataacaaaaagcgcagctgtctaagtaatgtaatgtaactgttaaatttttaattatatttatatattatttattcgcttcatattctattaatttgatttttaatttaataattatgtccttactgaaaacatcggtcaacaattctttatattttatgctagattaagccgaataaagagaattttttgatttgcattagcaaacaataatattaacaaacaatattaaattataaaaaattaaattgaattaatattcattattaatgattgattataaatgaacttacgcgaatttaaaatacaaatgataaaacaattaataacacagttttcaccagtggtcagaaaaaaattaattcatccatgattcacataaagcaccaaaaaataaaactaacttttcataacctgtgaattttattagtcagaaaatttgaatttttaaaattatttttctgattttctgccaattttttagtgaattccaataaatatatattaattaatgctgacttattgactttcggttattaacaaacaattcatgaaaatttcaaaatcacttgcgttattatttcttttaaaattatttttatttatggatttttgtgattgtatgtttaaaattaattattttactcgtttaattataaaattatataattacttttatgctattcacttttaaaaaaataattattatttaaaaccatttaattatccttttggattataaaattaaaatttcattttataaaaattatatctacagatttaaaatttaaaatgttttatatttattaaaagcaggattcgatgtcgctttttccgtctcccattaccatcaaacaatataattaattattgaattcaaataaattttttaattcattggtttttctttttcttttatatttatctcaatattctcgtgcactaagacaatttatcaatacatatattaatccaattatagaagttgcattcaataattcgttaagaaatataacaaaaaaaacatttttcttcaatttttggtttaatttattttttaagatggtttacttaagttaatatctatttttaattattttatttaatgaacattcaaatgttttatagtatttagaatatatataaatattatttaatttcttaatttatattatgcgtggagccaaaagcctgcaaaatttagattgttttttcttattttgatttacatatttatcaattatgagagagtatttaaattaatcgtttttctgcgatgaataaagtttattgaatttttttattatttttctataaaattatttcttatttatttaaatttaattcttgtctacctgcccctttcatggctaccttatcctccattttaatatgtattttggtcgtgatcggagaatggatttgccaaatcagttggggtttggatttgccaaatcagttggggtttagatttgccaaatcagttggggtttagatttgccaaatcagttgaggtttggatttgccaaatcagttgaggtttggatttgccaaatcagttgaggtttggatttgccaaatcagttggggtttggatttgccaaatcagttggggtttagatttgccaaatcagttggggtttggatttgccaaatcagttggggtttagatttgccaaatcagttggggtttagatttgccaaatcagttgaggtttggatttgtgaaagcggttgaggtttggatttgccaaatcagttgaggtt

SEQ ID NO: 115 - DNA, 1863 bp, Heterodera glycines
  misc_feature (1841)..(1841): n is a, c, g, or t
  misc_feature (1845)..(1845): n is a, c, g, or t
  misc_feature (1855)..(1855): n is a, c, g, or t
aacacccatttccgatcaaaactattatacacccgacccttttaaacggtctttttaggtacgtgaaggaaaacaaagatttatttaaaattacggcggccggaaaggtacagtcgaacatgaatttgccgattgaaaacagtaattatagagatgttttgttgtatctcgcagggaagaaagatgaaacgccgcgcggtgcaaaatttctcaaagatcggttactgaaggatccaacagtaaaagacatggttgataaatcaaaggtcatgtggggacgtggaaggaaaaaggcaataaaatctataaaaacacccggcatagtgcgagagaagaaacccttcaaaccactaatatgggcaagactgtagagaaaattttatcgaaaatttattttaatttaaaatctccggcaagttttgctggaattcaaaaaattttaaatgaggccaaaaagattgacccgaaaattacgaccgatgacgttaataaattcctagaaaagcagaaaacatacacgattcacaagcccatcaggaaaagattcccgagactaaagacgataccaagtggcttccataccgattggcagtgcgatttgtgcatatttgaccagttgaaaaagcataacgacggttataaatatttattggtctgcatcgacgtgctgagtcgaatgatcttcagtgcaccggccaagtcaaagaagagtgaggacatgatcgaggcttttgatcgggtgttcgaaaagtctaaaattatcccgatgaaaatatatagtgacagtgggcttgaattccaagcaggaaaaatgaaaaaatattttgaggaaaaattcatcatcaaaaatgtaatgtatagtcctgatctgcacgccggagtcgttgaaagggcaaatcggacaataaaggagcgcttgtacagatattttacaaagaaagacactcttcgatgggtcgacgtaatagacaaaataataacaaacattaacaacagtgtgaatagaacactgggagccaaaccgtcttcaattaattttgaaaatgcccgtgcgctctgggaaaaattatataaggagaaggaatttaaaatttcgaaaaagaaaaaatttaaaatcggtgatatcgttcgtattaccaaggaaaagggaaaattctcaaaggggtacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccagggcaggagaacactacgtcaaaattcacagttcgactccccgagactttggaattgggcacaaattggtcagtagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaaattggtttgacaaaatggttgagatgggaaccganattncaacatcccngaatgaac

SEQ ID NO: 116 - DNA, 1860 bp, Heterodera glycines
  misc_feature (1746)..(1746): n is a, c, g, or t
tagacaaaataataacaaacattaacaacagtgtgaataggatcattgggggccaagccagtatccgttacttttgaaaatgcccgtgcgctctgggaaaaattatataaggagaaggaatttaaaatttcgaaaaagaaaaaatttaaaatcggtgatatcgttcgtattaccaaggacaagggaaaattttcaaaggggtacctcccaaactttaccgaagaattgtttaaaatcgttgttgccaattcgacgacacccgattcatacaggatcgaagatttggaaggaaatttaataaaaggcatattttataaccaggaattagtgaaaacagatggatgatttttacattgtactaccttcgaacacaccagggcaggagaacactacgtcaaaattcacagttcgactccccgagactttggaattgggcacaaattggtcagtagctctctcatcaattatttacccctactcattcaccgcactcggtataaacggtcaagagtttattaaagtatgggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaagattcaaaaattgatgtcgcaaagagggccgcagaacgcgccgggagagacgtagaaagacattttaatcagatcaacaatatctcgaattccatccaaacccaactaaacacactacgagaaacaaattctcaaattttagaagagcctgatataaaaatttggtttgacaaaatggttgagatgggaaccgaaattcaaacatcccgaaatgaacttaaatcttttcaagaagaagtagataaagccaaaaacataacattggagcatgtggaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacgtaaggaaattgaaaataaacaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaaaaaatgacacatgtgtttttcgatcccgagtcggtcgattggtcatcttttatcactccccaacatggaagaggacagaaacaatattttgtcggaagcaagtatcaacgngggattcggtttcctcggtaatgtggcacgtttcttgacccctattgcgaggaatattgcctcgagtgcaggacatgaggggctcgccgctgggcagagaggtctgagtgacat

SEQ ID NO: 117 - DNA, 6881 bp, Heterodera glycines
  misc_feature (6795)..(6795): n is a, c, g, or t
  misc_feature (6800)..(6800): n is a, c, g, or t
  misc_feature (6805)..(6805): n is a, c, g, or t
  misc_feature (6846)..(6846): n is a, c, g, or t
ttcaatatgacagcattgatcatcttttcagaagaagtagataaagccaaaaacataacattggagcatgtggaaaagaatgacatgaaagaagcaaagaaatcagccgacgtcgcaaagggaatcgccagacaggcaaagaccaaatatacatcaactctcgaggaatataatgataaatcggaaaagggttttagcgggatggtggttaggcttaacgaggcgctcggtgagcattttaaacgtaaggaaattgaaaataaagaagtttcagaagctgaaaaagggccgcaaaaaagagagagattagccaatgaggatgttcaatttaactacgacagtattgatcaaaaatttattgtctatctttcctctgccgtcacccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaaacacaattatcggcaaccagatggccccactcttaagaatagttaacgtcgtcgatgacccgggatcaattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaaaaaatgacacatgtgtttttcgatcccgagtcggtcgattggtcatcttttatcactccccaacatggaagaggacagaaacaatattttgtcggaagcaagtatcaacggggattcggtttcctcggtaatgtggcacgtttcttgacccctattgcgaggaatattgcctcgagtgcaggacatgaggggctcgccgctgggcagagagttctgagtgacatcgcccagggtcgtgatttaagggatgccgtcagggaacattcaagacaggggttgactaaccttaccgacaagttacaacaatgtgggaaaggaaaaaggtctctgatcactaataagaaccggaaacaagtatatgatcagttaagtttcatctaaaggtataaatggaataaataatacaaaaagttaaaaatgacaactctcaagaaaatcgacacggcgagtgaggacggtctcgaggggggcctttcacttttcgacatccctccgacgaacgttgcaattaataaatccagtattcgggaattgctgccactttcagcaataaatcaatctggaccatatatctttagacttttttcagataatcagttttgtgatctcaataaaacttttctttatttgtcaacttcaattgagagaaaagacaaaagcaattggattccgattaccaaggacagtgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattacacaaatagcggctttaaaaacagagcgtcacgttttgctgatggtgccaaatgtgaaaccatggtgaaacttaattttgatctcgctcgtcagcccaatctattgcttaataactcggatgtcatttttagcatacaccgtaacaccgatgattttctaattatggcaccgccatatgtttcaggaaatgcagtcatagcgaacccgcacacatatcgtattaacatacatgatattagaatttatgtaaaaacagtcgacattacccagtcattaaataacgtaataagcaatcagctacaaaccaccccggccaaatacccggttagaaaaattgagatcaggagtcttttcatcccacggggcacttctgatctctcacacaatgtttttaccagcattgttccgagacgtttaatcgtcgggtttgtttcaaccggtgcgtataccggaaatcctaaagagtcacccttcgtctttgaacatgccaaaatacgctctatcagtgtcgaagcgaatggaaacattttccccgggtccccctattctcttaattttgatagaaacaaatacattcgagcatttgttgacatgtatacggggctcgggatggacgacggagaaaggacaatgtcgatcaatatacaaaaatttgtaaacgggtggtgtttcttcgtcatcccgatgacctctactctagaggacacccccggttttgaattgattcgaaacggaacgaccagcatcaaggtgcaatttaatgagcctataaaggacggcgggtatgagatgatcgttctgggggaatttgattcgattttgtctattaatgctaatcgtgtgctcagtagtgacggaagcatatgatgaattctcatgagattgaaatatttctatccaaacatccaacaacacgaaaatattttatcggtgtttttgcttccgacaagatgcctaaattgaatgacaggcattttccctactgttttgtagcaaataccgacagggcgggcacgataggtgaacactgggttgcctgttttgtaaattcgccgacagaaatagaatattttgattcattgggcgattatcccaacgaagatttaagttcatatcttaacctattcaaacgaattctcattaacgaccgcatcgtccaacatcaattctcagatgcatgtgggcaattttgcatttatttcttgacacaacgatgctatggaatcacttattgtgaggtcattgacggtctatataaggttcgcccgagggccgatttattagttaagcaatttgtcagtaatgtttaatttaattgttctcctaacgatagtcggtcaactcagtggagaaagggttactattctttctgatacacaactttttgacgacaagtatctcactatgacaaagagttcggtcaatgaaagacagttcggattcgatcgctcgagattatgtacgataaataggaatctgatttcagggtggagtgtatcaatccaagaaattaattcaatagaaaagagcggaccaactaatgttaagctttaccaggattttcgacaattaaagccccgagcgtgcttttattacaacgatcatagttatttaattttccaaaacgaaaatacaaatgaaacttcgataacaagaggaagtcaagaaaaggttgttaggaattttcccagtggggaccttagatttgatcacattaatggccgactttttgtaatcagtgacgatcgaatagatgaaattgacattagatcaatcgagaatttatggacacatcataatggcaccaaaattattactaaaccgatcggatcaatgccgtcttcatttaccgatttcctaataattgagggacaaatttatctgattaaggaaaagaaaatatataaagatcgatttgactcaaacgagatacttcccaaatatgtggcagacacaaatagtgaattctttaattttgtcgtgttcaaagaatttgagaaaattaaagtttcaagttcaaatatttgggtatattttttgtcaattgtcgatttggtagtggtcatcatctgtatttcagttctcagaattttaaaaataaaaagaaaaggtaaaaattcatcatacggcggtgaggtaacggtatataaggatttgcaacgaatatgaaaatgcctactggtgctcaaaatgaattctctcattgaaattctatgcgattttaacgaatgcgaacctcacgaattatcagaaattctacgacagcggaagaaacaaaatttgaaatttttgagaagacacgccctaataacgagacaccttaggcacaatcagtttatctcaccggatgacatcgcatttaacggttctaataggctttttgcctaccgaggtttcctcggggttactgtcgagcagcacctctattcaagacacagggtcaaactacaattccctcaactcccatgtataactatgtaccagaataacggtcatagatgctattttccccttgaactgctggattttttataaaaatattacggctaacaggagtgggccttcactttagaccgttccacccccgttagtcctaatatcacattaatttttattcaactttatttaacaaaaaacaaaaataaaatacaaaattaacaaaatccaaatggcatcacattcaattcttcatcaataatccccttctgacagaccggcttgtacatcttgtgcctctccctcgtcacgaccttcgactcccgcgttggactaaaataatatgagattgtttaaaaaaattttcaaaaaacatacccaaaatcatttttgtaaacaaagaatgcggggtctacttccccctttccataattcagcaccatctccttaaacgcatcgtaatgcaacgccttccggttgtccacatcaaacgtcacacccctaatcttcatcacgtaatcgacctctcccgtctccttgctcctgatctttaaaccatactgcttcgccccaccacaacaaaattcttcaatttcgtaacctccatactcctcactcatctctccaaggtatttccccgtcgttattggctccactcctctgtcatgaaacacgaatatactatccgtgtccgtgtacaaaatctccccgccattcctttccgcctccatcataaactccagcaatttcaaccgcgccatgctcgtcgtcctgttaaaattatattttctcgctttttttcaaaaaaaaacttaccataagctgaccacaatattgcttgacttgtgctcagtaacaaactcctccttgtccctgtagatcacccgcatcgcgtcacccgagtactccacaatgtcacacaactccaccttatgatcacacgccaactcgtaaaaggcagactctctgtcaatcaccgcattcttgctcaatgaatttctcatcgaaaatttcccctaaaaattaacattttatcagatctaagaattcgtatttcatacccataaactattcagcataagcttgctgatataccgcaaccccggattcttctgcaccctgctcagttcaatcgcaattccgtacttttccttgtattcctcagcccattgcctcttctgttcatcgctctcaactcctttcggaaatccgcttgactcctccttcaacttcaagaatagccgcacatatcccttgaataaatcatcatccgtcgcttcgtaatgccatgcccggcaaaatctgtccaccctgtaaccacattcaaatgcttttgcctaaacataaatttttaaatacgtttaatgggtgttttttaccaattccaaacttgtatacgttgccacatatctccgctgtgcgtcatcatgggggcatttgtggccacatcttgtagtctccttcttaaacatcgacgcgcacctccagcacagcggaaatagtaatctctcatcacacttcaactgcaggacaggaactcacaacgccctcggcggtatcaccctcactttatacaaccctctgtactgcaaatcatcaggctttgtccactccacattgatctaatccccttttggtaccacaatctccgggactccaatctggtacgctgtcccataattcaccgacggatacaaactgacgatatcaaacaccgagatcttcttcttctcgtcggactgcgcaaacaatctcagaggccctgttcttcctcccgcatacgccatcctcggatcgatcggccctttctcgttccccctgtcgtcgaaaaattcctgcatttctttgtcccccttcagcttgattattggtcgcatcatgatatgcatccatgaaataattcagtctttttgggaacagttgtgaccccagtgtcctcacttgtaattgtccgaagggttacgcattaaaaccagataatgggcgttcgctcttgccgttttgatgtccctaccatagagactctgggttacaaaaattacgcttacgttccaattatgggagcccctggtaaagagtagatcgaggaaagtattctgcatattaagcattaaatcgtcaagtatcagtaaaatgggtttttcctgttctttaatcttattcatgtccggaatcccgttaaaagtctcaacgccctccccgattaatcctaaaatactatcattcatctcaccataacaataaagaattttttcaggcgatggttcaattagattcttatgatgctttaaaaaccgtaatagccaacgggtcttaccactcccagtagtccccgagagaattagagtgaacggaccgcgaaacacttttaatgcatcttatttatttgacctatttatattttcatagggaacatgtttcgcgcatttggggcatagccagaaattatcaaaaaatgatgtaccgaaatgcaaaagactgtgttttttacatctgttacatatctcgtaatgacaggggcagtaatgacaacacttaattttatgtggacagttcattttttcaatttaattttatttttggttgctatttatagaaggagtatataaagggagtgaaaggacaatttgattggtacattgtatcaaaatgcaaaacccgataatcgtaaatataattgctctcgctaatctcggtaccggnattanactanactctctgacgatcaccgaatgcgaatttaagtataacccntagaaatttcaatgcccgcagtatataatgcacag

SEQ ID NO: 118 - DNA, 5147 bp, Heterodera glycines
cttttggacctaatctccgggatccatcgggctctcccatgctaattcaccgacggatacaaactgacgatatcctacaccgagatcttcttcttctcgtcggactgcgcaaacaatctcagaggccctgttcttcctcccgcatacgccatcctcggatcgatcggccctttctcgttccccctgtcgtcgaaaaattcctgcatttctttgtcccccttcagctctttctcaatttgacatccctaaaataattggccagttttttaaaatattcttcattactcacccaaatttcttcaacatccagaatttgccgcaattccgccaacctttcttgcgtctcatcgttcagctcctgcgcagttcttcctccaaccaaatccgccgacgggtcataacagctcaaacaaccgtggatgtaacagcccatcacttcgatacatttgtctctcccgtccatctgtgaaatgaacccgtcgagcttgtacttccccattttcatctccccgccgttgcccgcatgccttatctctacggcatccctcttgctccgccattccaaatattttattgccaccacactcgcgcgatcgttccgctcatacccccgttccggcacaatcgacagttgttcctccaacaaaaacatcgctttgaagatattcatggcgatgccagcattcgtacagctcctcggcaacgggtcaaatcctttcgttatctcatttatcaatatcctcctgaactcaacgaccgcacccaacaatatttccgtatcattcctgcaataattcttcaactcctcgggcaagtaaaacgacgtttccatattctcattatacctaaaattatgggtgatcaatatttcacattttcaccttaccatttctcaaacttttcaaatttttccttcctcattgatcctggcgaataatcctccatcggtggtaaatgcggcaaacgaactccataattctcccttctgttgtaatagtaggggaagaagggcttatcctcacactgcaaattgaacgtcgactttaacgattcaagtttgacgggcatcagcaaacatgaatccctccatatcaataaagaatgcttcttcgaattcttcactttaactcatagatcttcatcccattaattagcggtatcggagtcctgccggtccgacacagataattaaacacaaaatgccctaaaatggagggtttcaaaatcaggataatcatcaaattaccgtcaaaccgcccagcattgtgagcaaaaatgtaggtgtcgtatttcacaaatgccgtcaaaatccactccacaaagtccttggtcggttcatgcccctcagcctcgctccaatccttttccctctcctccccacaaatgttgcaatttgtcctctccttgtcgtcgcagcactccgtacatgtcactcgaaccgaaatgtagttgatgacatgctccatttgatcctccttgtaaattgtgtcctgtgaagtctccgaatcctgaataataaatgaaaactaaaaaattttttctcttcgtacccaaataacaattctgtaaatgtccttgtcctctctctccttgatcggtctgatgtaacatcccctctccacatcatgacaaacattgcacagccggcaaaacatctccccacattcatgcagcttctgtgggttatgcagataggtcttactgcatatcacacatcgcctccacaacatgcaagtttggtgtccctgatggtaatcgtagcattgccggttgtagaaaaagcggtggcaatgtggacactcaatcttcactccaacatccttcacacacggcacgcccccaactcggttgcagtaataacaccgggccctacactcgtacgtatgtttgctttccgttgaataaaaacattcgcaatcaatgcaaaacttcctccctcggttgaaaaagctcacataattcttcaatccgtcccaatgatttccctccaaaaatatcggcaccaccttctcccgggccatcggtcccttccacagcacgcgaatcgatttcctcggatccgcagatttctcaaatgccacaatcctgtactttcccggattcaaatcgtcctaaaattacttttatttttctcatcatttctccaaaactaacccaatgagcctgaaccatcaccaaatgctcaagtccatagccactttcattcctctgcactcccgaatttagcaaaagttcaaacgctgcctccctctgcctcgaaatattctttataaaacgttgaaaagcgaaacgatccatcatcagataattcttcgccgccagcagcgcataaaacaagcaaaatttgtcattgttctctatccttaattttttcgttttttttgttttttttttgtttttattcatttaatttaatctaagatcactcaagcctacttaattcgctgctgttccttgaaaccaaaatcgaatttatgcacatttcgcggtccctctccagctggcagcgctacacaggtgaccttcatctttattgattccgaaagcagaattgttcttttgtcctcctccccttcttctcctccgctctgccccaatttattgatttcctccatgacaacatccgcgttgttttgggggaagggtcggtacggcagccaaattgggtgtccaagtccagccccagtcaatgccacaccaaacattttcactttgcgccccattgtctcctccgtcttcgatatggaattctttatcatgatatcgatcgcttctcgcagtgtttcatcggggcgctccacatccgggttgatcacaaattccgttatgtttttcgtgaaaccaaatttttcgcattttgtagtttggtggtcaataagtttaaagggctccatcgggaaattatttctaaaacggattagctatttatatgttattgtttattaaacttacccgattgagcggaagtcccattttttggccattggcacggcagtgggttggacagagttcacgcgtttaaaagacatttttaaaaaccaaaacgcgaaatttaagaagagtaatagaaaagagcagagagatttaaagaaaatagacggcagaaaaattatagtagattggaaataaaatgtagaaaaaaaaatagagcggagtaaaataaattagagcgcaaagagagtttaatgaaatccaactatttagttgaatgatttgcgatttgggccgggtgtacgaattgggggaaaggggaggggtctagtcacgtgactgtctgggtctaccttaatttagagggtcatcaatcattttagtagacaactgtcacattttattcaaaaactgcaaaaaaaaatcgtctggatattctttatttcgaaagtcgtcaatcatttttttgtgacaggtgacccaaataatgcgcatattgtgaaatagttggtccaaaaactaaaagtcacgtgcacattacaaaataaagggtgaaaattgcgaaataaggaaccaatcaatcatttttattgacagttttattcaaaaacggggcaaaaaattgtctgacgaaattttatgcacatttaaagccgtatttcgggagtcatcaatcatttttcttgacagcttttatttaaaaggggcaaaaaaaaagtgagtcatgcaaaaaaaaagatttcgcaatcgtaaaacaaaaaaattacgaaatcgcaatgcaaaacaaaagaattttatatgaccttaaatttgtacttaaattctatcgtaaattgcattattaaaaattcgctactttcactcacaaaagtgcaaatgaccttcacgcgggagaggggccgagggggcagaaagtgaaagggggaagatgtggtaaaaaaaaaagtttttgaaaatatttaatcattatatattttaaacataaaaattttattggagattaataatcacaaattcttcacaagtttccttctatttgttttttttaatggattttaattatatttaaaattgagcaattttgcgtcattaacatgtaacgattaatgaccttcgcgcggggcgacggaacgggcggcgggagggagggatgggagggacgggggagagacgtaaaaatacacttaaaatatttaaatttgtcataataattgcgtattttaaattgttcttaaagcttacaaaatttctttttatttatttcaaattttaattgtttttttttatattttgcattattaaatgattaatgacctttgcgcggcggccgacctaatgggcggcgggagggagggaggggcggccgacggagagagggtggtggagaggaggggcaaaagtgcagatcaatattggtcaaatttgaatttaatgatagaatagccgcaacattttgaattatgcggcaaattaaataattaacattttttattttgtaaggcggctgcttcaaagggtttggattgtgctcacaaatatcgactttattttatggcggaattcgggattgtgagcgggcggcaacttcaaaacatttaaatggctcgggattttggggaaatatcacgggcggcaacttaaaaatcccccaataggctcgtgattttgcggtaataatcctaaggcggcaacttcaaaggaaaaacaccccttcaataggcttggaattttgcgcgggcggcaacttcaaagataaacaccccttcaataggctcgtgattttgcgcgggcggcaacttcaaaggaaaacaccccttcaataggcttgggattttggaggagtcgttcctgtacccgcgccgttttggcaccatatactacttatctttgaactctttaaaatattatagttgaccgttgttgttataaccatgatgtatgctatatagaaaaatggaaaaaacgatatgattgcgacaatagttattgtaaatgtctatatgaaagttcggagtgttctctaacaaaagtctgtatttacttttttttttaactttattatttttagaatttgttatgctggtctgttaaaatttttggtgaacaatttaaagaacaatcaaaaacataaacaattttttcgcatcaaattaataatactacataatcaacaatttttgaataaatattatattaagcgagttctttctgtaaat

SEQ ID NO: 119 - DNA, 3567 bp, Heterodera glycines
agaaaatgctaaactaatttgattcggaaaaacaaaaatcactcatttagtcgagattatggccacacctccttgaaattgttggcccaatcgaagtccgtttgtcctttaaagtcttcgcaacgcaatcgcttgggttgtccatcttttctcggagagtgcaaccatttggacaatgcttggccagcagaaattattgaatttggcccatcaaaatcatcaccaaacgcagcgggcgacaaatcacaggaacagattgaattcaattggttgagatcggtgagaattgttggcgaagtgcgacgacgcaaatggtccaaatgatcaccaccggtaaagcccaaacagcgaatgtttgtcgaaaaaatgggccaaatttcacgaacaaaaacatcccaaatcggctggccattcgtagagtgtgatgatgaaatccacaaatataaatcggtgcctcttttctcaaaaatttggtgatttaaacgaagaaaagcgatgacgaagtgatcgatgtaactgtgaaaatggaaggaatgcttttattgtcatagctctctgatttttaattactcaatccgaaggttcttaaagcgaattttgctgggcaacggacggtccggcaatggaaatggcacaaattcgtaatcgattcgtacagacagcttcggttctggtcctttgtccttgcgacgaatttcgattggtctccaaatagtcaattcgcttttgccatcgaaatgtttgtccaccaacgcatcgaaacgtggcgaaagaagtgccaatttgaggccgagttgagcacggtcaaaggatgggaaaatgtccatccaaacatcgttgcaaatccaactgaaaaaagttttgttaggtaaataaatgacgaatttgtgcttaccgtcggttcattttttggcaattagcaaaatttgctgttgaatttcgaatgatgtcacacaaatagcagaaaaataattgcgttggataaagcctggatttttagggttttcctattttttacggataatacttgatgagaaaaacacgagaatcgcattttattaaaacaattttgaaccagttcagcttcaactgttgccaatgggctcgaggggttggacaagtgccaataggaggcgaaaaatcattgccaaaaacggaaggcgcggaaacattttgacataaaatgacgacggatcgaaagaaaagggaacgcacataagaggaccaccaaataggagaatattttgcaaatgatgagatttcggggagttttactttaccccaaataaataatcaattcgactagagttgagcggtaatcggtaattgtaaaaaaaccggtaccggtactgaccggtaatgcaaaaaccggtaccggtaccaactttttccaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattgagggtgaccaagtttttttttcaaattcaggataaagaacactaaaattcagatgtagacctcaaaattcagattattgcaaaacaagggatcagcggccaattttccaattttacgaaggggtctccggccatgtaaattaatgtaaatcaatgaccttttttgctttcaacaccgctttttacaggcgcggctgctgcgacaggccgcgcacgcccgcgtcgcccaccacgccaatggcatagccggcgcccagtccacacagaccgcacacgaggcctgcagcgaactggctgaacccgcggtcgatggtgtagccgggcccggccgcctccagccggccggaaatgatcaccgccaccaccagcccgtagatggccacaatgccggccatgaccactgaattttcggatttttttttttgagggggaataatgaaaaaaaaattttaatttaaaaactgataattttcaaaatttagcgctgttctaaaacttgaatcaaaaagtcgaaattctattttgttgtttgagttaaggattcgaattggtcaaaaatggatgtcagatttttcaaaatccgagttcagtgattagcgtatttttaagcctagaaaaagtgttacaaatttaaaaaaaaaatttttttcgggaccgcaattccgaaagattgccagttttattgttttaagttagggttggttcggtgcgtttttaccttttacttcgagttcgaataaaaataaaatttcaaaatttttttggcaatttttatggcattttgttttcaaatttcaaaagaactttttttgatctttgattctttgatacttctctttcattggattttggcgattgaattggcttttttcgttttaaaattgatgtataggcccaaagattagttaaaatttttctataactccgttttttttattaatttgtatgaaaaaataaaggtacaatcagaaattcttgaaaatttttgatttaaatgattttaagaaatttggattttgtcatacgacttatttactaattttagcattttacaaattcgtgccaacaatttgagggatgtctggtgacaattcggcacttattgcagcggagcaagcggcgtatggcccattttttggctcacttggcgtcactgcggcgatgattttcaccgcggccgggtcggcctatggcacggcaaaatccggcaagttttttctgcgcgggagggggagggttggaattttgaaaatttgtgagcgcttgacgcagccctatacctgaaaaacttgcgattttcttccgccagattttgccttccaaaatttttcgaaaaagaaaagttattgcaaaaaacattcgaatgatattaaattcattcaatttgggcaactatgaaatgagttataccccaaaaaccgggctggcgcccagtcgaccttttggggtcggtgatgacgaatctgacatccatttttgaccaattcgaatccttaactcaatgccaaaaaaattgccaaaaaaattttgaaattttatttttattcgaactcgaagtaaaaggtaaaaacgcaccgaaccaaccctaacttaaaacaataaaactggcaatctttcggaattgcggtcccgaaaaaaatttttttttttaattcgtaacactttttctaggcttaaaaatacgaagttttgaaaaaattgctagtctttttttttgttgactttcttataacaaattttctaagaatttttttttgaaaattatgagtttattttttttctacccaacaataaagaaattaaaaaaaaaaattttttttttgaaacgtacctaattctaagaaacataaatttttaaaaaattgatggcggtgaattggattgggaacctgggtacaagccagggacggtccccggatttcggcttggggggggggggggggtaccagcaaggaaaatctaaaattttcagcaaaaatactaatttttccttaaaaatttcgggtgcgtaggggccttggggggggggggg

SEQ ID NO: 120 - DNA, 2324 bp, Heterodera glycines
aaaattttgtatcttaggatcatgataaatttcagtacatattctatttagtgtatttttttcaagtgatatttgttttaatgctttaagtttctaatacgcaatttgttccattatcggaaataattaattgtgtcacttttcttcgcgtgatgtatgggcgaaatgctaaaagaatttattaggcaatgacattggtaagttattccaaatgaatttctcatacaaataagcaatggaaatattgctgaacaacatttgttaattaacatcaaaaatatttagggagaggggttcaatataatcaattacaacatgttgtaatgtatttttaccttttactgtaaaaagtggtagaggaggatttttaggataagtatatttattacttgaaaattttgatagaatggaacaattattattgatttataaaatttcgtaactcacccagttgcctggggggtacgtacccctcgtacgtcccccccccccctgggaccgtccctgtttttcgactataactcctttcataattgtccgaattgaatgtatttgatatcatccgataggcctaaaaatctttataaaccttgctaaagtttaaattgaaaaaatttccgtttttaaaaaagttgtgttcaaaaaatgtttggaaaaacaaatcctaagtcttttggcaataacttttttgaaattaaactaaatttttcaaaaatttacaaggaaattgagaactcttagggctatcgaatgatttcaaattcattcaattcgaacaggtatgaatggggttatacccaaaaaccgggctggctggcgtggcctcagtcggtcggtgctcagtcgtcccaattcgtttcgaaactgttgggtaaatttatttgaattttctttttgctctgttcaggtgctcggtctctacggaatgattgtctcactgctgctaagttcctcctgaacaatggaaggaagaaagaaggaaagaatggcacgtctgctgaacattgtgccgaccgtcgtgttttgatgatcaaaatgaccagccaccgtatataatagataaataccgtattttccatccattcttttttactgtgcccccttttctcattttttactattacattttaaaacgtccaaaaatttggaaaatgagtgcggtgagcgggacaccattaaggcttgggctactgtacatattttgctgaaaatctatatgtaaataccgcattaaaataccgtatttgctctaattatcccccaatctccattaatcccccaatctccaattatcccccagtctaggaggggtttgaaaaataatcccccagtctccatttatcccccagggggataaatagaatttggtcgtaacatttttaggggatgcataataacggaaaagtacctccaatttgtgaaaattttggcctaggaattccgttttttgttaatttgaataaattaggtataatatttcttctgtagcaattggtgaaaattagcagcaattcgccgtgttcatgtgtgacatcatcgtttggaagcaataaaattttttggaaaattcgattcggaatttaattttatttccattttcaattttttttgtaatttgtccataattttatcagttggatttgcaacgacgtttggatggacattttcccatcccttgaccatgctcaactcggcctcaaattggcacttctttcgccacgtttcaatgcgttggtggacaaacattttgatggcaaaagcgaattgacaatttggagaactatcgaaattagcaaggacaaaggaccagaaccgaaactatctgtgcggatggatgacaaatttgtgccatttccattgcccgaccgtccgttgcccagcaaaatcctttttaagcgccttcggattgagtaattaaaaatcagagttatggcaataaaagctttccttccatttttaggtacattgatcactccgtcatcgcttttcttcgttcaaatcaccaaattcactaaaaaacctcatttttacgggtataaaatgacaaaattttagtcaaaaagcaacaaattaagcaaaatcagtattgagtctacacaatttctaatatctttaattttggaggatgaatttttcatttcttagctgagtcgctctcagttgggccggcacggttgggccccagcatgcttttctactattttttctttgtcgtccaaatccgacgatcttggtatccgttcgaaagctcttcagctctattagccttacaaaaagcgaagtgtggtcaagcccatgaaaaattttattaagaaaaatttcga

SEQ ID NO: 121 - DNA, 1469 bp, Heterodera glycines
  misc_feature (77)..(77): n is a, c, g, or t
gctacaatccgtgcgcaagtattgcagaacactgcaacccccgtgttggctgcttttccgaccaaagctgcgactanaaaggtcaacgtttgcaaatttttatgccaaagttgctattttgatcacctctatggcttttcttcctgtccatcatctctctgctggcctcactgttttgcaggcacaactccctcaacaacttatgggcgtcttcaattggtgaattttttgaaacgttaactcaattatttaaatttaaaggttcatggacaattacaccgggagaccgtggttcaggtgctttgacagtgcctcggtttgcaccggaagaatggagtgtgcacaaaagaacgttggatggaggagacagaaccaacaattacgcagaagccttccatcgaaaacttcaacgggcatttgattgtacccatcctactgtcttccacttcatcaacacaattcgatgtgagcaaaagtcaattgatgcagacatctcacgatgcatcgctggtgaagtccctcctctaaagaagcccaaatattgtgccgccgatgaaagaattcttcgacttttgcagggctacaatgccatcaacaataacccggctatccaaaatgatcacaattaccatgccaatgtcaatgttaatcccgataacatcaatcatttgctcgttggtgtttctcgcaattatgaaatgcgcccgtaatttttcaatgcttgttatttttttttgttgttaacacattgataaatatgttatgttattaattttaaaattttttcggaaaaaatcagtagaatctatttttgacaaaaacagcttgccgtactaaaccgacccctcgtactaaaccggccgtactaaaccggccgtactaaaacggccgtactaaaccggccgtactaaactgacccggtccgtgaaatttgggaccagagcgtttgggcccccgtttttgggcccccgacgattgaagcccacgctgttgggacccgggctccccttggatccgcgtttttgggccccgggggactgtgccgcccaacccaaaaacaaaattttgaggtgttctgatagttgaacatcctaaatatataggccatgagggatccctcgccaattgacataacagacgataagtaacctattctcaaaggatacagtctcctcattatctgcctattacgtttcagtaggactgccccgagaacgaaatatcgattttttcatgtgtccgattggggtactccaactgttatggggagccaaaatccaacgcagaatcaaaggacacggctttagggaagctattccgagaaggattgggtctccacataaatctgtgcgcatcggttcaggaggactgtcccgaaaacccaaaaacaaattttttggatatgaattatgtaaatgaactgactagataatatttacaataggttatttctcttcctttcagtatcc

SEQ ID NO: 122 - DNA, 6485 bp, Heterodera glycines
  misc_feature (6308)..(6308): n is a, c, g, or t
  misc_feature (6393)..(6393): n is a, c, g, or t
  misc_feature (6421)..(6421): n is a, c, g, or t
  misc_feature (6447)..(6447): n is a, c, g, or t
  misc_feature (6455)..(6456): n is a, c, g, or t
gcgtttgggcccccgtttttgggccccggggtcgtttgggcccccgtttttgggccccggggtcgtttgggccccaacccaaaaatagaaaaatgtgcttttttaaaaattaagattctaaaaactaagcctgagggatccctcgccacttggcataagttaggtttaattacattcgctcattttttacaattttacttattccaaatcctattattttttaatagttaaccaatttgatgtacattctgatttggacatttttcagaaatggctaacccaattgcaaccaaaaaacaaaaagtaaaattgactctaatgcactttatgagtccaatcaattgacaatccatggtttttatacaataactttttccatgttcgaacaaaccctatctttttggtatcattcgaaagcacaaagtctgaataatgtaataatacgagaaaacaagagaattctaacatttcaagaaagttacaaacgaaaataatcagcaattacttaattaatcaaatcttttgtggtaattgcaaattattgttgaatttatttttaaaatttttattttacatttttatgctgaaatttaaaaagttgtttttactgtgatttttcatttttctgtacttggggcccaaacgaccctggggcccaaacggcccaaaaacgggggcccaaatgcgggggcccaaaaactggggcccaaacgcccccgactcgtgaaatttggcccatttttgcgccaaacattggccatttgaccatttcaaatgctgagcatttggacaatttgcgtcggctcatttcaccaacaattctcaccgatctgaacacaaattcaatggattcccattttctgtaccctgatgggatgatcagtgcttttgatgggccaaatgcaacaacttcggctggccaagcgttgtccaaatggttgcacacgccgacaaaagatgggcagccaaagcgattgcattgcatagattacaacgaacaagcgaacaccaattgggtcaacaatttcaaggaggtgtggccataatctcgaaaaatcactgatttttgttttcaaattgtttagcattttcttcgtgccaccatttcttccgtcagttaccaaattcgttgtacttttcaaagaactttttttggttacaaaaaagttatggttaaaaatatttagaaaaccagttttttgaaatcataaccttttttaaacccacccaacgaaattttttgaaattttgcaggctattagatgactcttaacgctatcgaaacaaataagaatctttaatttggatgcttttaaaaaagttatggtgcattaaaattgtcgaattattttatggtcgtgtctttttttgtggtcgtgtgaaccagggttgttccgggacgagaaaaatgtcgggattcggacaaattttgattttctttttcaattgtttaggcatttctctgtgccatcacttcgtcttctgcctgctacacaattcaattatatttgtccgcctcattgccaattgtgccatttgaattggtgaacgaacgaacccatgaaaagctgacaatggccaaagacggcacatttggatttactattcgatggataatccggcggtgtccaagtggggagacggttcgctggactcttgcacttttattgtggcaataattgcattgggtgagcagcaacgcatttgccattgttaaagtttgttaaagtgttcatcatcaaattcaaattgcacttaatttaggccattgtatccacaatcaacaaaagaagcggagaaaagagcgcctaattaattatgtggtagccaattaattacatttgacaaattgccaatcatttcgaattattgaatgaaaaattgttgttttgatacttttttttgtccatttttaattgttgattttatgttttcgaaaaaatcttgtttattatgtaaattaataatacttcccgagaaattattgttataattgctacagtacccattcattccttcggcatatggtaatcgactttgttcccattttaattccattcacattcattctctttctttcgtttctatcctttagcaaattttcctgttcgattaaatttccatcctaaattgtccccccgccccgttttttaattaatttgcctttgcccgccggcgcaatgggcgacgaaaactaaccaggcacatcacttttggccgactgtttataacggtttagcttcaaaatagtgccaaaatatttttgcccacaaactcaaacattctcttgttatccttttgaaggcgtatagtgtgctttatcacctcacaaaaaaatttcaaaaagttgccaattcgcaaaaatttatggcaaaaaaaaaacaaaaagtgcgcgaggaatttcaattttttctttttgagttttggccaatttttttttgaaatttgacaggagggctctctaataatttaatgtttgattgggtgtaaatcaattaaataataatttgcctcccctccaaaaaatgatgccaacaattggccacgccctttgcctctttggcctaacattcaaaatgccattccatgccaattttatcactaatcaattatgattggtccattattttcttaattaattcattcttcttctgcggctgatcaccgttccgtttttgttcgtttgtccgtcactaattgtcagcagaagacgaccctttttcgctgctttgtcccgcttcttgttcttcttctgctgatggcggagacaatggccttaattaagcgaaatttgaattatttaacaaaactaaatgttttttttaattgctcacccaatgcaattagtgtcactatcaagccaaatgaacacattgttacaattgttgtcccaattttcatctttctgaagctgaacatccgcggcctctccaacgattgatctccaaattgtcaattcgcttttgccattgaaatgtttgtccaccaacgcatcgaaacgtggcgaaagaagtgccaatttgaggccaagttgaggacggtcaaaggatgggaaaatgtccatccaaacgtcgttgcaaatccaactgaaatgggaaaacagtttagtcaaataaacgacgaatttagacttttaaaattcttttaccgtcggttcatttttggcagcaattagcacaatttggacgagttccgaatgatgtcacacaaatagcagaagaattaattgcgttggaaactttatttttatataatgagaaaagcggaaaaccaaaaattctaacgaaaatcatgtagaacataaaaggtaactcgcccggtgggactcgaacccacgacctcagcaatccgtgccgtgctctaaccaactgagctacgggcgcctcttttagaggttctctcaggtcctttatcccactttctcccacactccgttccttctggcatcacattccgcctccctcggaagaccggtccctcgggctctccttggcccttcaccgacggacttggactctccttggtccagtggtcccggcagtgtggaggggatccacccaggagcgccaaatagtaaaacttctcgccgttcggtgctgttcgctgcttatttgccttagattaattagggcaggggcacgggaacagtctttaattaggacaggagagattggggacaatattattattagggactttgaccaattcgttcggcttctttccaattatgccgactcagtcaattcgcaataaatgcaattgactgcacaattaaaacacaaacaaaattattccacagcacacaaatatccgcaattaccacgaatcattattaaaacaaattactacaattaacgacttaaaaaaaacgcaaatgaaaaagctcaacaaaaataactaaacaaaatgccaaaaataataaattaaaataatatcgaatggtcaaagtcaaaatatcactacatcccccgctcctcaaaaaaggcgtccctgccgtcaaattggaaaggtttggtgggtcgatcagaacaacaaggctaacgacgagagtgcgacgggccacgaccacggtacggcatcacggcgcggttgttccaacggctgtatggatgatggcgttcacggctgggcacttctccgaatgtgtggcgccgatggtcccccagaccaatcgagcccaagctctgacgtcgctgatcacgatcgcgatgtccaactgatccaattgtgtgacgtcgacggtcccccagacctatcgagtcatttacggccaaagacgaagtgcttgcttggcgatggtcccccagacctatcgtagcaacggcacgaacggtcgatcgaattgaccgaattttcagcttctgatcgcccgggaagtcggattgggtgaacagccatgccttcagcgctcgcaaaccggcctcttgcatcagtccatccgttgtcactctttggttgtcgaatgaattggcgaatcggaacacttcgtgaagcgatcgccctttttctgtcacccaaacaggaagaaaaggtttttggctcatcatcggcaccaagctttcgatcagttcttcgtactcgtcgtgtttgtcgtgcacgtacggtgggcatgtccaaaagaacttcacttgcgggaatcggcggcacaaattggcaatcatctcgtattgctccatcatcacttcaatggtttctccgcccaagagtgaatctcgtccgacaatgatcagtgcggccttcactttgctggagagcaccacgggcttcaggcttcgcactgtctccgccaatgttccattttttggcccgatcaccgccgtttgatccaagatttcggccaattggtgggctgtcgaatctccgattatgacacgtggcaaggcgatcagttttgtggccttgtgaatgattttggccctcaatttctccagcacccacggtgtctctcccatcgcttcttcccatttcttcttctcagaatcggccaaatgattgagtccgacgggttcgtccatgccgatgcgacacatacctccaattatttcgtgaaaatgtgttgaatatgctgaacgaagcgaggaaaaattctgatgaagaaagaatgagaagtaaaatttggtacgattcccagccgaaagtgacggctaacaaatttgaagcggggcaacgcgtaatggttgcctttcccggactgaatcgccgatctcggcacaagaaattgttgtggtctcatttcgggccttatcttatcctagaaattaacgaatcgtcggcatttttagtcccaattgacaacagaaatgctgagcccataaaagttccgattgagcgtctaattcgaattcctccaggaatcccggacatttcaacacttccaaaggggaaaaacccatttaaaaatgcgttaaaatcattaattgtcagcattttatcgagttttgaagtctgtgaatcagatggacaaatggcccattatgagcaattaggggcaattgctaatttaaagggtggcgaaggaatgattagaaaaatggaaaaggcggcgcaatcaagagaaattcccttttcagagatggaaattgacaacgaagatgaagcagaggacacgttcggttggaatgccaagtgtgacgtcggtcaaggcgaacatgaattttgtgccattctccgtgtcgcagaactcgatccagcgcttggaaatgctgaattgggctcaatcacagtgaagacaccactgcaggcacttttggcggtgttccttttgaaggccgggactgtcaaatcaatgacagccgcaagaagttttgtcaaatcgataattgaaggagcgccaaaagaggagctcagtctgttcgtgaccaaaaagggagactatgtggcgacaggacaatgcccaactgaagaagaccaaatgaaggcgctggagtgttggttcgaaaagtgctccgtggcaaagcatgctttggaagagagcggattcaaaaaaatcggcatggacgaacccgtcggactcaatcatttggccgattctgagaagaagaaatgggaagaagcgatgggagagacaccgtgagtgctggagaaattgagggccaaaatcattcacaaggccacaaaactgatcgccttgccacgtgtcataatcggagattcgacagcccaccaattggccgaaatcttggatcaaacggcggtgatcgggccaaaaaatggaacattggcggagacagtgcgaagcctgaagcccgtggtgctctccagcaaagtgaaggccgcactgatcattgtcggacgagattcactcttgngcggagaaaccattgaagtgatgatggagcaatacgagatgattgccatttgtgccgccgattccccgcagtgaaagtcttttgnacatgccccaccgtacgtgcacgacaancacgacgagtacgaagaactgatcgnaagcttgnntgcgatgatgagccaaaactttttcttcc

SEQ ID NO: 123 - DNA, 6297 bp, Heterodera glycines
ttaaaaaataaacaaaataaatatataaaatgttatataaatcattaaaatttagtaaaccttaacaacccttgtgctcaaaaatttctatgttattgacaattaaaaaatttatctatggaaacctgttcaatcttattatttagtcaattcttacggttgtttaaacgcatagttaaacatgtatttagtttctgtttggacttagacctgaatacccagattagttggccccgaaataacaagacccgtctaattttgtttaaactcataaaattttagaacccgtctaattttgtttaaactcataaaattttagaacccgtctaattttgtttaaactcataaaattttaagtcttgaacagaccgagccttgcaatgttataattataagttataaaatacatatgttggcattgttttcatgacttttcaaaagaaaaattttttttcaaaaaagggggctaccatcggcagtattaccgaatcggttttgcacaatgaggattttgtgaaaaagaatttccgacttttgttcgaattcgggtccgcgttcaaaactgattgaaattaaaatctcgaaaaaatctaaatttggtatacaagactaatttagaagagaaaaaagaaaatttattattttggacgaaaaaggggaatgcgccaaactatattgaaagaaaaataattatattcttgatttttttttgtgtgaaacaattatttttgataacatgccataagttaattttctgactccttgttttacctttctcaaaaaattgattcacccattcaagctcgttaaggttaacagcatgataaacattgcccatttgttagtaaatttcttcaattttcagaagcgaaatttgccgttttgccatgctgtgggtcgacctttcttggtagcacttgccggagctaaattttttttattaataaatggttattttttgctggtcaacataataaatttcatagaaacaaatactcaaaatgtcattttaaacagtgatcgaaaccatttttacatattttttaaatcaaagcaaattcaaaaaaaattactgaaaatccatttttttgtgttgaattatcaaaagatttacttttttcattttcctgctgcggttagttcataagtgacaaaagtcggtgcgccgtgacacgggcattttacttcagcggttataacatgccgtgtcgctgtatttttgactttgttaacttcgattttgatcaaagttttgtctgagcatgggcacgggcaaaggtactcttcaaccattctttttggatcactaaatatgaactgaaattattttgcccttccttccgagccgcccagcctggggtcctcttcaaagaggggggggggacagaaatcgaccacccgcccccttaaattaataattaccattatcgaagaaatcgtctgcccatttttgacaattgtaccatattacacaatagcccctcaacggcatgtcagcgtatacgtcattcagagtttggtgacatcgcaatttttttggttcgaacgattttgatgaagtttccgtactctcccaacctaaagtgttggattttcatttttggacaaaaaactagccaaaatccctaaaaatttccagtcacaaaaatccattattttcttaaaaatgagctccaaattaaaaaatggaaattttttctgttagttaacatatgtattgcactcaatttttaaaaaattttccggcggcgcttgttggcaccatcgtctcccactttttccaattgttaaaaatctgatgttttttgacggatcggattccgtaagattttggtgacacccctggtcaccacaaaaaaaattttacattgcgctctttccttttctgctgaattcatacgttacgtgagtttttttggcgcatgtcttgcacaagaatgtgaccacagcacaatggtgctttggagcaggcgcaatgggaagcatgtcatatgaggtgattcggattttgattgcggtttgatgttcgtagatatgacagaagtggtcattcctccaaccgccagagtgtgccaatgtgtcgggcttcaaagagccaccggagctgctactgctacttgaggagtgggaagacatttttgaacagaataattggcttaaaaagagtaatggttttacgaaatttttacaaaagcaatgagcaaaagaaaacccaattctcaagtaattttggatttaaaacgaccttttttaaatagccacctaaaagagacacgaaaaaaaggcatctaaaatgcatgaaaaggacaaaaagtagggatgtgcgagaagtgatttttactgggaaccgagaaataaccccggaaacgataagagatccaaaaaccgagaaatttctcgactcggaaatcgagaaatttaaatgaaaagaatccaaataaatcaaaaacacattaaaaatgaggtagatcaaagggaatttttgcgtagaagtctcagaagtctcaacattaaagtgacagcgttttttgctgttaaaaacgctttttgcacactttttacaaaaaaaaaacttgggaaacatgagggtccgacggtgccggtaggcgaggattctgatcgaaatttggggaacaaatgaataagcaaatcgtaattttcagtgcattcgtgattcaaacggctttttttgcggcatttttcaaaaaactttttttaggcttggggagtcagggtggcaacatgaagtttgggcaccagagggagggatttaaaaaaataaaacaaaataaatatataaaatgttatataaatcattaaaatttagtaaattttaacaacccttgtgctcaaaaatttctatgttattgaaaattaaaaaatttatctatggaaacctgttcaatcttattatttagtcaattcttacggttgtttaaacgcatagttaaacatgtatttagtttctgtttggacttagatctgaatacccagattagttggccccgaaataacaagaacccgtctaattttgtttaaactcataaaattttagaacccgtctaattttgtttaaactcataaaattttagaacccgtctaattttgtttaaactcataaaattttaagtcttgaacagaccgagccttgcaatgttataattataagttataaaatacatatgttggcattgttttcatgacttttcaaaagaaaaatttttttttcaaaaaagggggctaccatcggcagtattaccgaatcggttttgcacaatgaggattttatgaaaaagaatttccgacttttgttcgaattcgggtccgcgttcaaaactgattgaaattaaaatctcgaaaaaatctaaatttggtatacaagactaatttagaagagaaaaaatacaaaaaagaaaatttattattttggacgaaaaaggggaatgcgccaaactatattgaaagaaaaataattatattcttgatttttttttgtgtgaaacaattatttttgataacatgccataagttaattttctgactccttgttttacctttctcaaaaaattgattcacccattcaagctcgttaaggttaacagcatgataaacattgcccatttgttcgtaaatttcttcaattttcagaagcgaaatttgccgttttgccatgctgtgggtcgacctttcttggtagcacttgccggagctaaattttttttattaataaatggttattttttgctggtcaacataataaatttcatagaaacaaatactcaaaatgtcattttaaacagtgatcgaaaccatttttacatatttttttaaatcaaagcaaattcaaaaaaaaaaattactgaaaatccatttttttgtgttgaattatcaaaaggtttacttttttcattttcctgctgcggttagttcataagtgacaaaagtcggtgcgccgtgacacgggcattttacttcagcggttataacatgccgtgtcgctgtatttttgactttgttaacttcgattttgatcaaagttgtttgagcatgggcacgggcaaaggtactcttcaaccattctttttggatcactaaatatgaactgaaattattttgcccttccttccgagccgcccagcctggggtcctcttcaaagaggggggggggggggacagaaatcgaccacccgcccccttaaattaataattaccattatcgaagaaatcgtctgcccatttttgacaattgtaccatattacacaatagcccctcaacggcatgtcagcgtatacgtcattcagagtttggtgacatcgcaattttttggttcgaacgattttgatgaagtttccgtactctcccaacctaaagtgttggatttcatttttggacaaaaaactagccaaaatccctaaaaatctcccgttacaaaaatccattattttcttaaaaatgagctccaaattaaaaaatggaaattttttctgttagttaacatatgtattgcactcaatttttaaaaaattttccggcggcgcttgttggcaccatcgtctcccactttttccaattgttaaaaatctgatgttttttgacggatcggattccgtaagattttggtgacacccctggtcacctcaaaaaaaaatttaaatgtttacattgcgctctttccttttctgctgaattcgtacgttacgtgagttttttggcgcatgtcttgcacaagaatgtgaccacagcacaatggtgctttggagcaggcgcaatgggaagcatgtcatatgaggtgattcggattttgattgcggtttgatgttcgtagatatgacagaagtggtcattcctccaaccgccagagtgtgccaatgtgtcgggcttcaaagagccaccggagctgctactgctacttgaaaagtgggaagacattttttaacagaataattggcttaaaaagagtaatggttttacgcaaatttttataaaagcaatgagcaaaagaaaacccaattctcaagtaattttagatttaaaacgacctttttttaaatagccacctaaaagagacacgaaaaaaggcatctaaaatgcatgaaaaggacaaaaagtagggatgtgcgagaagtgatttttactgggaaccgagaaataaccccggaaacgataagagatccaaaaaccgagaaatttctcgactcggaaatcgagaaatttaaatgaaaagaatccaaataaatcaaaaacacattaaaaatggggtaaatcaaagggaatttttgcgtagaagtctcagaagtctcaacattaaagtgacggcgttttttgctgttaaaaacgctttttgcatactttttacaaaaaaaacttgggaaacatgaggatccgacggtgccggtaggcgaggattctgatcgaaatttggggaacaaatgaataagcaaatcgtaattttcagtgcattcgtgattcaaacggctttttttgcggcatttttcaaaaaactttttttaggcttggggagtcagggtgcatgaagtttggcaacatgaagtttgggcaccagagggagggatttaaaaaaataaaacaaaataaatatataaaatgttatataaatcattaaaatttagtaaattttaacaacccttgtgctcaaaaatttctatgttattgaaaattaaaaaatttatttatggaaacctgttcaatcttattatttagtcaattcttacggttgtttaaacgcatagttaaacatgtatttagtttctgtttggacttagacctgaatacccagattagttggccccgaaataacaagaacccgtctaattttgtttaaactcataaaattttagaacccgtctaattttgtttaaactcataaaattttaagtcttgaacagaccgagccttgcaatgttataattataagttataaaatacatatgttggcattgatatagaatgaatggtaatgaactaatgagtttagcaaaataagcatgcttaatcgagtgaatattcgttaaaaaattttctattcctaacttgattcgacttgataacagattttcaccaaaaaggccaatttttgcatgacaaattttaggtcaacttttgaaatctggggaattttgtggcacggcgcgctgaagacgccgaccggaaaatttttaaaaatgtgtgtccagggctattctgggtcgctgatcaagaatacgacatccatttcgatcaatttcgaacccatgacccgaattcgaacaaaagtcgaaaattcattttcaccaaaa

SEQ ID NO: 124 - DNA, 7367 bp, Heterodera glycines
  misc_feature (31)..(31): n is a, c, g, or t
  misc_feature (7339)..(7339): n is a, c, g, or t
cattaaaatttagtaaattttaacaaccctntgtgctcaaaaatttctatgttattgaaaattaaaaaatttatctatggaaacctgttcaatcttattatttagtcaattcttacggttgtttaaacgcatagttaaacatgtatttagtttctgtttggacttagacctgaatacccagattagttggccccgaaataacaagaacccgtctaattttgtttaaactcataaaattttagacccgtctaattttgtttaaactcataaaattttagaacccgtctaattttgtttaaactcataaaattttagaacccgtctaattttgtttaaactcataaaattttaagtcttgaacagaccgagccttgcaatgttataattataagttataaaatacatatgttggcattgttttcatgacttttcaaaagaaaattttttttttcaaaaaagggggctaccatcggcagtattaccgaatcggttttgcacaatgaggattttgtgaaaaagaatttccgacttttgttcgaattcgggtccgcgttcaaaactgattgaaattaaaatctcgaaaaaatctaaatttggtatacaagactaatttagaagagaaaaaatacaaaaaagaaaatttattattttggacgaaaaaggggaatgcgccaaactatattgaaagaaaaataattatattcttgatttttttttgtgtgaaacaattatttttgataacatgccataagttaattttctgactccttgttttacctttctcaaaaaattgattcacccattcaagctcgttaaggttaacagcatgataaacattgcccatttgttcgtaaatttcttcaattttcagaagcgaaatttgccgttttgccatgctgtgggtcgacctttcttggtagcacttgccggagctaaattttttttattaataaatggttattttttgctggtcaacataataaatttcatagaaacaaatactcaaaatgtcattttaaacagtgatcgaaaccatttttacatatttttttaaatcaaagcaaattcaaaaaaaaaattactgaaaatccatttttttgtgttgaattatcaaaaggtttacttttttcattttcctgctgcggttagttcataagtgacaaaagtcggtgcgccgtgacacgggcattttacttcagcggttataacatgccgtgtcgctgtatttttgactttgttaacttcgattttgatcaaagttgtttgagcatgggcacgggcaaaggtactcttcaaccattctttttggatcactaaatatgaactgaaattattttgcccttccttccgagccgcccagcctggggtcctcttcaaagagggggggggacagaaatcgaccacccgcccccttaaattaataattaccattatcgaagaaatcgtctgcccatttttgacaattgtaccatattacacaatagcccctcaacggcatgtcagcgtatacgtcattcagagtttggtgacatcgcaatttttttggttcgaacgattttgatgaagtttccgtactctcccaacctaaagtgttggatttcatttttggacaaaaaactagccaaaatccctaaaaatttcccgtcacaaaaatccattattttcttaaaaatgagctccaaattaaaaaatggaaattttttctgttagttaacatatgtattgcactcaatttttaaaaaattttccggcggcgcttgttggcaccatcgtctcccactttttccaattgttaaaaatctgatgttttttgacggatcggattccgtaagattttggtgacacccctggtcaccacaaaaaaaatttaaatgtttacattgcgctctttccttttctgctgaattcatacgttacgtgagtttttttggcgcatgtcttgcacaagaatgtgaccacagcacaatggtgctttggagcaggcgcaatgggaagcatgtcatatgaggtgattcggattttgattgcggtttgatgttcgtagatatgacagaagtggtcattcctccaaccgccagagtgtgccaatgtgtcgggcttcaaagagccaccggagctgctactgctacttgaggagtgggaagacatttttgaacagaataattggcttaaaaagagtaatggttttacgcaaatttttacaaaagcaatgagcaaaagaaaacccaattctcaagtaattttggatttaaaacgaccttttttaaatagccacctaaaagagacacgaaaaaaaggcatctaaaatgcatgaaaaggacaaaaagtagggatgtgcgagaagtgatttttactgggaaccgagaaataaccccggaaacgataagagatccaaaaaccgataaatttctcgactcggaaagcgagaaatttaaatgaaaagaatccaaataaatcaaaaacacattaaaaatgaggtagatcaaagggaatttttgcgtagaagtctcataagtctcaacattaaagtgacggcgttttttgctgttaaaaacgctttttgcacactttttacaaaaaaaaacttgggaaacatgagggtccgacggtgccggtaggcgaggattctgatcgaaatttggggaacaaatgaataagcaaatcgtaattttcagtgcattcgtgattcaaacggctttttttgcggcatttttcaaaaaactttttttaggcttggggagtcagggtggcaacatgaagtttgggcaccagagggagggatttaaaaaaataaaacaaaataaatatataaaatgttatataaatcattaaaatttagtaaattttaacaacccttgtgctcaaaaatttctatgttattgaaaattaaaaaatttatctatggaaacctgttcaatcttattatttagtcaattcttacggttgtttaaacgcatagttaaacatgtatttagtttctgtttggacttagacctgaatacccagattagttggccccgaaataacaagaacccgtctaattttgtttaaactcataaaattttagaacccgtctaattttgtttaaactcataaaattttagaacccgtctaattttgtttaaactcataaaattttaagtcttgaacagaccgagccttgcaatgttataattataagttataaaatacatatgttggcattgttttcatgacttttcaaaagaaaaatttttttttcaaaaaagggggctaccatcggcagtattaccgaatcggttttgcacaatgaggattttgtgaaaaagaatttccgacttttgttcgaattcgggtccgcgttcaaaactgattgaaattaaaatctcgaaaaaatctaaatttggtatacaagactaatttagaagagaaaaaatacaaaaaagaaaatttattattttggacgaaaaaggggaatgcgccaaactatattgaaagaaaaataattatattcttgatttttttttgtgtgaaacaattatttttgataacatgccataagttaattttctgactccttgttttacctttctcaaaaaattgattcacccattcaagctcgttaaggttaacagcatgataaacattgcccatttgttcgtaaatttcttcaattttcagaagcgaaatttgccgttttgccatgctgtgggtcgacctttcttggtagcacttgccggagctaaattttttattaataaatggttattttttgctggtcaacataataaatttcatagaaacaaatactcaaaatgtcattttaaacagtgatcgaaaccatttttacatatttttttaaatcaaagcgaattcaaaaaaaaatttactgaaaatccatttttttgtgttgaaattatcaaaaggtttacttttttcattttcctgctgcggttagttcataagtgacaaaagtcggtgcgccgtgacacgggcattttacttcagcggttataacatgccgtgtcgctgtatttttgactttgttaacttcgattttgatcaaagttgtttgagcatgggcacgggcaaaggtactcttcaaccattctttttggatcactaaatatgaactgaaattattttgcccttccttccgagccgcccagcctggggtcctcttcaaagaggggggggacagaaatcgaccacccgcccccttaaattaataattaccattatcgaagaaatcgtctgcccatttttgacaattgtaccatattacacaatagcccctcaacggcatgtcagcgtatacgtcattcagagtttggtgacatcgcaatttttttggttcgaacgattttgatgaagtttccgtactctcccaacctaaagtgttggattttcatttttggacaaaaaactagccaaaatccctaaaaatttccagtcacaaaaatccattattttcttaaaaatgagctccaaattaaaaaatggaaattttttctgttagttaacatatgtattgcactcaatttttaaaaaattttccggcggcgcttgttggcaccatcgtctcccactttttccaattgttaaaaatctgatgttttttgacggatcggattccgtaagattttggtgacacccctggtcaccacaaaaaaaatttaaatgtttacattgcgctctttccttttctgctgaattcatacgttacgtgagtttttttggcgcatgtcttgcacaagaatgtgaccacaacacaatggtgctttggagcaggcgcaatgggaagcatgtcatatgaggtgattcggattttgattgcggtttgatgttcgtagatatgacagaagtggtcattcctccaaccgccagagtgtgccaatgtgtcgggcttcaaagagccaccggagctgctactgctacttgaggagtgggaagacatttttgaacagaataattggcttaaaaagagtaatggttttacgcaaatttttataaaagcaatgagcaaaagaaaacccaattctcaagtaattttggatttaaaacgactttttttaaatagccacctaaaagagacacgaaaaaaggcatctaaaatgcatgaaaaggacaaaaagtagggatgtgcgagaagtgatttttactgggaaccgagaaataaccccggaaacgataagagatccaaaaaccgagaaatttctcgactcggaaatcgagaaatttaaatgaaaagaatccaaataaatcaaaaacacattaaaaatggggtagatcaaagggaatttttgcgtagaagtctcagaagtctcaacattaaagtgacagcgttttttgctgttaaaaacgctttttgcacactttttacaaaaaaaaaacttgggaaacatgagggtccgacggtgcaggtaggcgaggattctgatcgaaatttggggaacaaatgaataagcaaatcgtaattttcagtgcattcgtgattcaaacggctttttttgcggcatttttcaaaaaactttttttaggcttggggagtcagggtggcaacatgaagtttgggcaccgggaagtttgggcaccagaaggagggatttaaaaaaataaaacaaaataaatatataaaatgttatataaatcattaaaatttagtaaattttaacaacccttgtgctcaaaaatttctatgttattgaaaattaaaaaatttatctatggaaacctgttcaatcttattatttagtcaattcttacggttgtttaaacgcatagttaaacatgtatttagtttctgtttggacttagacctgaatacccagattagttggccccgaaataacaagaacccgtctaattttgtttaaactcataaaattttagaacccgtctaattttgtttaaactcataaaattttagaacccgtctaattttgtttaaactcataaaattttaagtcttgaacagaccgagccttgcaatgttataattataagttataaaatacatatgttggcattgatatagaatgaatggtaatgaactaatgagtttagcaaaataagcatgcttaatcgagtgaatattcgttaaaaaattttctattcctaacttgattcgacttgataacagattttcaccaaaaaggccaatttttgcatgacaaattttaggtcaacttttgaaatctggggaattttgtggcacggcgcgctgaagacgccgaccggaaaatttttaaaaatgtgtgtccagggctattctgggtcgctgatcaagaatacgacatccatttcgatcaatttcgaacccatgacccgaattcgaacaaaagtcgaaaattcatttttcaccaaaatccggactcgattcgaacaaaaagtcggaaaattcaaaaaatttcgaaattaacttttatgttctgatctgtgcagagtgattattttttggtgttgtaatggtttgtaattaatttttgcttgttttaatctattttagaaaaaaatttctaattttttaaattttcgactttttgttcgagttctacttccggattacaatataagtcgaaatcgacgccggatcgtgatcagcgaccctgaaaagccttggaaacatgttttcatgacttttcaaaagaaaaaattttttttcaaaaaagggggctaccatcggcagtattaccgaatcggttttgcacaatgaggattttgtgaaaaagaatttccgacttttgttcgaattcgggtccgcgttcaaaactgattgaaattaaaatctcgaaaatatctaaatttggtataaaagactaatttagaagagaaaaaatacaaaaaagaaaatttattattttggacgaaaattgcgtaaaaaccgaaaattttcgaaaagtagcatcaaatgaatattttgaatttcactgatttgaggccaaaatagccgatttgatagagggggccatcttaatagaggattttttttgaaaaaatgcccaaatatgcacataatatgcatataaattgctaaatatgcacaaatatttaaaaaatgcatattcaatgtcctcaaaccaaagctaaaactcgtttttcgtgtgcattaggtcgtaggaagttagtaaaaaagtcataagcctcaaaattcgggacctaatcatgaaaaaagttaaataagttttgaaatttttggccaataaaatgatcagtaaagggagagagagagagaggggagagagagaaatagagaaagaaaaccgatttggagagatgaagtgaagtataaaagaaagtgatcagctctagtgatcacccatccaagttagagatcatgctttccttttttataaattanatttgatagtgccatgccgccatttcta

SEQ ID NO: 125 - DNA, 1928 bp, Heterodera glycines
  misc_feature (106)..(106): n is a, c, g, or t
  misc_feature (147)..(147): n is a, c, g, or t
  misc_feature (167)..(167): n is a, c, g, or t
  misc_feature (185)..(186): n is a, c, g, or t
acgtcaagcgttacatcaacttgtcaatagagctgtacaaaatgcggaaaagcaaagcggacgctctgtttcaaaataggaataatgtggctgggaaaaggattanccgatccggttagtgctgcctttgagccctccagcacaaancaatatgacgttgtaaatgnccgagatggacaaactgnnccaaagcgagggagacgaaggaggcgttaccaaaaaaaactttgctactcagcgagccggtggagatcatcgttacatgtttaactattccggcaggatcggcaccacaattctttccacatcagaattggggctacaatcaaacgcaaataattcatatatccaaccgagacaactattgtctctttcatgctcttgctgcaggccgagcttatcatgattatgaaatttttcgctccattcgcagtccaccagataaccaagctccactttttgcagctataaagaatagaacagacttttgcaaggattatgaagcgtataaccgtctattatcaaacagcgggcgaatggaatctgtagttgaagatctgatgaagaactcaggcatcattattggccaagattcttatggaattgaccatctgctacctgttcagcaatactgggtaatttttgtctacaatttcaattttttactaatgaaaatatatgagtgtgcttcaggatagcgtttttcctggaatgtatcgtatagtgttatttgaagaccggccagaagagttaccccggcccttatggaaaggagcagggggacatcgttttaacgtcacgctttttctctctaacaaccattacgatgtgatcaaaaagattcactgtttcttcaaacttggtcggaaatactgcgttgactgcgaatgtacgtacactgttgatgctaaacatacaatgagttgtaagagcaagtgtcctcaatgttctaaaggtttgcttatttgtgaacatttttaaatgactgatattttagttggacctcaacatccttgcccgagacaggacggcgttcgtattttttgctcagaatgtaaccgtttctttttctcgtcgccgtgttataatggccatcttggtctagcatgcaaactctataacggtgttcgctctgtaatagggtttatcgctctgataatggtcagcggcacaaatgtgacacaagctactgcaaaagatgcaaggtttaaatggtcaaatcgaagtaaatatattatataataaagaatattcaggtttatcatgacaaaaaggcgagctgttttattaaaaagatcaaaatgtctgaggaagaaccgagctatcggattgttgtctgggacacagaaaccagacttgaaaaacttgaggacgaagggcagcatatacatgtggtcaactttctttcagcacgcattacttgtaccgattgctgtgacgcatcagtgttagaagcagattgtgaaatttgttgccagagcgacgggacgcttgaacgagccaaagaatggttgagcaaattgaggaaattttaatattttaccaaaattcaaataggagtgaagcagatggcgatgatcaacctgttgccgcctttgtcgaatggattttaagggcgtggaataagcaatacaaaacatacatatgggtggggtgaaaaaaagttacttttaaaaatttgtaaattattaggctcataacgcctcaagatttgatggccattttgcgttaaattatctatgcaaaaccgttaggcgccctgatgtcgttatgaatggactcagaatataacgagtttcgtgtttgacacagtccaaagcattcaatcttgatcctggcgtgactccatgtctgaatatgccgattgcgctcgcttgattttaaaaaagaatttcaaccttgacttgagaagacaacaccgatcttcc

SEQ ID NO: 126 - DNA, 9056 bp, Heterodera glycines
agctcgttgacggaaagtcgtgtcaagagctgaatgaaatgacgcaagaccgacttcgtcaacttcgcgagctgacgcggatgggcgcagtctacaagttgaagaaatttgggaatgtgaaataaacgaccagctcaagagaaaccatgaaatgaaagtgttttttgatgacttggcaaacgaacgtggccctttagaccctagacttgcatatagcggtggacgcacgggtccattacgactttttgctgaaccgtccgcggatgaaaagatttccgtcttcgacattgtctcgttatacccgtgggtcaactacgacacggcttatccaattggtgttcctaccattgttcgtcctagcgctgaggagatgattgtcaactggaccaaacctgagcatctaagctaccgtggtctttatcgtgtgcgtgtcatccctcctcgtggtctacgaataccagttctaccgatgaagattgatgagagactgctgttcagctgttgtcatcgatgtgcggctttgtttcgtaaaagtgtgacacgctgtgcacacaaatgcgaacattcggaacagcagagagccttcactggaaatttcactcatattgaattggaaaaagcgttggaaatgggctacgtcatcgatcgattttggagagcatggcattatgatgaatggagtgatcaggtgttcaaaggatatgttcgccaattcatcaggcttaaggttaatcgttccaggaaatatttcattccaaattattttgacaggtggaatcaagcggatttccagatggtgtggaaacgttagaagaaaagcatcaatatatccgcgagtaccggcgcatatacggagttgatttagaatttgggagtattaaaaagaatccaggactatgattcatcgcaaaattaatgcttaatagtctatggtcagtttaaaaaatttttgtttggcattttagcttatatttttcaggggaaaattcagcatgagaaatcagcttggctcgaacaaagtgataacgagaccgcaggagttttatgatctagtgctaaaccatagaatggtttggttttttctacatatattgagttatttttgaaaattaaggaaatatcgtcaataatccccatatccgatgcagctattcgagtgctgtataagccgaagaaaaacttcatcgtagaacatacatcaagcaatattgtcctaagcctttggacaacgagtcgagctaggctgaaactgcttgactatatgctgcaatgttataatacaccgggcaccgagttactatacactgacacagacagtgtaattgttcggcataagcgagaccttgttccagttcacacgggcgagtatttgggtcaaatgagcgaagaatacgccgattacgacattttaacttttgcatgtggcggagcgaaacaatatgcaatgaaaatggtgcataaacagacaaaagcagttaaatttgtgcagaagatccgaggcattactttcgacgtcaacaattctcaggagcttcagtttgatcattttgtacgcaaagtgatcaactacggaaaagaggaggagcaggaaaatgcagcaaccttcaattataataaaatacagccgacaaaggataatcgaattataactcggaaacaaaataaaaagtatttacctatctgccagaaaggcattattagtcaaacccttgaggttttaccatttggatatgaatgattttttgaatgtataaattttcaatttacaataaatttatttatttgtataatattaaaaaaaacaacaacaaactagttaaacagtttcatcttgcatagctaacgaagatattttcaaaagttcaagtgggaaataactttgatggccgttgccgccatcttgtacaacacatgggaggttgggaaattttagacggacacgatgcttagcgtataaatgttgctctaccgtgacaccaagcataccacgataggcgtacatacgattagcaccaaaaagagtaaatgattccggataaatttgtaaattctgtcgaagatgtacagtttcgattttccgatcgcctataaatttgatattttccttcttccttcttcgaagcatcatggcgagatattccggtctacatttattaaacaagcatagctctttcaccaagctccttctgcgatgtcgtcgtcttcgtcgtgccaatccagctcgtcgacgaccaagttgcgctgatccttccgatgtccgaagtgtgacagacatttccgcaaatcgcccggacaaaccatcagatccttcaattccacatacagaggttcgctcctgaataaataaaaatgattaaattgacatttgaataataattaaaatttttaccaatcgatcccctgtctcttcttgggataacatgttgaaaagaacagatctcctatcagatcaagtgttccttctacaacaacaggctgattttcgtactcttcgttcacaaggtgcacacaaggaactgattgcaagggatttggaaaatagttggacggttcagagtctatttcggatttgaacagagcataaagctgagctatatcatctaacgcataatagtcaataaaatattttattgcacgctgcatatacgtttcgggtagaaataaagtcagatggatagaatagtcgccttaaatactcctttctctgaccgttgttggcctgtacactaaatctttcggattatccgaaaagatttccagttccatttggtcaaacatgccaacatcttcggatgaagttttactgctgctgctggtacgacgaatttgtcttattacatatgcgcaaatgacgaccagcagtacgtcaaatgtataagcagaccataacaataatttgatttgaggcgttggcgagctggcttgaagtatattaattacatcgtcgcgatattctttaaataataaaaagttaaatttcgtgtcactgatgttggacacaaattttgggttgatttgaccgtcattaattccatatttgtaaatacgacggtccgatcgaatcagatacaccttgttatctattattatgaaatcagttttatcctgtggtaacatgcatacaaaattcagctttagcagcgtaaaatttgtcggattcttatttgtccacaaccgctcgagatagcttagttcaatttcactgatctgacgttcgtacttatcagatatgtataaacgctcggtcatatagtcaaacattggtctgtttgcgttggccaaaaatttcttaacaattttttgctcatgcccacgataaaggtgcatttcgtccgcctcacggtcctcaaaaaacacatagctcttgccattatactcaaagcatgccattggttcaagttttcgaatgctttcgaaatgtactggactagaacgaactagtttgttaaagttctgaaaacttattctccattggctgttgttatttttacttgcaagacatgcgtttttttttgctgtatccaaaaactagctgatcacctgtgtttttggaaaaagtcctaaaattgttgtcaaaataattaggatgatcaaccgtcacttcaactgtaaaaaattcccctttcgcgccgttgttataacaacaaatggtgaaaagcaggagaaaaaatatactcatggctggaaacaaatttattcaactttgagtgccttttatacacgtaaaagcgcctgaacaaacccctttactagtaaatctgcaatagtacgtgtacgataaagattgaccatcacctcacaatacgggacgccagagcaacgagcgactaaaaaataaatgcaaaaatgcccgcaagtgtctgctgttgatgattgaatttgacgcttattaatttgaatgtgcctaaaattttttaaatacgctcccaaatcctcgttcggtgcattgcctaagctgtcaaaatactcaacccttgtagcgttaagagcgaagcaggcgacccaatgttcgccctgtgttccctctttgtctgtatttattatcatacaatgggggtattttcttctccactttggatgtggaattttatcagatgggaagacgccaatgaatttattcttggttgaatgtacgcctttgagaattgctgttagctgaaccgaattcattattacacacttccgtcagtgctcaacacgcggtcggcgttaatggaaaggactgagtcgaattcacctaatataagcatttcataaccgtccgcctttataggctgctcaaattgcacttttacggtgcaagtaccttgtctgattaactcaaaaccaggcgtatcatccaacgtggatgtcattgggattacgaaaaatgcccagccactgaggaatcgtgccatcgaaatggacactgttttgttgtccgaatcgtcaaggccaaggcctgcatacatgtctacaaatgctcgtacaaaccttttctgattgccaaacgagaatagataaggcgtgcttggaaatgtcagcccatttgcttcggcgctgattgaacgtacattcgcgtgctcaaaattgaacggcgacaaatgccgggcgcctgaatatgcgtccgtagacacaaacgcacatattagacgacgtggtagagttgaggtgaacacgttgtgtgatagctcagtacgacccatgcctaagaagatggaacgcatctctaccttacgaagcgcatatttggccggcgtgctttccaactgtctactaatcgcaatattaaggcttgaagttacgtctacagtgcgtacgtaaagtcttatatcatgtagacggatacggtattcggctgtgttatcatgccatgtcacacgcgctgctgtaattatattaccttgtgcatctttgaccgcatctgtaacggttttccattttggtgtaagcagaaggaaaggatcgctgttccgatggattgtgaacacaacatcctgattgttcagcaaaagtgtgttttgacgagccaaatcaaagttgagttttaccattgtttcgcactgttttccgtttgagaatcgctgtgctcggctggtaaaacctttgtttgagtagctatcctgactgttttcatccggataatagcagccagcctcgtgaaatgctttgcgaatctcatgtgaatagccaagctcctgcattatgtacgcacgatagtgatagtatattgagctatcaaacacttcgacaccagaaatgttgactttcaatgatcgaacaaaactgcttccaaaattttgaataacacctacatgtttgtcctcttcaatcgcatcgtcggtcggcacccattctccggcggcattcttacgctctatcgaagttagcagatacatgtacgttttgctaagatcacaatattgactatcggaaaacagacgaaaaagatagggtcctgtctggttgagagcggacaatggtaaaagctcccgaacgctcgttttattaatagccacatttgtcggtggaaggttaaacaatgatagactaccttcaagaccttcaacactatctttgtcaatttttttgataatactcatgattaatcaataaggaatatttagtactgctatatgatgatgatgagttcctaaatgtatgattttgcaaaattctttacctatttatagactttcgcgttcaaggtgtcaaggggagcttaactgatccatgattttgttccgtcggcgtttaacagtcccaattctgccaataatagaatcactggagctgatgccactagcttttttaacctttgacactcgttgtcctcttctaccatcggcaccataatttccacctttcccacattgttgtaattttcctgccaggttttcgaaaccttgcttagcatgcgtttcaagagattctttcaatgctttaccttgggacaaatcgccaagaacgcgtgttcctgcagcaattccctccttcgaagcactggagagtagatttgatgccactggcatcaaaaatcgggctacattttgcagaagaccgcctccgcgttggtaacgtgtaccaacaaaatactgctgttcgcctcttccttcttgctgcgaggctagaaatgttgaccattcaatggagtcagggttgaaaaagacatgagtcattttaaaatagttttcgtttaaaatgaagtgttagaacgcaattaccccagttaaatttaatgtaacgtccaaacgctgtttgaatttcgattttgatttcggaaattcgtttgttctgtatcggtttaaaaaactcattggtatatataacctctggcacgtccagaggaactgtgcctgacacgttgacaacgcgcaacaatggagccatacggtctccaataattgtatcttccaccaactttggtgcataaacatacaattgccttacaccacccgacagatctggtaagtatttggccggatgattatagtacaatcgagtgttctcaaatccgagtacatatgcaagatggctactcgcatcaacatgttgtactccactacctatgttaatgtaaaatctttgagttatctcattgaaaagaaattctactgctttcctttgctgtttctgatgacccatgagcattttcatcctgtcagacacagaagttactccttttttatcacctcctctccccttggcagaaagcgcttgaggatcaggcagatctgggagctcatctacatcataaggctccgatttcggcatatcttcttcgagaacagtagaagcaagctgttcttctgacaattcattgacaatagtatctctgctatcatcgtcattatatgaaggaaaatctgatggtaccatttgtattgttttttgctcattatcccctgtcattggtagttttttaatttggaccgttaacaatccttcttcacctttggtcgttaccgatggttcgttttgggcaataaatgatgatgatgatgatgacgatgaataattatcttcaatctcatattggttagatggaaatacttccccttttttatcggtaacgataaccaaaattgtctcttcatctttttggccatcgggctgctcaaacggctcctcgtttcctttcaatattttttgtttagcttgatccggcgaccatttctctgtctcctccgtttcactctcttctattccatattctgtagatggaaattcattaatggcggtatcatccttggtttcaattttttcttcttccaattttccttcctttttcttcaatacatatgatacctctgcctgttgttccgttcgttccggctgcttctcagagctgtcgtcaatttcatattcggaggagggaaattcggtttccgtgttctcagcagtggtgttaatatcatgctgacttttttcccgctccagttcctttaagacttgaggaatttcctttactagcttcttttcttgttgtatattaatcgccgcaccttttttggcttcttcttcttccttctctttgactgcaacagtgaatttgtcatttaattcatgcattttattattcaactgttttatttccagtgaatagtttagtataacttcaaacgcattttttgcagcttcgattagctttcgcgcttctgtcaaatttttcattcgataaggtttatcaaattgctgcttagcgtttattacctttgacggttcatttcctaccttttttgccaattcgtctatcttcttatctaattcaacaatttggtcaagccaatcgtagaattgagggacacctgaatatgtgttaagcctaccttctgcaacgcctctattatgttttgagttggcaactagtgtgcgaatatattcagcttttaaggctgcattctgtgctgtttggtcaatttctttttttgctttttctaacaaattgtcttcttgcgtagactgttgttttaccataggttccagctctttgtccgctttttttgggctttcaggctccaattctttttccggtggttttactggttctcgttccatttctttttctacggttggctttgtaggttcgcgtttcgtttcagtttcatcagacagttttggaactggtggcttgattatgcttccaacttccttttctacggttggcttcagcttttccatttgtttttcttgctgctgtttcggttgcccggcagggagctgagggtcttcgaccggccttggaaccgttaattctgcatttaaaaaattgttcactgccgtcactacacgatttgcaagctcattcacgccaagctgatcctcaggtactgtgctaaaatacatgggtgtaagctgagcaatgtagtttttcgagtttttaagagcttgttttgacatatctgcgtgtttacggcattcattcaagttcttggaatcataatgtacatctaatttccgttttgcttcggccgcctttttcgactcttgtgaaatcttttccacaagttcacgcaaattattctccatatttgatagactgtcgaaccatttctttacatgtggagcattaggtgcccgtttgcgggcttgttcagctcggttgagggctgttttagccttttccgcgatatcggctgcattagcagccaatttaacggtctctttccacgattgttccgttactcgtttggctaagtccatgcgctcttggtctatcgtagatatttcaccatgttcaacaatgggagtggcttgcagctgttccttttgcggtttttcaccttctaattcacccaattgtttgtcagaaagttgcgctggtcctgtttcacgtcctatttccttctccaatggttttggctcatctccacgtggtagttcaatgtcatgtgttgctggtaaaggcgcttcacgtatcagttccttatccaatgttttagatgaaggcacttcacgtgtcagttccttatccggttctcgtcgcgtttctggttgcaattctttgtctgcagaagcagccgccgctctcttttacggtttttcttttggaaactttacatcataggccgattgaa

SEQ ID NO: 127 - DNA, 6852 bp, Heterodera glycines
tttatggaacgtccaacgctgtttgaatttcgattttgttctcggaaattcgtttgttctgtatcggtttaaaaaactcattggtatatataacctctggcacgtccagaggaactgtgcctgacacgttcacaacgcgcaacaatggagccatacggtctccaataattgtatcttccaccaactttggtgcataaacatacaattgccttacaccacccgacagatctggtaagtatttggccggatgattatagtacagtcgagtgttctcaaatccgagtacatatgcaagatggctactcgcatcaacatgttgtactccactacctatgttaatgtaaaatctttgagttatctcattgaaaagaaattctactgctttcctttgctgtttctgatgacccataagcattttcaccctgtcagacacagaagttactccttttttatcacctcctctccccttggcagaaagcgcttgaggatcaggcagatctgggagctcatctacatcataaggctccgatttcggcatatcttcttcgggaacagtataagcaagctgttcttctgacaattcattgacagtagtatctctgctatcatcgtcattatatgaaggaaaatctgatggtaccatttgtattgtttttttgctcattatcccctgtcattggtagttttttaatttggaccgttaacaatccttcttcatctttggtcgttaccgatgcttcgttttgggcaataaatgatgatgatgatgatgacgatggataattatcttcaatctcatattggttagatggaaattcttctccttttttatcggtaccgataaccaaaattgtctcttcatctttttggtcatcgggctgctcaaacggctcctctttccctttcaatattttttgtttggcttgatccggcgaccatttctctgtctcctccgtttcactctcttctattccatattctgtagttggaaattcattaatggtggtatcatccttggtttcaattttttcttcttccaattttccttcctttttcttcaatacatatgatacctctgcctgttgttccgctcgttccggctgcttctcagagctgtcgtcaatttcatattcggaggagggaaattcggtttccgtgttctcagcagtggtgttaatatcatgctgacttttttcccgctccagttcctttaagacttgaggaatttccttttctagcttcttttcttgttgtatattaatcgccgcaccttctttggcttcttcttccttctctttgactgcaacagtgaatttgtcatttaattcatgcattttattattcaactgttttatttccagtgaatagtttagtataacttcaaacgcattttttgcagcttcgattagctttcgcgcttctgtcaaatttttcattcgataaggtttatcaaattgttgcttagcgtttattacctttgacggttcatttcctaccttttttgccaattcgtctatcttcttatctaattcaacaatttggtcaagccattcgttgaattgagggacacctgaatatgtgttaagcctaccttctgcaacgcctctattatgttttgagttggcaactagtgtgcgaatatattcagcttttagggctgcattctgtgctgtttggtctatttccttttttgctttttctaacaaattgtcttcttgcgttgactgttgttttaccataggttccagctctttgtccgctttttttgggctttcacgctccaattccttttccggtggttttactggttctcgttccatttctttttctacggttggctttgtaggttcgcgtttcgtttctttttcatcagacagttttggaactggtggcttgattatgcttccaacttccttttctacggttggcttcagcttttccatttgtttttcttgctgctgtttcggttgcccggcagggagctgagggtcttcgaccggccttggaaccgttaattctgcatttaaaaaattgttcactgctgtcactacacgatttgcaagctcattcacgccaagctgatcctcaggtactgtgctaaaatacatgggtgtaagctgagcaatgtagtttttcgagtttttaagagcttgttttgacatatctgcatgtttacggcattcattcaagttcttggaatcataatgtacatctaatttccgttttgcttcggcagcctttttcgactctgtgaaaatcttttccacaagttcacgcaaattattctccatatttgatagactgtcgaaccatttctttacatgtggagcattaggtgcccgttagcgggcttgttcagctcggttgagggctgttttagccttttccgcgatatcggctgcattagcagccaatttaacggtctctttccacgattgttccgttactcgtttggctaagtccatgcgctcttggtatatcgtagatatttcaccatgatcaacaatgggagtgggtggcagttgttccttttgcggtttttcaccttctaattcacccaattgtttgtcagaaagttgcgctggtcctgtttcacgtcctagttccttctctgatggttttggctcatctccacgtggtagttcaatgtcatgtgttgctggtaaaggcgcttcacgtatcagttccttatccaatgttttagatgaaggcacttcacgtgacagttccttatccggttctcgtcgcgtttctggttccaattctttgtctgcagaagcagccgccgctctttttacccttttttcttttggaaactttacatcataggccgattgaataatgctgttcaatgatttttgcatatgctctacgctgtgaaactgtatgcctggaatttttaccttcagagttacagtagtcggacctgtaccgtctgatttatagtcgggattgagaagttttatgttgacaaagtcgtcctcatccacccctacggaagggaacgagtgtggatagatgatggaggaaagtgcaacggaccagtttgagtctagctctagggtgtgtggtagtcttacggtaaaatgggatgctgtatttcccggaaagggaacatttaatggtagtacaatataaaaatcatccatgcctaacgaacgagatctgaatccctaatccacttattgtgattttctgaataacctatccaatgaacaaaatgttgcttaacaccgtttcgcaccctggatttcaaaatttctgctcgatgagttgtctgttcagcagcaacagtctttaccagttcctgatcgtaaaaaataccttttatattttcaccttctaaatcactgattcggtatgacggaggattggtcgggtttacccgaacaattttgaataattcgtcagtaaaatttggaaaatatcctttggagaagtctcccttctctttggtaattcttacgatatcaccaattttgaatttttgtattcgcttttgttgttccatgtctttatatagacgatttctcagctctgttgcattgcgaaaattcacatcaacaggacgcattcctgttgtacggttcaccgaattgttcaggtttttaactattttatcaataatgtctacccatctgtgtgtgtttttttcgctaaaataacggtaaagtctttccttaattgtgcgatttgctctctccacaacacctgcatgtagatgagggctgtacattacatgtttaatgatatcttttgaaagccagtactcattcattcgtttggcttggaattctaggccactgtcgctgtacattttattaggcagcacttgtgcctttttgaaaactttttcaaacgcttcaatcatatgctcactcttcttcgactcagcttcggcgacataaatctgtctactaagaacatcaatacagacaagaatataccggtatccatcgttgtgctccttcagcgagtccataatgcaaagatcacactgccaatccgtatgcaaaccacttgggacagtttttaaccgtgggaatttgtttcttttgggtttgaaaagtgtgtaagtcctttgtttatgaagaaacttctgtacatcgtgaagctttaggttggggatacgttttcgcgcttctgctagcaccttttgcattcctgcgtagctggccggcgaatttaggttgtaataaacctgttcaagttgactttctatagttttgcccataacactggtttaaatggcggtttttctctatttaatccttgggtttttatagggttaacctggacaaggactagttttcttttagttcttctcttctttcctttaccctgttgtaaattaaataagtattttgcaatttccggttccctcttcaaacgttgaacaaaaaatgtatgacctcgaggcggagaaatatcttcacctgataataatttcagcgattcagtataattcgatccggtgactggcttattaaaattggtcaaaacctgtcctgattgcatatcgattccaaatttgtccggattttttccaataatattcataatttttgaaaaatttttctgacttaattttacgtcttgggaacgtattggcgtactactgctaccttctgtagccgaagaataatctgccgatgattcaaacacgttttcacttttctttttacgtgatgctcttattaatcgtaacggctgacgcttattctcttgttctacggctgtttctatttttggtattttatgaattcccatatatggagcaacgtttggtattgcagaactcgggtttccttctatgatcactttctgtggtttattttccatcagctctttgagttgacgtctccgtttgtacagccaagagtgtcgtttcattttaatatcagctccgattgttttatcattcaaatttttatgtatatttgagtctaatgatgttttttcatcttgtataggatcgcctcggctacccatactcttcactatgttcataagcgcaatgtattcggtttccggaaccatgaccattttctttgtgtgcttcattatgctgttattttttcaagcaaatgttgggctaagacactgagaacaggcacaagaatagcaccaagggcaattccgctcccttgttgaagtttttgccgagctgagttctcactgcgagcgcgtgctatggccctgtaatagtccgcgtattgtgacaaccgtcgcctctggctcggatttagacgaaaattaaattttaaaatatttgcgcaaatttccacaagggcaagtatttgttctgcggatgctccctgcaatagatcgttttttcgtttatcagacctggtggccgcaagcttttttaagaaatctgtattttccctaacgtaaggactaaattgatacattttagttttttttctatattcatttctttatatagacaatgcggcggttagcgcgcatacattattcgctcggtaaatagattactctatgctcgtctggaaatattttactagtaagacgttcagtttccggtgcatttggatgcatatttataaccaaatagctaaacggtttatttgttgcgtcattatatgattccataaaaaaatttaaacgctttggaaacagttgagatccgactgtccgtacctgaagctgtccggatgggttacgtgtcagcacaaggtaatgactgttcgctcttgctgtccgaatatttcgcccatacaggctctgagttacgaaaattacgtttacgttccaattatgcgaaccgcgcgtaaacaaaaggtctaaaaaatcattgtttatgttcagcataaggtcgtccagcacaagtaggagaggcttaggttgactgttgattaatgtctgatcgggaatcccattatgagtttctatgccacgcttaatcaaatcaatgaccgaatcgttcatttcggaataacaatataaaactttttcgggaggtgggttaatcatttcgttatgatgcttcaacagtctcataagccattgggttttaccgcttccagtggcgcccgataatataagagtgaagggggcgttaaacattttttatatttgtttttttctaattgcaactcatttaaatactgtttgtcctcaattttgtatgggacatatgctgcacattttgggcacaaccaacatttttctgcccatggggagtgtgctgtgtcgaaatgtaaaagactatttgtcctacaccttttgcaaaattcataatgacacgggcagtaatgacaacatttaacttgatgaatacaatttttgttcatttctaaaagttagggaatttgtaaaaaaaaagtggttatatatagtatatttattgcgttggggaaaggggttggttactcggctttcatgacgtattcgatccattgtgttaaatcagtcgaattgccagataattctactgtttccttccacgagcactctgttgttaaaatggcttttttaagcagagtctgtgggtctgattcggatattttggtatatgttttggatttctcgcctgtcaattcgttttcataggtatgagtaggtattggtggaggtttttcttgtgtgaaatcttcacctgacaattcggtcttcggtagtttgagcggttgttcacgttccaactgtttgtctggcgctggtgatgtttcatgctctagttctttatcaaccgctacttgtatgcttctctccatgtttattttaagtaatgtatatttggatagtatgtgtatatttattttaaatttttctgcttatatagtgattgagagggtggttaacaaaagattaaattagggcgaagag

SEQ ID NO: 128 - DNA, 1241 bp, Heterodera glycines
cccccccccccccccccccccccccatatgatgctattttatcccactaatggcatttcttcggcagctgactgatcgtgaatggaacaacgacgacacccttcacattagcgcatcacggcgcaacaccagcaacaacaacattttatttgtttttccatcccatcatgtccatttagggaaaaaagaaaaattttaaaaggattttgtattttaaaattacccacaaaaaatcaagcaaaaaagaaccgtttacatttcacccaaaaccacgacttttgccaaggccacgttttcttaatgcatatacaatcaatcagtaaatttttaagcaattcagtgtaaattgctggattttaatgcaaattttgctgctgattgtccgggaagttaagtgtgaattgtgtgggaagtgaagcatgtccaaaaattatttagtcaatccttattaaatttaaaaaactaaatcaaccaaaaaaaaaatttacggtatcaacttactgtaaataagtttactgtacatagcttatttgcatatcaatttgactttctgcaagatattctgatgcaaaaactattcggaaaattttctcactattaattaatctgctgtcgggatttgcaaaatccgatcggatatttttcactggtccacttggcttgtagttagtgctgctctccagcgccgacaattaatttctctttctgttttttttgcgcttccaattccactcaataaatgcttttccttctccacctactgggaggggcccttaagcggcaattagctgcttcctctcttttctgtcgctcctccaaaaaaaagaagccaatttcactgatcaacaaaaactgcccccgcggagcagtctttttgatcgaattgcctttcgctttctcttaattgaacatttgcagagtgatttatttatttgttgtgaagcgatcagattacaaatttatccaaaaagtaaataaatgtttttttaatgtatgtaatgtttttaaataatttttattacttaattttagaattttttcccctaagtttctttttcgtggaaaaccaccaagctataaaattaataaaagttatattatatattcataatttgaattagcccaaccatgtgcatccaactgaccaccaaaaaaaaaaagaaacataactgtcgcaaattgcctaacaataggcggacgtatgcacgattcggctcgtttaggcgtaccacgcccagcat

SEQ ID NO: 129 - DNA, 12625 bp, Heterodera glycines
caatcatttcatatctcaatttcattattaagtagtatatccatttttaaaagataacatcatttttacgaacttttggagatgcgaaaaattttcttaggccatttttgagatattctgatcaccaggggttctttttttatgtaaaaaatctcaaaatatgtaaataaaattaaaaaaaaggttctagtcggttttacgcgtgccatcactagggatgggatttaagtcatgaaaaatctcaaaaaagtcacgaaaaagtcacataaaaatgccaaaaaagcactaaataaacccaaaaaaagtcctggaaaaatagccaaatgtaattaaacccaaaagccgttttaaacattcttgaagaaagtaatttttcagtcccgtcatttgagtccttatggtataagaaatttaagttccgtcccgaagattgatttatttttcggaattttcatcacaaaaagtcaaattttgccttaaaaagtgtaaaaagtcatgaaaaagtcataaaaatgtatgttagaagcttcaaacaaagtgtagaacacttttgaagtcattttaaggtcatttagagtcagcaaaaaaggctcccggacatttcgacaatgaccgtttcgacaataccttttcgacaatgccgtttcgacaataaaattaaatatatttttttaaataaaattcaaatttctgcaaaattatatggacggtgcggatttgggatcaatataaaaaagttttttttcgtttttttcaaaatagcattatgaggatggctttagtttgtcaattttcggagcaaattgcttattttttttaattaaaaattgaaacattgttttacacctaaatagttgataatgaattagaagcttttaccctgcaaaaactattcttgattaaaaaaacaatttttttttttttttgttcgaattcgggtctggagttcggaattgggcaaacccgagttaagaggtccgtctcatttttcttctttcttcactattaatagggctcggatttttaggtgctaaaaatccctaaataggtactaaaataggtgctaaaaaagtgcaaaatatgtaggtgctaaaaaccccaaaaaaggccaaaataggtgttaaaaattgaaaaaatctagaaataggtaaaaacctaaaaatccgactcctaactattaataatcatacacaataggcgatagataatgcattcattaaatctaaaaaatataactacctaattaaatttttctctttaaatttcatcaatatttttttaattaatttattattttttatattcattttattatatttaatttgatattttaaattttggcgatatgatatagtcgtaaatggtcattgtcgaaacggtcattggcgaaacggtcattgtcgaaatgtaaaaaagccatttgacttaaattcccatccctactgatttcaagacagagatgatgattttttcttgagatgctgaatttcatagaacgtaattgacctaaaaattgccaatttccagtgataatctgtttagaaattccaatttttcccaaggcgcggatgtcggcacaccgtcgggccaccaaaacttattttttaataaaaattggctcaaaataacaaatcatttttggtgaaaatttctttaacaatttgcactcaaattttcaaagtttcggcgacaattttctaaaatgctcatttttgacaccaaatgcagattttgtctcccctaatccacatgtgacgggctaattatgcatgttttggggtgggatggattttcactagaaaagaaaaatcacttccaattatttatccggtcggcgcaacacagcaaacatacaatatatacacatagcagtgatcagaaaagaacaatacatcgatatgaacgttgatcacgcaaatatacaatagacaggtttatgtacatctctgttattcgtctgccgcgctcgttctccggttcttcagctcagctctggccctgaacgatcgccaccacgtcgatcatgacgtacgcgctcttcggcaacttgaccacttggaagaagctgcgcgcagggtacgtgtcctcggtgaagaagttcttgatcgtctcgttgaccgcctggaagtcgctcatgtcggccaccatgatgttgcagttgatcactgaaaaggggcgcaaattcacagatgatggatggatgatcaggcttttgctcactcaccgtgcttgaaggacgagccggcgtacgtcagaatctcgccaatgttggtcatcgcttgtttcgcctcggctcgcgctccacccggcaccacattcgtcgaccccgccgcgatcccggtctggccactgatgtacagcgtctggttgttgaggagcactgcctggctgaaaaaacaaaagacatgaacatggtttgtgatggcctccgttgttccgacctgtgacccgtcgcaggaggcgccttggacgtggtgatgagacgaatggagggagccgccatttggagaatggtggtttcagaaattaggacgttggtcgtttgttcgctgaaacacagaaaaaaggcaagcgaaatgcaaggaaaaaagcaaaatttgtgcaatttgaaaatgattcagcattaaaattttggcgtatttatacgctcagaaaaaaattcggaaaaatctgagcatttaattcatttttctgcgtataaaagggtgctgcattttggcaatccgcaccattatccttattcctaaatattcacacaacaacaccggcagcgtcaccattctgcgccagccacaaattgcacagcgacacatcccatcctgcgccttcgccacggaccgcaacacatcgctggccaacatcaagcgcaatggagacggacgaacagatgtgggacatgccctactaccacggactggtacgttttggtggttggcatgcaattctgaccactaatgcttttgcttgtttagctgccccgcgaggacgtcaatgatctgctggtcaaagagggcgacttcctgatccgcatgagcgaggagacttcaggacaggaccgcatctacgtgctctctgtcgtcgcgggaggccacaagcatcatctcatctttcgcaccgagcgtggaatgatcgcggtggacttcaaacacgaaagaggctacaggacaatgcggcgcttcatcgagacacatctgagcaaaaaagacacggtggttgacgtgagtttgttggggagagaggggggaaggaaggcgctaattaccccgaattcccttttcagcagaggaaggtgattctactgaaaggggtcggccggcagaaatgggagctcgcacattcgaccatcacgcagggcgctgaactgggcaagggcgcgttcggcgttgtcaagcgtggcgtcttccgcgacccgaccatcgggcagcccgtgcaagtggccatcaaggaggtgtcgcagacgagtacaaaggcacaggtaaaatggacgggcagcaaattggattttcagcctgctaatcgattcccctccccactttttcagatcaaggaattcatgaacgaagcgaggatcatgcgccacttggaccacaaaaatgtcatcagattctacggcgttgctgttggccgcgaaccgctgatggtcctcatggagctggcatccgacggctcgctcgacacgtatctcaagaagacgaaaaggagtccgcgcagcaaactcttcatgtgctacggcgccgccgcgggactggaccacgtgcactccaagggcatcctgcactgcgacatcgccgccaggaactgcctcttctcagaaaacacggtgggtttctgcttttcgcctgtgaccggcgcacaatttgccgttttctttcaggtgaaggtggcagacttcggcctcgcattcaaaggaccgtcaaagcctgtggaaacgggcaagccggtgccgatcagatggctgtcgccggagacgatgcgcgaacgcacattcacgccgaagagtgacacgtgggcctacggagtgctctgctgggagatcttcagcaacgcgcaacagccctaccagttcatatccaacaacgacgtcgccccgatggtcagtgcagtggggggaagggggttgaaaacgaatttcccattttcagaatcatctcccctctcccttttcaggttctgcgcggctcacgactccgcttcccaaatgtgacgccacctccgtttgcggaattcatcaaagcgaacgtttggactgccgacgtcggtaatgttttttgtttttgttttaacattttcaaaaataatgttttcccttccctttcagcgcgccgctatgcaatgagggatgtactcgcctggatcgagcaacacatcgatgagctgatcgacgataccacagcatcgcggcacgacacgactacagctacgactcgaaaccgcggatcccgtcaaggctctcgaactggctcatagaagatggtgatcgatgtgtcgctgatgcgtttatacgttctttatgtgtgttgtatatatgtatatgagtgtatattacgtcgctgttgtatcaatatttactgcatttgtcccgtatttcgatcaaatgactgtcatatttgtatttgtcatgaataaatgaacatcaatcatttcatatccaatttcattttaaaagtgtataaaaattaaaaagataacatcatttttacgaacttttggagatggaaaaattttcttaggccatttttgagatattctgatcaccagggcttcttttttatgtaaaaaaatctcaaaatatgtaaataaaattaaaaaaaaggttctagtcggttttacgcgtgccatcactagggatgggaattaagtcacgaaaaatctcaaaaaagtcacgaaaaagtcacataaaaatgccaaaaaagcactaaataaacccaaaaaaagtcctggaaaaatagccaaatgtaattaaactagggttgagcggtaccggtactggccggtaattaccggttttttcaaaaatgaaattaccgttaccggtttgcctagtaccggtaccgccggtaaaaatttgcactggtaagaatgggggtctggtcgagaaaagagtaggaaattggtgaagaaggagaaatttatgagaaaaaattaaattttatttcatttagtcatgggattgcacacgtgcacatgtggtgtagtggttaaactttctacctttcataatttttcgcctgagttcaattccccacttggatagaatattcctcatttctttaccattattttaattaaaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgcccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctatatctgaattttagtgttctttatcctgaatttgaaaaaaaaacttggtcaccctcaatatacatatacttctgaacaattctaatgctaaaaaacaggtactcgcgcgaaaactgaataaaaattttgtatttggaaaattttgtccaaaacttttggacatttcgtggttttttactcttttggacatttcgtggcttggacatttcgtggcttggacaattcgtggcttggacactttgtggggatgccatttcgccaactcagtcaaaaacattcatttcgccaacttaaccaaaatctgacatttcgccaactgacatttcgccaagtagtcaaaaaaagtaaagaaaaaaagtaaaaagacgaaagaattgcatcaatcaaagcttaagtattcctttcatttttataagttcttttctaaccaaacaaaaaggtaattcagattttagtaagaaatgccagctgtacgtgaaatacttgagagtctgcaaaagccaagagtggtgaagaaactgatgatgccgatggaaattaaattcgaacaattttagattttatttccctttctttttgttattttattttataaagatttcttcgcattggtgtgcttttctgttaattttttaatcattatatatagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcatttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacacctttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctagcaattaccgattaccgctcaactctaaattaaacccaaaagccgttttaaacattcttcgaagaaagcaatttttcagtcccgtcatttgagtccttatggtataagaaatttaagttccgtcccgaagattgatttatttttcggaattttcatcacaaaaagtcaaattttgccttaaaaagtgtaaaaagtcatgaaaaaagtcaaaaaaacgcaaaaaagtcataaaaatcccaaaaagtgtaaaaaagtcacaaaaaatgtatgttagaagcttcaaacaaagtgtagaacacttttgaagtcattttaaggtcatttagagtcagcaaaaaaagtcatttgacttaaattcccatccctactgatttcaagacagagatgatgattttttcttgagatgctgaatttcatagaacgtaattgacctaaaaattgccaatttccagtgataatctgtttagaaattccaatttttcccaaggcgcggatgtcggcacaccgtcgggccaccaaaacttattttttaataaaaattggctcaaaataacaaatcatttttggtgaaaatttctttaacaatttgcactcaaattttcaaagtttcggcgacaattttctaaaatgctcatttttgacaccaaatgcagattttgtctcccctaatccccatgtgacgggctaattatgcatgttttggggtgggatggattttcactagaaaagaaaaatcacttccatttatccggtcggcgcaacacagtcacgcaaatatacaatagacaggtttatgcacatctctgttattcgttgccgcgctcgttctccggttcttcagctcagctctggccctgaacgatcgccaccacgtcgatcatgacgtacgcgctcttcggcaacttgaccacttggaatgttggtcatcgcttgtttcgcctcggctcgcgctccacccggcaccacattcgtcgaccccgccgcgatcccggtctggccactgatgtacagcgtctggttgttgaggagcactgcctggctgaaaaaacaaaagacatgaacatggtttgtgatggcctccgttgttccgacctgtgacccgtcgcaggaggcgccttggacgtggtgatgagacgaatggagggagccgccatttggagaatggtggtttcagaaattaggacgttggtcgtttgttcgctgaaacacagaaaaaaggcaagcgaaatgcaaggaaaaaagcaaaatttgtgcaatttgaaaatgattcagcattaaaattttggcgtatttatacgctcagaaaaaaattcggaaaaatctgagcatttaattcatttttctgcgtataaaagggtgctgcattttggcaatccgcaccattatccttattcctaaatattcacacaacaacaccggcagcgtcaccattctgcgccagccacaaattgcacagcgacacatcccatcctgcgccttcgccacggaccgcaacacatcgctggccaacatcaagcgcaatggagacggacgaacagatgtgggacatgccctactaccacggactggtacgttttggtggttggcatgcaattctgaccactaatgcttttgcttgtttagctgccccgcgaggacgtcaatgatctgctggtcaaagagggcgacttcctgatccgcatgagcgaggagacttcaggacaggaccgcatctacgtgctctctgtcgtcgcgggaggccacaagcatcatctcatctttcgcaccgagcgtggaatgatcgcggtggacttcaaacacgaaagaggctacaggacaatgcggcgcttcatcgagacacatctgagcaaaaaagacacggtggttgacgtgagtttgttggggagagaggggggaaggaaggcgctaattaccccgaattcccttttcagcagaggaaggtgattctactgaaaggggtcggccggcagaaatgggagctcgcacattcgaccatcacgcagggcgctgaactgggcaagggcgcgttcggcgttgtcaagcgtggcgtcttccgcgacccaaccatcgggcagcccgtgcaagtggccatcaaggaggtgtcgcagacgagtacaaaggcacaggtaaaatggacggggcagcaaattggattttcagcctgctaatcgattcccttccccactttttcagatcaaggaattcatgaacgaagcgaggatcatgcgccacttggaccacaaaaatgtcatcagattctacggcgttgctgttggccgcgaaccgctgatggtcctcatggagctggcatccgacggctcgctcgacacgtatctcaagaagacgaaaaggagtccgcgcagcaaactcttcatgtgctacggcgccgccgcgggactggaccacgtgcactccaagggcatcctgcactgcgacatcgccgccaggaactgcctcttctcagaaaacacggtgggtttctgcttttcgcatgtgaccggcgcacaatttgccgttttctttcaggtgaaggtggcagacttcggcctcgcattcagaggaccgtcaaagcctgtggaaacgggcaagccggtgccgatcagatggctgtcgccggagacgatgcgcgaacgcacattcacgccgaagagtgacacgtgggcctacggagtgctctgctgggagatcttcagcaacgcgcaacagccctaccagttcatatccaacaacgacgtcgccccgatggtcagtgcagtgggggaagggggttgaaaacgaatttcccattttcagaatcatctcccctctcccttttcaggttctgcgcggctcacgactccgcttcccaaatgtgacgccacctccgtttgcggaattcatcaaagcgaacgtttggactgccgacgtcggtaatgttttttgtttttgttttaacattttcaaaaataatgttttcccttccctttcagcgcgccgctatgcaatgagggatgtactcgcctggatcgagcaacacatcgatgagctgatcgacgataccacagcatcgcggcacgacacgactacagctacgactcgaaaccgcggatcccgtcaaggctctcgaactggctcatagaagatggtgatcaatgtgtcgctgatgcgttcatatgttctttatgtgtgttgtatatatgtatatgagtgtatattacgtcgctgttgtatcaatatttactgcatttgtcccgtatttcgatcaaatgactgtcatatttgtatttgccatgaataaatgaacatcaatcatttcatatccaatttcattttaaaagtgtataaaaattaaaaagataaccatcatttttacgaacttttggagatggaaaaattttcttaggccatttttgagacattctgatcaccagggcttcttttttatgtaaaaaaatctcaaaatatgtaaataaaatttaaaaaaaaggctctagtcggttttacgcgtgccatcactagggatgggatttaagtcacgaaaaatctcaaaaaagtcacataaaaatgccaaaaaagcactaaataaacccaaaaaaagtcctggaaaaatagccaaatgtaattaaacccaaaagccgttttaaacattcttcgaagaaagcaatttttcagtcccgtcatttgagtccttatggtataagaaatttaagttccgtcccgaagattgatttatttttcggaattttcatcacaaaaagtcaaatattgccttaaaaagtgcatattttggctacttttcgtgcatatttttggcagcactgttaattatatctcaactttctgttcacattctgaaatttaaaaaaatttgggtccaaaaatatttgagacggaaagcggctgcccataaagtgtggcaaactttttgactcatgaaagcataaaacctttattttggcaaaaaaaacataatttgatacataaaaaatgattggacgcataaaaagcgattggacgcatgaaatgagattggacgcataaaactttgattggacgcacaaaactttgattggacgcataaaaagcgattggacgcataaaaaacgattggacgcataaactgaagtagagccttttatacagcctatacaatgcaatacaatatatgtaatacagcaatatatacatatacacaacatcatgacatacatatgtgtacaattgagtcaatccatcggaatttaatcacccatatcaattgcgcgattcatctccattcacagcagcggcgttctattcagctccacctttgcgcttgttccactctctcagattgttgctgagcttgatcatcaaatcgagggcctccttcagggttttgttgttggattctgccaatatgaccgcatttgcatcgtcgtgagcctgcgcaaaaaaaaaataaaatttaaaaatgaacagccactaaaaaaatagaatccttcccccaccttttgtgcgattcggcgagcctcctccgtcgatttcagtaattcctcgtagaaaacggaaaagttcagcgccacaccaagacggatgggatgcgatggtcgaagtttttcctgagcaatgctgtacgcctcctgatacgccttcagtgcattgcgaagatctgaacattggggaggggggaatttgttgaattttagcattttcgaagcccttttacccttcgtttccgacggtttgatctcggccaagtagcggtggaagtcgcccttcatccgcatgtagaacactttggcctccgggtcggcagcctttgggatgagctggttgtccaacagagtctgaaaaatttcaaaaaaatttttgcagttaaattcgtacggacgcactgaccaaaatttcacggcccttctcctccgcctcgctctccaccttcttctgcagctccttgacaccttgcttctgtttgtccatggtcgactttttcacatgggattcgatgacacgccacgcggaacgacgagtgctgatcgcccttcggtacgcatcggacagcaaagtgcgctcttcttcggtgagttcgacgctcatttcggccacctgaatggggggaggaaaattataacagggaaatccggaaaaagcatccattcgatccatcgccgctcacaacacctgcttcatctccttggccatttcgtcgtagcgttcgcattgcctcgccagcttggcccgttggatgttgtccttgcgctgttctgccatttagaaggatgggttatgatgaatattaaggactgggcttattttttctgaacaaataatggcatacttatgacgaaaatgaaaaaacaataaaaattagttaaatttgtatgtcgtgtcttatcatcgaaaaaactgaaatcaagaaattctttttaaaatgtagggaaagaaatccagaaatgtgagtgctcaatttcagcaaacagtcaatgaaaatcaatcagaatccgaattcggattcagaaggttcacagttttagagtaacaaaggacaaacagaaaaggtgacaaattttggtttagaaattaaattagcaaattaatcaaggcgatgaaggcagaaaaaaaggcagaagaaataataaagtggaatgggtgggccaatttgattccttaaataaggatttttaaaagaaatacctatgcaaattt

SEQ ID NO: 130 - DNA, 1868 bp, Heterodera glycines
aaaaaagtggcgtgaaaagcaaaaaaaaaaaaggtcgtcgccctgggaccgtacctggagtgggtgtcaataaggaaaacctcttgcaaaaatgccccgcatacccaggaacggtaagtctcaggttggggggccccaaaaaaaaactcccctccgcaccctaattttatggaaaaatatcggtttttcttgttggtacccccctcatcaaaatttacaaagcagttctttcgaaaatccaaaaaattatcaatctttagtgaaaacctgttagaaaaaagggacactcccaagccaaaatcccgggaccgtccctgttcaacataattaaaaactaattttctgacccgtgtaaagcactgccattgcgttgtctccattcaattcactcaaatcatccgcataaatgaagttgagcatcactttgaacacatgcgcatcgatgtcagtgacttctacgggacccttcgcttcaaattaattttttttttttaaatacaaaattttttgttgttttttttacaccttctccacccgctgattcattgtcagtcgcattttttgtggtgtcaaaacggaacatcgcttcaaaaacgtccgaagccgaattcagaatcgctctgtgcgcgggcacatgcttaaagaaaacaatattaaattaaaattaatttaaaattaattaagcatttaaatttgtaacaatttccccttaaaactcgcctcctttccctctccttcccccaccaaaaagagaacgtccgcgtcatcgcccgagctcaacaaatgcttcatccgctccaccaaagtttcgggttttgacgacattttgacaaaacaaattttctataaatatgaattttagaaaaaaaaggaatatcttatccatttcatccatccgttcatttagtgaaggttaagggtgccgcggtagcagtacgcgaatcgcgcattaaaaaaagcataggaattttttatccaattttcacagattttagacgacgttagagcatttctgatctggtaatactgcagatggtccccacccctttttggaaaaaaaggttttgaaaacatgttattggagttttagggacgttgatctcgaaaatgccattcattttgaccaatttcgaatgccagacaagaactcgaaagtagaaaattccaaattttgaaaattcacaacgttcctaccaatgcatagagctctgaaattccatttaaatgtattttcgcgtttgctgagaacaggagcttacacaattagtggctcgcaaattttgaagcaaaaagaaacaaaacaaaaataatagacagtaaaacataacgccacaatggatttaaaaaaaacaaataagctgtcctgctgctctcctgccctgtcctgaactgtaactgtgagaccgattatttaattccaatggctgtcaagtcaagtgtccttatttctctagcatttgtccttattttgttaatattcagtaaatgaaaatatctcaaatttttttaattggttttttaaagattaaattagccatttttttgctgcaaaatgaaagtggtcgcgctggtgtcgggcggcaaggacagctgcttcaacatgatgcgatgtgcggaggaagggcacgaggtggtctgtgcggccaatttgcatccaccgaacgaggtagaaaagcaaaattccatattttacaaaatgcaaaatttccggtaatggtcccgttttgtcgcccattttaaatttaaatttattttcaaaagtcgtgtaaatatttttcaagtcttttcggggccgcttatcacaaatccggcacccgtttgactaactcagaacctcggattttttgtcagattctgacccctgggtt

SEQ ID NO: 131 - DNA, 13266 bp, Heterodera glycines
  misc_feature (290)..(290): n is a, c, g, or t
  misc_feature (13243)..(13243): n is a, c, g, or t
attttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttaaaaatttttgttgaaatatttgtcggctttgaanaggccgggggaagatctaatcattaaagaaataatgcaaaaatatgaataattaaaaatgattaattaaaaataatcataaggaataaaaaataaataatttcaattaaatcgttatttaataccggttataaaatgatttgaaaataaattatttactttttttcttgtaaaaaaggaaatttttaaacctataattttttacctagaaaaaaaaatttgacggtcactttttgaaaaaaaactttcaattcttagggtgtattttctgaaattttttcggatcatttcttaggaggttttcccgattttattgcattcttagtaagaatttttcggaaaaaacaccagaaaatgcaccaaaacggcaaaatgccaaaaaggcatttaggcacgaaaatcccgaaaaaggcaaaaaaggcataataaaggacaacgtaggagcctcaaaccaagtggaaacagccttttttatgcttaatatatagaaacaagtgcgcagaaaaaaaaagtttaatttttattaattttttaaatctggaatagaattttccaaaacgatgatttttgtttttgtctgccaatgttgattctggaaattttcagttggtagccttggttttaggcttctaggcccagctttttcatgctgactttttctttatggtttgactatttaaaaagttgtagaaaaaatttcgcgtttcgcatttattttcatttcgcattttttgctatcgcaaatttcgcgttttgcattttatttttcgatttgaccatccctgatatagatcccggttcaagtcccgccagttccgtcttggacatctggccagttgcgattacgcatttcaatacacgaaatttgtaataaaaaaataatttgattgtgttgtacagttaggtatttgcgggccaggacgttttcgcgtggacgttttcgcgtggggtacgttttcgcgtaagtgccgcctatttaggactgaaattggtcggatatgtgaatcacttgggggaagtgattgttattgatgaatagggagtccaattatatggaaatccatatttttttcctggactgtgggaggcctgaaacgcacgaaaaacatttttttagcttggtttgaagcttctaggaaggatttctatatccatattttccatatttttccatatttcgcgatttatgtccatatttccatatttttccatattttggcattttggtccatattttatgtccatattttggcatttttcaaaaaaaacctctattagaacggcccccagcagctaaattagcctttttgagcccaaaaaccggaaaattttagaaaaaaatcattttttcgccaaaatttctcgagaatattgaataaatttaaattttcttaaaaattaataaatttatgtcaaaaataagcaaaaaagcgaaaatttcgcttttgtggttgattttgcgctaaaaaaattaataaattttagctttcatgttttttttcttctaaaatgattgcacagaattgccgaaaaaattcgagaccaatttccgaatttggaaatgtatctcatatgcaatttcaaccaataaatttgaagaaattttacattcaatttgaaaaatttatgtccatattttgatatttttgccatttatgtccatatttcgcgatttttgccattttatgtccatattttgcgatttttggtccatattttatggccatatttcgcgattttatatccataaagttcgtctaaaacagggttaccattgaaaatcgctggtcaaaaatatgattttagggtcaaaaataaggacatttttaaaacacgcttccaaaatttaaatcgcatttttattcaacaaatcaagcattagcaacatatttctcgccgccaactatttttctgagcaattccggcttagaaatgagaaatttatatatttccaaaatcgattttaacaattttgtggaaaacataagcaacttgtaaattattttaagttcattcgggatcaaaaaatcagtttttaacaatttttttgcggcgtgctttttccaaaaaattttgaggaatgggcgatgggatggggtccggcggtgccgataggcgccgccggaaaaaaatttgtaatttctttctgatttgttaacatattttcatcaaaaaatcatcaatttttgcggtttttacattcaaaaggctttttttgcggcatttttttaaaaactttcttttttaggcgggtggaagtccggcggtgccggtaggcgccgccgggaaaaattttgtaatttagcgcgacttagtaacaaattttcaccaaaaagaccaatttttacatggcaaatcttaggtcatctcttgaaatcttaggggaattttgtggcactgcggcgccgatagtcgccaatgggaaaattttgccaggcttttcactgtttctacttcaaacaaatttctcgtattttttttcgcgatttttgagtcaatttaaagaaataaaaagaattttggagctctggcggtgccgataggtgccgccgggaaaaaatttgaaattttagtgcattttgttaatagatttagtccaaaaaagacaaaatttttgattgtaaatgttagaattatgattgaattcccatcgataaaggaataattttgaaaaattataaaataaaatattgcttggaggggaactgatccaacgataaaatgaagaaataacccaagatcacaaccaacttgaccacgcatatgagtaaataaattaagcaaaattaagactttggatataattcgcttcaaaaattatcatttaaaatctaaatttctctctgaatccaaaaaataagactaaaataaggacaaagagcttaaataaggacaaatcttacaaataagaacatttaaaatttgtaagatttgaaccctaaaaataaggacaaatcttacaaataaggaaggacaaatggtaaccctggtctaaaatggatcaaattttataatcttagtattttcgatagctctaagtgttttctattatcctgcaaaatttctaaaaaattctttaagtttaaaaaaagttatgacctgagaagctcaaaaaaccatgtttttttgaacattttcagtcataactttcttgaaacttaacgaaactttttgaaattttgtaggctaatagaaaacacttagtgctatttaatgatatcaagaattaaaaatttagatgctcttgaacaaagttatatcaaaaaatattttcatttgatggttttttgactaacgtcatagcacccattgcatccctagtaatgaattctctaatatgcaaccacgcgaaaacggtcctcacgcaaaaaaggccacgcgaaaacgaccccgaccgaggtatttgttaggacgataattcgtagattaattcttaactaaataataaaattctctatttttttctttctttctctctctctctctctcttcactcccccctctctctccctctctctctctctctttctttttctatctctctctcagttggtcttactgcactaaaatggtcaaaaaattatcgattggtttattcattttttttttgttccaatctcttcaatattaatccgccggattaccttcgtccttttttgctgcgtcatttaacttctcttttctgttaatttaccatcagcggaagacaaatacattttattttgcagaattacgatttcgaattttttgttagagttgccaaatatttttttcctttttgatagagtccgttaaaaaaaatttccgggagcgtgatcgggaatcccgttaaaatcccgctgaaattttacgggagtccagggcgggagcgagagttaattaaagactaacaaaaatatttttaatgcacaaatttgaaggacaatcctttattaaagaaaaaatagacagaaaaatttagtaagcagaaatttgaaattaaaaaaatcatatttttgtgtcgaaaatcagaaatttttcaaatttcttcaaataaaattttttaataatttatttgttgactcccttcaatagagccaaaaaataatcaaaccaatataatttttaccaacaaacggtaaaaaataaaccagatttaagatttaccaaatttctaattcgcataaaataatgccgcgaaattcacatgcaattggcatcgatcttggcacgagcgcttctcgtgtcggcgtttttcgaaatggatacttcgcgtcgatccacaatgaccgaggtgataaaaagaccattttggccatttttgaatgttttaattgctttatattttcaaaatttctttcaataaatttctttttttttcgtttcgagggttgggagatggcctacccaatttcctaatctttttttcattacgggaggttcaggagtttctcccattcccctgaagggcctaaccaaattttttcattttgtaaattgaggaaagcgtatgatgccatcttacgttgcgttcactgacagcggacctttggtcggagaagcggcaaaagcacaggcaaaaaaataatttataaaatgattttttaatgaattaatgaaaattgggtttcaaaactaaaggaaattgaaagaaagaaagtctgatctaattcaatcaatgatcagtgctaaaaaagggagagagagcgcgaaagagagtacgagagagagagagacaaggagagtgtgtgcgatagaaaaagagagagggaggtatctttgttctagagctttttgaatttaattttttttttctaatttaaatctgtggaagcgatcggatatgaattcaaaatttttaagcgtctgtttctgaatcatagaaaaatcatgtccaaatgttataaaaagcggatttgcagaaaaagtttttgtggaattaaataacctaactttttttatacttaagtaaaatttaataaaattatattctgatatagaacaccttgagctattgaacaatactatgaaatatttatttggttgaattaagaaacgacccaacacgcggcaaaagcacaggcagaaacatttaataggaatatttttatgaattatgaaaattggtttcaaaactaaaataaattaaaagaaggaaatctggggccaatcacaattacgaacgacaaatttggcaatcgtccgaattttgattacgacaacaaattatatcgttgaataagccgttttcagtttgtctctgtcgtgtgaattgtcgtccaatcacaattaacaaaatctaccgtaaatttgtcgtcacttttcttatgaattaaccaacatttctcaggaaaatgcaaaaaaattgaaaaatggctaaagggtttttctagaggttttttggtaagtattgtagattccaaatctaatagattcgaaaaacccgaataaatttaaaaatcatcgataaaagtatagaaattaaaatctgagatctgattcatgaccaacgaactcatttacacctggaaacatgtttttaatattaaataaaaaattttagatcaaaataatttggtgaatttttgggacatttctcagacgccaaatttgaggggcgaagttgaacgccccccaaatatttggcgtttatcgtctgaaatttgtcgtttgtcgttggtttcaatcacaattacgaacaacaaacgccaaatttcagacgaaaaacgacaaatttcggtaaacaaacgacagattttttaaaattatgattggagataacgacaaacgacatattttacgacagatttggcgtttgtcgttcgtaattgtgattgacccctgctctgatccaattcaatcaatttaagtgacaagagagagtacattttcatatttatagttcgttatgttcccttgataatttgccggcatacgctaattacatattttggcatttagttggccataaatccgtctaacaccattttcgacttttttcatctcatcggacggaaattcgttgaccgagcagttcaggcgaacatcaatcgttggccatttcgcgttgtgcctggagaggacggacgccccaaaattgccgtgcaaagcaatggaaaacagcagacattcaccgtggaggtgtttcaattatgaacatttttccctcaaagtgaaattgacaacaaaaaaaggaaattgctctttaattagtcagatttgattcagctaaaataaatatttcgacaaaatgtaggaattgccctacatttgaccaacacattaagtagggccggtcaggtgtggcgctcatatttggtgtagccagtgaagtttagcgcgacattttttaacttttttttcacttgtactattttctctaattatcctccatggggcattatttttcaacctcctcagaagggggcgggataattggagaatgtgggattaatggagattagaggataattagagaaaaaacggtaattcacagatatttttcgaatccaattttccgcggctaagggatatttttaaaaatgcaataaaattattatacacactttttggaaagaatacaaatccatcaaaaaaaattacattaattatgagccttgtcctagtagtttttgagaaatgaacccccggataagaagtccggaaaaattctgaaatcttgtccataactccggattctgactccggatttaaaaagtaattaatcacaaattatttctcatcaataatcaatgtccattacgcagaccattttgtccatgctgttggccaagttgaagcattcggctgaagcatttcttggccatacggtcgccgacgctgtgctcactgtgccaacgcatttcggccattcacaacaccaatcagtaaaagattcagccaaaatcgccggcctcaatgtgttgcgtttgttgagtgcgccaacgtcggcttccattgaatacggtagggattgagtacggtttcagcataaattagtgccaaaaaatcatgcatagatttgtttttgcatattgagcggcttggtattttacatgctgtttttctcggcttataggcttataccatcaccgcataaatttaccattccatcactccactagcattttaatgagacaattaaattttgaatttgttttcttttcacagcatttaacaactattgggaaaatgttaatgtgcttatcttcgacttgggtgcgtccaatgttggcgtgacaattgtcaactgcgaagatggtatcattcgagtgaagtcatgtgtcggtgacactcgggttgggggcgatgacttcaccaatcgaatggtaattatgccggattatggcatgctttattaaatttggcatttacggtcgatcatttcgttgcggaattcatgcgtcagcacgggtacatgctcagctggagccctgaagcgctttttcgtgttcgtgccgcctgtgagaatgccaagtgcactctctctttgtacacagaagacaggtgaggggggttatttttttgggaaaagcgcgccgtaaaaaaggggtgtgaaaatataaaaatagtcatgtcaatgcgggattgcggactggaaaaaatcgcgcgcgggatcccgtcccgctcaagtctaggattccagcccctattttttggattccattttataattactattattactctccgtttcagcattgaattggactctctcctcatctcaagcaggctgagggagatgaagcacttcgttcaaaacagttagacaaaatttggcaatgtgcatcttgaaaaaataaatttttttgaaattttcaatttgactaaaatacagctgaaaatattgctaaataaaaaacaggcgatattgtaaaattgcaaattttgatgacaaaagtatttttgtgcaaaaaatttgtgtctctcttctcactctctgaaacgaaacacatcaacaaaatattatactttaaaatttaaaataaatttattaacaacaagaaaagcgtgatacataatagggcacctatttaaaaaaagatacataaataaatttttttttataaattaccaaaaaatactaattgatacaagaaaaaaacataacaattaaaacttacaaatataattatacctcctatataaaataatactaattttttcatatataatatacaaatcaagtattgctacaattaaaaattataaataacatggttaaagaggaaaaatattattttattcaatgttttatgttatacgaggccaacatgatcggcaaaggcatgtgaaaaaccccattgttttgtggtacaacgcgaatatcttttaatttctaaagtttaaaagtttaagtaagcataattggaataataaacataaaataaataaaaaaaacaatgcgaaaaacaaatgcttatgtttttgcattataaaacgcaaattaaacattaaaaatcttttaatcacgacatgcataaaaaatgaaaaaaacaaagaaaaatagctaaatcacattcatttaggtaagaaattaaaaagcaaataaaagttttatttaagatgaataaggtaaaagccaataatcatgtaattttaaaagaaattaattaataatttttaaataaatcaaagatcgtgaatttatttccaaaacaatggtaagaatgggggtctaatttgtaagtgaaaaattttgaaggatattggtgggaaaattaaataaataaattgatttaaatcaactagtgaacatatgtgtgtagccgagtggttaacactttggtcgtttattatttgtcacttgggttcaattccccattggtatagttagttttttatttttctttgaattattttagttgaaatttaattaataagattgaaattatttttatttatttttaaaacagccatagagccataaactaaccaatgattggacatgttttggacaaaatctactaacaaatttcattaaaatttcaaaattttacccggcggcgcctatcggcaccgccgtccccccccccccaatgtttcccaaaagattttggcaaagatgcgcctcaaaaaaacgatttaatcaaaaaaagttttgccaataagttaaaacacaaaaaaattctataagaatattttggaattaaaaaaatagacaattttaacgaaaattattgctctataaaaaattttctaggaattttagaactcaggaaattaccagtttttgcgggtgcctcaaaaatattgttaccggcttatttttaaaacaaatcaattccagaaattaaattttaaattttttgtcattaataaaagcaatatttaatcatttatatagaaataatttttttaaattgttaaaaatatatcactaaaaaatagtaaatcaaaattttagaaaaaatcaatatttttttgaaaaaaattttttcccgttcccagcgggattcccgttaaaattgacgggatttttacgggaacgggaaaaaggcgggaatcctgttcgggaatcccgccccgttcattttcgttttcccgttcccgttccggaataatttttttactgctctttaattaaaaccttaatggctaggataaaaaataaattgtcaaaatatctttgaaacttttcattcggctaatacgaattgctattcctttcatcaagaaagcatatagaaagaaaattccaaaattatacgacaatttacataataaaaattaaataaatacaataagaataataacaaagacaataatataccaaaaaatagctagataacatattcaatcatgcaagtaattcataattatatgaatagataataaaagattaattgaaaaatcaaaatatcaataaaaagtacgataaggataaatgaatggacgtgtgcactcattaatggttgcgtttcttttcatcgatttgtcagtttattattatacttttaataattttaataggaaacaatttggtaaaagtcacatacattttacgtcacaccgtcacttgaaaaatgttctagaatttttggcattgaagcttaacaaaaattcattttttatgattaattattgtttttccgcttttttgtatgtattttttgcatttctcaaaacgccaaaaatgtatctaagttcgtcaatttgagcagaaattaaaaagttggaaaaattaaaatatctaattttattaaaggtagatttttgagctgaattaatttcgaatgcgccaatttcagttgttaatcatgttaaaaaaatttattagtaaaaaatgtcccaatccaaatccaatttgccaggtttcggctttttgtcagattatattaaaagtgtttttaaccaggttgaaaaatcataccctcacaatcgttatgttgaataatacccagtttactagattatgcagtaccacgatggcaataaattattgaaaaattaaaaagataaaaatgaataataaatacatttataaaagcgtttaaaatataaaaataaattatttcctgaattttttttgcaaaaaagaaaaattaattagcaaaaaataaagcaattctcttatccaaaattatataaagttatcaatggaaaatgaaattataagatatgtagtacaaagcagtttaactctatatattcaggaaaaatttgttttttagaaaaaggcttgtaaaataccgaaaatccttaaaaatattagaaacaaataaaaaaatgaaatttaggagccataatgggactctttaaataatcggagaaagattgtatttgtggaaaagctttttgtcatcgaggcaaaattttcttaatgaattgaataatttttattaaatgattctcacagtcgataatatcgaaattcaaaattttcatgggatttgtatttatggaatccataataaaaatttaattaaatgttaataaaactttaaaaaattttaaaaatagtgcattaaaatgatctttaaaaaattaataaaaaaagtgcataaaaacaatgttcttggacagttttttaaagcattaaaacaaatttaaataaaaattaatggtataatacttaaagaataataatcaatttttttttaatttaaaaagctctttttggtgaatttaccgtaatattttagaaaaaaaagcaaaaaattagaagcaaaataaataatactgtaaatgatagataattcaagataaaaatcataaattaagaacgtattgaattatccaattgctgttgggacatcgaaactcgtcttgaatcgctggaagaactggaatttaaaatcaatcctttctaaattatacatgaaagttattcaattttattcattatctaaataattaaattgcgtagttttgatgctcacccatttcatttagtcttgcccattgaaaacacaaggtatccttgccaggagaaatttgaaataaaattacttgaagcaaaaaagaaagaatcaattaaaacatattttaaaataaagaatatattttcacacgagcaaaaaatttcttcttttgtttcttagctctagtcaatacaacattttaaaacataaaaaacaacaaatgcaatttaaaattttaaagaaaataataataataataataaaatttatttcttctatgttcataattcttaaaacgatttaaatgcagtttaaaaaatctcttaatgttaattatttatattttggtaaatcgtacaaattacgaaaattgaacacggaaagtatctatttgtaaaatgtcgatttcatataattgagtttgagtccaaactgctgtgaaacagagtgtgtggctatttattgtttttcaaattgagcgccagtcaactgagagccaagaaactatgctaatagcaaaactatgctgtaatgaaaaagaattaaaaaatgaacttttttttttaaaatttaataaaaataattataaaacttagattcaaaagaagggaagtgaagcgatacataaataaaaaaatatcacattttgtagaaaataaattcgagtgcacatagttaacagagatcggacatgtcaagaagaaaaaattaaatttttaaatttttaaacgataaatggaactgaatttattataaaaattattattgaaatgtaaaatgaaaattaaataaataagaaattttaattaaaatctcaaaataaacaaaaaaataaatgtctagcatttgtcgtcagcataaatataaaatttatcttgttatttatttattatcgaactaaccccaagtgaaaaatatttttaattttatatactataccaaaatataatatcgagaaaattagagtaaaaaaataacaagcattttgaaatcaaatttttttattgagttcaagcgatatgtaactacaataatttatagacactttagcttaaaatgtaatcttggaattaagatgccaaaattcgacgtactgtggtatttataaaaatttctgcgtgaattcaataggttgaataaattaaaaaagaatttttataaagttaaattaaatttgccttaaaggaattatgaggccccctttttaattaaagtgccattgacataaaaagcaattgaaacgaaatagattgccaaaaaaattaatttataaatttttagtaaaaattttgttttcgacaagttaacctaagaaattaaacattaatcaataaaatttaaaaaaaatacaagaaatatgaataggataaaaatataaatgatttcgacaaataaatttcacatgacaaataaaaagaatcagactttttaattaaattttgttacaaacaaataaaaaagcttgtcggatttaataatatttgtgaaaagttaaaaaatctaatcattaaagaaataatgcaaaaatatgaataattaaaaatgattaattaaaagtaatcataaggaataaaaaataaataatttcaactaaggaggtatttaataccgngttataaaatgattgaaaataaa

SEQ ID NO: 132 - DNA, 1188 bp, Heterodera glycines
  misc_feature (96)..(96): n is a, c, g, or t
atgcagaattcttttctctatcgatatgcaactcccccctggggtttaacgtatagaaaaaaagttagacggagacatgtaaatgttgttttttanataattaaaatgaagagatagtacgccaaagtgagagaaattacaaagaaaaagaaaaacgacgagatagtactaggcttttctctgcacagtggggcgtacccatagtgtatttacaatcccttctccatcttttcactttttgctcaccttctctttcttaaaaaaacatcaagaaatcgacaaaaaaattcgttctctgtgtacaaaacgcatacgtctctttatttcaattaatttgcttataagcaaagtttcctaaaatctgataactgaattgtcgttgctccgcatttgacaaaaaagaagaaaatgactctccagtggaccgtggttgcgttcattctttacgcagaaatagccacaattattgtgcttcttttgccatgggttcggccgacaatgtatttattgaaaatgttcaaaatacaaattcagtttaattttaggtggaaaaaagtgtttaacagtcgcgttgtgcacaaactcaaacagttttccaatgtttacgcctacgctttcatttttgtgctcattcttttgttcgttggtaagtttactccttttggctcaagtacagtttatgtgtccaatcttttttacatatttcagatgccacccgtgaggtgcgtaagtacagccacgtggacacgactagagagatggtgggacgagtggccgaggcggacgccgtcgttcacatgcgtctcttcaggtgactgattcattctcactttggcacggcagcaaatgttttccttttagagctcagcgaaacctttatttgagtggtttttctctgcttatggcactgtttgtgacggctttattaatttgaccactaataaactttcattatcaggattatcagtcgcatcgtcactttgctcgcccgttgtgcccacctcgaattggctgctgaggcggcgatgaaacaggcggaaggggcgggcaaagcggcgcaaactctgctcggaaaagtaaaattgaaacaaaaatggacggataatgacgaaaatttcgactggtttaggagggcgatgtgaatagtctgtccggcgaagaagcgaaaaaattgcgaaacgaagtgaa

SEQ ID NO: 133 - DNA, 1505 bp, Heterodera glycines
agagggaaagtacattcatttcttttgggatgaccgttttaaattaccaggcttcgcacaatggtaacaaaaagagtgatgaagacgaacgatcgcacaaagaaacaatccttttgactgtgtgcaccgcgtgcttccagctgaccctagtaatccaatggattgtattctttatccgatggaccgttatttaatatggtcaattttatttgtttcggatgaaaaaaaatatataattaattatttgtgagttctatataatgacaaatattgtaaaatggagaatagacgctaacagaataggagatcaatatgagatggatgtaacattagaggtcaaaataggaaaggaatgatagcatagctcttttacgtggcaatgctttagatttctttcttttcctcctctaccgactgttgcaccaaatagccgcgtttttctcgatcgtgttcagccacagtttgactagccgtcactaaatgaagcacattgatcgctgacttagcaagggcgaccgggcagacaacgcaggccaacagaggcacaaaatgaattcctaaaagcccagggccagcccaaaaatggttgacaaatagcaatccgtagaataactcgttgccaaagcacatccaaaacaaacatgtcctgaaggaaatggataacaaacgaacgtaatctaccggtcaactgacttcgatgtataataaacgttcaaaatgggattcttcgaccctttgtgcgtctcttttccggttagatcagtggcgtggagatgcatccaatgtgcggcgatgtctctgaattgaataaattaataattatcgaataggctaataacagccatggtcatataattagcacctcaaattttttattttgttggagatcctaaaacatatccaaaggtgtaaacggctttttaaaaaagggtaatgctaaaagaaatgaccctgattgtattgaaaatattaaaattgtaaaaacgaacaaaaaagcaacaaattgaaagaagagcatttttgttgggtagtaatggcaaagggtcatcagaacaccaagaaaagtgaggcgatcagtgagttggtccaacatagcaccaaagcgagaaccggaaaaggacgatcgaataaaaccacaaactagtgtattattaactggtccctaaagaatggggtggtctgggtcaatggcaactcgtacaaaaaaatttataagaattttcaactaaaacttagaattttttatataaaaaaaatctaacaagggaaccacccgaactgtaagtcggaaaatgcatatgtattatataccattcgatagagcagggtcgacttctattgtgaatttttaatattacgcccccataggaagaaattaaaaagttatggggcctcaaaaatcgaaattttggcttgtattttcccttcacatttggtggtcaagtggcgcgaactgctgtcaggttctggtggttcgagtccgcgtgggtttaacaaattttttt

SEQ ID NO: 134 - DNA, 4905 bp, Heterodera glycines
tggacgtataatcgactcgtgccctctaatggtaccgtctcttttctcactttggttaaatttccgggccaaatatccgtcaaaagcatctaaaagtgcactagcgaagtatagcagtgcggcgctccatggcttttcctcgtaagacatcgcaaaaagagcgccaaaagcgagcaaaatacgcacataaccgagcaggtttgggtagaacaaaaaaacattctcatcactcggacggacgggcggaggacaaccaacgctgacgggcacaaagtcatagggcggaagacgtacagtctcattgtcgacagaaccctcacgcaaacccaaaggcgcacagcgtttgattccgacgctaaaacaaacgcaaaacaattccaataccccaagaaagaacgcacctttcagccattattgttgttttacgccaattattcttaagggggtttctcaacccatatttatgagtaaacaatgaatatgatatttcgaagcaatgtaaacttgtgcggtgcgaatacctattataaaatataatttagtgaaatgtgcttggtctcaatatttttctctgaaaaaccggtcattagaatttttaatagcgagagattatttaaatctttagtaggctaataaccattattaggtatttcgattaatggtcaaccaaagaccaacaaccgattttcctggataatttgagcataaataataagtcataaataaaaaacaacgagctttttgttggtggccaaaaaatcagaaccgtcgcgatgtctctttaaaatttggttcatttcatcgccatgtctcgagggaaatattcgccccgctcgtccctcttcgcaaaagcgttgatcatcaactgttccttcaacagcaccatcatctcatcacgctttcgagccaaacaaagcgcagtggagaaaaaatcggaggcttgcacaaattttttcctgatgaaaaaatgaggtaacatacaggtgtcctctcaacggagcacaaaaacaaaagacccataaaaatattaaattaaaaaaaattgtgcaaaaaatgccttggggcccgaaatttactcaaattaacaattgagaaaaatgcttaatgaccaagcacagcattttaactcattggcatttatttcataaatcgactggggatggttaggcactttgactttattggttatttgaatcaacttgggtcggtcgtctgactcgactcctaatgttttagatcaaaatgttgattattttttgctagaattttgccaagttttgatcggtttgatatttaacaaaaacccacaaaaataacaattttaggttagaaccgttatgtattatttactaaaataaaatgtttttgtaatttacttttctccgcatattttgcccattattctgtacggctcccaataattcgggtccgcctcaattgcttttcgcattgcattttccatactctgcacgacttgtgataaatccaagcggtctgacatatccacgaggctaaagaaattaaacattcatgaaatagagaaaaatccgagtggggagggggtcaaagacatatttcgtaataaattttcaggaaaacataaataaaaagggaaaaaattcactaattgtaaacgaatttcatgggattttcttgagaaaccgaggggagggggcagggacggtcccaggaattcggctgggggagggtaaagccgactcgcgcaaaaaaaggaaacaatttttcatttccctaccctttatgttaactggctgtacatgaataaattttaaataaaatgccgattcttaggaaattaccccaagagataaatagcgtaggcgcaattgggcatcttctcaagcgtttttttgcacgcttcgagcacgatttgattgttgtgcaaaagcattgcgaacttaaatattctttaatttgttaatatattaaaaaataccttagagagaaatataaacgcaaaaatcggaacattttccgaatccgtcaaaatttgttgtagcataaacatctgattttgaatgtcaagaaaagtttgctgacgaatggcaattgaaaggctggcattgatttcgtaataactataaaagaagaaatgcatttgaatcaaaagaatttcattcctttgcgaacgaatcccctatttttgtaggacaccaattgtaagtgaaaagcaaaacgcaccgaatgaatggattcttctgatcaagttttttagcacgttgaaaaatgactaaggaattctcatgttgatcataatgaataagttgaacaccaaaagtgaccgaaaatatgcggaaagtgatttagagagattaggtttttcaaaatttaccagtgggtcgacatttttagggtttattcgaagtccctcctcaaccaattggtggcagcgttgtttagctgtctcatcaattttgtaattctcctcattgctcaacgattcgctctcgaccaaatcagtcaaagtcacctaaaaaactgaatgtataaacatcgataaacaacaaaaaatcaaaatggacaaataggcgaggctccatttattaatagatatattttttttatttataatttttctcaaaaataattatttcatttcagaagggaaaatcctttacggacctgtaaagttatgtgtgcaacatggatatccttgtgcgccaatttctgcgcttcgtctgcaagacgacgaaatacaaaaaaaatttaaagtcgagttcaccaagtttgtcccaaaaatgctcaaatttttgcatcgtttccattgcttgttgtttcagcgtttgatagaacaagaaacgcgccgccaaaagcactgccaatatacggtccacaatttcatgagtttcgtcattcacaattgcaaaagccaaagaagcaatttcactgtgaaaagtgaaaggaggtgttttttgaatacaaatgcttacaataataactcactcgtattctcctcgtttgagcgtcaacaaagcatcgtccaaagcactaatccatcgagttttatcctcatttaaatcgttcgtcaatttgttcattctcgccaacaacgggtcgttggtcacagtactaatcatccattcacagaccatcatttgtggaattttcatgggtttcccaatcttatccttaaaataagcagaagaatattagtggaaactctgtccgtcacctgaatgatttcattgagcaatgggctgatggtggcctcagcgacacggtcaagctcaacatggtaagtgttccggctttctttgcttacattttccatgaaggtcaagtcaagatagtctgaaattccaattaaatgaggaagttttattggaaatgcaaacaaaagtcgcccaattcacactgaccattaattgccttatcattttgtcccaatttgaagtgcgttctcgcgcgacgtctcatcgctttttcgtagttcggtttaatttgaagtgccaaattgcaatggtccaaacatttttcagtgtttccctatgcggagaattaatgatcgtcgcgttttgatccatttaaaagtgcaagtcaaccaaccaactcgtcgaagcaggcagctaaacggcataggttaagaagctcaaacgattcaataaaaaaatttgatttaattaggcggtaatactggagaatctgagctccataaaaatcattgtttggctagtaaatcagattatttatgttttgtacgattgttctatgatcatctcaatgtttatgtcgtatcattgtttggctaataaagattgctactcttgcaaatctgacataacatataacagaatattttttgtggagcacagattctccagtattatcgattgggctaattgcagcgccccaaaaaaataaaaaatttgatacattaagccttttaacccaccattgttgttctcgcacaaagacataagttctccgattttcgcttcatccacttggtcgctaaattccttgccgacttttcgcagttcgtcaatggcatcgccaaacaaacgaattgcctccttaaagtctttgcgccgatatgcttcaacaccctgggctttcttcttttcagccttttggagaatggacaccgatttctgctcacaatcgtttcggttccgacaacggtaaaactaaaaattataaaataagaaaacagaaggaaaaagaaaacacacccaataaataagcgcactgcctaaacccaaggcagtggcaatggccaatgttcggctattgagcgaccacccgcgagagtgaggaacagaattagcgctcatcacttacaattagccattaataaaaacaaaacggattgtcaataaattaaggaaataaattgaattagtctcgacaaaaattcacaccagtccaaaaaatctgtgtatttatttaaatcagtgaaaattgatgacaaatctgttaacagagtctaatctgcgtctgtattgtttttaagctgacgtcgcttttgcctttctttcgcttgtctgtccgccaaatttccgcctttgtaatgcgaagaagtccgatcaatggcaaaagcactgtccacgaaaaaggcagaaaatcgctcatcgctttgcacttgggcggcgtcgggcgatggtgctttttcattgtcaggtgggtttagctaaatgagatcaaaggcgtagccaggaccttcgtttcgggggggggggggaggcccaactcaaaaagtcggttcttaggggtgtattttcgtgttttttttaattgaattgattgcattagacgcgttcaattgtaaatgatctgttttttttatttcataaactcgtttgttatttttacaaaaaaattaatataatatttttaaaaaaataatttttttttcaaaaaattctgatttcggggggggggggg

SEQ ID NO: 135 - DNA, 2300 bp, Heterodera glycines
cccccagctacgcccttgaatgagatcggttacaaatgcaaatgcattagccatttctgcaaatttctcattcccgcccatctttcccacctcgtcccctctccgccgtttccgtcgcttcgcctcttcctgtttccgttcctgcttcagctgcttcttccgctccaaatacagctggaacttggtcttgcgcttcggtctctgtatgtccaccgcctcctcctcgctgtcttcgtctgtaatttctctgtcttcgccgtcgctttcgttccttgtcctctctttctcatccgccttttctttctccacattttcatgctgttcgtcgtccttctcttcatctttgctttgctgtgccttcgaatttcccaaaaggccttcacgcgcagcggccaataacatatcgcgctttgcattccgctgattctgtttgtccttttcctcctcttcgctgtcggagccaatgaaagcgcttaaccccaaaaattttcggaattgatgatactatttatcaacggtacggtacttaaactcctccaatttggcctcctcgtcgaatgctcgcttgaatgctcttctcctctccgggtcgtccgtctcccaactgatttttgggttacttgcggtgagtgtgtgcattccaacttttcgtggccggtaccattcagcgctgaactgatccgacaaaatttgttcccgaattcgttcagtctaaaggagtatattaattattcactgtatattcatcccacctcaaattccattccttcggggataaatcgaatgtcgaatctcagcccactggattcgtacttaagggagataaattcgtatattgaaaatgaaagaaataaaataatcacttacttccacgccatcacaagcttcgtatatggcagtcgccgtgtcgacagagtcacacacacaaacggcgtaataataacgcaatttgtccaactcatgcgcacggattgcttttttcgtttgcctatttgctttttttgtaaatgaattataatgcaattctatgcttactcttccaatttgtcctcttcctccctctcatttgcttttctattgaatcgcttcactttcaacatcggtccgtttcgcttttctctctctatgcttttcgctccaaaatccgacaaataaacagaaaccgagtgaattttcgcttcgttcggttttagtgagttgaataactgaatccaatttatttgtaaaaaccagtgcaatttctttgtttattgaatcaacattttttgtgccaaccagcattaaatccgcagcccgcacattgccccagtccaaattgcagattgccaacttagatgatgcccattccacgcgtcgcacttctttgtccaattctccccaattgtcttcctcctccccctctttgttttcgcccgttttttggtcaaacatttcatccgatgattcgtcgtcacttgacgaagagatgttcccctgtcctcgagccaaatcgaattgaatttgctgcactttgtcttccgggagaacatttggatcgcattcgatgtccgactcactgtcagttgtttcacaactcgatgaactcttaagttgcatttctccacttacagacggcggtgccgtccttaaatgagggggtcataaaataatgattttatgacaagttcaacttctcatcgtgatataactcgtaaatgtgtgacaaatgcgcatctctgttcgttttggtcgtaggccttccgcgcctgtccatcaattggaaagcgtcctctcgaaaatctttgtcaaccagtagtttcttgaaacgatcatcgatttgaactttgtgctccttcttgcgcatctcgcggagcattggggctttcgccaaatgcataaaacgactatcatgttcgacgtcaatttgcttcttttttgctgttcgttccttcatgttgcgtttcattttagtaacagagtaaaggtcaattgtaagtaggcgcaaagatttcacaagtaaaatatttagcataacacaacaaatttaaaatacgtgttcatgactccagatttataaaatgtaggtcgtggcttattgagcctcgcatggagcatgcacgcagagcttttagcatttggtaaatcgctcaaaattaaaaaatatggcgaaaaaaaaattttaatcatagatatctatcaaaacatttgtgagatcgacaatcaatggaaataagcaaaaataaagcaaatcagagtaaattatatggacggttgtgcttcagtgcactgcaacagatatggcagtcacgttccccgggggt

SEQ ID NO: 136 - DNA, 2269 bp, Heterodera glycines
  misc_feature (45)..(45): n is a, c, g, or t
  misc_feature (50)..(50): n is a, c, g, or t
ggggataaatcgaatgtcgaatctcagcccactggattcgtactnaaggnagataaattcgtatattgaaaatgaaagaaataaaataatcacttacttccacgccatcacaagcttcgtatatggcagtcgccgtgtcgacagagtcacacacacaaacggcgtaataataacgcaatttgtccaactcatgcgcacggattgcttttttcgtttgcctatttgctttttttgtaaatgaattataatgcaattctatgcttactcttccaatttgtcctcttcctccctctcatttgcttttctattgaatcgcttcactttcaacatcggtccgtttcgcttttctctctctatgctttccgctccaaaatccgacaaataaacagaaaccgagtgaattttcgcttcgttcggttttagtgagttgaataactgaatccaatttatttgtaaaaaccagtgcaatttctttgtttattgaatcaacattttttgtgccaaccagcattaaatccgcagcccgcacattgccccagtccaaattgcagattgccaacttagatgatgcccattccacgcgtcgcacttctttgtccaattctccccaattgtcttcctcctccccctctttgttttcgcccgttttttggtcaaacatttcatccgatgattcgtcgtcacttgacgaagagatgttcccctgtcctcgagccaaatcgaattgaatttgctgcactttgtcttccgggagaacatttggatcgcattcgatgtccgactcactgtcagttgtttcacaactcgatgaactcttaagttgcatttctccacttacagacggcggtgccgtccttaaatgaggggaagtcataaaataatgattttatgacaagttataccaacttctcatcgtgatataactcgtaaatgtgtgacaaatgcgcatctctgttcgttttggtcgtaggccttccgcgcctgtccatcaattggaaagcgtcctctcgaaaatctttgtcaaccagtagtttcttgaaacgatcatcgatttgaactttttgctccttcttgcgcatctctctgaacattggggctttcgccaaatccataaaacgactatcatcttcaacgtcaatttgctttgttcgttcattcattttgcgtttcattttagtaacagactaaaggtcaattgtaagtaggcgcaaagatttcaaagtaaaatatttagcataaaacaacaaatttaaaatacattttcatgacaccagatttataaaatttagtcgtggcttcttaaacctcgcatggaacatgtacacggacaaaaatcggtctgataaaattatcgcttttcttgtgcccgtttctttaaatatcggagtgcagacttcctttcttttttataaaacttaaaaacgaaaaggtaaattagaaaaataaataaaagaggacatcttttgtttcgcaaaaaattgtcctaatatttaaaataaaattttaaatccttaaaacaatttccagagaccggggtagccgatcaggaatttcacgtacatttcgaccaattactaaatccagacataaattagaacaaaaagtccaaaattcaggaatgtctacaaggattttgtatttttgatatgaaaatagtttaaatgatcttttagaaacattttaaagtctttgaaaacaaaatatatattattagcgctaaaatatgtatatgtattggaccttaacaattgactctcgctttttcccccattccttgcgcaaagtctcctctttttgatgtctccgaaacgaagacatatacgaacgaatagtgggagtatcagcattaacaaaaaaacaaatgcttttctgatttccaacaccaacatccgccgtttcatactgactagtagaaaagttggttccctaaaatggcaatggtgtaaatccaaatgttgtagatttagtgatgcttgagcccagtgtggttaactgggcggcaggccaactgggcggtatgggacacagattaggacccgctacaattagctaccgaaaaatactgagcgtgtataaaaaaaacatataataagttctgttaagtggctgatttttgtgagaccagaagcgcttaaaaaataggaaaaccttgttacgttgaagaaagcttggacttataacagtttgcccccatacaaaaattttttttcttttatgggaaaaaaaggggttccaggggtttccggggcctgctgatcatgaatataaa

SEQ ID NO: 137 - DNA, 5064 bp, Heterodera glycines
ccgtcaagatgtcccggtccgatgttagccctatattcactcacaaggggggggcgttccgaagaaccggcatttcccgaaaaatagaatttcagtaacccagaaaacctcggaaaatcattacctcgtgatcacttgtataaacccgaccaattgaagcaagaaaactaaacggttcctaaaataaattttgaattgtataaacgggcttaatcaaaagataactttgtgtttgtcatcgatttgaaccttgtgctccttcttgcgcatctctctgaacattggatttttcgccaaatccataaaacgactatcatcttcaacgtcaatttgcttcttttttgctgttcgttccttcatcttcgtttttctaatatagtaatacaaaatcaaaagtttttgtaaacaaaaatgtgaaagtaaagtaataaataaaaagcctaactttaaaggctacattactcacaattaccgggactcaacccaccagcatttcaatcactgggactcaacccaccagcatttcaatcactgggactcaatccaccaacattccaatcaacgggactcaaccctccagcatttcaattttttgaaattttgacctaaaaacggcaaaattttttattttttgttgcaaaattccgtaaaaagaaagatgagttttcagggcggcactgcgtgtatgccggattccagagatcactacataaaaatagagcaccattcctaacctttcattttgatgattaaaataattattcatttatttagaagcgatttactagcaaatttgcgcaaatgaatggccaaattattaattcggacgaattaaagattgtttgtaagttaatgcatttaaatttatgggtaatatttactatgctttgtctcccctaccgcctttttttggaagaaaacattcttaagtcgtgagaatatgtacatggaggatttccagggtctctgatcatgaatctgacattcctcttgtccactttcaaacccggacccaaattgaccttttttgatgctgtagtggttttttacaaatttagcttgtttaatctattaggaacaaaagtaaaaattttaaaattatgaattttcaactttttgttcgggttcgaatctagggttagaaattggtcgaaatgtgtttaaattcgtgatcacgaccctcaatacccttaaaacaagattttacgaattttagaaaaaaaattttctttcaaaaaaggggatgggcaccagccttactattaccacggttttgactcaattcttatgggtgtatttttcgcattttttgtgaaaatttaaaaaaaaaagacgaaaatatgctctaaaagccttaatatggcaaaatatgcatttattcttgaaacccccgacaaatgcttttatatgcactcaaaacttttaccaataaactgaatttatttttttgttgtttaattcttaattttctattgtattattagtcacacataaggcgcttcatactttgattgcatattattcggacgtcgcagtaccaactggaacaacagttaacagggacggatgtgggctggtaaatttagctaaattttgtttacaattgaatgaaaattaagaaaacttacgaaaaatcaaatttgatgtaaaatcatagatttaaagatgtcaatgacaaatctgataaggattattcttgttcagcaccctctctctatacctgggatggcacggattacgaaaaaaatttggacaattctgatttcctgattttgatatggttgaaaatttttttttcaaaatttgtacaaattctgttaaaaatttgcactggtattttcaaaaaataccaagcggtgcctattgacagcgcaaacaaaaaaaaagattaatgaagaaatcagattaattttgtcgagcaaataaagaaatgtgattttaaacgttttggggtcggaatttcggcattttttcctttttatgggaccactgttacatcattttcaaattaagtcattaaacacgcatacctattataataataatcgtaattacctaattcagacaaaacggcgattcttgtgcccgtcggtcaagaccaaagaacagatgatcttcgagatagatttccgaatttcggcgacaattggcgaaaaaattatgtttggtaaaaaacatgacggttcaaccgatgatcttcgcgaggcaacgagggtaagaaaaaatgtttttcaatggatcaaggggatatttgattttgtttttttcattcgaaaaaacacgaatcctgtttaccgtctgaataattattttttagatgatcttagacatggtaaacagcggaatgttttacgacgaattgggcctgcgcgaatttactgtaaaaatcttacttctctatgtcttaaaacaattcctttttgaggttgccccaccaggaccggcactgaaaaacaaattggacaaatttgtggaccggaaattgaatgaatgtgtggcacgagtggagaaattagtgaataacaaaaaggttaaattgagtctaataaaacattaaattgtggatggtgcaaatgatttcaggacgaagtgaaagacctggccgagcatttggaggcaagcgacggttggcacttgaacgaggaacagatccatcaattcttcaaacgcagaaacgcaaatgcgtccccatgaagaagcaaaagaaatttatttcacataaacattacaaaaacaaaaaatttgtactttcttaacccttcccctgctgaaaaataaaaatttaaaacaaaatttatttgctttttaatttaaaattggcttatacagcctaattgtcatggtccatactgattcgtgatcagcgaattcaaaccctaaaatatgttgtaaaaattttgattttcaaaaaaggaagggcttcccaacatggcaaaatttttcattttttaaaaccgttcaaattcctgctttttatccccgtcgcttaaatttctgaaaaataaaaccggtgaaaatttttttggctcgaatagcaaaaaagctcggattcgcgcctggaaatttccttttctagctaggggcctggacaagtgtacgacataacaaaaaagtgtaaaaatgattgtttctttaatttaattcttcgctgcttccattcaacgcctcctgaacacatcggccgcctcgtcaagttggaaggcgaacatgttcattcggaacagctgttgttgctccaccgattaagtcatttgtcttaaatatcaatttgagtattaatgatttttcggagacagattcagaaaacaatgacttaaagggagagtgatgtcggaaaagcatgaggacactccatcgacgggccctactcgccggcggaggaacagggcaaattgccagcacttttcaactgaaaaataaatacatcggtagatcggcactaacatttaaaacaaaattaaattccaaggcatcaattgtttttgtccattgaaattgccatttttatgttgtatatgtatataaattacggattttgatgcgttaaattacatgacaaaaaaagaaacacaaaaggaagtaattggacagccctctctctcccacacacattcgttttgctttttgccattcatttgcccgccgtcgcttcggccctccgtttgcattggatgaagaacagttcgtgagggccgagatttggtgcacggatggtacaaccaagaatggcgtcgagccaaacttgaaaaagtagaattccatggcgcaacaaattttttgtaagcaggcacccgccatccccagaacgtacaaaaccatcaccgtgcgccctccctacccatatatttaaaaacaatttcgtcaatgaaatttgaatcttgtgatggctatgatttattttttgcgaacccctcctattgcaggttaaagtgtaagtaataattttttgaaaaatcttagtaattgaccataaaaattctcaaaaaatttctttaaaaaaattttttttggggggggggggggaacgtagtgcacacccttacgtttatctaattattgaaaagtatttgtaaagcgatcaaactgtctatttgtaagcccaattctggtttatacgaaaaatggccactcatacgcaccaacaatgcgttgtttgctgtccgtccgcacgcgtacaatttgcatccgtcgacggagtgatcgcttgccgcccttcccgtcggtggacaaaatttgctccagctcgggccacatgcaaatcagtgagccggacagcacaaaataagtgcgcatgcgacgtccaatctcacagaaagtgcctttcacctccgttgaacatttgccgtaaaagaaacggtggtggcacatttgctcccatgctgaaaagtgccaacatccatttttaaatgtcattgtgggtcggaaattctaatatggaaagcgagtgtcattttaagactcatgaaaactgaaaatgttcgaccccaaattttaagacccatcaaaaatagtgcttctccccatcattcgcctttttccttgccctgttctcaccgttaaactgctccttccacaacttttctgcatgtgccaagttttgcactgcggtgaaccgctgtgccaactcgtccatcgtttcgtagcgcggacttcggccggtgttcggcttgttgatgcagtacatgcgcgacatgcccaagccggccgggaggtggtgatcactgcaattgaaaaggagaactaaaccggcgggactggaatgcattgaccggcaattcatttccaaaacccggaattaaaaaaaaccatgaattcctgtcccgatctcggcaaagtagcagattgttgcataattcatttcgtcaaaaattccccgcctcctcacccgttggcgttgtcaatgcccagcccgaagatgaacgcaatgctgtgctttacgcatccgttcaacccgacattggacgtgtagaagtcgtcgccccgtttgcggtgctttttacgcagttcgcacacctcgtcccaggagatgccgcgcatcacctccattttgtcatttccaccaca

SEQ ID NO: 138 - DNA, 2716 bp, Heterodera glycines
caccccgcagatactggcctcactcaaattttccaagaaatgttgttaaatctttcaaaaaatccacaaatttttaatgaaaatctgctaaaaatggctcaaaatcacaaaatttggtcattttttggacaaaatctattaacaaaccgcatttaaaaccgcaaaaatttttccggcggcgcctatcggcaccgccggaccccctgtaccccaaaaatttttttgcaaaaaccgcgccacataaaaaacgggtgtgaaaagcaaaaaaaaaaaaaggtcgtcgcccggggggaggtgcccccccccaagccaaaatcctgggaccgtccctgaaacccggaattaaaaaaaaacccatgaattcctgtcccgatcttggcaaagtagcagatagttgcataattcgtttcgtcaaaaattccccgccccctcacccgttggcgttgtcaatgcccagcccgaagatgaacgcaatgctgtgctttacgcattcgttcagcccgatattggacgtgtagaagccgtcgccccgtttgaggtgctttttgcgtagttcgcacacctcgtcccaggagatgccgcgcatcaccaccattttgtgcatttccaccacaaagtcaccacttttgccaacaccgcgaaactgacggtactctttcttgtgcacccgatcattgtccattccgatatctatggcacaaaataatgttggcatttttttggaaaaaaacttcaaaaactcacccaaaatgcccatgtcgaaagtgccgtccactttggccactttgatcagctccgcgcaaatgtcgctgaagtactggaacagtttgttctgcgcgtagaccggcaggccgagcaagcggttcaggaatttgggaattgtcactgtgtcgcgctcgaaggcgaaaccgcgcccgcccggctgctgctgcaacatgccgacgccttccaggtaggtgcgcatgtcctcttcggtgatgttttcgagcattttctcttcagaatttttggatctgattcaatttcggttcaacaaaatgcaatttattgaaaggataaaactcactccgctctcgggttccttcatcacattttgttgctttcgatagatgtcgaaaatgtaattgttgcgtcgctcaacgtcctgccatctcttaaacatatttatcttccaaaatcaattcaaatggatggaatggcaaatgtccgggccgcaaatgtccgatttggctgggaccgcaaatgtccgggacgcaaatgtctggacaccaaccaaaggattaaaggagaaaataatggaaatttaacaaatggaaaaaatgtgaggatcagttgtcctttaatgccgaacaaaaagcccatgtttatcattttcggtctcaaaaaaactgggagaaaattgcagtccggtgacatttgtgcagtttgcacacaccttctccaacatgtcgtccaggttcaggctcagctcgcaactgatcacaatgctgtgcggcagccgggcgagtcgttccacctcctcgaggcttatttggtcaattttgttgtatatgtgtaggcaggggatgtacacccggttgccctggatcacgtcgatcagttcgtcaatgctgaaacatggagaatttctctttttgggatgtcaacaccaaaccgccatttaaattttatggaagtaaaaggtgtttttaaaatttacaaaaacaaacaaagaataaaaactaatagaatgatggtaacataaacatcactaaatacctttgaataaatccttaatggcctcaaaacaattcatttaataggacaaataaaagcttggcattttggttttaaatattttgtatgaaaaattttgtattcgtgcagcaccgtttggatcagtttctcgtggcaatgtgtcaacggcactgtatgagtgaatttcagtccgcccccatttttctttttgaaataaatgtttggcggccgtttgttgagccgaattccgaccgcttcgagttccttttccaacagcgttttctgaaaaatgacaataaaatgacataaaattggaagggcgggggggggtggcaaaaaataaatcaaaattccttggattttctttttcttaaacgccaccaggaaatttaaagaaaaagtgtaaaagaaaaaaattgcacaaatgtaaagaattaaaaaaataatggggaatgtaaaggagaaaatttacaaattttctaaaaattgacaataaatttacaaaattttacagagaattttttttttgaaaaagacaacccatgggtattcggaccgggtcggttgggccccgtcgattgggccccatagagcagtcactacatggacaagggaggggagggggagtcagaataaaaaaagttatattgtcaaatgttattgtttgcgtgtttcattgcatatttgtaaatatatttggcttcatatttgttttataattttttatattttcccatttcttgattgcctaactaaaataacattaattcagcttattatttaatatattaatatcacgatggaaaataattgaagtgccgaaggcgaacattatggaatttttgattggtgtttctcgaaattaccagatggatgcttagaattttatgaataaatttttgggatgttaaattatttttgacagtatggaatggaaaatgtgacagacccttgtggcccaatcggaggggcccaatcg

SEQ ID NO: 139 - DNA, 1276 bp, Heterodera glycines
gaaaatttttaaaaaatttttcagccaaataagaaaattttttcgaattccccccccccaaacgaaaatttaaaaattttatagacaattttcgtaacaaatagcactcaaattttccgtaaaacggccaaaattgggtccttttttagtgaaaaagtggagtttttacccagtagcgggaaaaagttttttttaagcagccgccgccgacgaccaaacaatagaaaagtctacaagtggaaaattgcagttatttgcagatcgtaaacaacttttatcaattttattcagcgaaaaaaaattacggataaatttgaaaaaaaaaggtcttcggaccggacccctctctttccccccccccgaaaatttttcctggctacgggcttgttgaatgacatatgcaaattggtacaaaaaagccaagtgtttacttggatctcccccttggtagcgtccaacatcatcagaatgaggtcggcagtcttcgccacggagatcacttgtcctcctcggcctgaaaagaaatgccaaaattgttttttaaaaatggttctcaactgctgacctttgccctgcgctgccccctcaatgatacccggcaaatcgagcagttggatgttcgctccttcgtactggcgaaagcgtttgtggacaaattgcagcaaaataaacgcctacctcaatcacaccaggaatgcctaaaataacaggaaaaatgaaacatttcacattgaattagcccaaaatgaaattacatgtcaaagtggtgaattcgtacgaggcagcaacactctgaaaacaaaaagaagtcaaaaactataataccggaattttacacaacaatttggaagcgaaaattaaaatttgttaaaagcatgatttgtaaaaccaaaaaatatattttctgcaaaagcgttcacaaaaaacattgcctctgttgttgtgacggttcaaaggaacgttgactttccaaaggatgggaaattctgctgctgttgtgccgctttgtccgcctcgtccatggctcggcagtcggccaactgttcgcggactcggcctagccaagcggggcccaaacggcggagaagggccagtcggtgcccatgcaacgcatggccaacgagcagaagacagatggaggcgtaaaacctgaccgaggacggcggacctgacaaaacgcaattgaacagtgtcaaatttacgggagaatggctaaaaacccaatcgttcgggctaatttatttggaagagtcatccccctcctcccaactggaaa

SEQ ID NO: 140 - DNA, 1543 bp, Heterodera glycines
atggtgtaaaatgtgtttctttaagtggcagtgcacggcgattcatccagcacccagtcattcgtttcatccgtctgttcggctctcttcgtttcttccgttcctccgtccgtcttttcagcttcgttcggttcgtccgtgcctccgtccgtcttttcacacctaaaggtttgaattcggctttgcggttcggaattagttgaaaaaggagtccagattcatactcagcgtctcaaaattcagcaagatgttataagaacttttagaaaatttttcgggaccaaaaagaaacttgattgccttcaataaactttttcaaattagctaggtaacgaaaaaatgattaccggctacgctggcaccttcgagagcggcacttccaccgggaacgggttgttcagttcgagcctgcagatttacacatacattaaaaacttttttttaagagaaagtacagttcagggatgggagccgatcaataacacttcaaaaaaaatttaaaaattctaaaagcactttctatggtggttttcgggcaagttagacacgaattgacacactttttgatcaatctcataccccggatcagaatttgaacaaaaagtcgaaaatttaaattctagaatttcgcatttttcatctaaaaacgacttaaaaatagtttttatcgcaggaaatgatggccctaagtttgttttcctgtatttaagccgtatttggacgaaaaaaagatcttcgacttttggttcaaattcgggtccggggtccgaaattgatcgaagctgtcagattcgatttagcgtgcctgaaaccattgctgaattgggtcccagtagaagaaactatggcgtaaccatggggacgtgggcagagggctaaagtgagtgggtacagctcaccctgtcctcccaaaaattgtaatgcatggaaataccaattaagtagaaaatgaaaaaaaatcaaaaaacctctgggacgttcccccgtcctacatcaaagttctcgctcattaaaaaatctatctaaaatgataatatgtatgtatttggcaagtttcacaataacaaaaaatatacatacataataatctattatactaattgggtgtgtcattccgtgtttttttgccttttttgagcggaaaaacagattatttattggcacgaaagattttgcaatttctctctccttcccttttctttctttgttattgctcacatgcacactcgattaagacaccaaacaacaaaaagagtttgttattgacacaccgtgcattttcaaaagcaaaaacaatttttcttatgaaataactttgattggttattcttctaagcgaaagcttttattttctttccaaacagaaaattttccttttcctttattctgtatttgctctaaaaatgtaaatcaaatgtttaatccaattctctggtaaatttttcattttttgtatttgtgtttccatattttccatataatccatatatttccatatttcactttttcgtccatattttttccatatttcgccatgtttgaa

SEQ ID NO: 141 - DNA, 1416 bp, Heterodera glycines
tttccatataatccatatttccatatttcgctatgttgaaacttctaggacaacttttttttgtccatattttccatataatccatatttccatatttcgccatgtttgaaacttctaggacaacttttttttgtccatattttccatataatccatatttttccatatttcactttttcgtccatatttgttccatattcgcaatttttagggaaacaaaatttatccaaatatttttagcaatataatggtgcgcaaaaaacaaaagctaataactgacgattgtgctccaagcacttcaaatgatcagcgcacgaatgacgggttcaaagctcccggtcaaaaaagcggtcaattgattgaaacggttcaaagctccgtacaaaagcggtctgaaacaatacataattcgattgaattacaaagcaaagaaaaaagtacagaaagacgttgtttgaaaaggaaacgattgcaaatggaagaagttatagatttggatgatttgcctgatgaatttttctctcctagcatatcaaatgaaaaaattaaggaatacgatagaaatcgcaaaatatcccgctttcaaatgaatgaagaacagagaaaattagagagagagttgaatttaacagttgtgcaatctagacgatttttttatatctcagtgcttaactattgcctttttgtatgataactggtagatattgggagtgaaaaaaagtttgtttgtgactatttacaataaaaatttatgcagcatttctaaaaaggatgtaaaaattatttcttgcgtaatattttttacattatgttgttgaagaatttgagtctgcttctgatgcaattggaaaatttttcagcttttctcgaaaagttttttcccagaaaacggatgggtcaaataaaaaactaaacatctcacatgaccaatttaaattcccttacattttgggtttactttattatgctggcccataaaaaatggagtttttccggtgccaaatttttgtgaattttctttcggcccgtcataagcggattgtttgggggcaaatgaaaacaaattttgtgttattcgaatgcgctagccgagctctacattttcaaatgtatcaacaaagggtctatctccactctctggcgagttatgtccagccaaagcagagtgggccataaacacgaattttttaatctttggtatttcctctattttgagcctgctctacatttatgtattgtgccaatatgcctattgcaactgaaatttattcaactttcccgacaaattgttgagataattattctagacgatttttttatatctcaaagcttaactattgcctttttgtatgataactggtagatattgggagaaaagaaaagtttttttgtgactatttacaataaaaatttat

SEQ ID NO: 142 - DNA, 17934 bp, Heterodera glycines
ggaaattcgcccccgatttcgtctgcctgtactgctcgaagtccgtctgcgccaaacctatctcctccttgagattccgtcgaattcgtttgtaacttggcacgatcattgaggagactgggagccatcgaactatctcccaaatattttttctcgtgtctctgaaccgaatgcgggtttgccgaatttcccgcttcttcctgtgttgccgaaggcacttctgccgctttttcgaaaactgccgatttctccgtcgtcgttgcgctgccgtatttctcgtccgagtcgtgagggccattccctcgagaattgtcgttccgaatttgtcgatttgccttttcgtcaggctgtacagctttaacttctcgtcctcgcttttcgatattttttcgcttggcttcctttttctcgttctccgttgctgccgagggtgcgttccgatccctcattttgctctgagtctcggttgctcgctgttcttcgagtcgttcatgtactgcttcgtcagctcggtcgtccgtttcgcccgtttttggccgcgcttctttcagcggccaaattttcttgatcggtcgtctccgagttcgtccgttggccattctgatcatggcatttctgttatgttcgctcgctccttttgtctcgactatccgtccgatgggccactttcgctgtttagggtccatttccccaattggctcctctcgagacgtaataacttcgttcgcacccgaccgatcgggaccaagctctgcaggtgagttgtggcggtctcggctaacaatccctcgcgaattgtttttccgactctttcgttttcgcttccaatttcgacgtacttctccgatttgttgtcgtttatttgttcgagtttggtggatatttccgcatggcatggttgttaggattgatgccgcgggagttgccccgctgctcgcttgtgtgccttcgccgcacaaaacttgtccaaacacggtgtcaatcacatgcgcgccactctcaattttccgaaatccgatcacgtaatcccagaactttcgaatgccgatcattatttgaggttgcgttgtctgtgtgatggttcgcgggtcgctatcgggtgttgctcccgactcgatgagttctgttctgattggcgtacagatctgaggtacttcggacacctcaatgctctcccatttgccgtcggtccgtttgagtcgtaggcgataagttgctgaccgaatccgctgcttctttcctccgaacacttgaactgtaagcggccgcttgtcgatgggttgcggtccgagttgttgaattagctccgtatctgcgccgtcgacatggcttcccgggtcaagcaacaaagttgtttggcactcgtcttcgccttcctctgcagctgcgatcactctgcatatcatttgctgggccgggagtcggcttccgaaagtggtgaaagcccgttgttccccggcgttcgtctcgattccgtctcgaacgttctgctcgtctcgcacttcagtgaagtgagttggtcgatccatcccactgatcagcgtcgcatggttctttgcccttcgttcgtgctcagtgaaggatcgggattggccacccgatatgctcttccagcacagaagccaatgatggtcgtcttttcggaatgcgttgcaccggtttactcgttggcattgtttaaataagtgatcggagctcatacagcgcaagcatcgtttctgctcaatgagtctcttcctccgtgcctgtgctgtcggataggcttggcatttgcttggtcgatgtccacttcttaggcatagtgaacagttccatatctccgttgtggcaattggtccgtttgatgcgacacggggccaattcccgcctgagctctcgttctcgttggcatgtgtgatcgatcgtctggcgaaacgggcgttcgtcccgtaccgctcctcgcttcgtgttccgttggattgtgcacgggttggttggctgtcccgtaccataaatgctctttgaaacggttcccgacctgcttgaacatccagtcccgtctgatcacgttctgttttgtgatcagtgcgtacttccgggtctttcattgctgccaatgctgactctgctgaccgcatgcaccgtacttgcgccgccaccgctctcctgaactcgcgcactgaccatttcgatcccatcatgctttctctgatccgcaattccgtgagcactcgcaccggcaattttgcctccagcaatgggccaaatgagtcgtcgtccacgttcgctccgagctgctcgagttggcaaacgcatcgctcaaattcgtcgatcatcgttgtcaagctgttcacattgtcctttgccggtgccaaatgaagaagccgggcccgaattgcccgctgtaaatcgtccgtgtcgccgaatcgttctttcaaaagttgcacgaccaccgggtagttgccgtcggagggagggtagacttcgacagcccgccgggctggtgatccctcctttaagcagcgcagaagatgcaattgtttttcaaacccgggaatgggtttgtcgtccacagctcgcttgaaataggcccaaaatgtcgtccaatcctcgggctttccggaaaaagtcggcggttgcagccgaacagtctcgaatgttgtcattcccgtgatttcgtccctcccgtgcttccgatcatgttctccctcgtctcgagcatgccgtcgaatcgggtatgtctgacgctcccgatagtcgtcgttcacgtgagcctgctgcttttcgatttttggttgcatcagtgccggccgatgggctgttgctgggggaaacgcccccatctcgtctcgatttcgattgatccattctcgcgctgggttcgtcactctcatgctggcgacggatggtactttggcacgccgctgaaaaatcccgtccaaattcgacatgacgggtgtcgcgactcgtcccattggtcttcggttgtgttgcagtacaccttgtccgtcgttttgccatcgtttggccgccacttggaaggatctctcccattcttccatgttccgattttccagtggaggtgggtcgtcccccaccggatggctgttgttggtcccgaatgacccgctcaatcgggaccgcgcgattgcttcttcttcatcctcgagtgccagtcgcatcgtccttaagtctccgatgtgctcgtccgcaatttgaagcagttcagctggtgttggatggtttcgcaactgcaactctttcgttgccgccggcagtggcgctgtcagtatgtcgtagaagaagtcctggtgacctgcgggttctgctcccgctgctgccattccaatctcgaaatgtccttggaagatttgagttgcctccttgagtcctctctccatggccaaaagtcgcgctgcttggtagcctgcctccccttcggtaaggtcttggtcgatcacttctcgagcctccgcaattcgagcgacgagagtcccggatgctctctcgattctgtcccgcgctgtccgtaccggtatggatacactccgcaaattgcgtgatgggaagggtagcatcccttgctgatttgtcgccaagcctgtcgccatgttgcttcctctcgttgcttcgtttactctggcaactttttgttgctcttcgttcgttgaagcgacgggaccatccccgtcctgcacattttcgtcgtgctgtgcgccattgcgatggccctcatttgctgggtccatgttgctttcgctcccgtcctcgaattcgagtcgttgcatttttcgtttccgtctgttctgttcgtcgaccgaaatgtttcgctggaccccctgctaacggcaccagtttgtcgccaatcttttatttgcgccgcgcgcttgggggttggggtgggccaagctgaggcgggattggttcccgctcctcttcaccgctctcgtccctttcgctttctgctcactccgttcgcttgttgtaaagggaagcgcacccttttttgccgttctttttgatgggtctgatgctgctgaccgatccgatcagcgccaaagggggacgagaatgggaggggggaggggtgacaaatttggattggtgcttgagagaactgtgcagcaaatcgctgcttgcttaacggcaccaccgacaaggttggaggaagggcttgtcggacccctttgactcgacgaccacgggtttcgactcccgttccctgcggcggacactccggctggtgggagtccgcttcgatcgacgcgcgcttctccggctggtgggagttacgctgacgaacggccctgtcctttcgtcggacgatttggcaccgctcggctcttccttccttcactgccctgcttggacttgacgacgacgggagttctccccgtctcttccgctgctcctactggtgggagactgaactgctcgaatttggcgctacttcgggtcactcccgaattttttcccagtggctgatgggagggggatttgggatccgggagggttgagggaaaagacgtaggcgaatgtgatggagtgaggagggtctttttccctccttaccgtgtcccccgaaaacgaattcgagacttcgattccgacacaaaatttattaaagaagcgatcgacgaattaaaaatgcgtaaaatggtgaaaaaattgatcgaaaagtccagcaaaacgaataaaagaatggttgggggtgaaggaagcgaagagagcgaccccttgggcagggccgcttaaatagacattcgacaaaatgggcggagtgacagacggcccgataatgcgatgagaaaaaatgggacaaaaaatgggcagaaattgtgatgtgaaaagtgtgaacaaagaaatggcgcataaaaataaaatgtaaattggcagatgtgaaaagttaaagaaattgaaaagaaagaactttgtgcaaaattgttttgcacaaagcttgggccggagattagccagccgatgagaaatgaatttgtaaagaagtgaaaaatgggacaaaaaataggtgaaatgataatggctggtacgattaaatggagaggaacgtgatcaaaatcagcgatttaggaattgatgaatcgggaatccgcccgaacgtctcgtcgcctttttgctctttttcttccggtatttcttcgtctttgacggtccggcccatgtgctcgtgcttggtcccgagaaaacggactccccgtaacggtcctcctcgtctgtgtcaagttctttcccgattcgctgcccgtccgcgccctggttgaacgcgagcactcgcgcacgccgtggcgggttggcacccgccttctcgtcgccaatgagaaaattggcgacattgccgccccgcgaccgattttcttccctggcctcctcagaagacgccagggagacgccatcatcctcctcctcctcggcaatggccaatcgaccgagcggcgatccgggcattccctcccgggcacacagctgctcctccgccttctttgccgtctcctctttctctttcgccactcgctcgtcctcttctttcgctttggccaaaatctcggccattttctcttccgatgcctttttcgcctcttccgttctcctctgccatcgtttttcgtcctcttccgcttggactttggctcgacgctcttcaaaaacattctgcgcgtgccattccaattcgtcccactcggccatcggtcgccgagtggtaatcccgaccaccgccgccggagggcacttcgtcccctcctttcgtgccgctggagggctcttctccccctccctttcctgggcgtcgcttttcgcctcctcagtctcttttttccctttttcttcccttctctcacctcctccgctctttttctcttgctcttcctcctggcgatttggcaccaccaccacttgcgatcgcatgcttggctctcgacgggtgtccttcggttgttgctggtactgctccatgtccgacaggtgagctccgtgcatcatgatgtcagacatcgctgggaatttggtcgccaatgctcggcggtcatccggtgccaatcgtcgcagcgctctctcgtacgaatcgatcatttgtttctgccggtgccggagcgcgcgggcgtgtggctcccccgcgcgtcgctcggctttgtactgctccagccggttgttgttttcgctgatggcgttgccgagttcgtcggtctggcggaggcggcgctggtaacgtgaaaaaccattgttattcgattttcggcaatttggcattatttcgtcgattggctgaaaattgagggaacgatttgaaggaagaggacgaggcggtttcccgccgttggcacagtgaaaatggtggataattggggagtttggctgggaagggcaccatccctcgggaaggggcggggatttgctgatggactggcaatcattcccgccgtctcgctcccagcgttggctgctgacgggggcgccgtcgtccttctctttctgcggccatccaacttcgctctcgagagaccattcgtcggtctctgtcgccgtttcgagctgccacgggtcaaccaacgccccgtcccgtccatattcgtcctcagctgccacttcttccattcggcagaattgcaggtgctcaagagccacccaatctgcgtgttcctcgagaaatctccacgggaaatggccccggcgctgccgagcccggctccttctcgacgtcccaacagttcctcccgggacgaaaatgcaggcccaatcgggatgttggagctccctcatgcgatgttggctgaaatagcgctgaactgtccatccgggactgaccacttgttgacgagctgggagatgccccaggacgaacggcacaggcatcatttgaccgcttctctcgtgcaccatccgccacccgctctgctctcggcttctcagaaagcgctccaccgccgcgcgttcgaatgggtcttccgcccaattgtcatatcccaattctgccacctcgtctgccaccgttcggaagtcgcttctcgggtccaatggctttggctgtcccaggcctcggcgttttggcccactctgtgcagcagcgggattctcatccccgccttgctcgttctgctctgccgtgccgaatccgccgttctcaaactcactcattggggaaattggggtttgagctctgaactgatgaggagggagggtcccaattttggccaaatgttttgctttgacggatgagtcgggtttgtccccgatggcagaaatgaagaaaagtgattttgctcgcccgtggggagtaagttttggttgaaggggcgggccaaatcccccgcctttcccttcattttggcccagcgctgattggctgcacgtgcatttgtccattcgctgcgctgtgccttggcccaattgcagtaaacacaaaacgatgagaggcgttggcggggttgggacaaaaggcatcacccgccttctccgtctgatagggcatcggagaattgtgaatagggcgatggccccggcagatgtgaacagaagaaaggggtaaacatcccccgtggcccttcttttgtttgatgggcacaaatttttgtccaaatcggagttgttgatgaatggaaaggccgtcttttgttgttggccggtcgtttttggaccaacaatttttgaataaattagtgaagtaaaaaaatgtgaaaattttggcgaaaatgttggccgaagtgaggaaatggtggggtgaattgacgaaatgtccgaatttgtgatgagacgggaattaaaacccgttccgactgcttctccttttccgatcagtgccacaaatgcgagagctgccagtgatcggtagagccgaaagtgggggttgaatttgatgaagacgaaaagcgcggccaaggcgatgattcccgaggccacggcgataagcagccattgtcccgtcgagagcaatcgaagaagtggaaaggggtcaaatccccaatttggcattgtcagggtgaacgtgctgcccggctcgatgtgaccgctcgctgagtctcgctggctaaagccgaattgctgctgtttagggatgaaagcaagccccccttttaagtttaaattttgttgtccccgccgggcatttcacttggcactcagtgaaaatttccgatcgatcgaaggggatggactcagtcgtcgtagtgccattccccccgcagtgtaagccaaacattgtgccatctgcgcatttgattttggcgagcgcagtgccgtaatccgtccggcacattgcttcgaaagttgcgccggaaatgcaccggtaacatccgctgagctggggcgagccgacccagcacttcgtgttgctgtattcgctgaccagctccagctcgttgagttggatttgaacctgcactggggtgtattggaactccgcttgaactgttggccctttgttgtgaacgtgcagccgtccaacgtcgagagggaggcggtgttccgggttgttcagcacccgctcaatctcgaggttgcggcaatggcagtgaacagttccgttctcgtgattcggcgcgcatttttggcatgacccgatcgccaattggcatttgtcgaagcctcgcgctgcttcttcgtccgagcagtgcaaatccgaagaaatgggttttcccatcgccatggctcgtccgtccgagatgaagtatgccgagaggattggcattggcgggagtgaggtgggtatgaccgcgatggtcatgttcccccacttttccggcacccccgggtgaagtataagccgttgagtctcgattttgccattgtttgtctcgatttcgatccatgcgctgagctgtaggtcccattcgatgcagctgaactcctcgaaaaccgtggtcgaggtggggacagccgcccaccggtagaacaggcacgaagctgatggaagcccacaggaattgtgccagaagcttgtgctgctcatgcacattgaatggccaggccggtgattgagttcgttgagttcggggaccatcactcgactgttcattgtgctgcagttgttgtcgcggcacgacccagctgatgggcaccttttcactgccacagtcgagattgtgtatgatcggagccaactctccgttttggggacacaaaccattgtgatcgaggccaacctgagtcgaaccgtccccaagagctcgtcctgctgcgttctgatcacaaacgaattgacctgatcggctggcagtaaggtgatgattgtggcggcagttccggcacattgaagtcctttggccgttcgggcacagtcctccgatcggacagtgaccgagagcggctttgaggcgaatgtggtgccaattaggagaagaagcgggaggagccccgccgcgaccgttcctcggactgtcaattggttccgttccggttgtctccatgcgtgcgcggctgctcgggcccgtcgtgacaattgaagctgttgctgtagctctcgaactctcgtgcgcgcttttctcgctcctctcttcagcttaatctcgacttgtgctgctgttggcggcgaaatttgtcttccggtcgcccaattgaagagacgaatggggtactttgctccccatgcaattgctttgccaagagctgctgctcccgaccaaaatcgtccgagaattgggcatatgcatcccattatggcgagaaggaatgccatcccgatcccgaccatcgtcatcgtccaccgggggaagcagcgtggattagcgaattgctcccagcaaattgcgcattggatcagatcacattctgattttgcggggcaccgcctcgttgtgttgaaaggggcattgttcccccaccagcatttgccatggcaatgatagccatgtatcagctcttccgccggcaattcgtagttcacatccgtcgacttgggcatggtcgcccaacatccgtcggcgcagcaaatctcgagtttatttaattcccgcccactcataattatgacccctcgttttgcacattccatggtacatggcatttttgggccttcttgaaatggcaggttcgggtccattcccgatgatcgaattgacggctggcagccgaacgttccgacaatgctgatgagcatgatcagtagtgccattcctgttttgggcttaattacgcctcgctttcgtggaacatgacgctccggggaccaaatctcccggtttctccgagtcctggccgacttcctttgttcagctccaggtactgcttgaacttctcggacgtcttttccgtcgtgtacttcctccacgggcttgttgggagtttgttcgagttcattttggtgctgttcgaccgctggtgcttcgggaaattcgcccccgatttcgcctgcccgaactgcttgaggtccgtctgcgccaaacctatctcctccttcagatctcgtcgaattcggctgaaacttggtaggaaccttgaggagacttggggccatcgaactatctcccaaatattttttctcatgtctctgagccgaatgcaggtgtgccaaagttcccgcttttccttgtgctgccgacggcacttctgctgctttttcaaaaactgccgacttctgcggcgccatttcgccgccattttttccgtccgaatcgttggggccctcttctcgagaactgtcttcccggatttctcgatttgcccttccgtcgggctgtacggctccaacttcttgtcctcgtttttcgtcactttcttcgctttcatctccttcgtcttttgttgctgccgagggtgcatcccgatccctcatttccctccgagtctcggctgcccgtgcgtcatctcggtgtcgttcttgtactgcttgatctgcttggtcgtccatttcggccatttttgggggtgcttcttccaatgggcaaattttgttgattggccgtccccagatccttccattggccattttgatcatcacacttcggatgtgctcgttcgaccctttgatctcgacaatccgtccgatgggccataaattccttggatggaatttgtcctcgattagcacaacgtcgccgatctgcggtgtgccgtgagcattcactcgtcgcgctgggtgtgcccagcctgctttatctctcaacaccaacaaatactctcgatgccatcgtttccaaaaatgctcaagccgctgctgggagtctcgccactgacgcgccaactgaagatgagggggctccctctgaacggcttgaatttgaggctcgggcggtggttcgatcgccaatcgtgtgttttcctgaattaaatcgatcggccgaagcgggagtggatcacccgcggtgctgttgacgtaagtgaggggtcgagaattgattgtcgcctcaatctcggctaaaattgttgaaagtgcgtcgtaattgagtactgtgccggagagggtcttttgcaatgccctcttgaccaattggacggctcgttcgaacactccccctgcccatggcgtatgctgaggggtgaagcgccattggatgccttttgagtcggcgaagctgatcgggtcggcatttgtgatcccgaaatccgcgagagtcttgcccacaattgtgaatgtcggggcattgtcgctgatgatgcgggagggtgccccgcgccttgcgatgaagcggcggaggaccatgatgaagctttgagccgtcaaatcgcgagtcgcctcgatgtaaatggcacgagtcgtcaggcaggtgatcagcaacacccatgattttctccgctgtccgttctcgtccgaaattgctgtggggccaaggtaatcgagccctactgattcgaatggcagtcgtcgttgcactcgatcggctggcagcggcggcattggcggaagggaatatgctcccatttgcattcgtcggcacgttcggcactgtccgatcactttgcgcacttgttgtcgggcgctgggggaccaccaccccctcaaaaactcagccaaggttccgtccactcccgaatggtggaggcgctcgtgaatcccgtcgatgataagtgctcctgcccgtgactttctcggcagaatgatcgggctgctcagccctggctcgtcacactgtccgatacgactgatcagtctctgaatccctcggtgatccggctcggttttcacggatcccgtcattgacccctgcccttgaacggcacgaattagagcccaggtagcttctcggagttcacaggcccgcagcgatgccaaatgcttcccttcgattttgatcattcgctggtttgggtccatttccccaattcgctccgcttcgggcgtaataacttcgttcgtacccgaccgatcgggctcaaatttcgcaggcacattgtggaggccttgacctacaatccttctggactcgatttctaaatttcctttcgatcctcgagttactgccttttcagtctcgatgatcggcgggcctccaatttcgcttccccgccttttcttgatccgcttttttacgattccgatgaagcgttgcatccatgctgtggcgcgctgcactctggaccatttgctgcacctcgtaagcaacgaactcgggaattgttcactctcgaggcctgtggatgcttcatttcggacaatgaatgctgattgtccttcttcctgccccgccggagagggtagtccctcttgatcaggctgaaactccaattcgcttggccattccgttctcggcccgcgcaaccattgaggaccattccaccactgatcattgtgttgtaagagggtgggcacttcccctcgagttgccaaatccgctgggttttcgttggttcgaatgtagtgaaacgtcgttgctgtcgcttttctgatctcgaagagtcgattggccacgaattgtggttgcgctgaagccgttctgacccagtggagagcgatcattgagtcgctccaaatgtgttgccccgcgattggatggtggagttgcttttcgatgaatgctgccagccggacccccaacagaatgcccatcagctccattcttggtattgtgaacgtggtagccgctttcttcggcttgaggcgtgatttggccatgatgaggcgggagttgcacccgctttctcctcccgttcgtatgtaagctgctgctgcatatgcgatttccgatgcatccgtgaacacatgcagttgaagcgggtgacccctgcccgccgttacgcctcgaggaatcacattactttccccctcccaacttgccaaaatgtgctcccattctcgagcttcctcccgggacaaaggagtgtcccattcgtggttgtcgtcccacagcttttggaagaacagcttcgccttgagggtcgccgggcagaccaagccgagcgggtcgaacaggctggcgacgctgctcagcaccgttctgcgtgtggtgctgatcggagtgccgggttcgctcccggggtacttcattcgtattttgtccgtctccgcattccattcgagtcccaagactttggccgtcgtcttgccgaggaattcggcgtccgaaaagctgctgttgagtgtctcgtcattgctcaagaattcccgaaggttcatccgcgcgtccgcaaacattcgtttcgcttctcgtcctttaatggctgcttcttccgcagtgtccgccgggatgagcacattatccacgtatgtgtcccgaatgagttcctccgcgaagttggagtcgtatttgcgcaggtggtgtcgtacaacggcggcgagacaaaaggggcttggcgtgagtccaaatgcgaggcgtcgaaatcggtatgtcaccaaattgtccgttgtcactggccgaaatgggtcgcgcacccacaaaaatttgcacacatctctgtcgtcctcctcaatcccgaccatgagaaatgctttctcgacatcggcgatcacaggcactcggcatgctcggaaccgaatgagcataccggccaaatccggcaaccaaactgggcctctgagtaggcagtcgttgagggaaggtgcccctcgtgtgtgtgcgctcgcatcgtagacgacccgcagctttttgggcgtgatcactgcttggtgagggatgaagtgttcgcgtttaccggctccgatcgtcgtttcctcgattattgcggcattgagctgatcagtgatcactgtggtgtactgcttgagcacctcgggagtcctttgcagccgttgaagcattgtcgttagccgtcgataggccatgctgaaattgttaggtaaagcggggtggcactcccgccatggcagtcgaagggagtagcgcccgtcgttgagttggcgcactgatcgctcgaattggatcactgcttgtgcatccgcgtcgtctgtcgggtcgtctctgatcccgattgcttccaatgaccaaaattgctcaactgctctgatcggcggcatttgatcacgttcatcttctccgcatggcaaggtcatgaacacggacgaagcgggagttgccccgctgctcacttggaaccgttcgccgcacaaaattggcccaaacaccgtgtcgacaatgtacgtgccgctttccgttttccgaaagccggtcacgaaatcccagaattttcgaattccgatcagcagctgtggttgtgttgtttgtgtgactgttctcaggtcgctttcgggtactgctcccgactcgatgagctctgttctgatcggtgtgcagatcagaggcacttccgccacctcaatgctctcccatccgccatcgatccgcttgagtcgcaggcgataagttgcggatcggatccgctgctttttccccccaaaaacttgcactgtcagcggccgcctttcggtcggcttcggtcccagatgttgaattagctcagtctctgcacagtcgagatggcttcccggatcgaacagcaatgttgttaggcattcgtcatcgccctcttctgctgctgcggtcactttgcgtatcatttgttgggccgggactcggctcccgaaggcggtgaaagcccgttgttccccggcattcatctcggccacttctcgattgacctgctcttctcgtgctgcagtgaagcgggtgggttgattaatcccactgatcagcatcgcgtggttgttctcctttcgttcgggttctccgacgggccgggattggtttcccggttggttcttccagcacataagccaatgatgatcgtcgcttcggcacgtgtcacatcgaaccggtcgttggcactgttcaaatgagtgatcagagcccaggcagcgcagacatctcttctgctcaatcaatcgcttcctccgtgcctgaggcgtcgagtaggcgcggcactcactcggccgatgtccgcttttcagacaaagcgaacaattccccctcccgcagcttggaggaggcccatttggcgtgaagcggggtccattcccgcctttgtgtccgttctcgttgccgcgtgccactgttcgtccggtgatacgggcattcatcccgtactgctcttcttttcgtgttccgttgggctgcgcacgcgtttgttggttgtcccgtaccataaatgctctttgaaatggctcccgacctgctttgcctcctcgtcccgtctgatcacgctcggttcggtgatcagtgcgtacttccgggtctttcattgctgctaatgctgactcagctgatcgcatgcaccgcacttgcgctgccaccgctctcctgaactcgcgcactgaccatttcgatcccatcatgctttctctgatccgcaattccgtgagcactcgcactggcaacttggcttccagcaatggcccaaatgagtcgtcgtccacgttcgctccgagctgctcgagttggcaaacgcatcgctcaaactcgtcgatcatcgtcgtcaagctgttcacattgtcctttgccggtgccaaatgaagaagccgggcccgaattgcccgctgtaaatcgtccgtgtcgccgaatcgttctttcaaaagttgcacgaccaccgggtagttgccgtcggagggagggtagacttcgacagcccgccgggctggtgatccctcctttaagcagcgcagaagatgcaattgtttttcaaacccgggaatgggtttgtcgtccacagctcgcttgaaataggcccaaaatgtcgtccaatcctcgggctttccggaaaaagtcggcggttgcagccgaacagtctcgaatgttgtcattcccgtgatttcgtccctcccgtgcttccgatcatgttctccctcgtctcgagcatgccgtcgaatcgggtatgtctgacgctcccgatagtcgtcgttcacgtgagcctgatgcttttcgatttttggttgcatcagtgccggccgatgggctgttgctgggggaaacgcccccatctcgtctcgatttcgattgatccattctcgcgctgggttcgtcactctcatgctggcgacggatggtactttggcacgccgctgaaaaatcccgtccaaattcgacatgacgggtgtcgcgactcgtcccattggtcttcggttgtgttgcggtacaccttgtccgtcgttttgccatcgtttggccgccacttggaaggatctctcccattcttccatgttccgattttccagtggaggtgggtcgtcccccaccggatggctgttgttggtcccgaatgacccgctcaatcgagaccgcgcgattgcttcttcttcatcctcgagtgcctgtcgcatcgtccttaagtctccgatgtgctcgtccgcaatttgaagcagttcagctggtgttggatggtttcgcaactgcaactctttcgttgctgccggcagtggcgctgtcagtaagtcgtagaagaagtcctggtgacctgcgggttctgctcccgctgctgccattccaatctcgaaatgtccttggaagatttgagttgcctccttgagtcctctctccatggccaaaagtcgcgctgcttggtagcctgcctccccttcggtaaggtcttggtcgatcacttctcgagcctccgcaattcgagcggcgagagtcccggatgctctctcgattctgtcccgcgctgtccgtaccgggatggatacactccgcaaattgcgtgatgggaagggtagcatcccttgctgatttgtcgccacgcctgtcgccatgttgcttcctctcgttgcttcgtttactctggcaattttttgttgctcttcgttcgttgaagcgacgggaccatccccgtcctgcacattttcgtcgtgctgtgcgccgttgcgatggccctcattcgctgggtccatgttgctttcgctcccgtcctcgaattcgagtcgttgcatttttcgtttccgcctgttccgttcgtcgaccgagatgtttcgctggagccccctgctaacggcaccagtttgccgttagcttctcgaattcgtgctcgttggtcgctcgtagaccgattggtcgctcgtagaccgattgttggtggctgcagttgccccctgctaacggcaccagtttgccgttagcttctcgaatttgaagtctctggtctttgcctgaccgatcgatttgtcgttgcagatgcccctgctaacggcaccagtttgccgttagcttctcttcgttgtgctgttggtcctcggcgaccaaaactctcgactgatgctttgccgacgtttgcagaaagcccctgctaacggcaccagtttgtcgccaatctttttatttccgggcgggctttggccaaatgcggcttggcccagctgaggcgggattggttcccgctcctcttcaccgctctcgtccctttttcctctgctcactccgctcgctgtgccgtaaagggaatggcgccctttttgccgttcgttttgatgggtctgatgctgctgaccgatccgatcagcgccaaagggggacgagaatgggaggggggaggggtgacaaagttgactggtgctttatggaatgtgcagcgattttgctggttgcttaacgg

SEQ ID NO: 143 - DNA, 5054 bp, Heterodera glycines
  misc_feature (53)..(53): n is a, c, g, or t
  misc_feature (58)..(58): n is a, c, g, or t
aaaataattaaatttaaagtatcctatcctttattaagaaaataattaaattnaaagnatcctgtcaacttttaaaaaataattaaataattaaagtatcctgtcaactattaagaaataattaaattaataaagtatcctgtcaactattaagaaataattaaagtatactttattaatttaatttaaagtatcctgtcaactattaataatttaatttaaagtatcctgtcaactattaagaaaataattaaatttaaaagtagcctgtcaactattaaaaaataattaaagtagcctgtcaactattaaaaaataattaaatttaaagtatcctatcaactattaagaaaataattaaatttaaagtatcctatcaactattaaaaaataattaaatttaaagtatcctatcaactattaagaaaataattaaatttaatagtagcctgtcaactattaaaaaataattaaagtagcctgtcaactattaaaaaataattaaattatttaaagtatcctgtcaactattaagaaataattaaattattaaagtatcctgtcaactttaataatttaatttaaagtagcctgtcaactattaagaaataattaaatttaaagtatcctgtcaaatattaagaaaataatttaatttaaagtatcctgtcaactattaagaaaataatttaatttaaagtatcctgtcaactattaagaaaataattaaatttaaagtatcctatcaactattaagaaataattaaatttaaagtatcctgtcaactattaagaaataattaaatttaaagtatcctgtcaactttaataatttaatttaaagtagcctgtcaactattaagaaataatttaatttaaagtagcctgtcaactattaagaaataattaaatttaaagtatcctgtcaactattaagaaaataattaaatttaaagtatactgtcaactattaagaaaataatttaatttaaagtatactgtcaactattaagaaaataattaaatttaaagtatcctgtcaactattaagaaaataatttaatttaaagtagcctgtcaactataataatttaatttaaagtagcctgtcaactattaagaaataattaaatttaaagtgtcctgtcaactattaagaaaataattaaatttaaagtatcctatcaactattaaaaaataattaaagtatcctatcaactattaaaaaataattaaagtatcctatcaactattaagaaaataattaaatttaaagtaacctgtcaactattaagaaaataattaaatttaaaagtagcctgtcaactattaaaaaataattaaagtagcctgtcaactattaaaaaataattaaatttaaagtatcctatcaactattaagaaaataattaaatttaaagtatcctatcaactattaagaaaataattaaattattaaagtatcctatcaactattaagaaaataattaaatttaaaagtagcctgtcaactattaaaaaataattaaattatttaaagtatcctgtcaactattaagaaataattaaattatttaaagtatcctgtcaactattaagaaataattaaattattaaagtatcctgtcaactttaataatttaatttaaagtagcctgtcaactattaagaaataattaaatttaaagtatcctgtcaactttaataatttaatttaaagtagcctgtcaactattaagaaataatttaatttaaagtagcctgtcaactattaagaaataattaaatttaaagtatcctgtcaactattaagaaaataattaaatttaaagtatcctgtcaactattaagaaaataatttaatttaaagtagcctgtcaactataataatttaatttaaagtagcctgtcaactattaagaaataattaaatttaaagtatcctgtcaactataataatttaatttaaagtaacctatcaactattaagaaataatttaatttaaagtaacctgtcaactattaagaaataattaaatttaaagtatcctgtcaactattaaaaataatttaatttaaagtagcctgtcaactattaagaaataattaaatttaaagtatcctgtcaactattaaaaataatttaatttaaagtagcctgtcaactattaataatttaattaaaataaaattcagataaattttttataaaatctaaaaaactgtaataaaactattacacttaaatttttagtaaaaaaggtaacctttactaaaaaaaaaatattgcttttttaaaaaaaaactaaaaaaaaaaacaaaaggaaaaaaaagaaagtagtaatttttcctttttactaattttcatttaaagaaaaagaataattaatcctttacaaattaataaacccatattattaaagaaagaaaaaactaaaccccccctagaaactccaaaaaaaaaaagaaatatttaccttatggaaaaagaacaagtagaccttacaggggaaaccttctctaacatcaggggaaataagccttacctgccttttatctcataacatgattaacgtagcctcgctagaatttaatctaaaaaacttttgtaaaaaaagcatttaacaacgtcgcaagcattgtagttttaataggttctaccactatccctttttgaaccttgaaactacgttaatgtccataaaaaaaaaaatccacaaaaaaaaaaagtagtgcaaccttgcttaaaagaggaattacattgctataatttaattttttaccgttgattgataaaaactctcctcatcagaactattatttaaatagttcaagtttctaaaaaaaactgaaaatttttagaaacaataacattttcccttccgggaaaaagttttctctcgtaaaaggctgatcactaggagcttccagaaactctattctataaattaattataaaatatattccaaatctcctatatttcacttatgtgaaaggacctcgggtcttaatctacacgaagcccgtagcgtaccatggcatgccttaacggtgacttaattaaaccatttaatcagccgcacccacctccgtactctaaactaataaaaaaaaaaataaaaattaataaaaaaataaaaattaataaaaataaaataaaaaattaataaaaataaaaataaagaaaaaaaataatattcagttttttacacctttttaaacaatgctttttataggtactattttaccaactaatacaagaaattcttattagaaaataaaaccccgaataataattaacaaaagcttgaaaaccttctaaaaattctacgtcgaactttttttcaaattatttaaacaacaagaaactagggccagtcatagttaccaaacccaatccctagctacccaaacataccgagagaagtccatcagggccttgtaccatataggacgttatctaatcactactccgacttttttttaaaattaaaaaaaagatcttaccaaaaatgttcttcttaaacaaaaatacaaatttttgatctgagaaaaaatcttcatttaaaaaattaccaattttttcaaataaaaaattcaccttttttttgtaaaaaaaagattactaaaattattaaaaaaaattcttaaataccttctttttggaaaaaagaaattttaaaatttaaaataaaagaaaaaaatttacttttttttacaaaaaataaaatttaactattaaaaatttattcattaaataaaaaaaaatatataaggaaaaaaaaataaaatttaactgtaatattaaaaatttattcattaaataaaaaaaaatatataaggaaaaaaaaaaaaaatattttttttttacccctaaaaattatattaaaaaatagaaaaataagaaaaacttaaaaaaaaaaatgaaaaaagtcactttatatatagatttctggcgcagcgtttttatgtacacaaaaaaaaataaaatttcactgtaatattaaaaatttattcattaaataaaaaaaaatatataaggaaaaaaaaaaaaaatattttttttttacacctaaaaattatattaaaaaatagaaaaataagaaaaacttaaaaaaaaaaatgaaaaaagtcactttatatatagatttctggcgcagcgtttttatgtacacaaaaaaaaaaataaaatttaactgtaatattaaaaatttattcattaaataaaaaaaaatatataagggaaaaaaaaaaaaatattttttttttacacctaaaaattatattaaaaaatagaaaaataagaaaaacttaaaaaaaaaaatgaaaaaagtcactttatatatagatttctggcgcagcgtttttatgtacacaaaaaaaaaataaaaaaaaaataaaatttaactataatattaaaaatttattcattaaataaaaaaaaatatataagaaaaaaaaaaataaaatttaactgtaatattaaaaatttattcattaaataaaaaaaaatatataaggaaaaaaaaaaaaaatattttttttttacacctaaaaattatattaaaaaatagaaaaataagaaaaacctaaaaaaaaaatgaaaaaaaaataaaaaaagtaaaaaaaaaataataaaaaaaataaaactaaaaatataaaaggatacctatattttttttaaaaatagatgttataagtggtcttttaaatattatagagccgctgagaacagtttttcatcaaattaccaaattttgcgattttgggccattttctaagaaaaaataggaattttgggggcgcggcggtgccgatagtcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgcaaaaaagcgaaatgcgaaaagcgaaatgcgaaacgccaaaaaatgcgaataatgcgaaatgcgaaaagcgaaacctcggcccatccctg

SEQ ID NO: 144 - DNA, 1202 bp, Heterodera glycines
aaaaaaaaaaaaaaaaaaaaataaattttttctttaatttttaaaatttttttcctttaaaaaaaaaaaaaaattttaaaaaaaaaaaaaaaaaaatttttctttttattttaaaaatttttcctttaaaaaaaaaaaaaaaataaggaaaaaaaaaaaaaatttttttttttttccccttaaatttttttttaaaaattgaaaaattagaaaaactttaaaaaaaaaaagaaaaaaggccctttttattttgatttttggggccgggttttttagttcccaaaaaaaaaaaaaaaaattttaccgttattttaaaaattttttcctttaattaaaaaaaattttttagggaaaaaaaaaaaaatttttttttttttccccttaaaattttttttaaaaatagaaaaataagaaaaacttaaaaaaaaaaatgaaaaaagtccctttttatatagatttttggcgcagcgtttttatgttcccaaaaaaaaaataaaaaaaaaaataaaatttaactataattttaaaaattttttcctttaataaaaaaaattttttagaaaaaaaaaaataaaattttactgtaatattaaaaatttattccttaaataaaaaaaaatatataagggaaaaaaaaaaaaatattttttttttacccctaaaaattatattaaaaaatagaaaaataagaaaaacttaaaaaaaaaaatgaaaaaagtccctttatatatagatttttggcgcagcgtttttatgtacccaaaaaaaaaataaaaaaaaaataaaatttaactataatattaaaaatttattcattaaataaaaaaaaatatataagaaaaaaaaaataaaatttaactgtaatattaaaaatttattcattaaataaaaaaaaatatataaggaaaaaaaaaaaaaatattttttttttacacctaaaaattatattaaaaaatagaaaaataagaaaaacttaaaaaaaaaaatgaaaaaagtcactttatatatagatttctggcgcagcgtttttatgtacacaaaaaaaaaaaaaaaataaaatttaactataatattaaaaatttattcattaaataaaaaaaatatataagaaaaaaaaaaagaaaatttaactgtaatattaaaaatttattcattaaataaaggaaaaatatataagggaaaaaaaaaaaaatatttttttt

SEQ ID NO: 145 - DNA, 2131 bp, Heterodera glycines
ggtaaataaggtgctgagtacgaatatgatgtctattttaagtttcataatttttggaatattttaaaaattctttattttttggcaattttttggccctcgggattttggcctaatatttgaaaattcataacaaatcgaagggttgatcaattttacaggaataaagccttaaaaatagagaaaaatcaggagaattttatgggatttatttgggttttctaacatcaatatgaaaaaagttattccagaaattctggaaattttagatttttcagaaaaaaattcctaattcccttctgaaaagtgattctggaaatgtttaatactacaaaaatccgcaattttttgctctattatataaattttatttggcatggttatttgggccgctgatcacgaatacgtgatcagatttcaattatgacatcgttaagccctcagaatccccgtgtgagtggggattctgaggcatcatttgaggggggaggaggggggggggggaaagttcgaatccgggcggtgtaacattatttttctctgcatttttacgttgcttctcctattcactttttgtacctgttttttactgttgtacctcttctgatcacttttggaccgcttttaatcacttttgcacctcttctaatcacttgtacctcttctaaggcgcgaagcgcccgtctatgccaacaaaatttaaaaaacgggctcgaactgcccgtctatgccaacaaaatttaaaaaacgggctcgaagtgcccgtcaatgccaacaaaatttaaaaaacgggcgcgaagcgcccgtctgaacacaacaaaatttgaaaaacggacaagaagcgcccgtccgagctcaacaaattaaaaacgggcgcgaagcgctcgcccaatcacaaaaaatttatagacgggcgcaaagcgcccgtccaagcacagtagagtttaaaaactggcgcgaggcgcccgttcgaggaggcatcattttgggggaggcggcgaagttcatccgggcggtgtacattattttctttgcatttattcgttatttacaatgttttatttgtttaaaatatattttttttattaatataaataaattttctattttttcttgaaaatgttttaaattaaaatttttcacatttttgttcgttttgtttaaaaatatagtaacgaactgaaagtcatccatcaatgctcaaaaatgataatttaaaccatttttaaattaatattgaacatttttcttttaaaatttcttgaaaatcttttttttataaatttaactttttcatttttgttacgttgttgtaaaccccaaataggctttctgagttcaaattagactcatttacctaagtttttttacaattttagctgggtgtcgtgcaacgacatttgatggaaatttccattttttgaccgtcttcaactcggcctcaaattggcaacgatttcgcccctttttgatgttttagtggaaaaaaattttgatggcaaaagcaaatgtcgatgcggtggagcagaattcgcaaggacaaatttgaatgtggtacttttttaatattttttaaatcactaaaattccattttcaccaaaatagtcaaaatttatccatttttttattaaaaaatgtgtttggttcacattagtttcttttgataatacgaattttttaaacccataaatataaacttggtacaatttaatcaataaaaaagtcacaaattatttattttgccaaatttacgtttttttgctctatcgactttattttagcaaaaattttatttttgtgttccattattttatttggttactttcacaatttcagttggtgtgcaacgattttttgatggacattttccctctttttgaccgtcttcaactgggcctcaaattggcactgatttcgcaccatttcgatgttttagtgggcattttggtaaaattgaagtttttttttgagtttttatctatttttcgctaattgtgttttaaggagtttatatgcacaaaaaaattttcagtttaaaagatggctccgaaaatttaaaatctttccaacttcataattttttgatttacaaacatgcattattagcgaaacccagtgttcttggtattt

SEQ ID NO: 146 - DNA, 10069 bp, Heterodera glycines
tgctcagcgcatcaaataacccctaaaatatgttttttttttggatttttattctttttttttcgtgggaccaataatcttcacaattgccgacattttcccctttaccatactcaattcggcctcaatttagcactgatttcatcatttcaatttgcagatggacaaacatttcgatcgcaaaagcttagcttttttcaaattccggtaaatttttttttcgatttttttgcaaagcttattggtcttgggtttttggttgcgtaaatcttttttatttggtgactttttcgttacgctttgtaaactgtgtctacaaggacgaaaagatacaaaaataaaagtgtttttggggttcgggaccaaaggggtgagcatacgatttttgagtgaaaaagttttttcacccaaaatcttcaaaaaatatgtctttaaggccattttttaacgctgatcacggatacgtgatcagttttcactttagatatcgttaaggcctcagaatccctgtgtgattggggattctgagacatcattttgaggggggggggcggggatggggggagttcggatccgggcggtgtacattattttctatctattttttttgttattcaatgtatttattaatttgaagattttttgtaaattatttgaatttattttttttaaattaaagaatagcattatttttttctgaatttgtaaaaaaattaatttcattttaaataaaataaatattattaattttcaacgttgtttttttattaataaaaagagtattttaaattataagatttttaaattaaatgcattcgatttttaatatttaataaaaaaatttccttatttatttgattttaaacatgttgacctctttcacattgttgtacctcttctaatcacccttgtacctcttctgatcactgttgtagctcttctaaacaccgttttacctttctgatttcggttgcataagcgcattgatgctgtaagtttttacttttttcaattgatttcaaaatgttatttgccctaaaaattttgattgagcttttaatagaattttaaaattatggcaaacgcgaatttttcaaattttggcaagctgagttctttagggtttgaaaaatcaatgatcagtagggatggcgtttttgtttattgatttttccttttttaaccttttttaaaaagcgttggcaccactaaaaaagttgtttcgtgcctctttttttgagcctattctacttaattgaaaatggtttttattttactaattaataataattacattttttaataaatttaattttttttgaaaaacaagaaatttctttagacttatttgtaagcaaaagttgaacaattcatttaaaaacaaattatactaaggaatttctaaaaattattctgtttaataattaataaaatttgctcattttctctacacactctctttattgacgcatctctcatgttaagcgcacggtgtgctattgattaattcattattttttgcactcgtcttaggaaaaaaatacaattacttagagtttattttcaaaattctctttgctaagtttagcacagatatacgaataaataaattttcctatttaaaaaacaagaattgtattatttttttagaagatttattatcttagttttccatttctcaccttttttacaatattcatttaaaagcagattttttatattattattattattataacatttttaacctcaagccaaactttattttctctaaaaattttaaggctctacaatttttaatttctttttctcattagatataagacaaattctatgggtgcgctaacaaatggcattaaaattgcttctccgtccaaatcgcccagcattcaactcggctcaaattggcactgttttcgtcccgtttcaattcgctggtggacaaacatttcgatggcaaaaaagtgaattgttttttagggtttttgttgtggcatttctgtttctataaagcaattttttaatggaaattttaatgtttttgaatttttaatagaaaaattttggtactaaaaaatttgtttaacccttattgcttccctttccgctaaatattaattttcgcaatttcagtggtgtgcagcgatgtttggatgggcattttcccttaattttgaccatcttcaactcggcctcaaattgtcactgatttcgccccatttcgatgttttagtggacaaacacttcaatggcaaaagtggattcatgccgtaagttttgagtttataagcacaaaaattttctcagttccaaaaatggcctgaaaattaaaaaattttcgaaatacgtaatttttttgattttttttgttagtgtcaggttttttttaagtgtttaattgttatgtattttttgggggcttaatgaattttaagctgggccttacatttatattttcccttatattcatttcttattgttagtttggcaatttcatggcagaaaattttttttttttttttttttggaaattttgtaggtttttggttttaaatataaaaattttggttttctgtaacattcactaagattttaggccaaaaaatttttgtccaacacctattgcttcttttccgctatattattaattttcataattttagttggtttgcagcgatgtttggatggacattttccctctttttgaccgtcttcaactcggcctcaaattggcacttctttcgcatcgtttcgaacttttggtggacaaacattgcgatggcaactcgaaattcggcaagtttttgttttttgagtttttttgtaaaagtcaatagtcttttagggttttcattgtttttttatgtttgtgtgcccaaaaaccgggaccgcctatttcaaaatgactttaaagtaatttttttttgctaaaatgaccagttttttaggctttcttcttttttctgagctttttcaatttataaaattttaagtgctttttccagcaatttcgcaacgacctttggatggacatcccctttttgcccagctccgcctcacattggcactgctttcaccccgtttcgattcacaggtggacaacaattagatggcaaaacgaattccggcaagtttttagagtttttaatgttgcttaaggattttgtgcccaaaatcagggctccatttcaaaacggccaagaaaataaatttttttttagaaatttggctttttgcttttaattaaatggtttttattttttagttttttattaatgaaaatttttatttgcaaaaaatttcgagcttttggtggacaaacattgcgatggcaaaaagagtgaatagtttttagggtttttattgttttatggcttttgtgcctaaatggggcctccaattttaaaggattttgcctaaaacctctgaaaataaaaaatttcgtgtgcccgtttttaagatttttgctttttgtgttataattttataagatttttctcaactttttagtaactgtgcaacaatgtttggatggacgacatcttcccttttttgaccgtcctcaactcggccccaaattggcactgatttcgccccgtttcgatgtgatggtgcacaaattcaatttaaaacaaattgaatgccgtaagtttcaaccatttaacacttgtgtaaagaatttttttttataatatgaacaatgaaaatttctgctttatctttttttctttttaatttgttacaaaattaaacaaaattaattaattctttaaaatttgttgatttcaagggcacaataatgatttttttgaaatgaaattttcaaagtgcaaaattgaactaaaaatagacaatgccctgattttgactaacactttaccagtatatcatatatataagacaaagcagacatttttcattgctcttttaagacattcgaaaaatttttagagttcaatttattttaaattataccttgctatatatagaaatagtttttctatcccaaatctgaggatggaataggtaatactgtatagcgaggtacgctataagttctttgatagaataataagaacaattaaactgccaattgaaaatatagaaattttgcaaatttttggaatgtttagttgttctgtcctttaacacctttttgattcacatttctttgtggttcgctgactggcccttcggggcatgtgtcgcaccagtggttcgctgactggcccttctgggcatgtgtcgcaccatttgcggttcgctgactggcccttcgggcatgtgtcgcaccatttgcggttcgctgactggcccttctgggcatgtgtcgcaccattcgcggttcgctgactggcccttctgggcatatgtcgcaccatttgcggttcgctgactggcccttctgggcatgtgtcgcaccatttgctgttcgctgactggcccttcgggcatgtgtcgcaccatttgcggttcgctgactggcccttcgggcatgtgtcgcaccatttgcggttcgctgactggcccttcgggcatgtgtcgcaccatttgcggttcgctgactggcccttctgagcatgtgtcgcaccaaagcggttcgctgactggctctttagggcatatgtcgcaccattgcggttcgctgactggcccttcagggcatgcgtcgcaccatttgcgattcactgactggcccttcgggcatctgtcacatttgtggtaaacgttgcctgcccttcatgggactgtggtcaacatgtcctgcccatcacgggattgttttcaacttgtcctaccccttcttgggattgtagcacgatgaactttcctttgaacattgtgggccaccacggtttacaatgatgatttccttattgttaccggccaacatccggtgcgaagctggtcccgcactttgccatgaccagtggactggtgagaagtaacataggatattggagttaaccaaaacttatcaagttaaagcttgatgataataaggacttatcctttggaatcgtgattaaaggacctgctctttcgtgagatttgtggttcgcattgtatatcgatgagttcattgatcaataatgataactctgcactcaatgcccttagggcagatgggatatgtgagccctggctgattgattgcagcggcttcactgtggcgataaggaatatacaccatttttatttcacactatttcaatgtatttgataaatatttgatttacgtgtggcttatcggtagtaattcctaaatattttgccacatgcacacatcatctcctcatttttgttttcagatgacgaacaaacaaaaagctaagagaaagaagaatcaagagcggtaccagcggcaggcagagcaatctgtcagcccaggtagctcacccgtcccagacggaagtgcagatgagaatggggtgacatcacacccgggcatcaaaacgcccaatattggtgctttgaaattaagcaccccggcttcttccatcggaagtaaaagaaggggcagacccccaaaagccggagcggagtcaattgtgacttcgcaacacagtgtgtcatcagttggcacacaaattgtatcggccactcaaaatgaagagtcatcgcctcgcaacaaaaaggggaagatcaacgattttgatcgacccatgtctgctcttgaggcaattgcttcgacgccggtttccacacaaaggaaccgtggagggcgaccatccaaaaaaagaggcggtcatgctggctcaggcaggagcaaagctaatgattccataagcgagagctcgttaatggatcatagctctgaagctatcacaaatgtggttgttttgccaactgtgactgataaaataaacttcagcacagtgcaaatcaatttcgcaaccacgcgaaattttgcctgtaaaatttggaagtgggcagcaattggcctttacgaacgtgatggcgaaacagcgcttgccccaaggtctggtccaagattcattgaaacgtgctggaatgatctgacccagtttctcaatgacggctttgctgccacatatttggcatacttggcaagcatatcacaacgaaaagtggtcgttgttgacccaatggtatgggaaaatggcttggaccgtgtcatgcaatataaaaatatgacatttgggtatgacccaaatgttcaggcagaagtcattcttttgccagtacatttccctggacattggactctaattatccatgatgttcagtgcggtacacattttgccgattctttgcctaccccttatggcaggttggattggcaactgacggaaaaaattggaaagatcatttctgacattttgccgtcaacagtgttgaccgggatttttaatgccgtaaatcttacggtacaacacgatggtaacagctgcgggtacttcgtgtgcctatatgctgaatcatggctcatgaacaatcgcacgtttgttctgccagatttgtccatcaattatgaaaagcggcgcatattgtggcacattaacgagctgtataactctgataatgttccatatcatccaagggaaggggtacctactccgtgcccaattgtctatcgacatgcggatgaggctccatcgacatccaaggccgctgagccagttgaagttgatgatcatgatgatataatgatcatcgaaccacagacgagtggacaagcagttgatgccattccaacacaagcccaagtggcaggtgaaaaccaagctgacacgcttggattggtgtcggaaacttgcgtcccgcaagagccaattgcgcagactgacgattcaatatttgtcagaccaaagacgcctccaaggcgttcatcgcgcattgggagacggcaatcagcttcgattagccgttctccttcacccgcgccgagacgtcggtcatcgacaaatgccgctgagcaagtcacagcatttactcggcgttgctaccttgtccacaagggttggtgctgtgctgcagcagcggcaaagcattatccagaatactcagattctggtaagcttggtgacaagaagtgttctcactgtggagcattacatttcccacacgaggacagcagcatttgctgtcgtcagggaagggttgttttgccaaagctcaaccctcacccaaaagagcttgaagagctaattgtggaggaaaaacaatcccgtaaaggaaaagaatttgtacgacaaatgtcgcggtacaataatttgctccaatttgcaagtgtttcggctggccataagccaagtcctgcaggcggaccgatggcagtaattctcaacggagaattccatcgccgcattagcagcatgcaggcgggtacaacacagatacctggcttcggtcagttgtacattctggatccagttgaagccatggagcagcgacgaaaaaatcccacctttacgggagagaaaatcacaaacgaggaagagtttgtgcagggtcatcagcttaatgaagagacccttgaaattttggaacaaatgatccaagaaaatcacccggctgcatctgcttacaagcaggctcgtgagcagctacaagagttgttaagacaacaaaggactgaagagctgcggttcttcagaatgactttgttggacgagcgctctgccccgggtggtatgaaagacccgaagttgcatccccaccagatcatcaccccctcaacgggtgaagggatgttcgcgattcatgcggatcccactggtgcccctgcacctaaagggatatgggtcgaaaacaagcaagggcagttaaatgaaattgccccgttcagtgcatggactgatagcttgacctatccattaattaagcctaagggcgacgatggatataaaattcgcattccatatgccaaacctgcacaaagaaggcggaaaagcgacatgtctgctgatatgtttgccactgaagcaatgtccgatgatgacatgtgcgagactgagtcaattgcagagtcagatgccggatctgaagcatcgatacaatcagtgaccagtcgttatgacaactcgaaaaaatttgtctccctgcgagattactgcaagtattatctcgccataagggatgaaaatttggagtggcaataccaccacattctttcatgtggaggtggtcttggacagcgctgggtcctagaccaagcgtccaaaattgactggcaaattgccacttttttgcgccgtccagagatggacctgcgcgtaagtactccaaaaaatttgctgcagtacttggtaaaccaatacaataagcagcaagttcggcaaaaccccaatgctcgacaaaagactgtcgatgacattggcagcgttgttcgcctttctgaaaagaatgttaattctcttcagtattggaaaaaaatgtatgaagactgcaacaccatttttgcgcgttgccacgacgcaaaaaaggcgcggctcttcatcacattcacgaacaaccgtgagtggcccgagttcaaggagaacatttacaaaaacggtcaaatgttcactgaccgttttgacatgtggatgcgtgtatggtgcagcaaaattgctgttttccaccaggagctctatgaaaagagtttcttcggaacaatccttggctcaggcgagtcaatggagttccaagggcgtggtggcccacacgcacacattgtagcccagactgacctggacgcagtcccagaagtcatccaggaatacatatgggctcatattccacctttgccagacaaagatgatgactccccaattgcacaaatgcatcgcgaagtacgagattatatgcatatgcaactgcacagatgcagtgatagttggtgcggtccacgtgaccccaactttgggcggtgtaaaaaaggcttcccagccccgtactcgaaatgtacgattctgcacccggacaggcccgcgttgtattaccggcctagcccaaccgatggtggtgccaaaattgaggtgaacggcttaatatacgacaactcacaggtcgtgccgtacaacccatacattttgctgcgttaccgagtgcactacaatgtgttattcgcttatggtaacaaagcgaacatcaaatatgcactcaaataccctttcaaagggcctggacattgttatgtcgagtgcaaagaggagtccggcagcaaaatcggtatcgatgagccggctcaatatgccaaaatgaacttccgtggtgctacggaagcttttgcagttgtgcattcaatgcaatttgcaaaactctcacatcacgttgttcagttgtccattcatttgccaaaccagcagcccgttgtatacagggccttccaactggtgagcaaagctgaggaaattcagcgaggcgagctcccagagacgccatgctctgcctattggaagcaatggcaaaacgaatggcagcatgttccttcgctcaaggacatgctttttgaaaaagtcccagagcaatttagatgggcaaaagatcgatgggtcccatataaaaggaagcctaccaagaggcccccaatcggtcgtgttgtacctgtcgctccaaaggacattgaaagatttgcactttatgtgctgatgcgtcactttcctggtgatcccgaccacttaaaactggtcaatgggcagcagtacagcaccttccaggaggctgctttacagcatggtcttcttgaagatgaccaaatttggcacaaaacgctcggcgaggcagccttgcatcgctggccggatcagatgagatggctcttcgtgagcatcctcgtttttgggcagccaagcaattccctggaactgtggtacaagtacaaagaccaaatgtacaatccgcagggcattatcagtgcggctatacgccaagcacgggagcaggaagcgctagccgacattgattggcgattgcacttctttaactcaagctgcatgcactgtggcctcccagatccaccaaattcaaaagccaaaaatatcaatttggcaattgaagaatatttctatggtgatgatggaatgaatatgccgcctggccagccaaaacaaaggccacaaca

SEQ ID NO: 147 - DNA, 5808 bp, Heterodera glycines
  misc_feature (159)..(159): n is a, c, g, or t
ttcgcgctgatcaggggaaacattcgctatgtgtcgacaacacagtcagcccgatcgcttctcgaaatttggcgctatgggaacggctacaacaccgaacatgtttctgccgaaggaacgatgaaggagaagggactgtacatgctcaaggcatggtgnatgacacaagtcaacgatttcccgggtgatcgagaattggggatcgagaagaaaagggcggagagcgaagagaagggaagagggaaaacggaagggaaaaacgtgagaacgggagaaccagaccgacaacccagtcaccgccccattccatcgccatttcgtcacaccggccgtgcttttcatcgttcgaatcgtacgccgactcatcacccgtatgcgaatcccgtcgaccgacaccagccccagccttttcggatgccgaatcagcaaggcccgagccgccgacagttccagcgctgaggacatcgcttgtcggagggcgaggatgtcgtaattaataatgacctcattttatttttgattttatgatatttttggcattttgttttaatgtttgtgatttcgtttttgttttcttttttgttggcagactttaatttggaattgcctgacataaaataataaggctttattctgtgtgctttaattgtgtgcaagtgctgaactgttcgacgtgctgctgagtaaaattaaattatttgtacgttgcgctcctgcaaaaaggtgtggtcgacgcgatttttatacggggaattgtagaagtaggaaattctacaaagtcttcaactactgcggcgacaaaaaagtaaaaagtgaaaagaaattcaccaacgatttgtcagctcggtaaagtaattccgtctacaaagctgattcgacaaaaagggtaaagtaattcccatcgacatttcatcttctacagaacggaaattttgtgaaattcatcagttttcttctcaccgaattcgacaagtgaaattttgtggaaaagggcgaagtaatgcctaatcttcggtcgcctccgcttactcgtcaaagagcactcaacctcggcattcgtctaaataacaacgcaaaccagcagggggggcaacaaattgtagaaccacagcacctagcagaccgacgtttggaaaacgaggctcgccataattctgtctcttcagttgcttcatcacttttggacccaactgaaattcgccgacgcctgctcatgtctggaattggagaaaatgctgctggagttgagaacggaccgcgagatgagcaacaattcgacgcactgctgaaccagcatggtaacgacttgtttcaaaatgaaaatcggggagaaaattttgagagggacgtttttcaaccggtggtcagagaaccgccgttgcaattttcggaaaattttgaaaatggtccgaggcaatatgagttagttggggtacggcctgttgtgacttcgacaccccatgcggtgcaaccacaaaggcgaccaaactctgaacccttaaacccgggcttagttcgtccccaagcgatgtttctgaatagttttcaacaaaatatcgccgcaaatccaaacggcaatcaacggcaaagagccgaacagcgtttcattgatgaagacgaacgacaagcggctctggttagacaccgccaagcaaatttgacccattatgtgaacaacgaccgcgattttaacgcgtttcatcctattgctggtgctcaacacgtttggcgcgcacaaattcagcatgtttcatacccaaacaacccgcaaatcggcgaggttaaccctcaacaaattccacgacaaaatcaaggatttgtagggaatcaacaaatttttcgtcccgttgcggtacgaaatgattttcaccctgaaaattatggcgacaatttcaacttcggacatcccgaacagcaaaattttggtcagcaaagaactgaacaaattcaaatcgcaaatttggaatatgttttgactttggaccgtctgccagagctaaaaggaaatgaaggagcggataaagtgaaaatttttttcaaaaaattttcaaacgcaacggaagaatggcccgagcataaaagggttaaggcattagaaacgaaagtctcaggccgtgcagaacgtgcttttaatgcagcaataagctctggaccacatcgcttcgattcaattcgacgtgcaatgcagaatcagttggaagagacggattgccgtgagatgggagcatttgatgagctgatgagcggcgtaaagcgtcgttcgaatgaaaatttggacgcattggcggatagaatccaaagcctcgtctcccgtgcctatccgggattgacacaaaatttatgcgacgattatgccattaaacatttcgtcagagctctagcaaatcctgagctatctctaactttggaaatgtcgcggaaatcgggaatgtccttcgatgaattcgtggcactagcagctcgtgccgaatcgattcagcgggcgaccagagtgtcatccaatgaaaacaaatactcggataatcggaaccgaggcttttatttttcgaataatttttcaagaccgcaaagttctgagtttcaaggaaactcacaacaacctcgaggaaggattgtttgctacaattgcaatgagccgggtcatctttctcgggattgtaatcagcagatcaaagggcagcgagtcaacagcaacgaaaatgagcgaattcgcaatcaatttgcgacgggttcgaattctgtagcgattcgtaacaacgaagagtcgccaagaaacaatcaaagaaattttcaacccaaatcacagaattttctcaaacaaaactgcatcgttatgcaggaggaccaaccacctgatgcattttgctgtggtgtgcaactgacatcggagttttcgaattttttggagaatgagttgcatgaggaaaatcagagtgaagagtccaaagaaaaggaccatgtaggaaaaattttggtgatcagagtggagacgaacaatgttagaacggatgcaatgttggatggaggggctcaaatttctttgattggagcagaatttctctacaaattgataaaggagcacggcctggacctgagaaaatccggtttttctcgtacgaaggcacgaattgctgacgtaaacggacaacaactgaaatgttttggaatggttacaataccaatttcaagaaaaggacgcgagaaaacgccaatttgtttccatataactacggcgcaatttggctacaatttgctgtttggcacgaactcaatgacgaaattgggctttcttctatacgactcggtgaacaaagaaatgattgaatttgaggaagggcagcaaaatgatgggaattcagctcgaattattttttctacaaaaatcgaacctcgaacgaccaaattaattgaaattggagtagacaaagaatggaatggtaaagatgtgatcatcttaccttcaaacatggaaagcggtgttaaagttgagccaacagttggaaaagttgaagatggcagagtgattgcacaaatcacaaattattcgaccctttcgcaacgcataaatgaaaaaacttatattggcatgattgaaaaggtggacgagatttttgacaccgaaaattcgattttgtcagctgaaatttcatcaacaatggcttacggcaaaaacgaaagtgggaaactcggacgcgctgatcttcacatcggagaaattttggggcatcataagaccgaactgttggaacttataagccaacacaccgaaattttcgctacttctgaacaggaattaagccaaactgacttaatccgtcacaagatcgaaacgggaaaggcgcttccaattaaatcgcaaattcgcccagtcccatatgcctaccgagaaaaggtatcggcaatgattcaagactacttaagccgcggaataattcgctcatcaaattcgccatgggcttccccgattgtgatcgtgccgaaaaaagacggaacgctgagattttgtgtcgattacagaaaacttaactctgtaacagtgaaagatgcatttccactgcccaacatcgacaacacacttttagccttgggcggaaagaaagttttttcgaccttggacttcatttcgggatattggcagattaaaatggatcgtaattcgattgagaagacggctttttcgacggagtttggtcttcacgaatttttggttctccctttcggcctttgcaatgcagtggcaacatttcagcggtttatgacccgactttttgcggaatgtcttaacaaattcgtctttatctacatagacgacgtcttaatcgcatctgaatcatgggacaaacacatcgaacatctgaaagaagtttttaaacggatagaaaatgccggactgaaattgaatgtaagcaaatgccattttgcttcaaacgaacttccgtttctgggccatattctctcccgtgaaggattgaaaatggacatggcaaaagtaaaacctgtcctggatttgcccattccgtccaccaaaaaacaacttcaatctcttctcggttttctcgcatattaccgcaaattcatctacgggtttggcggaattgctgctccactttattcacttttaaaaaaagacataaatttcaagatcggcgacttagaaaagaaagcgattaatacgttaaaaagcaaaatcgtcagtgatgttatgcttcattttccaaacttcgaagcagcgaaaaatgacacaacgagaaaatttattctcttaaccgacgcaagtaaaattggtattgccgcaatactttgtcaacccaatgaaaaaggcaacattcggcctatttactttgcatcacgacaatgtaaaaactatgaaagcagatactgcccaacagaattggaggctttggctgtgcgattcggtaccaagaaattcagccaatttatcaccatgatgcccacaaaaatttttacggaccatcgagcattgataccaatgttcaaaagcaaaaaggaaacgggaaacagccgtgtggacaaatggctgatggaaatgaatgcgaaattcattttggaagttgaataccatgccggaaagaaaaatgtgatcgcagatgtactctcacgctctctcgccttaaaatgtttggattcgccaagtgaagccgaaaaagtcatcatcggacaggttcgccgatttgaaaatggtcaaagacctcaagaaatcttatcgcaccaggaatgggtgaagaaaacgaaagagagtgagctcggatttctatatgatttcctgacaacaaaagtactcccaatagaaccgaaaagtcggcaaaaactggcatcttcacttcacaattcacaattataaatgaacttctttataaatgtggaaaagacgctgaacttcgccttttcgttccgtcttcttttcgacaaaagttgataagagaacgacattcgggtgtttgttctggacatatgagcggaaagaaaatctttcttcagttggcagagaagtatttttggccgaatatgtatttcgactgtgttaaatctgcatttccatgccgaatttgtgcgcatacaagaaacccgaggtcaaatgagcctcctctgaaaattgtagctacggcagaaccgctcgaattggtctgcctcgacattttatcgattgggcccgcgcactcgtgcaaaatatattttggtggctggaaaccacttctcaaaaaatttgggtggcaaccgcccattccaataaaaagggcttaccccatcccccaaaagctcgttaagaaactttaccttaattttggg

SEQ ID NO: 148 - DNA, 7430 bp, Heterodera glycines
  misc_feature (7318)..(7318): n is a, c, g, or t
  misc_feature (7374)..(7374): n is a, c, g, or t
ggaaatttctggcttcagctagcgtctaggttggtcccaatcagataaactcggaattcaaaaccgttgaaagtacccattgagaggatggttagagtgccggacggagtcccggacataagcacgcttccgaaaggcaaaaacccgtataaaaatcagcttaatgcgcttctgtgcattgtctgtctgatttacaacgaaaaacttgaaaatgagacggattataacctgcttaaaggcaaggaccatcctcaaaatatcagcaaaaatacttctttccagggagatagaatggattctcaaaaaagtccgaaagtaaacggaaaaaatttgatgggaacggaaattaaggattttttgggaaaattcgcggaattgtggcacaattgaggacaattgtttttcaagggaccgaggaggtaatggagacggacaacatcgactttgccttgacctgggatatgcagtgcggcggactcggaccggagcatcgaaattgtgtccaattgacaaccgctgatttggacccagttttggagagggccggattcggactcaaggtggccgaaagcagactgaagccacaaaatgcaaaattcgggcttaaggtcgtcggaactccgttgaaggctttgttggccacttttctgttaaaaaccaacgccatttcttcatctgcagccggcagaaagttggcacaatcagtgattggagcaccagtcgggtttgaactgatcactttcatcggaagccgcgaaaccaaatcaaaagtggccgaattccggtggaagaagatttggaggccatcctcgagaaatggaccgaatgctgtgcagttacacggacgaaattggcaaaatgtggatttggcgccatcaatgtgccaattccgcgctcaattgaagacctcccagaaggagaaggaaaaccgtggaccgaactgctcggaaaagccggatttgtgctggagaaagtgaaggccacgtcggtgctgcgcaaacaccaattcgttacgtcgccacgcataattattggagactcaagcgcaaagcaattggaggacttgtggccgacttctcagtttattcgcgccacccaaggaagtgttggagatgtaatgcctccgccgttcatccgcgatcaacaaattgaacacgacatgctgatcgaccgaatgaaggaccatttcgcgctgatcaggggaaacattcgctatgtgtcgacaacaccgtcaggccgatcgcttctcgaaatttggcgctatgggaacggctacaacaccgaacatgtttctgccgaaggaacgatgaaggagaagggactgtacatgctcaaggcatggttgatgacacaagtcaacgatttcccgggtgatcgagaattggggatcgagaagaaaagggcggagagcgaagagaagggaagagggaaaacggaagggaaaaacgtgagaacgggagaaccggaccgaaaacccagtcaccgccccattccatcgccatttcgtcacaccggccgtgcttttcatcgttcgaatcgtacgccgactcatcacccgtatgcgaatcccgtcgaccgacaccagccccagccttttcggatgccgaatcagcaaggcccgagccgccgacagttccagcgctgaggacatcgcttgtcggagggcgaggatgtcgtaattaataatgacctaattttatttttgattttatgatatttttggcattttgttttaatgtttgtgatttcgtttttgttttctttttggtcctcagactttaatttggaattgcctgatataaaaataataagactttattctgtgtgctgaactgttcgacgtgctgctgagtaaaattgaattatttgtacggtgcactcactcagggacattgcctggtggcatcggttaccagaggtcgtcaccattaatgatgtttgtcagatgggcgtcgtgcggacgacggaatgggccgagcacatcagaccgtttttttacgatttttggaaattggaaagtatcccgccgattccgccgttcatcaacgacagagcaccattttgccgccgtgtccgggttgaaaaaagaggcgaattgctaggattttttaatcagcaattttatttttcgaatttcaacgaagcgtatgaattcgtcatccacggaagaacctaccgatgtgttgagcagtattactgtgctcagaaagcgttgtatttgaaacgtttcgacgcggcggatgcgattatgctggggacaaataaatatggcaaaagaataagcgcatttgaaatgaagaaatgcgcaaacatgaacgggtaggacgaagtgactgtccaagaatggactgagctcaaaattggcattatggaagaagcacttaaagccaagttttcggtgcccgatcttaaagatgtgctgttgagcactggatcggccataatttgcgaattatcacccgaccagttttggggggtgggctgtagaccgggactcatttatgacaaatggctaacagcagacatacaacagtggaacggttcgaacacacttggacgattgttgatgcagctcagagatgatttgaaggagccaacaccaaaaggtacaacacaggctgttcagccaaatgatggatggtcaaaaaatagggaagaaaattttcaaaatattcctgttgaggaaaacgtatttgacttaaaaagtttcaaaaatctcgaaattacgatcgcagacgaagcaaaaaaggggtccaaaaaattcaacaaatgccaactcgatcagtgaactattgatgagccacgcagacgaagtggcagaggcagaggaaacgacaaatgagaaatttgcattgtctgaaaggattaaccagtggctcaaatatgcaggcataaattgccaagtcctagtttttggttcctcattatgccaattggcacgacacggttcggacttggaccttttcatctacaaattcgaccaaacatcaattcgtcttgctgacgaattgggaaaggttcgaaaaattttaaggcaaagatatccacgaacagagatggaattgagagcgagaggaaacaccccggtattaaaaatcaaactggaattccacgttgatttgacaattggacgatccgaaaaattgaatggtgtctacaattctgtgtggctggccacgttggtccgaattaatgacctgttcaggtccgtctgcttattggttaaataatgggcaacggatattaatcaaccggaatttggttcgttcaatagcctgtccttggttattatggttcaaagttacttcgctgaacaaaagctgttgccaagcctgtttaggctttatcctgatatttacaaagaagacaaaatcgtcaaattctacgacgcagaattccatcaagaattagatgcaaaagcaaagtgtccgcaatctactccatcgttaattgaggtgttaaccgattttttcctttggttggatgatattgactttgtcagagtgaaattgtcagcaaaaagcggcaaaatggataggacagaaggcaatggattgcagtccgtgataatcgaagagccgtttgatgcaaaatcgaactgcagcagaagcttaacagataaggatttccaaaattttaagggtctgttaagacgcacgaatacgtatctcagagcaaaggactggtatacagtgaaacacctgtttaggctaaaaccgacaaatgatgtagcatggtcaatgaccgacgaatcagaagacgattcgttcgacaaaagtttttccaaaaaatcgctgaaattttttcaaaataaaaaaaaacttttcgggaagggggagggggaaactaatgtacccaaaataaatagttagttatacattgatactactaaaaaaatgccataaaacaacacatcagaaataatatttttccatttttttttgtcatttttaaaataagtgccgttaaaatgcattgagggaatttaaaattaaaaaacaaatataaataacaaaaaatataaaatatatttccttaattaaataaattaaatagtaatcattaaaattatttaaaaatatattttacctgtccccgcacaaaaatgtggcatttcttctgcactttcgtcccaccatcatttgcaccatcgtcatcatcagcaaaaggtgccgaaaaagcaatgtcaccggttggcgttggcgccgtgccatcgttgttgttgtactgctcgaaattgatggcacaacgccggccatagaccaacagaatgccatcggcgccaatttcgagccgagtgcccatcaacggttgcccaattggcaccaaattatgcgggtatttacttgaaaaaacaaaaatttgtgtttcaaattgcttataaatgaaatttagggccctaaaatcgcaaaagatccctcaaaaatattgcctaataaatgatgaaattatagtaaatccgcagtttatgaaaatatttttgttgaagaaatatgaaactcggattccgttatgatcttggtgttgtaatcttaaaaagaaaatccgaaaaagatcattaaaaattaaattttaaaatacataatttaattaatttttccgcgtatttcatttatgtaaaatgaaaattagagttggttgggaccaagaattctgctggcttggtgaataccagctcgaaaagtaaaaccatatttttctttcggtacaaaaaaaagttgagaaaatttcaagaaaaatattttttcaaatttataagcgatttcaaaatttttcctaaaatctctgaaaaaaatcaattttttctttgaaattttctttcttgttaaaaatttgaaagaaacgataatagggggagagaacgaagagctcccgagtgtattagatgttgaaattgccaatttgcacactttttgtcggcaagttcaaagcgatgaacggatgcccagcagctgacttcggtcaatccgtacacattgaacaccgccatcggacacgacttggtcatgtgatttttgaccaaattcagcgggaaattgtcgccgccgatcagcagcgtttggatgggcgaatttggaccaaaaatgtgccgtaaaatgtccgtggaaaggcattggagcaccgcgggagtcaactgtttgttgcaaaattgtgtggaggattaaatgcaaatttttaatttttcgtctaataattatggcccaaaaaaaaaaacctaaaaatctcaattttcaaaaattatttttaatgttttttttgaaaaattaattaaatttttaaaaaatttaactgttcataaaaacaaaaacataataaaattgtaaaaaaaaacattgtctcttttgtaaattttttacaaaaaattaaaaattttatttttaaattttcctggagggcgatggcggagcagttcatttcccgccgaatttttttataatttccagactaagaaattttcaaaaaaaatctttgaaatttttacaggaaattttcaagtaaaaaatttgaaaaatttttctatgatttttcaatactgtttttctaaaaaaatttccaaaaaatcgctgaaaatggtttaatttttttctttgaacttttcttataaaaattttaatatttttttgaaaaaatacacaaattatataataaaaaaacaaaaaaaagaggggaaaattggaaaaataaatcgctgtaaaaattcgttttaaaaaaatgataaaatccatgtgaacggtccgcaaaagtcgcactacgttacagggttggtatcacccaaagtcggcttccaaggacgggtatgccgatttggaaggacatagagggggaaatacatgaaatccaaggacatttaaaatttttattatatgcaatgaaaaatgattaatatttattcaaatggcttgtatttttcaccggaatggattttttccaacattttttttgttttcactgatcattttcctaattcgcgacgacttttctgctttaaaaacgctttttttgcggcgtgttttttcaaaaaattttgtgggacagaggggaggggggggggggtgtccggcggtgccgacaggcgaatttgttaacagattttcaccaaaaactgcctaatttttgtgattttaagcctaaatttgcatttttttgacataatgccataatttaatccaaatattgttgaaaattacaaaaatttatcaattttctttgattttttttaaacttttcctaatactcatttccaaggacgtccttggcatccaaggacggataccatccctggcctattataatgaaaagaacaatatatgtgggtggtagatgcactaattagcgtaaattattaatgctctaattgccttctttaattggccaaatcaaagcatccatcatttgccttgatgagcccagcggtttttttttcaatttttcaaattaatggaataaataaaccaaggatgttttgtttgatttcaagtacattaaattagggatttggcgatttcaacaaatttttggcaaataaagaattgcctgcataacataaaacagaaatatttacctgagctattttttgcattgacgcttttattctcttctgaaacttaacgaaattttttgaaattttgtagactgattgagaacattgagaacacttagggctatcgaatgattatgcggatattttccaccgtttgcgttgtaaatgtgccccgacaattttcaacgattgcctaatgttacgtgttgtctctttccatgccggtgccgacgatttcttcatcgaatttcagcccgatgacagtgccatggcatcggatggacaagcggtggcaaaatggctgttcactctccgtccggacaatgtgccaaaggtgttcaaatgccggattgacgaggatggtggcaatttggcgacgaagctattcaatcggtgcttattattaattatatgcgcgttaggactagtcagcttgggataactcagtttatggaaaatatgctttacgacaatttagaaaaattataaaaatagaaaaaacaattaaataaataaaataaaaatattttttaatttcagtaaacaatatacattaaatttaacagttgttttcgggtgctatgataacttgaacacacacacacacaactcatacaatggcttaggtttaagctttagattagtcctaggcttaggcctaggcttaagcttagcctttattttataaaaatttttattgtacgattgagttatcatcgtctttttaagctttttccaatgcttcttctcctcccgcccctttctatttcccagatncaaattttcaaaagcctcatttgacacgcaaaaaaaaaagctaattttttttaccnaatttattcaaacacgtttaaatgtttaatgtcatatttttgatttcattccattt

SEQ ID NO: 149 - DNA, 1527 bp, Heterodera glycines
  misc_feature (1523)..(1523): n is a, c, g, or t
aatattataatctattctatcccagacggggaataggcccctaacaatgaataataagcggataaagggataaccactagaccacacatcttcccaaaaatatgctttatatgccaaaatatatgtgttattttaaatgaaaacctacaattatatcttatatatgacaaaccctagagaatactataaaaaaatgcaaaatatgaaaatatggtaatttctgtataaggatcgaacacaatgtaaaaataaggaaagtctaaaagaatagccactaggctatttgcacaattgtcaacattacttttgaagaatttattaatatatttttaaaattttttccttttaactccaattttctttactaatttttcactcagacccccattcttaccagtgtttgtttttcccgtttgccctaccgggaccgggacctgagcttttcaaaatcgggaccggtaccgggacctcggatgaccgggaattcccggcccggtcccgcttcactctagtattgcgctaaaaaaccgccgcacactcgactacggctacgggctatggaagaagtccgcgcgtgatccgcagtcaaccgctgtggcgctcgtcagactttttcctccgccctccgtctcgccccactacttgctccgtcttcgcatgctcccttttatttcttttggtactgaattgtccattttcactgggacttagttgccccagtgcctggatggcatcggttcgaatttataccttgttttttagatttagctgatcaagagctttcgtatgatatcaaatttgtctgaatttgaccattttaagggtcagtggcccccccttttcactcaatttttcgagttttaaaccggttcaacaaccgattttttggcatttccgcaactggagacgtattttttcgtgcagagctcgtcgagacaaatcgattggtatatcatttttgccgttttttacggtggtttactattgtacacccttattttgctatctgtgtgacattattcctaataaggcaaattgtgctaattgccacaaaatgaaccgacggtaatgaattttttaaaagtcacttattcttgtttgcctaatttattttcattatttcagttggatttgcaacgacgtttggatggacattttcccctgttttgaccatactcaactcggcctcaaattggcattgctttcgccacgtttcaatgcgttggtggacaaacatttcgatggcaaaagcgaattgacaatttggagacgaatcgagattaacaagcgcattggaacaaaaccgaaactgtctgtacggatggatgacaaatttgtgccatttccattgcccgaccgtccgttgcccagcaaaatccgatttaaattccttatgattgagtaatttaaaatcagagatatggcaataaaagcatttattcaattttcacagttacatcgatcactccgtcatcgcttttcttcgttcaaccaccaaattttcgacaaaagaggcacccagntgcg

SEQ ID NO: 150 - DNA, 4855 bp, Heterodera glycines
atttttgcatcaaacattcgccacttggactttctctatggttatcatttggacaatttgcgtcgtcgcacttcgcccacaattctcactgatctcaaccaattgagttcaatcgattccgttcaattgttgcccgaggcaattggtgatgattttgatgggccaaatgcaactgctggccaagcattgtccaaatggttgcactctccgagaaaagatggccaacccaagcgattccgtttcaatgatattaatgaacaagtgggcgtccatttgatcaacaatttcaagcaggtggcccacattttcggcaaatcactgatttttggaattatttaggaatttatgcgtgccacttcttcagtcagttacgaaattcatttttctgttcgcgtgccgtcaatgccaatgatgccgtttgaattggtgaacgaacgaacgcaagaaaagctgctgatgctgactaaaggaaacgaaaatggctttgacgattggttaatgaagcgatgcaaaattattgggaagaccgtggcatttcagcaacagaagaaagatgaaaattggaacaatgtgttcttttggttttttagtggaaccaattgcatcgggtgagcaattaaaaaaagcatttgattttgattaaataattaaaattgcgcttaatttaggccattgtctccgccaccggcagacagaagaagaagacgaagcggaaaaaagcagcagcgaaaaagggccgtcttctgctgacaatgattgagtgacggacaaaagaacaaaaaagggctgggaatttaagtcactaaaaatcttcaaaaagtcgactaaaaaagtcataaaaaatcgcaaaaaagtcataaaaaacccaaaaaagtcacggaaaatgaaaataagtcctgaaaaattaggcaaaagttaaaatcccatttttaataatttatagaataacattttgatcatatttttaggcacttaattttataaataggtacctaaaataggcataaaaaagagattcttccaacaattgagaaaaaatttatccaggttttttattgatcgaaattttatttttcggaattttctttgtatttttcgtcattttcttcgctaaaattcaaattttgcctcaaaaagtcaaaaaaaatcacaaaaaaagtcgcaaaaactcaaaaaaatcataaaaacaaaaacaagtgtaaaaagtcacaaaaaatgcatgtaagaggcttcagacaaagtttagaacactttttaagtcattttaaggccatttagagtcaacaaaaaaaagtcatttgacttaaattcccagccctaatgatcagccacagaagaaatggattaattaagaagaatgaccgatcgatcataattcatcagtgttaaaatgtattttatgaagaaaaaaaagcctggaagaagctttccaacttattatgccgaaaaatttttgcaaactaaaagggaccccatttgtttttaataaacttatagtttttcgtagggttacacacgggctcgggtacccgaccgggtcgggtacccgcacgtccggttttttaatacccgagcccggtacccgggcccggttttttgaaaatccaatacccggtacccgacccggtaggtccgggtaccaaaaatacactggtaagaatgggagtttgattgaaaattagtgaaaaaaattgttgttaaaggtaaaaattaaaaaaataatatacatattatataaaagtgccaccaccaactgtaaaaatggcctagtggatgatcttctttcttttctgttacttttccttggttcaattcctccacgggcattaaaatatttttaattttttttttggtatactcatgggtgtcatatcgacaaaatataattcctcatatatttataactaacatatattttatcattttttaaagaaaatccgttaacaaattgagcctagtaatcccaaaaatcaacctttttttgtggacaaatctgttaacaaatcccattaaaaattacaaaaaattttccaaaaatttttttggaaaaagcgtgccgaaaaaagtgatgtgaaatacaaaaaaggtctaccgggcggtggtaccccctccaagaaaacatgagaccgctcctgacctttggaaatattttctttagtttatattttagtaaaggcattttggtaaaattattattttgaaaaaaataaaaattgaaaattttttaatacccggttttaccgggtacccgacccaggcccggtttaaaaattgataccggacccggtacccggcttttcaacacccggtaatacccggccccggtttttgcccaaatacccgggcccgtgtaaccctagtttttcgggggtgtgctgtgacgaagtgtcaaaagttttaaacaaattatttggaggcaaaaaatttacccattcaatacattgcacttttattattcattgtatttttatatattttataatttaagcatattacactattatactcggatcagttaaatttgaatttaaaaaatttctttgagataaatataaagagtgaagtgataaaaatatggagttagtcgtttttgtgggaaagttgacatagccgcaaatgtcgggacacaatgatccaacctttttctccaacaattcaaaaagtatcaaaatttgtgctgtttgagacccaaaaaaccaaagatttttatcgagtcgtcagactcgagaccgactctcgggcataattaattaaaataatacaatcagacatgacacgagcataaaatttgatcacagtattcccgcgttgcaccataggggctttattcccgtctcccagttaagttcttaaccgcggttaagataagtaaccacggttaagaaattaaaccgcgattctcgtcttcccttttttaaccatggttaacgcttaaccacggtttatttaaccgcggttaagaggccgcttaaccgcggttaacgccacttaaccacgtattctcattttttggtattctcgttttcacatacttaaccgcggtttaatgtttcccttgtaattttaaccacaagtcgtagcagggttaagcccttggttaagagaaaaattaaataatattcgaataaaaatagtctaaaaaaatttttaaaaccgtcaaaactatcaaaagaagttagtaacattattatcttttatataaccggcatttataattttttttttttttgcatcagcgtcaattaaattctttttgacttctttcaagtaaaaaacattttttacgaccgtcaacttccacacaatcgtcctaaaaattttcaaaaaatatgccccctaaaattgaaaatgtttcaaaaaattttccccgaatattaattctttctttaaaaaaatttattttattttatttttttattctttccgtgagaactttaatttgaaaacgaatttttcgtctaaaatagaaagaaaaaataattaataaaaaaatttatttaccgatttttgatacctattatatgctgtgtaattatcttatatatttggtaaattttaattaatcaaaattaattctcacgaattttagaataaaaatttattttttatatttatttatttaataaatttaatgcttaaccgtggtttatttaaccatggttagcttaacaacggttaaagacgagaatacatattttggttaaaaataaaccgcggttaaataaaccacggtagcaaaaacaataaattaatgaattttaaatgtgtctgtaattgatttaattttgcctagaattactgtatcagttcaagttttactgtactgatttatatttgtaaaattatggaaaatcacatttattggaaaatcggccaatgcattcctggcacaaaattgtttcaataaatagcacaaacaatgagcacggtaatgaaatgttgttgatgttgtggttgataagactttggctagggaaggttttttaggaaaatttaaattaaaattaattttaaaaataaaaacgatacctttttggcatcaaatgcaaaactcgagctcaagtgtttggccattttttagagtaaaaaatcacttgaaaaaggatgaagtggaaaatggagagcattattaattattttttgtttttggaaaaacaaaatttaaaatattctctaaaaaaattaaattttattttttcaactaaattaaattataaaaataatttaaaataattttactaatgaattgacaaaatgaatgaattaattaattaatgaattaatttattataaatgaaaatttattataaatgcataaattatagaaaataaatatcggataataaatatttaatttgttatttcataagagtggattattgaattctccaaaaaagcgaagttacttttgtttcgtttctctgcatttttgaacgtctcttcgatactttatttgtttggtttagcttttaatcattactgatgatcactagagcctggattttgagtagagaccggacaagagagtcggtcggtcggtttcggttaaaaaaccgaaaaaaaaaccgaaaccgaaaaaaccaccgaaaaaaaccgaaaaacttaaaaatttgtcggtctgtcggtttcggtataaaaaccgaaaaaaaccgaaccgaaaaaaaccgaagaaaaattttcggtataccgtttcggtttttttgaatttttttatcttttcccaaaaaaaacaataaaccatttttatcaatagaaaaagcgaaagatcacctctgagtaaaattgtagagctattgaagctctatcaatggtgtataagttgggaaaataattgaaaaaggcagccaaaaaacgt

SEQ ID NO: 151 - DNA, 1110 bp, Heterodera glycines
aattttcggtttatttcggttttttttgaatttgttaatttattttttccaaaaatgcaagaaaccatttatattgaccgaaaaatgctctttaatatttatattgaatttttggtagatttaaagaaattttttgcttcttctaccaaggctaaattattagggccccgacttttagtgccgaaaaatctcaaaatagttaactaaaatagtgacgaaagtgccaaaatagtgaccaaatattgaaaaaagtgcgaaatagttacaaatagtgacataattttcagccaaaaatctcttaattgtccataaatttgcttttcaaaaccgctttttttgctgcgcaattttttcaaaaactaggaataagcgggttcacgccgtagaaattctttgaaaatttaatacgatttgttaacagagtttgtagaaaattgactattttgctattttgggtcaaatttttaaaagagatattaatgatgtggaggccatccggcggtgccgataggcgccgccgggaaaatttcacaaattttgaatgaactttgcgatgaaaatgagttcattttaaataaacaaattaattaatttatccaaaaatatttggcattttgtccaaaaattctcaaaaatttcccccagcggctcctatcggcataaccggatgctaaaaatcttaaattttctttaaaaattggctcaaaattgaaaaattggtcatttttggacaaaatctgttaacaaatcgcattaaaaagtcggtcggttttttcggttttttgattatttcggtcggtcggtttcggttaaaaaaccggaaaaaaccgaaaaactcaaaaatttcttggtcggttttttcggtcaaaaaccgaaaccgaaaaccgaaaaataccgaaaaaaacgaaaaaaaccgaccgatttctaattttgaggcatatgccttttttttgttgctaacttgctatggcctaatacgcatgaaaaacgagtttttaacttggtttgaagcttctagcttcaactttttggtgcctttttttgcatttttttgttattttggtgccttttttgccttttagtacctttttcatgcctttttcagcattt

SEQ ID NO: 152 - DNA, 1372 bp, Heterodera glycines
ttttaagtgcatgaaaaatttgaaaagttcctggttaatggacatagaacaaaaatgttttccaagtcctttcgtccttttcctttaggctgaagacaactgtacactagagaccggagatatatagtcggtgggatcccgagtcggtatcccgaatttattcgctggatcccgatcccgtccatactgtattgtgtactccctagaatagaatcgaattccgtaatatttaggtgtttggtaatccattccgccggctatacacccccagatttttgaaaattcgggaaaattaaaaatcctactgttacaaaatttttgagcaaacaaagagcttggactgggcttggaaacgaggatagggccaacatagagtccaggtttttttcaaaatttcgtaattttctatttttaaaaactttattcaaaggaatttcaaaaaaaaaattaaaatattttgggacgcagttggctgggacgcagttggcctgggacgcagttggcgggacgcagttggcctgggacgcagttggcgggacgcagttggcgggacgcagttggcgggacgcagttggcccgttccggaaacaaaccccggaatttatttatccggaaagctaaagaaatttcctgaatttctgctcaaatgctctggaattccggagccaaaaaattcaccgaagtccggcctaaaaagtctcagaaatgcattccaccaccgtttgttgggtgtttgctgttgatgtgccctgctgccattgggtgcaataaagacaacagataacatttccccaagcaagaatcaaccccccccccttaatgagagctcctccctcccctcccccaccagaataaaaaaaataatttaaattgtaagttttgaaaaaaaataattatagttttaatgaaattaaattagtgcactattaacaaactaaaaataatgaaaataattacggcgtaatcagagacatttttcttttgttcttaaatttattcttacttatttaaaaatattttgtattttttgtttggggtccaaaagatcttgtgcacctttaaaattttttggcaaatttgattcatttaaattccagtagacacttatttattttcaaaaaattataaattgaaatgtgcgaagtcgacgaacaatttaaagataaataattgttaggactgctaattttatgtaagaaaatttgcgaattatgtaaataaaatatgtgcaaggagccactgacaagcataggcttagaattatattttagtatttcaaaatttaattttgagatataatgaagagaaaaaattcgatttttatgaatacattgtcaaataaataaagcatatatctaaataaattagcagc

SEQ ID NO: 153 - DNA, 1881 bp, Heterodera glycines
ttgtgtcaggccagtggtgaatggcaatcccacttcgcgcgcgagatctgtaaattttgtgctcaagtatcatgactttagtttatgatacccatgtataaactagcttggcaacacttgccccccccccacttccctgccctctccaaattccccctggaaaattttgaaaaaatttagtgatttttaaaatttttttaaaaagtagaaaaatttttctgattttcttaaaattttctgcttttattttcttttaaaaattttctgttttttagattttctaaattataaatttttttaatgtataagtaacttaccaccgatgatctgatacaaaacagtgcggtccaaaaaaataccggcagccagcagatgcccaattgctacattaagccttctggccttaattaattttttttataattgtcagcaaaagaaaataatgacccaatttaaataatatataaaaattactgatgtggcgaagctcatcatttggggattttgttaaaagaaatctaatgaatttaaattgaaaaaaataaaaatgaatggaaatgctggtttctaatgttggatttaaattcatcggccattcgatggccgatcaaattgctttcgttggttaaagaaattttcccacattccttggccgtaacggaaggacatgttgataaaatctttcagtccatttgattgcttttgttacaataattataacgtcaatgaataatggacgcaaaaaagttaatttaatttactttgttaaaaaataaaaccaaaaaaaaaaaattaaatttaacgcaattcctgcgaccaggtcacataaactctaggtcattcacatttttaaaatttcactaacggcatctgtcggcactagcgatggatgagttgtggcaccagtgcaacttcttggaccagcgttctgatcacgtgcggcatcggcaaggcaccgtaacgggcggcaacacacgcattttgccaaagatgagaaaaggccccagaagcaattggcactcaaatagacctgttgcaatcacagatcggctgaaaatggaagaaacataatccaatgatcacatcacccaaaccgcgaggctccggcctacaccaactttcgaatttactcaaaaccccactaaattggggaataaagctaagaataagcgacagatgaatagaacgagcgcttttgtcgaattcatttgaaattataagccaattttttagaagcattttctgttttaatgcgttgttctcaacgccaacacaattaaaccaatgtttttaaaatttgttaagattattacaaaaagaacaaaatcttagaggaaacattagttcataatatgttttgcgtcgagaaaacgaatcagcttcgtcttgtagctaaaaacaaatatgaccaggaaaagggtgcttttccccactgagactggctttttccaaagtcgggaccgacccttgaaaaaagcagaaatcccggcctgcttccgtgcaactgtaacccttcattttagcataaaaacagaaatgtataatgtagacacaaaattgctcacgtgaaaataaatgtactgtcccaatttcttaccgttcgctgcaattgagtgatttttgttttgtggcaaatttccaagttcatttgttgcagtcacacctccttcgccaaagtgtgaacttaatattaaatacaattatgaaatattattttctaattaattttaaataatattttgaatattgggccgaattgtgcctgagccgttctctccattgatgaattgtaaatttccgtttgcactttcctctcacttcttttgcttttgtattcgtcggcatctccaccattggataattgcggagctgagcattcct

SEQ ID NO: 154 - DNA, 6412 bp, Heterodera glycines
cggtgccgcccacactgtgccaatggtttgccgccctcgtcaccgcttggaccccgtcagcgcgttgcgtgtggtggccagctcgtcggcatcgacgacatgtgcagggagggccaagcgcggacaattggccaagaaacaccgagtggattcggacagggatttcgatgggtaaactgcggcaaccaattgaatgtgagtgtgacgaggggagtggggggtcagaacagacataaatagatatggtctttttttactggatttgcaggggtgatgaatacccattagaaataatggcaatttgttttttgttttttttttttgcaaaaaatttatccaaatattacaacaaaacggaagacaaccaactcgtttgtgtatcgatcagtttttgactcagttcgtttatttgtattggttgaacctgatgacaaacgaggtcaaaccgatgaaatttttaaagattttggtttattcaactcaggatgctttttaggcgagtgttcacagtttttaatatacgcaggctttcataatttttttgaaaaaaaattttgttgatcaaaaatgagtccaaaagaatttagaaaatttttaattttctaaactcgaaaatttgtggttttaacttaacctattcccaaaacatttaaaatgacataaaaagccttattccgagattgaacaccaaaaaatctaaaattttcatcaatttgacctcgtttgtcgtcaggtttcaacccaaaaaaaatacggaccaatacaaaaacgggttggttgaaacttccccaacaaaataaatattaaaaaacaaatcaaattctgatctcaaaccacaaaaccgccgctgtcgtcctcgaactcttcttcactttcatcactagccacgcttgcttcactcacgctcaacagttcggcatcctcgtcattgtcatttgcgttaatttcgctcctttctgggtgcccaaaaagcctaaatttttttatagattttaaattttaatttatatatcaaaatatttgtcaacactgcttttgaacgtgtgcacttcatcctgcccccccccccacatcccccaaatttcaaaaaaatgtattaaaccctaagaaatgtcaagtttttcaaaattgtcagagacacaggctgtttaatatataaaatttttcaattttttccattcgaaccttccgtttaggccgagaaaggacaaaaaattattattattttttttttttgaggcttaggtggtattttctctcaccacctacgctcaagctaaaaaagaatcattttttcagacactgcaagacgctggctgattcacggacagcatggaaataattttagcagaaggaggtcctgctgctgctgcccgatcactactccattcggataaagtggtgagcaagttgatttttttgaaaaaaatatgagtgcgtgcggatctggggacctcccttcctccctctccggttaccccacatttgcgcgcctcaaacactagcacctgtgtccaaaatcgggttcaaatttaacattctttcaatcccaggaattagccttttttgtctctatgtttttttccagtgcaatttcaaaaaaaaaacccattctccaatcccagcccattttttaaaataaaacaacataagaacatactcctgaactcctgggcgaaacatggtgcggttcatcatgagtttgacggccatctaaaaaaaaaagtcaaaacatttttgccaatgctttccacccgtgtaccgacttttgcggcccgacatttgcggttatgtccaaaatcgggttcaaaattaagttttttcaatccctgatcgactaatcagctttaaataagttattgaaaatgattgtatccgatcatttgatcgttaatgaatttttgaaaaaataataaaatcaaacaacagaattaatgttcctaataaactagaagacagttttttcttaattttaatgctgtttaagctatcaggacttgaaaaaatgcaactttgaatccaattttggacataaccgcaaaagtcggggctcctttccaccacaccccaaccgaaaatttttcaaaaaaaaaaatcataccctgagcaactgtttgcgatgttttttcagttcttttttggcctttttcagtgctgtgttgatgtagccttgtcggagcagcgcgaaattttccggcgtttggcgcattcgcgtccatttggggctcgtctcggccagctgaataaaaaaaaatttttttttgcgttcaaaatttttttgttaaaagggagggatccggcggtagcacgagagacgaggtgctcctgcccacccccgccccctccctcctcgttcgtcgtagggggccggtttaaaagaggggggagtcgccggtgaagggggggggggggaagtagaaatttaacagattttcaccaaaaatggttattttttcaatttcgaaaaaatgcatgcatttttaaggaaagtttaagcaaaaaaattctatttcagtgataaaccgtctcggctattcgcttccagtcatccctgtcagagccatcgccgacgcatttcgaaaaaaaagtaattccgccgctttgccgcctatgcacatccggagttttgccttcaattgtcttcgtgtgtagctgggcgcttcggtgtagtgcaccgcgccctcatttccctcggcatctttgacaatggtaatctgtttaattataataattaatcctcaaaaaataaatccactttttttgaaaccccaatttatggcgccaatggcatgcccgggcggggccgagaccttcgataatttttcaaaaaatcgagtttaattttgaaaaaaattttcagacagtttatagttttggtaaactctcaaaaaaaacatttcttttccttcccatttaaaaaaaagaaaccttgataaatttgtcgatgcattccatcagcttccacaagaaccaaagatgaccaagctcatgcagggtggtgcgggctttggtaagtcgccccgttctttcgcctctttccatgctttcggcaagccttttttcgtaccggcgtctccgtcgttgtgctttttgttgtccagttaaagcggccatagttagtgataatttatttaaaaataacagaattgtgcagatctgaattcgcaagccaatatggcaagacgattaagcaacaaaacacaaaaacaaatgcttaaagatgcaaaaaacacttttttgtttgtttgtttttttttgcaatttacgacttgggtagaagcgtgacatcaatactcatttttgagtgtcagaacatatcgcatcaacagttttcgaatatgccattacagtaaccttgcgtttcaaaaaaaaagtttctgatgccattacagtaacctcgcgtttcaaaaaaaaagtttcaaattcttgcgcttaaatggcagccctcaatcggctacggttcgctgagcattaaaaaaaaaacgattgataattcaaatttgcacaaatttatctatcaacttcagaacacgcagccaatttgctgcatcttttcagaatacgtccgctgttgttcatttcctgacaagcaattcggttgaactgagcagttttggagggtaatgcgttaattgtgtcaaaggcaaaattttcgactgcttttcgtttacttacaaaaaaataaaacaccgaattgcctataagcattgcttttttttttctcaattgtgtgtctacataagggccgaaacacactgatttttaacccaaattatgatagtcttccggaagagatgtactgatgaggcccctcttccgtaggatttgtctaaaaaagctaactattttttaatagatagtgccattggccaccacgtgtacggtcgcggtcgtcattttcagaactgttcgcgcttatcaccgacgagttggacgaggcatggtcatttttgctggctgaacgacccacgtgctggcactacgcgcatgcattggatcaacgaccaacaaaaccatgtagtggcagtgaacaggattctgacggttttttctttttcttggggcgggggtctcttcggaaatgattcaccataatttactgggttaacatacgttttttatacaaaaaacataaaaaatttggtaaagtctatcataaaatttattatttagtcataaaagccatgctctttttccaaacaatttgaattcatattgtatattaggttttaatcgacgaccattttttcgccggcggcaaaaacttttaccttcgttttttacgtattttttataaacatatttgccatattaaagtttatgatgtcaattatgctttcagaattccgaaaaattttgtgtaaaaatcttttgttttcatcgtcgtttttgcgtcaggttgagcatcatctgttccgtcgtctacggtggcgcccgtccaaactgttgctgtctgttgttgaccgattcgctggtggcggtggacagtgccaacggcattcatctgactaccgttgtgagcaattccggaaacattcaacagcaatgtttttttgtttttttatgaaatttaccccttacaaattagggtaggggttttttttgactactagaagccgtttggtccgtatggaaaaaatctggaaatttgattcaaatttgtttgctcattctgctcaaaaagagcacagtttagggtcaaattttatttggttaaactttttgaagctggtggagaaaattttgcaaatttaacaaattttctattgcaaaaaattgacaaattccctcttttatgcactcctttctttcaaccctttacggagaacgttacatcatgtttttgagaccgtctctgtgcgtggtcttggaggaggggggggggggggagagcaagggaggatataaaaaatttgcaaaaatttttcagcgattttttgggaaaatttttaaaaaaattaaataatttcatcataaatcatccctcctgaatgacaagttggacttcaacacaccattagaattgtcacccccatttgctatagacaaatgtggtgaccaatttcatcgctggcggcgtcggcggctcatgcgccgtcatcaccggccatccgttcgacacggtcaaagttcgactgcagacaatgccaaagccggcgcccggacagccgccactgttcgccggcgcgatggactgtgtgcgccaaaccatggcacgggagggattttttgtgaggtttttttgaaattaaaaatttggtcttctaatccgcttccgtcacaaatggacagttcaaatatgagtttttctcactaaaatcctatccaacccttaactcatcgaccgttttatctgaacaatagtcgcaatttggttgaaaaagcacacttttcaaagagttgtgaggtttaaacaactgacgggttgtgaataaattcggttttggtgggatttcctgaaaaaaaaatctcagaaaattttggagatttgttttaatctcggattaattccgccgaatttcggtcgcatttgatcgccaagtaaattcatttgctgttcattcatcagtcatcctttggttggggaaatccacttgttttcttaagtggctgaagtgaccccaatttacggcactcacattcgttcattcattcaaatgatcttctctgcctgccgatttgttccccgctcaaaaaccagcagctctcacataacgccaaacttttcgttttgtctggggccatttttgttcttttttgaattgaaattcattttgaagtgccagacttcaatatttagattctttcagccttttcggcagaattcgaaggcaatttcccaaacattaaattttcaaacttgggaactcaaaatttccagaaattctaagtaattcccgcactttccaatacaatattcaaatccggggggggggggggtaaaattacttgctattagtgagaccttcggcgtaagctttaatcccatggaacattcaaatgaatttgattgaaactcccgaaaatgccaaccgctcttaattaaatgctaaaactcgagactcccgaaatttcgtcaaaatgccggcaaattctttcccgatcaaaaagccatatagctgcttcaacatattgctaattacatatgaaccaaccacaccgttctttgtactctgatcgcactcagagtacggcggcgggggcgggcggcgcgacataaagtgcccgccacccaccgacggcaccccaaattgcttcttctccagaggcggcggcgtcatttgttatgtgcctatgccccgctaatgggcgccgctggcgcctcattaggcgctggctgctctcactaatcagtgccggtcggtcggcgctatgaaaccatttgttctcagccggcggcgctctcccaccc

SEQ ID NO: 155 - DNA, 2491 bp, Heterodera glycines
cccccccccaccaaaagcagcagaataaatgcaaattttattatattatgggtttaatttgattgtttgtgctgcttcatgtacatatgacggcgggttattcgctcgcgcaaacccgcgtaaacattttgcttttcagccactaatttgattttttcaatttttaattgtgaaggcaggcatctcgactccgaatattaaacccatgtcattttcggcatggcatcaaatgcccaatatccggaccaactaaaatttgccgagactcggcatccatattcctggagcgttaggtgctatctcctgctagtggctttttctcaaaattttcaaaaaaaaaaacacgcaaaatcctcaattctttaaaatgactcattaaattgtttcacggttttcttcttttacatgccgagcagatcatcattattttattatttatgtaaatggttcaatttgattgtttgtgctgcttcatgtgcgcataagataataatatggcggcaggccctttatttgcttggacaaacccgcgtaaacatttgcttttcagccattaatttgatttttttttatgggaacgcaaacatcccgaccttctaaatatgtggcttgaatcccggatgttttcagcatttcacaaagtgatgctcaatcccaaatcaaattacctaatttaaaaaaaaacacccaaaaatcttcaattctttctttatattttcaaaaaatgccacattgactggctccttccaaaattagaaaaaagtgtaaattctctgattctgagaaccctagcaaaacttcttgtgaacaaagccgattctttggcggcgccaaatcaccattttttatggcctaaaaattgcaccacatccctttgataatcatgcaaataatcatattaatcggttttgttctctgatcagaatttgcgcagcaactctctgcggctgttgctgatcagtgatcataatggatcagcttcaattatgatcaacagaggaactgataagcaatgatcagaattgttgtaggataattctgttgatcaattttgtccccactagttaattattttttattttaaattggttaaaataattcattaatttcctaaaaccttgttactctgatcaaaagaattatttttttgatatctaagcacatttatcagctaaattaactgatcagaaaacattatttttcgatcagaagaattcgagaaattttttcaaatttctgagttttccattatttatttttttgcaaaattaattcataaaacattttttaagaaagtgctctgaaacgcatctacctatatcccggcctggtcccggttattaaacaaataactcagggatttaaaatcgaaaatcccgggaaatcccggccctgatcccgaaaaatggccacttcctccacaggcaatgtcaaatggtacgagtaccatatgacagcgatgagttgccgagccttgacgagttgccagaaatttaagatgaacgcaaacggttcaacgacattcacgaatttaaaaaaaatcggtgcttttgatcagtttacgcccccccccccctgtcgctacgctcttgcggagatccgaatttgactaccattttcgcccatgtcgaattgcgaattcaaacagcattttggaaaagtacgaggggataattttctgggaatttcagccctcatttgagcagccctaattggtgcatttaatgtgaaaagtgaaagaaataaaaaatatttttgacggaaagaatcatcaaaattaacgagtcaaaaaaataagcatcaaaaaatggaacagcagatcaatttgtccattcaataaatatttcacttccgcacagttcgacgccgcttctttttacctctttttggtggggacaataatggcctaaagaaatgccaaaatctattttttatctcgaaattttttttcttaattcaataaaagaatggtaatactattctgttttggcctcatttcattttctttgcccgaatttgaacaaaaaggcgaaaaaaaaacaaaaaaaaaattgtgaaattattaatcgcaattttaatttttgatttttttaaggatatgctcaacatcggtgtatttttattaaaatcaaaatttctaatttggtattgatttaacgtataggaaaaagatataccgtacgaagtaaatatattagagaccgagccggaccggatccggtaccggatttttctggatccggcaatccggtccggcgattttgggaaaaatctggattgaccggattaccggattatgagagaccggatccggaatccggtcatttttgaaaacgccaatccggtccggtccggcgaatttttgaccagatccggtcaggctcgatctctagcaaaaatcgttcacttttgttcattttcctttgaaaaaaactctggcataatgtcctttaactttaaatgatcaaaatttcaatttttctcccggcgg

SEQ ID NO: 156 - DNA, 3057 bp, Heterodera glycines
  misc_feature (81)..(82): n is a, c, g, or t
  misc_feature (131)..(131): n is a, c, g, or t
caaaatctatttttatctcgaaattttttttctaattcaataaaagaatggtaatactattctgttttgggctcattcatnnttctttgcccgaatttgaacaaaaaggcgaaaaaaaaacaaaaaaaaanattgtgaaattattaatcgcaattttaatttttgatttttttaaggatatgctcaacatcggtgtatttttattaaaatcaaaatttctaaaattttaattattttaaatgtttatccaatttttgctcaccaaatgcaatttgcgccattcaaatgaatgctgacattgttcaaattgatcgaattttcgtccgtccattgtgccgtcattgtctcctcaatcttaagaaattttatcaaaaataaattttcagcaatttatttattttttttaaatttttcgcgggaagggggaacaaggagctgatccggaaaaaatgatactttttacattaactgcttttgattataatcaattttttaattactcaatccgaaggtgcttaaagcgaattctgctgggcagtgaatggacgggcccacggaaattccacaaatttgccatcaatgccaggggtgttattttacctggtaaacccggcatttgccgggtttttggggtccgtgccgggtttttgccgggtttttgaaattgccgggtttttgccgggttttggttttttgaccgggtttcctgttctatactcatttatttgaattttattaaacatttcaccaaaattaagagccaactatagctaacgttcattattagggttgtaaattatatggattaacatattttttctgcgcatatgctatgaagaaaggggcttaaaaatagcatttctgcgttaaaattttttgatttggtgaaggtttttagtccatataaatccatattttgggggttttctggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctattcattattctattttaatcgatctctagtctctagcttagcagaatgtcgcaaaaatctatttctggttttatttctaaaattacatttgaacaatcatcttcaactcaaaatttcgatgaacaaatttcaagtgctgaggaagcaatttctgatttagccgtttctgtttcgagtgatgagttttgggtgaattttagcaaatgtacttttgtatattaaattgatttgttcactgagattgctgagttgaaacagacactgaaagagctcgagggcgactggttcaataggaaaaacgtggatgaaaaatggacggctattttcaaaaatcctaattttgtcctgctcaaatcactagtctctgcaattctatcaattttcccttccaatgccgtttgtgaatctgtcttttctgttctcaagaaaatcaaaacggacgagaggaatagtattggcatacctttgttgaattctcttatttcaatcaaattcaattcaaaaatttcgtgcctaaatgttcacaattattttctttcattggcaaacttgctcaaacaggtgaaaagtggtgataaatatattgtttaaatgtttttgacgttttttacagtgaacaattgacctaaaaaaaattgccgggtttttgccgggtatttcaactggtttgccgggtttttaggttttggcgatattgaaacggggcgaaagcaatgccaatttgagaccaagttgggcgccaaaaaatgggagaatgtccatcaacacgtcgttgcacacccaactgaatgaaatgcgaggaaaaatgattgagcgcttttatcttaatttatgttcaccaattggggcggtagaagaaatgaggcggcgattgtcggcggaggaaaacttgctttttttgtgacgggcggtgccattaaaaataataataattgcccaaatgaaattttgtatgaaaaaaaatactcgagaccgagatttccaaaattcgccggaccggtaccggatccattaaagaccggtacaattcccggtcccgtacaactctatttgaatcaaatcaaatgcctccatggacggtaaaaaaatttaaaaagcgccaaaaaaacattggcgtaaaaaacataatgccaataattatacagaatttcatcatttattttagagaccgagatttccaaattctccggaccggaccggactggtattttaaaaaatgaccggatcccggatccggtctctcataatccggtcaatccgataatccggattttcatattgccggatccggaaccggattccggattggtaaaatatttaaatttcgatgttaatttagggaaaaaacccgcaaaatgtcatcaattatatgtaaaatttggtgcaccagaaaatgtcgccatagaaaagacaatgcgccgaaaaaaaaataaaatcaagaaaaatttaaaaaaaaaatttttattttaaagttttttatttttgaaaacctatgtttaattgaaaaaaaaataatgttttttgcggcgcccttattacaaaaaaaactttgggaatggggccggcgatgccga

SEQ ID NO: 157 - DNA, 5559 bp, Heterodera glycines
ggctggaccccttcgcaaaattgtccgctgaccccccctcgaccccggggacgggacgaaatctcgccgccggaatctcgccggctgaaatctcgccgagacaaaatctcgccgccgaaatctcgccagctgaaatctcgccggccgaaatcttgccgcagaaatttcaaaaaaaaaaattcaaacagaaatttttcaaggaaaaaagtttagaaaattttttttataagaaaattccaaaaaaaaactatttgctaagtttttttcctattctttttttcgccatagaaattctttgaagtggtgacgatagcactcactcactggaaatggttaaaccaatttacgaatttagccaaaaaaaaaaaaattctgttaaaaatcatccccatccaaaaaattttataatatcttacaaagttttaccaaaaacccgaaagaaaagttctaattgtaatacagaaatccgtaattacgtccagccctgatcccctcagcaatgggactgcttgtcccccccccccccctcccctccctcgttccgcctgaaatttctaaaaaaaattttcgcagcgagcatttcaaattttgtttttgattgtcagatgacaaagaaactgcgcgccatggaagtctcttgggcattgggcgccgctttccatctgctgaacacgtaccatgacaacatgaagcgcgaacggcacggcaggcggcactcgcgcgaggagttggagcagcgcaggcgggcagtcgaggagcgcgaggcggccgcagacgcgcgcattgccgagttggcgaacagcaggaacttgctgaaatcagtgggtgggccttccgagttatgacaaatttcgttgggttttaaaaaaatctacggccaaaaatatttagaaaccaactttgtaattttctggtcataaattttttaaaacccaagaaattttttgaaattttttcccatttgataaaaatgtttcaaggctttgcctgcatggctgttgccaagacaaccgttaacgaaccggtacggcctcttcaatttgctcactgatcatgacgatgatgcatggaatggctttttcgatgcctatgtgcgccaatacgttggtgtccgtcgccggccataatttcttcgacgagaacaatgtgaccgtccaatggaggccaaatggacggcggattgagggcagttccgggtccggcacagtgctgtgcgctctgtgttcgctggcgaccggccgtttgtgcagagccgacacggcgataacggcgagagttgtttcggctccttggctggagagcgttgggggtttggagctgaaggcggcggctgcgcgaaatgcgcgggtgagacgcctggtgatgtcgcggactaatcaagtgaattggcacgcattgccagctgctgcgacggtcggagtggaaccagtgtttgtggagggcgttggggaattattggaaaatgtgctcgtttgatggggattctcatttgttgttttgcttatcgggcggcccgggattggtgggttttaagcacggcattgtttttgggatgggtcgcccggccagggctgcacttaccaagttcaataataatgtgagataaagggaactgaacattttctaaacaaaaaatgtaacatactcaatcacttttttaaacacaaggaaattttaatcactaattaattctggaaacaaatctttttgtgcagccctggttattagtgcatatatatcattcacccgatttttaaaaatttaaaacaatgatttaatttagttggttacggtctgcactatgtgtcgtactgtaccagctaatagcattgtgcactttgtagtaaaaaaattaatttcataaattttggaaggtgaacaactttttaatttcgggcttaatttaggtgattaattttaagtgtaagggtgaatgaatagatatgcctaacttacgttatcatattttttgttttgtttcaatttggataaaaaacacaaaatggcaagttaaagaaagacgtcaaaaaatatatcaaaaaaaaaaaaatcgttttccaccgtttgtgccatccaatttgtgccaattcgtccgcacttaaaatttaaaatacaaaagagtatattcacaataaaaataatatgacacatattttccttggggaagggggtcgcaaggcaaggaggggtcgcaaattctggtaattttgttaataaatcattaaaaattccaaaaattttaccggcatcgcctataagcaccgcctgccctcctgtttccaaaaaaattttcccccgcccggtctcgaatgtgtggttctcgtcctcccccagagggctgccctgaacgcacttgctgaaggaatggcatcagtttgctgttcctgttttggcccatgtgatgggctagcatcgggctcgcctcgaagaatgcggcacggactcgccagtcgtttttgtcattgagcaggatgatcatgtgcatcaacacatcagtgactgtgccaacaaaatgattgatataatataagcaaattgattaaaatttggggattattctataattaaagaacacaaaaaaaaggatttttcattaaaaaaatgtgtctctcacccaactaaaatttttttaaacaatttcaaacgtagaaatttatcaaaatcttttgtttatataagaagttcttaaaaatagtattgctatttttttttttgtaaattttatgaggaaaacctatttttacaaaaaaaaaattaaatcgctcaaaaattaatttaaaaaaatcggagagggggataatatgtttttgaacaacccaccgcccggactggcgtctggacttttgggtaatccggtccccggccgacccacctcctcaacataggcctggttgattttgctctcccccaacttgtagaagctgcacagcgtgtcgtacgcccgctgcccgtgccatccgattttgtgccttcgtccgcgctgtaaatcttaaaagaaatataaaattccattttttaaaatttttattggacaaaaaaaacgctatgcaccttcgtattctggccaacagttccgctttggccactaattggtcatttcgtgccgacatggcaaatgcctgtggacgggctcgtaagacgaaactgcaagaaaattgggaccattaaaattttactttaaaaaaatttaatggaattttaaggccacgcccatcatcctcttaaaaaacttgaaaacgcagaaaaatctgaagcttaatcaaattaattcatgggaaaattttattcattatatgtaaaaacccaaaattctttatagaatggtagattaaactgttcacaattaactaataattaaattaaatttcgttattgcctaattaaaacataaattaaaatattaaaaaataaatacctaaataaaattcggaaaataattaaaaattttagaaatttttaaaaatatttttattctttcagtgtcctaaataagcagtttttttgtcctacttcctgtgccgtgccgtagtcggttcgccacagttccgcaacacactccacggtggtgtccagttttgagcgcgtttcctccaaagtcacacacaaattgtggcgatggtccccagcagcagcggcggcaccggcaccagccaatggaagaacagcagcagaagttgaagcagagcaggacgacgaaaggtgcactgtaaaatgacaaaaatttaaaaacagacaggacaaacgtttttggcacaaaaaaacaaatcaatgacccaatttttacttctcccccttcccgcccctctcgcttctttctcaatcgttgatttgacagaattttattgtttttgcatactgtagatttggaaatgtcgagctgtttctcgtcaatttaaaaatgtacaatatttaaagtgatcattgaaaagagaattaatttatatattttttttaattttatcggtgaaattgtgattttttatcgccgtttgactgatgagaatcccccggctttcaccctaattacctaaaattgaatgaaaaggggtttttttttataaagtacaatggttttttggggagaaagtgcaaagaatagggaaaataaaataagattataccaattcgtaaattaaaaaaaaattttttttttattaattatggaaaatttcccataaaaatggattaagttttaaaaataaaccctttaatctcgccgccggaatctcgccggccgaaatctcgccgagacaaaatatcgccgccgaaatctcgccggccgaaatctcgccgagacaaaatatcgccgccgaaatctcgccggccgaaatctcgccgcagaaatttcaaacttagaaatttttcaaggaaaaaattcttagaaaaatttttttataagaaaatttaaataaaaaaatgttaaaaatttttcagcaattttttttttgaaattttatgaaaatttactgtttttttttgaaaaatcttcaaaaaaacttagcaaatagtttttttttggaattttcttataaaaaaaattttctaaaattttttccttgaaaaatttctgtttgaattttttttttttgaaatttctgcggcgagatttcggccggcgagatttcagctggcgagatttcggccggcgagattccggcggcgagatttcggcggcgagatttcggccggcgagatttcagctggcgagatttcggcggcgagattttgtctcggcgagatttcagccggcgagattccggtggcgagatttcggcggcgagatttcgtcccgtccccggggtcgagggggggtcagcggacaattttgcgaaggggtccagccatgcactttgacgacctttttttttttgctttttaaaatctctttttttttgcggcgcggttttctcaaaaaattttcgcgaacgcgggagccggcggtgccgataggcgccgccgggaaaatttttttaaatttaagtggattttgtaacagattttcatcgaaaattagcagctttttgcgatttttaaccaggcgacgactttttttcttctttaaaaaacgcttgcctggcccaaatattctttttgccatcttttccaaaagcattctaaaactttgttcgttttattccattgaatttttaatttgttttccaatttttctggctctaaagtaaattcttcgtcatttttatcatcatcagcattttgcaaatttattcctaattctaatcctgggtttataaaatcgatcggacggagggctctttcgccttccggttcaattgatacatgagtgattggtcggttattcatagcccactcgacttcagttataaatgtgcgcaactcatccaaatttaataccatttttcccagtgatgctttagacgcatctttacaaacttttactaatcgttctgccaaagaattagcccatggagctagagctggtataaatctccaaatatttttgatttaaactaaatatttttctaattcaatcttttcctttttcctcctccttgcttcctatgccaccctgcaactttt

SEQ ID NO: 158 - DNA, 976 bp, Heterodera glycines
aagcaagaccgaaaacagaaattatgcataaagcatgcataaatttatcggaatgggcaaataaatggcagatcagaatctcaattaaaaaaacttttgtacttcatttggggaataaaaaccccaaagaaatatataaaattggtggaaatataataaatgtcgtggatacaattagggattcgggcataaatattgataataaattgcaattttccaatcatgtcacacaaataataaagaatgcatatttacgtatgcgctctttatttcgggttattaaatcaaaatcttctaggatttggattagtcggcacgaaatgaccaattagtggccaaagcggaactgttggccagaatacgaaggtgcatagtgttttttttgtccaataaaaattttaaaaaatggaattttatatttcttttaagatttacagcgcggacgaaggcacaaaatcggatggcacgggcagcgggcgtacgacacgctgtgcagcttctacaagttggcggagagcaaaatcaaccaggcctatgttgaggaggtgggtcggccggggaccggattacccaaaagtccagacgccagtccgggcggtgggttgttcaaaaacatattatccccctctccgatttttttaaattaatttttgagcgatttaatttttttttgtaaaaataggttttcctcataaaatttacaaaaaaaaaaaaatagcaatactatttttaagaacttcttatataaacaaaagattttgataaatttctacgtttgaaattgtttaaaaaaattttagttgggtgagagacacaattttttaatgaaaaatccttttttttgtgttctttaattatagaataatccccaaattttaatcaatttgcttatattatatcaatcattttgttggcacagtcactgatgtgttgatgcacatgatcatcctgctcaatgacaaaaacgactggcgag

SEQ ID NO: 159 - DNA, 2150 bp, Heterodera glycines
ctggttcattgcgcaaaaattgagccaaatttgttctcccctttgttccggtcatcattcccaaaataaatgcccaaaatggagagatttttgggggaattcgggtgatcaacgttgccgatcaccagtcccaactttgtcgttgccgccactccatcgccccctttgtcacccgtcagcaccaacacaatttgagagacaaattgctggtggagtttcagtcggccttcatttaacattttaaaattcgattatttttctctctctcaccactgttcaccaaatcctgaagacggccctcgatcattgcacgaacgtcgacggaaacgagcgcacgcgtctcaccattgcccgtccaatggaaattgaccgcctcgcacagttccgccttcagacgcttcactgctctcgtcggtgcccaaacatcatgtccttggccggcgaaagaccgcttcaacgcttcacgggccttgaacgagatgcctgcgtccaatgtgatgagcagatcattcgccgcgctcagcctgttgtcctcgtgttggttattcgtcacgtcagaaagggctttgcgctgacgacatgacgaagccgaacgctcgaggcttgtcgaccggtcgcgctgggccttgagctgtttccgtagaaaggcattcgaccggcgctgtcgctgcagttcctcctcggtccaaacgtggcgccgtcgcagctcgtcaaacatgtggacttaaaaataataaaaatgaaatgaattaaaaaaactaaaattttgtttgaatttctctcaccatcatcgagaccaaaggcaccggcgcactttgaagtcgatggtgtcgccatgtggtcacagcgtgccgtggatgttgacggcattggttgaatttgttggtcttcatcggcaggcgttgaagggatttgcacatcggtgtccaccatctccacagacggcacgtccatttccagcggtgccatcggtgttggagttgatggtggtcgtccgtcgttgtcccgcgccggtgcctctgatgtcgacggctcttcttcggatggttgtggtgtttctgcatcggtgttcggctggggagcggctaaaaattggaaaatttgggaatttatgaaaaataaatggaaaaactcacttctcttggccaaataggcttgtctcgccttggccgtctgcgcttttctctcctctcgcctttttctcagttgttcagcacctcttttgccttgaagcttaagcaatgatttttttttagccataaatctttaaaaaattaagaattttcataaaaactgacaattaaaaattttctgggccgaaatttttactcaaaacactgaaagtttgttcataatttttttctctatcgatatgcaaaatttggtgtggatttaacaagtaggaaaaaagttaaacaggatgaagtgaatgttgatttttacataattaaaatgaagagatagtacgccaaagtgagagaaattacaaagaaaaagagaaacgacgagatagtactaggcttttctctgcacagtggggcgtacccatagtgccatagtggggaggtagggcataacgccaatacatttattcaaagcattagtcagtgcctttttgtgagttctccttttttatgttggcaattggtatacttttgtaagatcacttctagagattggaaatttcaaacctatcggtcccgctgcgtgattggaactcgttattttttttcgggacggcgacccgcgggattaatcccacaaatccctcattttccaaaaaatgttggattgcggactgggatcccgcgcggaatcacgtcccgcaccggtctctagtcgattccatggttacaataattcgcgtatccttaattaaggggtggtggcgtttaacccccgccgggagcatgacaggcacttttctcgcctgagaccagccagttaatttcaacaaatatgatacgaattgttttgtccttgctagagatcggaattttgaaagtactgggaccgggaccaggcggcccggttaaaagcccgggcccatgggcctctccggtctctagtccttacaatttttcgtcacgatatgcccgcattgatcaaaatcacgggtcattcttaagttgtgcatccgaagttcgcct

SEQ ID NO: 160 - DNA, 2457 bp, Heterodera glycines
  misc_feature (23)..(24): n is a, c, g, or t
  misc_feature (42)..(42): n is a, c, g, or t
  misc_feature (59)..(59): n is a, c, g, or t
  misc_feature (2442)..(2442): n is a, c, g, or t
ttaattaccagtttgtattgttnntacgaagttcggtgcacnattcaatcagcacacanccattgtccctcttgctgctgctgttgttctgatgagtcatttgtcggccctcccgcattatttcttcgtgccaccgacgcaaaagtgagtgttttaatgactcattcattcattcagtcatcgttttcaaaccagcgacatttttggtcaaaatatatttttggatttttgccaaacgccgggggaaattccctcaaaatgaaagataaacattgatgaagaacacataattaagctgtttcaaaaaggttatttagaaggaaatttaattaataagaaaatgaaaacgaaaaataatttggccattttttaatttcattttataaattcaattttcaattttaaaatatgttctacatattattattatcgtcttatgctgattaccattcccccattcactaaattccttttatgggttggctttttctaaatttttttgtgctttttcgagactctcgactttttatttttatcccatttctcaccttttaatgaccttcatcttcttcaccgtttcacacattctctgctcaaattttaggcgtccttcccccccccctttttttcccctattcaaattctcccactttttcaccacttttttgtccaccacactgagagaataaatttatgcggggctataaaaacattttttactatcaaaaattatttttgtcagaaaaaagcgaaaaagaatccattcggatcaattgaaataatacgaaatgaaatgctggtcagagtcagctaaaatcatatccatccacccgttttagagatattatttttaaaatacccattttttcttaacttaattctaatgtttggggtgtttttttaattttgcattatttttggccatttttattttacaaattgccattattttccatttgctgacaaattattgccagatgtaccccttttttccgtttttgtcccccccccccccccaggggaggggaacaaaacaaacaaaagatgtgccgattctgtcacccgcaaatttcatccccgtttttgcatataaaacaacacaattaattcccatttgtgccagtcgagactctcggcattgaatgcatcgtccgatttgtcgggcgtcgtgaaaaaacgaaaatttccatttctttccgagaatggaattggtggttatgatcgatgcccctttttcacgaggatttatttccccattcttgtagtaaaaccctaaaatttggcattgtaatttcctcgtgactgtgaaattttagtgataaaaatttctcgactctgtgccaagagtctcgagcggaagtgccagcctaattaatccatctcaaattacccctttatcttttattagttattttctctcattttctaccacccaaatcaaatttggagcatctccgcctccatcattcaaccggtgattttctgatttgattggttaatgtgtagggggaaagctttgcggcgggatttgctccgttttatcccccgaagggattccctccccccgtccgatccgccgtttcctttgtccgccctgtcatcgtcgagattcaatctcgagaagaacacatttatttatgtgtgtgctgtgtgctgtgtgcacaacagtagcagcagggagtgctacttacaaatcaatccctcccgcccaattcgaaggtcggtcaccactttgcccagaggctttttgacttcaatcataattatattgtcaattgtttgaaacgcatctgttgcagttggaagaggccgatggaaaatttttcggcttttcgcgaaaaagttttcccagaaaatggcgtgggacaaataaaaattgtacttttattatgagcaatatatatttcctatcaatttcaggtttgctttagacgtttgccaatgaaaaaatggagttttgtgaatgcaaattttaatggattttctttcgacgtgtcataagcgggttgtttcgggacaaatgcaaaccaatttgatgctattcgaatgagctaggcgcgctctaccctttcaaatgtatcaacaaagggtctaccgccactccctggcgagatatggccagtcaaagcagagtgggtctaataaaacaagaatttttaaaattttcggcatttgcccttatttcgagcctgctctacgtgtgcttcttttgccaatatggccctgctatagaaatcttgtaatggttcacgactaagtgatgaaatatttttagcccatttcttttctatccaagcatgcgaattgtttattgcattttatagccttctggaaaaagatagtcagtaaaaataaagcttgttttaggaatatttgagtatatttacaacaacaatttttgggcaatttctaaagaggaaggaaaataatttttttatcaantattttatattaagt

SEQ ID NO: 161 - DNA, 6561 bp, Heterodera glycines
  misc_feature (58)..(58): n is a, c, g, or t
gctgatggagacgccggaggcgacgactacgacgaccaaatggacgacgacatccacnggtggcagcggcagcggaggcgtacagtggcaacggcgcgtgccggcgggcggcgattttgcgcgcgaattgcgtgacgccggtgggacgggggcatcagtttataatagcatgaaattatttaaatcatgagaatgcggagcattctaaaagctaataatgaaaggacaaattaggcctcggataggaatcgaacccacgcctccacccgattcgcgtgggttgctctaccactgagctaccgaggcgtattcgaattttttaaatttaaattttattcgcttaaattgccatttgctttttcattcttttgagatagaaatgtttttaatggagctttaagtcatttatttgaatttggccaattaaagagaggtaatggcacaaaaaaactcgaaaaattggtcagaagggattaaaataaaaatttaaataaaaatttgtttagctctgaccgagcgccaaagggcggccaatttgcagcaaaaatcggcgctaaaacagccctttggctgccaattgcccagctcactgcacaattacgcttatcatcaggtgcagttatggaaattcctaatttaatttttttttcttattttttgctttaatttggccaatttctgtgccaaatttggccccttcgtcctttttttttttgttggccgtcggaaagtcccctcggggaaataagttccttccgccggcatttgccgtccaattaaaaaggcaaaataataaaaccaattaacacagaaacgaagaaaatattccccattttaggacactttaattggcctcattttttaaattttcttggcattttctttgttttggccctattatttatggccgagtaaacttctctttttcttttccatcgaatatttataattaataaatattaaaattgcatttttataacaattttagacggtcacttcatcgtctttgagcagtgcagcaacaaaaaatggcggtggcaccgccaacaaaaacaacggtggccaagcagtggacgaactgatccgggacatggagtttaaaatgcgcagtgccaacgcgtcaaacaaaggtggctcataagtcttttttggcatttgaaatggaatctgtccgagatcgagactctcgagcagtgacaagtgtgtctgaccccaacaatttcgctgccgccccccccccctcccccgtccaattccattgcttctcccgctacttaaaaatttggccccccgcggagtcactcactcaattcacggcatagcgcccgccgggtacaacaacaacaaaaaagaagcagcacaaaggaatttccgccttttccacatgctcttcttggccccttcgtcccctggggcgtttttggcttttccccatgcccccccccgttttttacgctttcaatttcctctcatgggcgccgtgccgtgccaatgcgccgttttaccgccctaaaagggcaaaaaattcttttccttttgtcagtttatgtacttttttcttctctccacaaaagtgtagtgccaatgtttgtgcttaagtgttatgtcgaaatttgctcagtgatctttggtcaacgacaaatttgtatttatttaacgtgcgaaattgctactttaaatgcccataaataaattcaaatttaaattcttaaagtggattaattgttaattgcttctcgtgtggcgaaagaccaaacttttaaatggccaaaaattctttaaaaaatcccataaaatacgttttttgaaacattttcatcacttttttatttgaaaattatggaactataaaaaccataaaatgcacattatttcaaatacctatttctgctttaacccccccccccctcaaattcgcaattcttcccattttttcgcgtccatgtttcatcaaaatctgtgcccgctctgtgcaaatataaaaaaaaccattcattcatttggccattccattcaacacatccacctcccattcattcatttccttactctttcttcttcaccccgtgggttttgaagtgtaaaaagtgtgtcgaattgaatgggccgggcaaaaaaacgggggttggcgatgcttttaagccttttgaacttttggcacattgaattgaatcaaaaattcaacaaattttactttgcccacccccctaatgcttcattttctcccatttaaactttttgtttagttttgccattctttgcctttgttaccccccgtttttgtcctctttccgcccctttttcccccttttttcggcattaattttgcctccccaaatgagggggttttgtcgagactgactttcaatggacaatttgtcttcttgtgtgttttgtgttgttgtcgagagtgaaagggccggacgcaaaagaaagcgccaaaaactttggcgccgctgcccccccccttttggtgtacatttttttcccggcggacggtgaaagccttttcgaaaacattcatccgccatgaattggatgaggaatgcgagtagtgaatgaatatgtgtcttccgtccgtccgtcgtcaattgttcgttcggcttctcgtcgtcgtttgtccatggagcacagctgcccggaggaagcggggaatgaatgcttcacgtccccccggggtggcggggcggggggagggggccggagagcggggaatgggagaggccagctgatgaaccatcgggcggggggagcaagggggagatgaagcatgcgaggaaaagctggggacaggggagcaaaagatgaagcatgggaggggggggggtgagtgagggatgaagcatggaggaggagggagaggccagctgatgaaccagtggggatgaggaggggaagatgaagaattggggggcgggaacggagagcattaccaccatcaccaccgtccgcttctcctcctcctcctttaatcatcatcatttgccggagcccgggctgaatcaagcggcggtgcttggaagagcacaaaacaaactttccctcccgccgcctatccccggagggaatgggcggcgggggggggaacatttgctaatgcacctccatccacagtcgtattcattttgtcactttttctccatccaaatctttttggaaaattttttcctatcccattttttcaacaaattcatcattgaacacaacgccaattcgttgtttttttttcttgacactgtcgcggtcatttgattccctcctctcagcttagcccccggcaaatgattaaaactcgcaaaaaatcaccggaaatcgaccttatgccattgctggacacccccaaaaccaaagcccgccgaagtggcacaatgttgaacagttgccccccccctttggtcggcactttgcttaacccccccccccaattcctcctccggcgcttttcacacggacccaaaaaatcgacgtaaataaaagtacgccccctcctcactttcaacgcttgttttcaccatctatcaatccaatcattaattttctcagctgctaattgcctgatcagtgcttcgcccttatgggcggctgatcaaacattgggacagcgaaaaatatatattaagatagggcaatttataagaccacacattccattagagaataataataataataatttaaaagcttattatctgcagcgaaattaataattagtcattaattaccacccaaataattaattaattgtttgccctctgtccgcccctaaaattgttgaatttgatccggcaaaacgcgtgtgaatggcggaagttggtgcgtattttaatagtcgaaacttgaaatttacagtaacaacttacagtaactaattctcaattttcaactcacattaacattcttggcattatttaatttaattgcaaattaaaatttaaaaaaaaacaaaataaaaaataattaattgaattttgaattcttaaaagcattggaaattaggaattttaattataattgtttaaattaattattaattaaaatttcaatttgctttcagatacgtgcacaaagtgccaccagcaaatcgggggcgaccccccgggggtcaccgcgctcggcaacccctaccacgtcacctgtttctgctgcgatgtgtgccaaaaacagttggccggtagttgaataattggccatgaaaaggcagtggggagagcgtcacattaaaaatattttatttttaatttttgaaaatatttttaaagaaaaaaaacatgacgcgactctattgctgataaaaaataatgaataattgtttgaatttgtggaaaatggcaagaaatagtgaacatttttaaataaacaaaatacaaaaaattttcatttattaaatttttactttttatatttttgccgctctaagcaaacactcgaaaatgaccttagggggtataaaatatttatttaaatattttctgtatgcttcttccgcttaggttgttccttttacgcggtggacgggaagaatttgtgccaagttgactacatgaactcgttggaaaagtgcgacaagtgcaaaatgccgatcactcagtgcgttcaaattggctgaaaattttatgggattcgaaaaagagtgggagagtcgcaatacgagagccaaaaatgccttgaaatctctcgaaatcgaaaaccgagactctcgaaaaaccctcttctacataccgctgaaatggtcatattttagccggcattcaactccctgttatcgttttttgcattttttgagctttgatcccacatgatatccatccatttgattaatctccctaagttggcattatgtattattatattttttatttaattttatgccaaattcccaggaaaattctccgtgccctcagccgcgcctttcaccccgagtgttttgcctgtccgatctgtcaaaaatcgttggacggcattccatttacagtacgtaccttttgttgtctgctggttactgtattattactttttactcaggtggacaaggagaaccaagcctactgtttggaatgctatcacgagtaattaatatcaattaattttatttgtattgggacatatcaatcaattttaaatgggtttgatcattcgctataaaatggtcgatcactctccgcggggttctaaatctcgaggacggtggttgggcattttggacctattaaattataaattaaaaaaaaatttttatggaatcaggcgggaaaataaacgtatatttccttaaaataattcccctccaattctttggcgaacaaaaaacaaaacaaaattggtaaataattcataattcattttttaaatttaatttattaaaccatcgcccaggcgcttctctccccggtgtgccgcctgtctgaaagtgatcgcaccaaatggcaatgagacggaggtggcgcgggtgatcgccatggtcagttagcgtgaaattaaaaaaataaaataaatttcaaaaatgcgcctggggcataaatttttataggacaaaagctaccatttggactgttacaagtgcgaagactgcggtctgaagctgaattccaaaattgagggccaaggtgaagttgcttttttaataggaaattgagttaaaaaaaggccttacaccaagtgatcagatcactactaactttcataatgatcggaattggcaaattgggggtaatttggaaaacaaaatgcccttttatataagaaaagactcggaaaagataaatccgtaagataaacaatattttctttgaattgccatttttataataaaatttcgatgaattgtcaccaataatttataaaacctcaattgatgaatcgaccattttactccttccccctgtccccataaaaaccggacgaagttcaaaattaaggcttatccaccccatttttttgctaattttttaaataaatttcaaatttatttttaaggctgctacccgttggagtcgcatttgttctgcaaaaactgcaatttgaagcgactgaagtccctcaagtgattgatcattcgttcattgactgtctctcccccatttttatttgtttttatcctcacaaggattgattggccagaagattgatttgagttgcatttaaatttaattgcttaattggccaataatcccttttcccgcccctaatttccgtgccctccgccacctcagaatctgtgtatgaaaatgtgaacaaaatgccctcccccctccacaaattcacaaattgtttctgttccttgccgggccaataatataataataatataataataataccctttttagtaatttctccgccaattaaacaaaattttaaaacgcctattttctagtcccaatttgtaattgtcccccataatcattgctgctgctgtctgaaaattatttgataaaataaattaataaagaaataaatttttggaaattaatatatttaggtaataagaatttcgatagcccttcacatgctctattagccttacaaaaagcaaaaaggttttcaagcatgtaaaaaagttac

SEQ ID NO: 162 - DNA, 3471 bp, Heterodera glycines
atcgaaaagcgcactccgtcgatggtcggggtaagaagaggagaacactgttttgtttttggggcatgccttttcagctatgatttttggttgtttttttgtcgaattcgtttggacaaaaaaatgaattttttttaaactattgtaattaaaattttcccacatttttacaaactctttacagtatgccgcaaaaatagaagagaagaacaatttagaatttgttggtgactacaaatagcaagtaaatttttaccatattttcaattgaatctgattttttcttgaaattatttactaaatttcttttataaatttatgacatttaatatttgccaaattatttaagtgatttttaggaagcgccacgtgacgaaaaattgcacttcattgaccaaaccgtgtgccattgcccgcttggcaaatttgaattaaatgtagtttaaataatgtttaataataaaaaatatgtacataatttaaattattttaaaatatttatttcaagctcgtcagtggtcatctaccgcatcgcttgcggcgaaggactttaccaagtaattattgttggagcagctcttttcctcgcccagttagattggaatttaaaaaacgaaatttaatttttcgaaatttttaaaatatttttcccataaccaaaaagaaaagcttttcgaaaagccccaaacaaatggtttattttcagcatcttttggcctacgaagtgccgctggtcaagcatttgttggcgcaccgttggcaaagccaagctgacactgactgtcgtcaacaaattgcggaacatccgatccacaccatccaacatcaatcagctaatgcgataaagccacgggtaatggaaaaattatatggaaatcatggatttaaaattacattcaaatttcaatgaaaaaaaatgttggtccctcagaccgaaatacccgactggcacactcatcgacaagggcgtggtcagccccaaatgttctgagtcctttttggcctcgcagcgtgcgttgcaggtgtcttcctctgttttttgaacttttaaatcaaaatttgaaattgtttttccccagggaactgctcgagtgccacggcacgccattttgatggacgacaacggatatccaacggacaaaacccaacaatcacatccgtatgtccaagcagacgaatataaattgtttaaaaatgtttgactatttcttaaaggccctctgttttgaacaccaaattgtctctccgcccatttcccctccctgcgccggcaggattttcccattatgtttagataattttggataaatttcattcgctttcatatgccatcattttaattcttttttgtgtgtttcatatatttttggctttttaggccaaaaaaggctggaacatcttcaacattgaccagcagtcggctgacaaatgaggcgaaggctgggaaagcttcgacactctgaacgacaatttggattttgagaacaaaagctaattgagcaaatggcgcgtcaatcaatgcctaaggggctcgaattgatttttccaatttaaactgatttcttcgcttttattatgtacaaatataaaatcatcttttttcttaattttttttctgtttctcattttgttagcaaatgttttctcttacgctttatcccttcatatcccattatcattacgtggttgtattatctcattgtcagcgttttctgctaattattattttttggactttattataacatatgatgatgctgttttccaacctttacggccaagtttaatgtacactcatcggtaattgtgtcggtgagcccatttttaaaatctttttcgcttttttaagttaaatcagaaaagggttcatcggcattttgattaattacataatcaatttaagactgataaacaaataaaaaatgaaatgatttactttccaataattagttggatttaatgagattgttttaaaaagcattttcagtgccgtttagtccattggcactttttagtctctgtctatgtgggttagtgcttttcactgacggaagcacggaaatgtgaattggtaaaatcaatgctttgttcgcaccgtccaataacaggaaattcgcccccgcgggcgatggatgccaccgattgtctgtccccggctaaaattccccccccacaaaaatagtccaattttaaaagtctcgtgaaatttttgtgaatttaacttctcgagatggagcaattagcgattcttttcgacgaaatttccccaccccctaaaaaattagaatctaattatattttgaggccttcgaaacttgtgctcattttcaatttacccaaagttgtggcattttttctcgcgtaccatgtgatgtgtagaaatgatcgtcattgttatttttcattttgaagcataaattcttctcgcgcacccccgaaaatccgtccaaatctttcgcgacgcattcgtcccaaaaaataaaacaaaataaatcgtccttataatttaatccgactgatcagtgcgcgttttccgctgtttgcctcaaatccgccgacaaattttgtggcgatggccaaaaaaatttgggtggaataaatgtacgaatgtttcacacgttgtataattaaaataatgtgtgtgaataatagacaatttattctctaatttgtgtgccttttctctcccctttttccatcgtttaaaatttatttccgctttcattggtcaacaaaaagagaatgtttaccgttatccataagctcaatttaagcatttttggagataaatggactattttgaacaattttgatttatttcatccagtttctagaatatatttttgcatatttcggtttttagcacatataataaatatttcggaattttagcacatatatattccatacttgctcataatttatataagattattgacgtgaaaattaggggagggggggggggggtgatgcattttgaaaattttgtgagaattattaacattttttgttccgaaatttcagtgaatgttcaaacgccgtgggatttctcattcaccaaaatttattttttaaaaagtaattaaatattttttaatgttattgccgagcatgaataataattaatgatttttgaccgtaaattttagctttttttgttcgaatttgggtctggggtcctgaatggctggatttttagacacttattcgtgatcactgatcagtgcccttgctaaaaactcggaaaaaattttctataataaacttttttgaaaaaacgagacacaaattatatattaattatcaacgtaatatccggtcgcataagcgagtcacattttgccgttcggggaaacaatttctctcggccctttgaagtccaatgattaattgtcattgcctaattagtaccattattatacaatcaaatttctttcagctaataagccatttccgccatttgattggcca

SEQ ID NO: 163 - DNA, 3213 bp, Heterodera glycines
taatgttacagtggaaggaagaaggatcttccataccgtaccagtcaatcaacccgaacgagaattacaaagagaacgtaattacttgaccagagaggtcctgagcgagagacagatagagaagtggagtgggaaagattgagtagagagagtaagcgtgaggcggaaagagtgagggcgagagtgagacgaagaaaggtaacgacctaatcccccagcaaacccgttcccttggattccgatcaattccgacatctaattgtgatttcgtgagtttgtctaaacgcatttcaaaatcaggcacgtgccaaccgctatcctcccccatcacgggtgatactccgttccctcagaccagcaccgtgccgggaagtaatgtgattggcagtggtctaactacggtatcctcgtcaacggtgggcagctgtttgccaatgttggcaccgcttggaggccaactaacgtacagtacggcaccgcaacagcagcagcagagcattttgggcggttccggcacttactcgcaaggcaccgtagtgcagctatattgtacaaacggcggagcagtcagcggaggcgcaagccaagtgagcacagcgggaaagaacttgccaaaaacggaagaaattgaaaagaaatgatggagagagagagagagaatgccaaaaagatgagaaaatgccaaaaataaaaaaggtttacctaaatcctaaaaaaaatcgattaagtgagtgaacacattgtacgaaatttagctaaagctgctaatttggcaattttcctagaattgtgcattttcttcgcccaatttttgcaggccgtctgtcagcttggccaatggcagccgttcagtctcggccaatgtttgggcagccttggactccccggagggataactccgtcgccccagcagcagtcaggcattggcattggcactaccccatttggcaccattccatttggcactacaaccactggcaccaatttgggtaccgctattggttgtttgcccgctgttaccaccgccgcttttggcaccgtacaatactcgcagcagccgctgtcatcgccgcagggctccccgctggtcattggcgcgaccaattacccatccggcactaccgcaacactacaatgccaacaaggtcagttttgcagaatgtatgcagcaaaaaaatttcggtgtcaacgaaaaagagtagggaaggagctggtttttagttctcaatttgagttcgaaagtttttagtcttggttttcgattagactaactgtcttacagttagaactaatttgaaatccatcaaatgccgtaggtgaaaatgattctgatgtaatttgctaagaaaatgacttaattctctgatttttttccattatttaggcctgccctcgggtgctcagtcgtccgtctgctcaaatggcatttggacaccgccgctgggcatgtgcaccggtggcaccacgccatttggaggcatccaattgggcaataccgcgcagcagagcaatgccgtcggcagttgcttttttggcctgatggcacctctgggtaaaaaaaaaagcattgaatgaccgtaaaactttcgatggttttcctttaaggtgcctccatacagtactccagtgggagtacggtaggaccgtttccctcgggaactctcgcgcaagtgatttgccagcaggtgaatgctttccgattccctattaataattttagtggtcaatgcaactcgtacaaaaggcaactcgtatttaacaaaataataaggtgaagcttaagcctaggcttagcctaaagcttaggcctaagcctagcctttaagcaattttcgaattgccttttgtacgagttttcatgacacctcaatagcagccaaattttttaacaaaattgccattttccaaggggtcgccgcaggggcaaagcagttcaatgtgtacgaatggtcaatggcaaccgccacttttgccgggctgttcggcacagagtgggggactctccaacggcataaacagcggcattggcgcaataaattccggggtattaggccaaatttgtaaaatggcaaaagaaatttatttgatctctgttagacgaacacagtgagtggcggtttgaacctgctcggcattggcacgcaatgtctgcttggaatggcacccgttttggggggtaattttttaaattgcaatttttcacttgaaaattccccaaggcagggagtttgtgattttaaatttattgtataccaacatggacttttgtagtcgtatttttgtaataatttaaatttgattttgaatcctttacaacaatgatgtcatggcaattcgtacaaaggcttagactaagcctaactttcggcttaatttaaatttaaattttatagccgtgaaaaatttcatttggtccattaatcactgcttttcctcgcccaaaattaaatttttggaagctcctcaggcagtctttggggttatcttttaaacttttttttgatatccctcgcttaggcaacattgtctattcgtccgttgggccgccctatccccagggcaccaccgccaatttgcaatgtgccaacggccaattgccgaccacaacaacacagagtagtggtctcacgacaagtacaatcggtggcatcggcagcagcatcggcagtccgtcatcgaccacggcgacatgcatcggaggacagtggcaaccggcacaattcggcgggggcgtcggacaatgcaccgggggagggacaatggcaacgagaacagccggaggtgggaaaacaattaccaaccaattatatatttatttatttatttatagtaattactaattagagtgagagatattttcggaaattgaaatataggcaaggcacaattttttggcgccgccaactttaacgtgttataactacttttttcttatgtgtccaaataaaatactcttgaaccaataaattaatcctcattagctttaaaagggacaataaaatgttatagcgtttggcgccaaaatggctggcgccgaagtgggcggtccccccaataggtcgaccaaaatgatttgattctgtgctcattcgtacggctcccagttgggcggtttaccaaaagaacgccattttaagaaaagcctcaaaataattttggaaatttatagaaagttttaatcggttgcaaattgaacaaaaaaaatttgaaaaa

SEQ ID NO: 164 - DNA, 1756 bp, Heterodera glycines
  misc_feature (21)..(21): n is a, c, g, or t
  misc_feature (1616)..(1616): n is a, c, g, or t
gaaaagcctcaaaataatttntggaaatttatagaatcttctaatgcggttgcaaattgaacaaaaaaaattttgaaaacagtctcgtgtttttgggattttcagtctcggtctcgaggtcatctcttgaagtctcgagaaattttcggtctcgaacagcactacttcgttcgaacgattggccaagccaactttctccgtgattgtgccaccgaaccttttacagccccctcccccttctcgcgggcacattaattgaaaaagctccatctttcaaatttatgatttagtagtcataaatttagaccccatcgccccaaacattgtagcacttggccaaacaacgtttccatcctccactccgggttttggcaccacaccgctcgtcccatcgcagcagcaacagcagcagtgtgtgctcggcatcggcgggttggcattcaacggacgaatacagtactccaacggggcactgttcggaccgtacccgccgggcacaaccgccacattgacatgcaacagcgggtaaaaggccgggctaacaacaggcaatagacagatggttgcccagatttatgggtgcaccacaaaaacttgttgagaaacaaatgaaaatttttctagccatttttcgattttcaaattttttacaaaaaatcgctagaaaggtttttcaaattcttttttatattttcttataaaatattttaaaatttttttcgtaaaaattttctgtttgtaaattttttttttaatttccggcggcgagattttgccaccatcccagattttattaccaacaatttgagctttttttagcgccaatgccaaaaattatgctaatttaaagaatgtttcgttagattttttccgaaatttttgaaaataattggcaaatttaaatgtaataattttctaattcttgaattagtccgttgttttgtttcactttttaaattcatttttatcgtgcttttccagctttgtgcccagcggccaaacggtggccagctgccagaatggccaattcctgccagccgtgcttggccaatgtgtgcagtcgagtgccgacgcgacaccgtacaccatgccaagcgcaaccacgacgacgacgaggaggagcagcaacagcagcactactgtagcctcgtcaacgacaacaagcagtaacagcaacaatggcatgggcacaacagcaaatgctacagcagcaacatttgccatcaacggaacaggaggtgatagtggcacaacacaaatagagcaagggaagagatagaagacgggagagacgggagagagaaatggaagagagagaaagataggagagaaatgaggtgaaaagagagaaggataagagagaatggaagaaaataaagataagagagaaagagagaaagggaagagagagaaaaggagagaaagagataatggaagagagagagaaagaaaggagagaatggaacagaggaagagagagagagtagagagactaaagttggggccattggcgggtttgagtacaaagttggatcacatggccattttgaacaaatactattgggggtttgtgtgtgtgttggcaggaaatggcacgaaaattccgatttccgaanattttggggtctcggaatgccattccctggtattctggttatggcaatgatgactcacaaatcaggatttttcttatccgacgggtcatttccggcattttgtttattccgaaacaatcaaattttcgctcacagtcgac

SEQ ID NO: 165 - DNA, 3505 bp, Heterodera glycines
  misc_feature (10)..(10): n is a, c, g, or t
tttttgatgnaatagttatcaaattttatttttttatccgcagtattttgtcaatacttatacatattatatatattgtgaatatttatccttttgtatatatttaatgttttaatccattaaattgatatttttgagtgattaaatttatttatttttttctttctttgtttattttgataaaaaaatgagctatgtataaaaccgttcacccatacaaaaaaaagtccggccgaaactaaaaaaaagtcaaatggaattccgatacttagccaattatggccaaaggtgaatgtttggcattggcattgtaaaatttaaatgttcatttagacacccaacaaagcgttttttctaaaaaaaaaacaaaacaaaaaatacatacaataaattagacacaatatttacacacagttttgagcattcgattgatcaatcgattgaatggctgatcgatcacccaccaaatccgatcacaattcgtccctctcctgccaatgcttatcttttcctctttgtcggagcatttcgcgcacttcttcagccattcgttgcgcgtcatttccatgccgtacaaaaatgccattggcattctgtcggtcgccgatccgatcaacgccttaataaaacataaaaaataaatgaaaaaagcaattaactatgttttaccagggtagagcatcaccgatgggaatgcctgaatgccggccatttggcaaatgtggccgaaccggtcacagtccactttgccaagacgtactttgccttcgagaagctgaagaacggggagcatttcaagtgctaatgatgggtacaatcgcttattttatgggcccaatgtgaatcttagtttgttgggagcccaattaatccaaaaaactatgataggaccattaacggagagctttgattgctaatgatcggccagcggacagacactaaacgatgtttgagaaagttgacttaccttcgccagtttgtcaaaagttggcgcaaattgcacacaatggccacaccatggagctgaaacttatcaaaaatgacactgtggtatactgtaggggatttgaaaatgccagggatttaccgtagaaatcaacgagaaacggctgatcagagccgagaacggtggaatggaaatcacccgccaaccgctggaccaacgtcggcatcatttcggaaagccaatgggccatggattgggcatttcgccaccaatttggcggataatcacttcaaaattgattttaacattggcgcaaaattgtcgagaatttcggaaagatgccaatgactcattccattttcggcccccacacactcactacggttgcaagtcgtgccggtgccggtagagacgaatggtcgggtaactgtgcacgtattccccgtcgcaaatgtccgggaacgcttcgcagtcgacggagccaaaagacacccaaaaaacaaaaacaaatgaaaaagttcccccaaaacaatgggaggtagttcctttctagagagcccttttctaattagaagtcgggagtggattccatccccgggacctccctctcatggacagcaaaaattgctaataagataaattcaaaaataggaaaatccgaacccaaaatccttcaattgccctttgaaaaaaaagaaattgcaaatgaggatcaatggcaacacgtacaaaaaacaactcatataataaaaattttacaaaataaagcctaagcttaagcctaggcccaagcaagtcgaagcctaggcctatcctaaagcataggcctatgcctaaggcattaaacgagttgccttttgtacgggttgtcatgacaccgcaaacagaagaattaaggtgaattgaaacaatttgataatttaattagaaaaattgaacagtcaaatgccaaaatggtcaaggtcaacggtcgcttacaatgtccgcctgtggtgcgaccactgaaaattgccgagccaatcgccgaaattcgggtgccaactttaaaatgaggaaatcttcgtaattttcgacaaagaaaacgggtttttcaaacctgttgacaaggaccgcaccacggggctaaaaatgggaaattagttaaattacagggcactaaaaactcgagacgaaatcgaattgggggacaaaaaaaagaggaatattcgactctgagccgagactctcgaaatggcatagcaagaaagattgatcagccagttaaaaaatgatttatcgagaatttaaaaaaaaaatgagaattacggcattggatggtttcgattgctccaaaaaccgcattattaaaaatatcgtaataatatttatttggaccgaaaaagtcgacgaagaacaaatggccttttggcctgtgcaccaccctttccatgaacaaagtgctgttcagcgccagcaccgacgggttcaatgcttcggcaacaaattcgagcagttggtccgctgaatgggagccgacgatgggatgccgagcaccgtccggcgtgaacagcacggagtggggataactgaacgaggggcggagggataatcaaaaaaattgccatgatcaagaaagatatggagattttcgagttggttgaggtaagtctttgacttggagcagctcgtttccccccccccccgcccgccttccctgtcggttccccgtgaaaattaaaaaaaaaaaatcaaactttaaaaattttaaaaaaattctagaaaattttttataagaaaagaatttgaaaaaattttcttcagacttaaaaacgccagagaaatttttgaaaaacttttttcttgaaattttatttgcctttaaacaattttctaaatgaaatattttgtttgaaaattaaaaaaaattaatttttcggaggaggggaacgtagtgcaccttttgacttagtctctagcctcgaggggtcgagtctgaattgactagtccactggaattgggagtaacttagggttcgagcctgatccgggattcgggaatggaacaaactgtcgggatttgaaatgatggcaattctgcaaaaatcctctgcccacatttaaatgaaaccagggtcgagaatcgggattaggcattaattagcccgacctttccttaattttataatgactcattttttgtgtttcttctgccgcttcttccctcaccttctgatgcccgcgcttcggcaaatggtcgcttccgcttcacaattcacagtgcccagccgaagcgggcgcccgtcaatttcggccggcaatttgcgcagttcggccaacaggcggagacatggcgggcaccaggggacgaagtggtcgaccagccacagagtgccggcggtgccgtcggcagctgccacttcgtcatggatttgctgcaaaagtttttgggatggaaggaaattgcgcctttaatctggcacaagaatacattgtatttgtcggcattcagcacgatcagctgcgacttggcggacctagtgatgaacttggcaattgccgagtgtcattttagcattgcct

SEQ ID NO: 166 - DNA, 5775 bp, Heterodera glycines
  misc_feature (49)..(49): n is a, c, g, or t
attcaataaaattttttgaaattttaagccaataatccttcatgtcggntatcttttcatatcaagtgcggtgtgactttattgatgttggaacaagtagtattattttaataaataaaatttatatcttatgggagttaaatgatcaaaaaactgtttgggtgttatacattttaacattaattttattttaactagtaactttaatgaaaataataatcaggcgatgcggataaacaccaaaataattgtttatatatttagaaaaaggtttatattattaagtgtttctttatttttctttaaaaaataattaataaaagcattccaacaagtatttgcagttattttatggtcttggtataattctaaaattagttaaaaaaagttttggggttctgttggatgtgttgatatttaatattattaagtttcgacacgaatacttttattgattagttatttgttgatggtcctctcccatcgactcattctttgcatttgtgttattttacatttcggtgtttattttcggactctctaatttgactccgtcgttattttattattattttgtgattctaattttattgtttattcatttaataaatttatcttgtttgtgtgttagcaaaacacaacaactggcgacgcccgtgcatttttgcgcttaaccgtgaattcaccaaaaaaagcgactctgacggccccctcacataacccataacaaacaagttattccccatctgtcgtagcccgaagagtttctcagtattttgactgagcaaagctaagtgtggattcggtttttgccaaattttgctagtggcaagcttttaaactttatctttgtctcatctatcattcatcttctgtctgatctggtaaaatgacgacaaaggaggagctaaaagctattttggacgcacaacaaaaacaattcaccgatttgttatcaacgatattgtctaaaaatgtgccatccaacaattctgacctgttttctaaaataaacggtcaaattcccgatttcgaatatgaccccgaagccgattcgacgtttgccttgtggtacgaacgcttcggtcccttcattgagaaggacggtcaagtgctggacgacgacatgaaagtgcggttggtcttgggaaagttgtcgcccccggattacattcgttttgaacaacaaattcttccaggaaaagcgtctgatctgactttccaggaatgcatcggcaaactgaaaactctgttttcagacacaaaatcaatttttgtgcgccgttttgagtgttttcagctggcatgtgcgccgactcaaaacgtgctggactttggcgcgattgtcaacgcccgttgcgagcgagccgaaatgacgctgtcgaaagaggaagtcaagtgcatgatcttcatttcaggtttgacagacgcacataaggacttgcggcaggagtgcctccggcagttggaaaaggcaagagccgcaacgccgcctcaggacattaagctggaaaagcttctcgaggagtgccgcgccatcctgtcgctcaaaaactcgtccgctgcgctcgcaaatccaggccaagtccatgcaatttcaacccgaccacaaaaacttggggatgggtcttcaaaaaagcattccaaacccaacaattttcgtcctagccaacaaaattcgggaaattcaaatgttaccaaaacatttacaggcaaatatcaacattctcaggcaccagttagtcaaaagtgtaagcggtgtggtcaagcacacgcggtgcgagactgtttatttcctgtggacgtcaaatgtttttgatgtcgaaagcaagggcacacgagaaatatttgccccaattcagctcatccacgtgttcaatcacacgttgtggtttcgactttcagtgtgaatggtgcgaccaaagaatggatatggattccattacaagtcaatggccaccagatcaaacttgcagccgattcgtgttcacatttgtcgatcatacagcttccggtttggcaaagtttgggcgaaccgaggttggaaaaagttggtaaattagtgggttccttttcgggccacaaattgaagttgttgggaagtttcaagtgtgacgttctgttcagaggagtcacaatgcggcttgaactttcagtggcagacaccgaagcgccgagcattatgggattggattggatcatccctttcgagcgtgccacccaacagccaattgccacgactttggagcagcagtcgctcattgtcaacagtgtgcaaccaacaaatgatccggtcaaattggaagggcaaatcaaggcttccttcccgaaggtgtttcaacctggcctcggacattgtgtgaagacgaaggccacgctgcatttgaagcaaaatgtgaagccagtgttctgccgtgcgcgacctgtgccgcatggagtccaagcagcagtcgacgaagaattggaccgacttttggactcgttagtgctgaagcccattgatttttcgcgctgggcagctcccgttttggcagttcgtaagaaaagtggtaatgtgcggatttgcattgacttttatacgggactaaacgatgcgctggagttgaacaggcatccccttccgcggaccgaagacatttttcatgctctgcgtggagccaaagtgttttcgcagcttgatttgcgtgatgcttatctgcaggtcgaactggacgaaagttcaaagcagttagtcggcatcaacacgcaccgcggactttttcaatatcagcgtcttccttttggcataaaatcggccccgtctatttttcagaaagcgatggaccaattgacgtccggtattccaggcgtgtttgcctatttggacgacatcatcattgcttcggccgatcactcgcagcatgttgctgctctcattgaactcttttcccgaattcaggactatggatttcgagttcaattggacaagtgccactttttgaaggctgaattgaagtttctcggacacgttgtctcgtccgatggtctgaagcccgatcccgctcgatccgatgccatccgtaatatgccgtcaccgcatgacattggcactttgcgctccttcctgggtgcgctcaactattacggtcggtttgtcaaggaaatgcgcgatttgcgtgcacctttggatctgcttttgaagaaggacactccttggttttggggtcctgatcagcagaaggcttttgatcaggccaaacaggttcttcaatcggatttgttgctgacgcagtatgatccgagtttgccgatcattgtcgctgcggatgccagccaatgtggaatcgtagctacaatcagccatgtttttccaaacggagtggagcgcgtcatcgagcacgccagtcgaacgctcactcccgctgaacgaaattacgcccaaattgaacgagaagcgttgtctttgatcttcgctgtgcaaaaatttcacaggatgatttacggtcgtaattttactctgttaacggatcataagcccctcttggctatattcggtaataaaaatgggatcccgatctacacggcttcccgattgcagcgttgggccctaattttgtccaattatgattttacaataaaatatgttaaatctgcaaattttggacaggccgacgttttgtctcgactgatttctgagcaccggacagacgaagaagtcattgtcgcccacacatcggacaacgacgtggacagcactgaagaagtcgaatatgctcttcttgtcaacttggagcagctgccagtcgatgcaaaagaagtgagcgaactgacgacttcggacgatttgttgcagcaagtggcacaattcgtacgttccgggtggccaaacaaatgcccagctaatgaattaatgcctttctattcgagacgtgatacgctcaccctcgtgggcggttcaattttgacaggaaaccgagtcattgttcctgcgccgcttcgtcaacgtgtactcaagacgttgcactttgctcatcctggcattgtgcgaatgaaggcgctggctcgcaaccatgtcttttggcccggtcttgacagtgacattgaggcaatggtaaagcattgtgcggaatgtcaattcgccgccaaaatgccgccgaaagcgccacttcgaccatggccaattcctggtgaagtttttggacgtgtccatattgattttgcaggcccatgtgccgatggaaacatttatctcatcctcgtggatgcactttccaaatggcctgaagtgatgcatatgcgcacgacaacagccaagggcacaatcgaagctttaaatttggtatttcaccggtatggtgctccaaaagaaatagtgtctgacaacggaccaccatttacttcccatgaatttaaggacttttgcaggcttaaaggcattaagcacaagttctccccgccgtatcagccgcactgtaatggtcaagccgagcggatggtggacacattcaaacggcaggcaaagaaaaacgcaaaatccaaaaatcaacaatggatttcggaatttttgtttgcgtaccggtcctcgccgagtccaattttgaatggtttttcccccgcagaattatttttgggaagaacactccgcacgcccttgtcaatgcttgaaccgagacagcacacgccgaacgagaacaacaaccaacgtggacagtaccaatcgaggatgtcacagcagtacaaccaacatcatggcacaaaaagccgttcattcaattcaggagactcagtcttagtcttgaattatggtaggagtggtaagccatcatggttggaaggtaaaattgtgagtggtagtggtttgatttggaaaatcgaaattccaatccttggaattaccgtaacgcgtcacgtcaatcaaatgcgttcattttccccttacatttcaagtaagattgtgtccgatcagattcaagccgctccgcaacaaccaattcctccaatggcgccaattcaaattgatcagacacctgtccgtgatcaaactcctgtccgtgaccgcacacccgaaccagtcaaatctcctcgtccgcagcgacagcgcaagaagccaatttgctattcgcccggctaattgccacggacggtctttccaaaagagggagatgttggatgtgttgatatttaatattattaagtttgacacgaatacttttattgattagttatttgttgatgggtcctctcccatcgactcattctttgcatttgtgttattttacatttcggtgtttattttcggactctctaatttgactccgtcgttattttattattattttgtgattctaattttattgtttattcatttaataaatttatcttgtttgtgtgttagcaaaacacaacaagtccaaagttgcgcaacgagaaacgcccccctgaaattaattcgattattgacatttcataagaaaaacccgcataaattattcagacacagctttgcaatcgaccgctttcctttgttgacaaccatttttgatgggtcgatgcttattccaaactgctcatagcattcccggccgaattgcgcttcttggtcggcgttgcctttgattttggagtcaaatcctgatgcttggatcttctgcgccatgaactcagcaatgtatggtctgaacagctggtcgtcactctgctcgtactccagcacgcggaacactttggtgacccgatacccctcctcgagcgctgcgttgagttcaattgaagtgctggtgttgacccaccgcgttg

SEQ ID NO: 167 - DNA, 6235 bp, Heterodera glycines
taaaaaaaaaaggttattcagacctttaatttgatcaaccatcgtacatagtccttgaatattccatcactcctaaatttcaaaaatattaagatttcttaacaaactcataccattcatcgtagtgccaagctctccagaatctgtccactcggtagccagtttccaaggctcttgccagctcaatatgtgtgaagtttcctgtaaaagcccgctgctcatccgtgtgtgggcacttgtgcactcgtcgtgtgtttaacttccgaaatttggcagcacaacgatggcagcagcagaacagtaggcgttcgtcgatttttagtggaagaaccggaattcggagcccttttggaggaataacccgcacacgataaattccttggtattgtaaatgctcaggtcgagtccagtcgacgatcatctcctcaacggtggggtggatgacagcgggtattccgatcgggtagtcggtggcatagttgacccacgggtagaggctgacgatatcgaagacagaaatcttctcatcctcctttggctctgcaatcagctgaagcggcccagttctgcctccgtagaatgtttgacgtgggtcgatgggcccccggtcggtccccaagtcgtcgaaaaaagctcgcatttcatcatctcttttgagctgttctcggatctgacactcccaaatctcttccacgtcaaggccttgttcatcttctccaccgtaagcatcctcagccggaacaggctcctgcagttttagcaaacgcagtttggtagcatcgttgagttctcggcatgtttttccgtcaaccagttcgtcgtcaggtttgaagcaactctcacatccgtgccagtagcagccgagaacttctatgcacttgttctgctccgcaatccacccatcaagtttgaactgccgccatctcttttcgagaccatttccagcgtgctgtatgcgaacaccgtctcgcttggagcgccagtccaaatatttgatggcgaagacgctagccctgtcgttccgctcgtaaccgccttcaggcacgatggcaagctctttttcgttaaggaatttccctttaaagatggtcatgcaaacgctgaatagaaattaaattagaagaccgattggtataacgacctggcaatagtagcactcagcggaagcacatcaaagccttcagtgatatcacgcatcagaatttggcgaaattggacaacagcagcgagaagaatctccgtatcgttccgacaatacgtctttagctcgtccggtaaataaaacggtgtgtttttgttcacgtcatacctaaaaaacataacattaaaaataccaaatcgtatgaataccattttatgaatttctcatatttgtcctgcttcattgatccagggcagtaatcctccttgtccggcaaatgttgaagatgcacgttgtaattttctcttagaaatataatcatttaaattaccctcatttggacatactaaccttcggttgaaagcgtagggaaagaatggtttatcggcacagttgagattgaatgttttcggcatttcttccagacgaattggcatcagtaggcacgagtctcgccatgtgagttttgagtggcgccgagaatgttgaagacgaaactcaaaaattttgagcccattcatgatgacctcaggtcgtcgctttgtctggccgaggtattttagcacaaaatggccatcaaacctcgaggcattgtgtgcctaaaattgtttttgcataacaatgatgttaaaaaagatcacaaactcacccaaataaatgtttgatatttgttgtcccaagccttcaaaatccactcgacaaatgccgaaattggctcatgtccttccgattcgctccaatccttcgttcgttccatcgctccgtatgttgtcaaacaaattttacaattgagtcgcaggccattttcagaatcacagcactccgtacaggtaattcgtgctgacaggtagttgaccttgtgtcgctgttgtcccgcctgttgcagctgttccaatcgagtctctgtgtcccagcataccattcggtatttgggtttctcgtcaggcaccacaatgggtttgatgaagcacgcgccttccttctcatggtatacctgtgttttttggaggagttattaataaataaatagagaaaaaataccttacatcgcgcacaatagttgctgtaacatttgtggggattttttctatccacttgaaaagttctgttacattcatcgcaacgtttaatcaagttgcacatctgcggacgatgaccatcaaagcagctttgagagaagaaaaatcgtttgcattgttgacagtgtagacagacaccttgcactcttatgcaaggatattgcggtccaactgtaggaaatatcaaattaattgttggattaaattagtaaccttttccacattggtgacaacggctcttacaggacatcgtatgtttagcgtctctaccatagaaacactcgcaatcaacgcaatattttatcccaagtttgaagaagcagtgaatttttttgatgccgtgatagtgcccatccgacagaaacagcgacacacagaagcggcgtcccatcggacccttccaaattggtcttggaagctcctcaggctggtccgtgaagagtacaatgcggtacattccagtatagatgcggtcctttttgtgaatttacattaaaaaatttcttgttttttttaaattatttgtacccatagttgttgaattagaataagatgttccattccataagcatcttgatccggtgcaatctctgctgcacgcatcagctcttggaccgcaattctcagccggtcccgattggacacaaaacggttcagtgccttgtggtcggagcaaaaatcagctcgtctcttcacacgttgtataacttcagaagacacgtgattgctgtttgaactttgtcctccctctgctgtttgcagatggacggtagacttcaaaaactcagcgtcagtgtaggcacgtgtggcaatcaatgcgtagaataagcagaaattgttgcccgtattaaaaatacggatcatatgccgctcatcatagccccagtgttggtatgggtggaagcgtggcgctgctccaacaggaggcgcaatgcaagtcacgataatttcgatcggctcactgagcaacagcgagcgtttgctgatcccgccaccatgcacatcctcatcgccgtccgattgacccaatttgtcgagctcggccatcagaacttcagcggtgttttgctcaggtggacgaaccggcaagacgattgggtcggtcagtcctgcgtagggaggtgcccaattaattaaaattcccttgttaggtaccttttccattgagcaaaacacctagtttaaggacgcgtcgccgatggccagctgttccacctccatcctgatctgtgttctcctctgcgttccgtatcgcttgtccgatgatgtgctcaaatgcgttaagaagtgcctcttccggctcatcatgttgtccattgagcacaaattctgtcacgtgtcgatgtagtgcaaaacgctccaccctgtgcacgtagtactgcagttgctcaaacaaaggtttctccgtctgctcattgtggtcttcggcattgtctgctgctgctacaacagtttgcgctccatcaatccccctttgatgaaggcggccttctccatccatcggaattgcgtgggactcttgcttctgctgctgttgccgtagatgatgctcctcaaaatgggccatggttttaaaatcccaactttggcggcgttgtcgtttcgcaactccatcagaattggagattgtaggcgagaaagaggccgccgccaccgccgccgccgccgccgctgccgccgctgtggtgtagtcctcaagggtagctgatgatgaggttgatggttcgtctcccgttcgtttcattgttgaggctgttggggtgttctttttcaaggaaaagagtgattaaatgcaaaaataattgtttggcgaaacagtttgatcaaatttaaaaaatttttcttcaaattttattcctatgcaacagttaatcaacattggcttcagcccaataacggccgaaatcagttctttttggcacgcttcttcccaatgtcaagttcgatgatttctccatcttcgttgtccgcttcattctttttgtccacaagtatcgccgcagcaatccaatccattgtggtgaactcgccgccgccctttgccttgaattaatgattttaactggctcagagtcaacaaaaaaaaaaaaaaaaaaaaaaatttcctaaccttcagattgagtttgaaggtcaaagtctgtcccaactttgactgaagcaaagcttccaatttttcggagcacttttcgaccatgtcggcaaactgattgaccctcatggccaggtagtcctctgcaacgttggagaagacggtcactttttggctgatttcaaggtcttcgcagtcttgaaggtcgagtctcaagaagagacattggagtgggctgttggcacgatggtcacatccgcggcagaacatctcatcgtcgagctttttcttacatggcacactgccggaggatttaagcggacaggcctgcaaataaagaaaattattaaaaattttcaaaattaataaccttatacaacgaaaactgcaggtctgccacctttgcacgtacaaaaaatattcccggcgcattgaacttcgccacttcgctcagctgttttggatgggatggaaattcgtctgcgggtcgtttgttggatgaagatgtgagttggaagcgtttcagtccgctcatgcttttaaatttgatgcaaaagaaatgtctaaaatatggattaaaaataaaaagacaatcaggctttagggggttcaaaagaacaaatattaacaaaaagttcaaatgatgacgaatattggcataatttcaacgtttagggcgtgttaaaagacatatagaaaaaaaaattttttcgtaatggtacgaatattggtataatttcaaccttttggggtttaaaatgacaaaaataatgtcaaatattggcataatttcagccttaggtagtgtaaaataaaaaatgaagcaaaaaaaaaatcgttggtcaggcgctcagatggtctgcacccttgcaataggtttaaaatattgacgaatattggcataatttcagccttttgggtgtcaaagtgacaaatattagaaaaaatttcgaaattatggggaaatattggcataatttcagccttttggggatgtaaaacgacaaaatattgacgaatattggcataatttcagccttttgggggaattaaaaatgaccaaaagtgaaaaaaaatccgaaaaagaacttaaattaatttaaaaattcaaatatttaaatgaaattttaaagaaattttaaaaattaaaaaacattttagatgtagggtttttatgtatagtaaaatttgtttaaaaatttaaaattttcccttattctttctacctcaccgctgtctgttgtgtggttggcgtttatatggcacgcttgtccacagcagatgaacgatttgtatttagtagtcaatgttgtactgaccaaagtcttggagctaataaagtcaaaatatatttaaatttgtccaagaaataaatgtttaaaattaaataatttttcttttctcactgatttttgtgccccaaggttgtcgtttgtttgctgacgatctgctgttgatgttgtcaatgtgttggagtgttttgtcagttgttgatgttgggcaattggccggcagagtcgttgtcagatgtgattttttggcgttcaaatcgcgcattaaataccccgcattttccgcctccgggcatattgtctagacatatcctagtagcctgttgtagaatgtttgcccatattatgcgataatttgatggctcattaatcaaaaacccctccctctctcagcttttcctactgaacgccaaccgtcctttgtcaggtgtcacttggacccgactgcttgttctctcgctcttcacttaaccctaatctccgattacaatctccaaaatttgcgcgagagactgccccgtcatccaggccgtcacggattacccgttgtttccttccaccccttccaagcatttatttattaaccggtcatactccatggctttgataaacgtcccccctttctccccccccc

SEQ ID NO: 168 - DNA, 7155 bp, Heterodera glycines
  misc_feature (52)..(52): n is a, c, g, or t
  misc_feature (80)..(80): n is a, c, g, or t
ttgatcaaatttaaaaaatttttctttcaattttatttcctatgcacagttnaatcaccattggcttcagcccaatacgngcgaaaatcagttctttttggcacgcttcttcccaatgtcaagttcgatgatttctccatcttcgttgtccgcttcattctttttgtccacaagtatcgccgcagcaatccaatccattgtggtgaactcgccgccgccctttgccttgaattaatgattttaactggctcagagtcaacaaaaaaaaaaaaaaaaattttctaaccttcagattgagtttgaaggtcaaagtctgtcccaactttgactgaagcaaagcttccaatttttcggagcacttttcgaccatgtcggcaaactgattgaccctcatggccaggtagtcctctgcaacgttggagaagacggtcactttttggctgatttcaaggtcttcgcagtcttgaaggtcgagtctcaagaagagacattggagtgggctgttggcacgatggtcacatccgcggcagaacatctcatcgtcgagctttttcttacatggcacactgccggaggatttaagcggacaggcctgcaaataaagaaaattattaaaaatttaattttaaaaaaaccttgtacaatgagaactgcagatctgccacttttgcacgcacaaaaaaggttccagatgagttgaacttaacaacttcactcaacttttttggatgggccggaaattcttcggcgggtcgtttgttagacgttgatgagagttggaagcgcttcagtccgctcattcttttagattttgtgcaaaaataaacgtctaaaatttggattagaaaaaagacaatcagctttagaaggtttaaaataacaaattgttcgaaatggtgacgaatattggcataatttcagcctttagggggcgctcagatggcctgcacccttgcaataggtttaggatcaaaccaccaatagtatcaaatattggcataatttcaaccttttgggcgtgtaaaataaaaaaaacggcaaacattggcaaaattttagcctttaagaggggtggcaataaaaatattgaaaaaaaaagttcgaaatggtgacgaattttggcataatttgaacctttaggggtttgtaaaaggacaaatagtgaaaaaaaaagtagaaaatgctgtgaatattggcataatttcaaccaatggtgacgaatatcggcataatttcagcctttagggggtgtaaaatgaaattgcgaaaaaaaaaagtcgaaatggtggcgaagattggcataattcagcctttaggggatgtaaaagtacaaataatgaaaaaaaagaacgaaatgctgacgaatattggcataatttcagcctttaggtgtgtaaaagaacaaataatgaaaaaaagtacgaaatgctgacgaatattggcataatttcagccttttggggtgtaaaaggacaaatttaaaagtaaaaaaagcaaaatgttaaaaagaaaacatttgaaaaaataaaataaaaatttaaaaaacattttagactcagcgattttatgtacgccaaaaaaattgttaaaattctccttattttttctatctcaccgttgtccgccggggattgtcgtttgttttttggcacggctgtccacgcagatgtatgagttgtactttgtagtcaatgttgtgctaaccggagtcttggagctaaaaattccaaatatttttaaatttgtataatatctaaatgtatttaaaattaaataatttttctttttcactgttttttgcccgccaagggttgtcgtttgttgtcctggcctattgattgttgtcaatgtgtgggagtgctttgtcagttgttgatgttgggcaattgaccggtggagtcgttgtcagatgtgatttttggcgttcaaatcacgcattaaataccctgcattttgcgcctccgggcatattgtctagacggagcctaggatcccgttgtacaatgtttgcccatattatgcgataatttgatggttcatcaatcaaaaccccctccccctctcagcttttcctaccaaacgccgaccgtcctttgtctggtgtcacttggacccgactgcttgttccctcgctctttcacttaatcctaatctccgatttaaatctccaaattttcgcgagctactgccccctcatccaggccgtcacggactacccgttgtttcctttcaccccctccccagcagttaattcaattaaccggtcatacttcatagctttgataagcgtccctttctccccccccccccccccagcgagagcttagtccctttatccacccttccccatgcaattcccttcagttcatgtcaattcccctccctcctttctccgcacaattctaatctccgatttcaatctccaatttttgcgcgagcaattgccctcaggcatttcgcggatttccctcactgcttctcgcctgccttcccctcctcctcttatctccgaaatcaatctccgagtgttgagcgaacgaacacttgcgattttgtccgctaatcctttgcttctcctcgcttcacttctcccaccactatctttaattcaatagccaatcacccctttattttgtattttactttatgctcttgactcaaaaaaaaaaatatttcatctctttttggcgacaacttggcgcgcttcatgaggtaaaatcatgggtcgggaatgcaaacatttgggacatcttttttctccccctccatccatatttttttttccttttctctcctttttacctatttttctacacttttcccttttctctaccttttcccctcgtcttttttctctcttttcctctatttcttttttccctattttccatttttccctcttttctctccttttttctcctttttctctcactttttcctcttttcctttttttctcgctttttcctcccttttcccctttttctcgccctatttcctcttttccatttttattttttcctctcttttccctatttttttcctcccttttctcgtttctttccctcccccgtgagtgcgtttcctccccctctttctatccctgtgggtgcatccccttttttcctttctaacccccgtgagtgcattccctcacccctttctctccctgtgggtgcattcctttttttcttttctcccccatccatcgcgagtgcaattctccccccccatgtgagtgcattttacacatctttcttcccccacccccacccccgccccttcaccgaatttcaattgattaattacatctttggatggaccaatcaaaatcctattaaaacaattatcctttttttggatacgtatatccttggccaatggtagtgttttggaattggggtatcccatgttagctggagattaatttaaattaaaagaattggtttttggtgaattaattaaatgaatcctctcgtgggtttagaccccggtctctgggacaaaaaccctggggttcggttgtttgtggtgaattattttaatttaatcatacatagctgacattttcctttttcggataactgtaccgctgcccgagtggtagtgttttggattcgactctctggttcgggcccttttgtttgtggtcgaattaatccaattaaattgtctcatgggttatggaccccggcaccagggattgggtgattttaaatcacacatataagacatttatcctttttctgccaacactatccttggcctgttggttgtgctctggatttggctcttgggttcgggtccccttatatgttgccgaattaattgaattaaatcctctcatgggtttggaccccggcccctgggactgagtgattttaaatcacacatatatgacatttatcctttttctgtcaacactatccttggcctattggttgtgctctggatttggctcttgggttcgggccctctgacttgtgggtgaattagttgaattaaatcctctcatgggtttggacccctgcccctgggatcactctgggtggtctcgacattcaaaaacattggtaaaaaaaagggtgattttttgggtggagggagggttttggacgcccgtaaacgtgtccttatactactgttaatttctcaaaaaagtctcattttttatcaatttcgctagcttaatgtaatgctttttggcgtaaattttttttcgctctcaaagatttactcatttttcggaatttcttcgctaaaaatcaaattttgccttaaaagtgaaaaagtcatgaaaagggtcaaaaaaatacaaaaaaaaaagaaaattttgaaaaattattgggcatttatttgaccacgaatttgagtgccaaaaaagacatttttgtaaaaaaaaactaatttttccaaaaaatcgccaaaatatgtgacaaaaactgccgaaaccccaaaatatgtttttattcccaaaaagcccaaaataaatatgtgctaaagactcgctctgattgaaaggaaaacaggtaaaaatgctatttttgagattttcatgcgatagatgcgcaaaaaaatatataaaaacatataaatccgttccctgataatatccgtcaagaaataggaaaaccctaaaaatccaagctttacccaactcaattaattcttctgctatttgtgtgacatcattcggagctcggccaaattgtgctaattgcctcaaaaatgaaccgacggtaaaagaattttaatagtcacacaaattcgtcatttatttagctaaactgttttccataatttcagttggatttccgaccgtccgttgcccagcaaaattcgctttgattccattcagattaggtaagtaaaatcagagatttatagcaataaaagcattcattccctttttgcagttacatcgaggccaaattcaacaacttcggctggccaagcgttgtccaaatggttgcactctccgagaaaagatggccaacccaagcgattgcgttgtttccaatggaacactgattggatcaacaatttcaaggaggtgtggccataatctcgacaagtcactgatttttgttttccaaattgtttagcaatttctccgtgccaatgccatttcttccgtcagttaccaaattcttttttctgttcgtgtgcaaatggggcaaaggtatattttactggtcccgtttttttttaatttgaaaagcctggaaaaatttttctagggctattttatggtgctgagcacgaatccggcattatttttgacaaattctaaacccctaacccaaattcgaacatattttcaaaaaaaaatttttgtttttattgtgcatacaggcagggatttccgggatcactgatcactagggcttccaattatatggaaatccatatttttttcctggacacgcaagaaaaacatgtttttagcttggtttgaagcttctaggatggatttcttctatatccatatttcgcgattatgtccatattttgttagccattttagatgtattttaattgaatttaatgaatttgaagaatatttttgaaaatttacccctcaattcggaaaatttatgtccatatttttgctattttatgtccatattttgcgatttttcctaggttttattgccatattccgagattttatatccatatttttggaagccctactaatcactagggctgggacaaatattttgataaaaaagccagaaatatttacgaaaaaatatttttctgtaagtttttggcgggccaggacgttttcgcgtggttgcatataaaagagaagtgcaaaagcaactctaacaaagggaggtggccaagtgtccgtgggatttcaaaatgaaacttggttaggtggatagagcaccaatgggttcttaagaaaaatggttttattttctgccaaatgagcacgagtgccgagttatgacgtgccaaagtttttagttttttataattaaagaaaaggaacaactatttcctttcttcaaagaaattgttagtgtataggtaattcgttagtcaaaattttttttgggtcaaaagttcgaatcccctatgtgtaaattcattttgttttgctttttgtgagcaattcaattatcaaattttatttctttatcaaaatatttattttaattttattccattaaaaatcaaaaattgcattaaacataaatgtaatacatattctgtcaaattaaaaaatatttttttggcgaatatttttattgaatattttgcgcattaaaaaatttaaaaaaaattaaaaataaaaattttttcataaaataaatttttataattgacttggcgtaaaagacaaaaataaaaaaactaatttatacataggggatccgaaccctgggctaaaagatgctgactagcgcactaccgctacaccactggacaccgtgctcttgtgcaaataggtatttcttttatttaatcattaaaaactttggccttttttatcttggcacaggggtccatttggcagaaattgaaaacatttttcttaagaacccatgggtgctctatctacccaaaaaatctcattccgaaatcccacggacacttggccacctccctttgtaagcaaaaaacaaatccaaaaataaataattattttttagcattgcaaagaatttattagtttttcaatttttttttatattagaaaaaatttcggtctttttttcaaaaaaaaaagtcttaagttttgaagtttttcttatttcttagggaaaaacatttgtgcttcgcttcggtaaaaagtaataaatgcgaatgcctcaagcgctgtgagatcgtcgaatggcactttgacaaaattcggcacaaatgggccaaagccgccgtaacagtcggggtcagtggatgcagaacaggcagccagagatcggccatggaaattgttttcggcaaaaacaactttggcttcattttttggcaccattttgacactgtggtgacggtgaaatttttaattagtcaactcttcgaatttttaaattgcgctcactcatacgcccaacgacgggccaattttacggccgtgtcacacgcctcgacgcctaaatgattacagaaaactttattttacaataggaataccgtatgag

SEQ ID NO: 169 - DNA, 3603 bp, Heterodera glycines
taatcatttgttgtttgtttactacttaatctatccgttcatctgactgcattgcttgttttcgacaacattgttgatcaaatttcccattattaccccgtgaatgcgtgatcaaatgatcgcttatatgcagcaaaccacatttatttaggcatattatatgcacaataaaaacaaaaatttttttttgaaaatatgttcgaatccgggttaggggttcagaatttgtcaaaaataatgccggattcgtgctcagcaccataaaatagcgctagaaaaatttttccaggcttttcaaataaaaaaaacgggaccagtaaactagtttgccgcaaatggtgccatttgaattggtgaacgaatggacgaaggaaaagctgacattggccaaggcaaacgaaaatgaattggacaattggataatgaaacgatgcaaaattattggggagaaagaggaaaattgggacaacaattgcaacaatgtgttcttttggcttgttggtggcattgattgcattgggtgagcaatttaaaaaaggcatttaattttgtttaaataattcaaattgcgcttaattaaggccattgtctccgccaccggcagaagaaacgggacaaggcatcacaaaagtggcgtcttctgctgacgatgaatgagtgacggacaaaagaacgaaacaatggtgattagtggaagaagaaatgaattatttaagaatggccaaccgatcataattcatcagtgatcaaatgcaatttatgatgaaaacctctcaatttcggtaaataaatcggacatataaaaatggcaaaaaatatatgtacgaaacacaaaaattttgagatttgcacaaaataatcaacaaaaattgacttttcaggcagggatttccgggatcactgatcactagggcttccaattatatggaaatccatatttttttcctggacacgcaagaaaaacatgtttttagcttggtttgaagcttctaggatggatttcttctatatccatatttcgcgattatgtccatattttgttagccattttagatgtattttaattgaatttaatgaatttgaagaatatttttgaaaatttacccctcaattcggaaaatttatgtccatatttttgctattttatgttcatatttcgcgatttttcctaggttttattgccatattccgagattttatatccatatttttggaagtcctactaatcactagggctgggacaaatattttgataaaaaagccagaaatatttacgaaaaaatatttttctgtaagtttttggcgggccaggacgttttcgcgtggttgcatataaaagagaagtgcaaaagcaactctaagcacacttattgatgtcaacagaaattcaactaatataagaaaagaaaatttacaaaagcctaaacttaggcctagtctaacaataagccattgttcgagttgcctgtgtatgagttgtcatgataaccttaggtttaacaacgaaatttatagttaaaaactttattgaatacctaacaaaaaaaagtttttctcttagttattaagacaactataataccatgagaccagggatggcacggaatttcgatttccgaaaatttttggggcctcggaatgccatccctgccatggacacaaaatgtcatgggacgcgtaaaatgtcatgggacgcgtaaagtgttgttgggacgcgtaaaatgtcatgggacgcgtaaaatgtcatgggacgcgtaaaatgttgttgggacgcgtaaaatgtcatgggacgcgtaaaatgttatgggacgcgtaaaatgtcatgggacgcgtaaaatgtcatgggacgcgtaaagtgttgttgggacgcgtaaaatgtcatgggacgcgtaaaatgttatgggacgcgtaaaatgttatggaacgcgtaaaatgtcatcggacgcgtaaaatgttatgggacgcgtaaaatgtcatgggacgcgtaaagtgtcatgggacgcgtaaaatgttatgggacgcgtaaaatgtcatgggacgcgtaaagtgtcatgggacgcgtagtgtcatgggacgcgtaaaaccgactagaaccaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcctaaacaggtactcacgcgaaaatggccacgcgaaaacgaccccgaccggtttttggggtctattccttcaaaataaaaacctagaaaataggccctaataactcgaaaagtagcttaacaacagccaaaaaaaatatgtttttcgtgcgtttcaggccatggggagctcaggaaacaaatatgtaaaaacctaaaaacatagccctatttataacacatgaacaaaaagatacaacaaacttcatcaatccctcccttttcatgactataaaaggtaaaagtgaaggatactgacgggatggaaaatgtatataaattatataccaatcgactccgctcggtctctaatgaaagaatccgaaagaattttttggcggtaaccaatcgctgaagagttacagacccgggactgaaatgacaaaatggctttgggactgaaccgtccaaacccttaaacgaatggaattgcgacaaaatgcatataaatcgattccgcacggtctgctaataaagaattcgaaagaatttttggataaaaaagaaattgacaaaagttacgggtccttaaaaatctaaaaaaatgatttattgttaattaaaaaattaatttaggtgagccaaaaaaacgtaaaaggtttttgaacttcgcaaaattaaaatagtcctaaaattttgaatgttatcatgattttccttgaacttataaagattttaatttaaaaaaatggcaattctgaataaaatctgataaaaacttgtgctgctccatttttcctaggccaatgacttcttttaaagattttttttaatagctcacgtttaaaattaactgtagttttaatatttgccaaaaattgcgcaaaattttccaattgttccagcctctattgtcccatgtaaagaaagcacttttaaagtgggatagattttaccctctaatccctaattaacatcatatttttatgtactttcacacgtttgggcgcggccgtttgggcgctggtgtttgggcgcggccgtttgggcgttggcgtttgggcgcggccgtttgggcgccagctcgtttttccacttaagcttttttctttggcatccatttccaacaatcttggtatcattcgaaagctcttaacatgctctattagccttaccaaaagcgaaaggattttcaagccttgaaaaaattttattaagaataaacttcaaaaatttcgtcttttcgaaattttcatgtataacttttttggtaattgtctaatcacgaagcaatagcttagaaaaagcttctaaacacattaagctttcgaatgataccaacaatgttggatttggattaaatagaaaaaa

SEQ ID NO: 170 - DNA, 9155 bp, Heterodera glycines
ttttttattagaacctgaaaacatatttccgggtgttttaagggtcgctgatcacaattatgacatccgtttttaccgaaaacaaaatttaaaattttttaaaaaaagctagaaaatatttttttcgaaatttcaatgtcaaaattgacaaaaatacagttagaaaaatatactaacttacttgaaaatcattcctaagttaaaataggtcaaaaaatctttgaaattctttgattcgacctcggttttaagattttcccttcaaaaaacgagttgaaataataaaaacgagttgaacaataaaaacgagttgggcaaaaaacgagtcgatacaaaaacgagttggccgaaaacgaaatttcttgcattttttataggttttttttgttacttttatgtctctcttgataaattctcatcttggatcttttatttttatccatggacgaatccaatcaaatcgggctggaaatagttaccccactgtgcaagtatgtcaaagattggggggttcaaacataaattttttcagtccctggtagcctgacagtattttaaataattgattgctgtaaagacttttttgatgcgtttgcaacttctccggcgctcgctcgacgagcggccgccccaccatttgccactattttctcgtcgtcgcattgcccctctttttccatttgggtaatgtcgttttgtgttgttgttaatgaaaatgtgacaatcgacgaaagcatccaatcataatctaaaagtcgccctttcattcatttctccattttcgatttcaattctcagaaagggaacgaattccccccattcattcgtcgccataaaatgaggccaacaaccattccaattgatcattgttcgctactccccaccccgccccgcattttcaggaattgatcgaactcaaaaaaaaacatgagtagttagagactgtgatttcaccggattacggtagccccccataggtgtgggaggggtgcatggccaactgagcgccagccatttgagcgccgccaagtgagcgcgggccatttgagcgccagacttttcagtactgaagccaaaacctattgcgcgactttttcttggaaacccaaacctattgcaggggtgcgcgacttttttgactgcgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggataataaacattaatttgctctcataaagggaaaaattgacgtcaccagcggcgggaggggggcgagagcgggcggcgagaagggggagggggtcaaataaacaaatcaattattgaattcacaattttctcttttaaaagcaaaaagaaatgggggaccgtataataaaatataatttagaaattaaaataattaaaaggttaattaattaattattttcctaaaataatttttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaaaaaattttattgtcccaatttttaccattttgtgttttttaaacaaaataaatatttgttcaaatttaaagaattaatttttaaaattttagacacaaaaacaaatcatgagccaaaaccgtgacgaaaactcgcagccacctgtactcgatggaccgtacccgctggcacaagagcgcaatgagtttgtggaagatgaagcaccggtgctgcttgagatgttggatcgtctgtcacaaggagtgggttttgttttgaattatttaaattttttaatttttccattttggcttatgctaattgttgattttgtttagggaatttgccaagccatgggcctgttttcgtttgcacttgccgactgtttggccacatttcatacatttgccatactgttcgactgtgagacacctgtgccatttgacgagcagcacaagcgatacgtgttcgaacacagggacaaaccgcggctaatctacgtttcggaagatggtagcgctatacaggttgacggtgtggtgaagcaaggggaatttgtgatgagcatcgagacgatgtatctcgataagcgaaacggagttgatcacttttgcacattcctgcacacttttggcatttgtttcttgatgtgccattgaatgtgtttatttgtttcctattcagagcagtaaattgtttgcataattctgtttaattattttttgtttacaaccaaaatattgatccgcatttttatgttataattttaattcatttttgaaatttttatttaaatggcaaacgaagacttccgcttgtccgaatgcatccgttttattgagcgaacagcccaagagtatgattgtgttctgccggttccacggcttgggtttgtcacggaaattttcttaataatttttaaaatagctcaaggcgcgatgagcacctggatgcctgtgttctcatggaatcagtgggctcaggccaccgcctctacattttcgaatttgaggactgccttcaggtatttttaaaatatgaggtcaattaattaaataaataaataaaacaaaaccccacaggtgaaaggacacatcgaaaacgaagatgggacaagtacacgcgtgatgattgagcactatgataaatacaatgggttatgtggatttgaatcgtttttggcgtcatgtgtttttaccttttttggattttttgttcccgtttcctatgaagatgatgattgatttaattttaaaataatttttattgtatattgcgtttcacaaattcataaacaaattcatccgaattacttggccttttcaaaaattgcataataaactcaaaatcaaatcctaaggacataaaataaataaaaactaaaacataatgaccacaaacattagagaaaatcgattgaaattttcttcgattaaaataaattttccgaaaattatttgccaaatattttttgatcagatcgtttggcatctcgccataggagtcaaaaaagtaggccacccccggcgaacgtgcccatattgcgcaccaatgggttcccggcattcccgacgggtcctgaagtggcaaaatttattttattgaaaatattttggcactcaccaaattgacaattagactgcagggaaatttcgtgcactttggcaatcggtcggccggaaaagtgccaacaaaatattttctcgtcgcccggttctcaaagagagctctgtcgatgaaccgattgtccattcctgcgacgaatccgcctctccctcaaaaacaggtaaaatcccgcagccgcagtacctgctgcgccaaacaggtagatgaggcagagaaaaaagttgattggcgacttctcgatcacatccggaaaacacagtacaatcccttcgtgtgcagcattggaggagggcatttgaacaaaatcggaggaataattctcaccattcatactgtaaggtcactagtgattgatctgttccggtcaatcagaatgagcccgtcagcctcggcataggctattaaagtgaccccctcgttcggaaccgcttcggtaaaccgaatgttcaccgctgtacagccctccttgatcagctcaaagcccggcgagtcctcctgcgcattggtcatttggaagacatagaggcagtaggcagtcttgaacatgctgtagctgatcccgttgctctcagttgtacaggccatgccaaggtgctcctgggtgtcatggtacgcccttgcgtacctgttgttcttgtagtccaagttgtacggaaactgtgggtatgtcctgccagaggcggtcagttcaatatcccgcacctgaacattttttctgccagaaatacatgtcaaagcggcacttacgttgtggtggttgaagtaaaaggggttcttctgattgtgcccaatgtaattttggttgggcaccagcccaatgatgaccctccgtggcacttcctcggtgaacagattggcagaaaaatcgtatcgtccaccggtaatgaacagcgacttcatcagcgttttccggatgccgtatctggcgggctccaggtccaacttctttgcaatgtcaaggctgagtccgtccatcagatcaaccgtcttcactatcagcctgcagtcgacaatctcaagcgtgtacttgtccctatttgcggcttcctgatgtatcataaaatcgtccgactgcagggcgagctcaatgtcaatctcaacattgctgatcatgtacaagtcctggttgaatatgtcggcgctcagcttgcttatcgcttgaaagcccttgctctcctccaccgcctttttccttcgatcgtttactttggtcgggtcactgtcacggaaatagcctgccacgccaaagtatgaatcctttgccgttacagggtagctgagctcggtgtccaggaacaccttgtagctgtacagctggtttgagtcgtacacctcccgctggttgatgtgcactttcaggttccggatgaacgttgcgccgggcatttggataaggccgaccgctgcgtttgccggcacatcaaccacaaccccatcatctgccacttttttgagcttgaactctgtgcacacaaacaccttgctaaggtctacatagctggtgattgggtggatctgaaccaacggatttgtctgctattgtatgtgaaaaccacctgccttaaaatgaaagggcctagagcttattgggttcagcgtcaggtactccctgtagctggagttggacacagcgcagctcgttgggggtatggtgaagaagtccagccccgcatttgccacctcagcacttgacgcatccacttttttatacaacattttgctaataataaccgagtgagtcaaatcttttcttctttaacagagctttttggggaacagtttgtccaacaacgtctgagggtttcaaaatgatttcagcttttttcccgcctcctcttctcttccttcttccgcgccccttttgtagtgatgaagaggccttgtccagcaattttttcgctccctcttttccttccgacaccagcgcgtctttgatgttgccaccctttgacacctcgttgaggaatcgtgcacccgtctcgaggccctctttgccaatctcggcagcaatgtttgccgcatagggtcgtgccgcagtgaccattggacgaaggtagcgccacaggttgcgcagcacagagccaactcctgctcccttctgtcgggggacacccaagaaataaccgtatccccgctgaaacgttggtgccccctcaaagacgctgatcggtccaccgcctccactttgcggataaattttctcgagccgtaaatttgagccgtcaaaaatcacgcgaaccatctctctcagaacgttaacacctttttaaactgaagagtcaaaacaacttggccaaactcaaatggcacctcccttaaataagtgattagaaataattgccctgctgaagagcctaacctcccggtcagagtgcgaatctcaacgtcaagcacatccacctcccttgctatgattttgtgaaacaacggcgcctggaagtccttctctaccacactacccgactttccctcaacggcaatcacttggagcagattggcaaaggtgttgccgacaatcatgctctcaatgacgccactgttcaggtaaatgcacaggtggctcacaccaccacccaaatcaaccgcatattttgcaagctcttcatttctgatctgctgctcttgttcatagcccaacacgtaggccagttgatcagtcagcgtaatgtgcgaaattttcccgttgaaaactttgagctcaaatctgccaatttgctcggtgaagtaaaagcggaaccctttgaccagctcgatcagctcctccttttcctctcgcgttttcaccgcatagttttcatcgtacacctcttgctcaaacagctcacggaactccccaatattctgttggatgtgcgcggatgggttaaactcgggcgcctcccaggggagctctgagtgccggacacggtacttgtgtacagcattcacaaagtggtaatcatccgtttcgtgcagatagtgtacgtctggggttgggtctttgccgtgcaccagcctcatgtacccgcctcgccacggtctgaactctttgagcagctccaactctttttgctttcttatggcctgttgctgtcgtttaagctcttccaactgcttttcctcctcttgctttttcttggtctcgttttccgctctctccgcttccgcctttgccgctctttcctcttctgcgtttgttaccattgccactctctccgcttccgcctttgccgctctttcctcttctgcctttgttaccattgccactctctccgcttccgcttttgccactctctcttcctctgcctttctttcttttgccactctctcatcctctgcctttctttcctttgctactctctcctcctcagcctttttatccttggtctctttctcgcctttcttttcctttgctattctctgctcttccttcttttcccgtgccagtttttcctcccttgccttcttttcacttgcctctttctcttcctttgccttcttttccttggctgctttctctgcagtcttccttctatcttcttctgtcttacgacgcctctcctcttcttctcgccgtctacgttcattttctcgctgctttctctgctcctcttcccttcgctttctctcttcttgtgcccatttttcatgccgcaacgtttcttgttgagccgctgattgcttggccaaatatgaaagtgggtttaagggcgcttcgcccgtattgtcttcttcctcctcaacaaacgagacgtcaagaatctcgccctcctcctcatcgtcgtcgtcaatgttcccaaaacttgcatgcaccggtgcggacctttttcgtgtcaacagccgttccacttcggcaatcatgccatgatgaatgcccctctcaagctgctgtggcgagagaaaacttccctttggcacacggaaacggtattttcggccgtcgtgcaggtgaacaatcacatattgtcggtctgatgtacccagctttgcccaacttaagccaaaaatcggacccaatagccatgattttcgcccacctgtttgggtaaattatgcctgacagtccaaccatccacccggccccatcaaacaccaacttctttggcaagtgcactttgaatttgtttgttttatttccaacaaagcctggcgtattgctcggcaaaattacaaagaaagagtttgtcatttgatcaacaagtataaattcttcaaaatgagatcgtccttatatcgtggtgtgccatctcggttcactttcccccatctttgatccagcggaaactctttgccatcgtcgtcgtcgtcgtcgttgccggttcatccttctttaggtgcttcatgatcagatcggtgcagtcaaagttcagctttgcacagtcttggcaaaacgattgggtgaactcaaggcgttgctgctcgccattctgattgatgagtttgaatcggctgttcccctgccggaaattgtcatcacgacactctttgcacatgaacgtgaacactccgtacttaagaaattttcctattttttcaaattaaatattagccaaaacctttgggcgggccaatttccaaaatatggtcgggtactcaaacacattggtcggttgttttttgggcgattcatccactaaaatttggctaatttaaagaaatttgcagaaaaagccaaaccttcagcttccatggcttttgcttttttcatagcggaagcaatttcctcatggattttgtccaagcgaggcttgcgtcccctttttgagggccccggttgcaggtcaagcagtgtttgagtgttgttgttgtctccaattgtgatgacgtcatcatcattttgaggggaaaaattttcccgtttcgactcatccatttctttaaatttaaaaaaatctaaaattattataaaaaacccaaaaaatgattacttttgttctcaaacaccaattgatcattgatttttctcggggccattactattaagaaatagtttatgattataattgttaaaagcataaaatgaacctgcgaaaaaaacacgtaattattgattgatagtgagaggggtgttagcgcgcagcgacctccagacgggctgtcccttcttaatcgataggccacgcccatccacaaacacattgacgagagagtagtggttagagaaagatacaaaagggcgccaattcaaacacacagtgaatcccaaagccgatttattgattttttttacagattatggtactccctctgactgctgccctatccaaactgcaaagctgtaaacccgaaaatttagcagaatatttgaacaaccccgaggcagtgaacaaagcgaacgcttacttggccggcaaaaaactcaaaactacctaccagagtcgtgattgcaagactaaagaggtcaagttcgcaccttttcggtgaaagccgctgcggaaacctacgcctttgagggatttcttggcacgtttccaaaaattctgtttcggtctaacacacacatgcgttcagaggttaaagtccaccagtatttctacataaagcaccggatccgcctactgtacccacagctgaagtgcattgttgagtaccacaacaaggggcactgcaaatactatcccttgggtataaaattttgcccgaaaaaaataaaataaa

SEQ ID NO: 171 - DNA, 7122 bp, Heterodera glycines
  misc_feature (4576)..(4576): n is a, c, g, or t
  misc_feature (4615)..(4615): n is a, c, g, or t
  misc_feature (4636)..(4636): n is a, c, g, or t
taatttaaagaaatttgcagaaaaagccaaaccttcagcccccccggcttttgctttcttcattgcggaagcaatttcctcatggattttgtccaagcgaggcttgcgtcccctttttgagggccccggttgcaggtcaagcagtgtttgagtgttgttgttgttgtctccaattgtgatgacgtcatcatcattttgaggggaaaaattttcccgtttcgactcatccatttctttaaatttaaaaaaatttaaaattattataaaaaactcaaaaaatgattacttttgttctcaaacaccaattgatcattgatttttctcggggccattacgattaagaaatagtttataattataattgttaaaagcataaaatgaacctgcgaaaaaaaacacgtaattattattgattgatagtgagaggggtgttagcgcgcagcgacctccagacgggctgtcccttcttaatcgataggccacgcccatccacaaacacatagacgagagagtagtggttagagaaagatacaaaagggcgccaattcaaacacacagtgaatccccaggccgatttattgatttttttttacagattatggtactccctctgactgctgccctatccaaactgctaagctgtaaacccgaaaatttagcagaatatttgaacaaccccgaggcagtgaacaaagcgaacgcttacttggccggcaaaaaactcaaaacaacctaccagggtcgtgattccaagaccaaagaggtcaagttcggcacattttcggtgaaacccgctgcggaaacctacgcctttgagggatttcttggcaagtttccaaaaattcagtttcggtctaacacatatgcgttcagaggttaaagtccaccagtatttctacataaagcaccggatccgcctactgtacccacagctgaagtgcattgttgagtaccacaacaagggccactgcaaatactacccattgggtatacaattttgtccggaaaaaaatcaataatcattttcagagttgttggccgttgaggaaggcggggagagtcaacccgtcgaaagacctgccgctgaaacggactacctggactacttgaactttcgcagtgggtggcaatcaacactctactgatcaatgaagcgtgtgcggcaatcggaaaagttgggcgaattcccggagattgagttcgccgtcaacacaatgggcgtcacggtgtactgcccgcggcacctgcaaacgcctcggtttgtgccatgggaccagcccgggcggtgctcgagctgtagaagcggaactgttgagctggactacatcatccagcccgagggggtgaccatcttttcgaatcggctaaagacagacggcgagaactttgtgccgtttgatgcaattggtaagctgcaggtgtatgtcagagtttgactcttttcttaagtggactttgccgatcgtgcgaaattccgcattagggcccggaacaaggtgttcacgctgccgctgcgacacccggaggtgcacgccgccggcccaagcttggaagacggcgtaaaagaacaaaaggaaatgactcagatgtcataagcacttgtccatttttctttctattgttgatattctgatggactacccaagaataaacgaaagtgaactcgcttttcccatcccttcggggataattgtcagtgggccgtcctcttcgggcaagacccagctggtccttcgtctgttacggcatgccaacttgatgtttgacccgccgcccaaggcaataggtatgtgcaaagggggtttctgtgcagtgggctgttgttatttagtatgggcatacggtgagtactcgacgcagattcccgatctggagcggcagggagttgtcccccacgcaggtgccccgtctgacgagatgctgaaaaagctgccaaagccttgtctgattgtttacgatgacttgatgggtgacattgaggccaagaagttggccgatctgtacaccaaaaagtcccaccataacaatttttccgtgattttcctcacgcaaaacctgttcgataaatcaatgcgggtgccaaggtcgaacgcccagtacatcttcctgatgcgggctcccaacgacatgcttagcattcgtaatttggccagccaaatgttccctcgcgagcagggattcctgatggatgcctaccgacaggcatgtgctctgccgtacggttacctgttggtgactctccacgcgaacagagacaacattatacgcctaaggacaaacattttcccagacgacgaggagagaatcatttttgcccccaaaaatggttaagcgggaacagaagatcggtgagcgagttgtgcacaactacgactatttgaagaagttgggaaagacaacgtcggagaagaagcgccgtcatttgttgaacagtgccggttgtgaggaactgttaacgcttgtcgagatttgtctcaacgttttgaacgggagtttctgtctgagcaggaaacaaaagcagagacttgcgccatttgccaaagacatcagacagttggcacgtgtgcgaagtgagaggggtgcgcgaaaactagtgcagcagtcaggcggatcactttttgcccctttgttggcccccattctgattgaggctgcccgatacctgctttcgcgcagcaataatggccaataaacttattctgctgccgtacgagcactacaaggggctggttgcagcgagggagacaaagaatgacgacgacgacgacattgctgagcggacaaacttgggctttgtcaaacgacaggtgaccgctgcagtacagaagcggaagggaaacgtcagcgaacggaacgcaatgtacaaccagcacctgcgccggtacctgaagatgcgcaaggaacataaggagcggcccgtccgagtacagctcagcaacggcgctcaactgctaaataaaacagtggagacgggtgtgcaggtacggcctggtccggacgaaccgaaggacaagtccgtgatggttaccgacgaagatgaagaggaagagattgaagtgccaaagtttttaaccccaacaagccagacgcagggaagcagccgatcacccaggcccaataagaaagcagcaaaacagcaaaaattgatcgagaagaaggaccacctgttggccatcattatgtctgatccgcagagattcggcgcaactgaccgtgggaaaatcattaacccaaagacgggccgagagttcatcgactcggacctggcctggtcaattgaacgcctggtggaccctcgcccggagaatgccccttcgccaagcggaacaaaagagttgaagaggaaactcgcacagagtccgctcgccagtagcctactcaatcgactgtttgttgggtctgggttcgtcggacaagtcaaacaaagcgggcgttttattccctcaaaatggacgaaaaaataaacaaaatatacaccgacccggccaatccgggcgggtttgcgggcgcgagtgctctgtacgcggcggtgaagaagaagcacccgaagttgaagcgtaccgagtttgaagactttttgcagaggaacaccacttatacgctgttcaagccaaagagagacaagttccgacgcctacgcactgtgcctgcgggtttcatgaccggtaagttgtagtgggcttattgcgcacaattcagggttcagatgttcaggcggacttggcagatttccaggcactttcgcgcaagaacagcggctaccggtacctgctgttggctgtggatgtgttgtcgaggcgaatgtttggctctcccgtaaagagtaagcgcccagtggacatgaaaagggcttttgaagagctatttgagcaaatgccaagggtgaccggacacactgtacaccgatcgagggctggagtttgtggcaaaaccgttgaaggagttttacgcggagaagggcattcaaaagtttgagaccagttcaaagaagaaggccgccgttgcggagcgtgccatacgcaccctaaagactcggctgtacaaatatttttcctccaacaacacatcggtttgggtggatgtgcttccaaagtttttgagtgccatcaacaactcggtgtgccgcgcgaccggacttagacccaacgaaatcagcgacaccaatgcgagggaggtctggaagagggtgtacggcgaagggctcgcacaattggacaagacaccaaaaatcagagcaggggaaacggtcagaattcccgagcctaagcacattttcgagaagggtactgtatttcacacattttttcggtcaatttattttaattttaggttatatacccaattactctgatcacgtttacacagtagacgaggcccgctcaaccaacccccagcactatttgctcaaagactattatggcacaaagttgaagagaaaattttatttaccagaattaacaaaagtacaagttgatgaaaacacaatgtatcggattgaaaagaaatacaaagaacgagtgagagatggaaaaagtgaaatattggtgaaatttattggctttccggaaaatattgngtgacaaatgaaagaataaatgaataaaaatattacaanatgacgaaaaatcatttaaanaaacaattatggcataatgtcggggtcgttcagctcctcttctgtgaacatgttcacattgaggtctgggttgaacagacaggtacaagcgccagggcagttccacttacaccactctttgtcgctgtacccaaagggcaccaccttcaacccgtgatccctgaccacccccttattcacggtcgggttgaactgcttgaccaaggggacggtgaaaatctctcccttcttggtgatccgaaagttcttcgttgggtagttgaagcggacgttgttgtccggctgtcccagcttgttctgcaccatgtccttcatcttctcgaaggtgatgcgctcgcaggcatccgagtcgagcgtgatgccgcgcaccttcagcttgtactcgtcctcccccgttgcgttgttgcgcagccacaatccgtacgccttgggcccagctaaacaaaaaatttccattttttttttttttattttaatgagttttaccacaaatgaattccataatcgtgtggttcgggtgctcatcagcgagttccccgagctgctcaccacccggaagggggtcccccagccgcgtcaggtagtcgtagaagatgctgtcagtgtcctaattataaaaaattatttcctattttcattttatttccagttttaccatgtagagaatgcgggtgtcgtagcgctctacaccaggagcaggtccatacactttttcaacgattccaacaggtggattcgcgcagcagaagtggtccatagggcaatggccacctgagaaaggcaaataaatttcaaaatttaaaattttttcttacgttgctcgtgctgtgttccaccacatgctcatccttggccttgtagcagaccatccaaaacttttccgtcagctgatcgatgctgctgacctcaatcttcgagtcgttgagcagtttggcgattccgcatggcactcgacgatttcggtttttgtgagccgattcctgtacgttttattttttttttcataattttttaaagaaattttaccgaagtgcgaaccggccccacagcgagttcaagcacaacttggacaggtagcggagcccggggttgtgcttgatccggtccgcctccagatggacttgggccttttctttggccttgtcgatgtggtcctgtttccgccgtgccgactcctcatcgctgatgcccgcctccgtacaagacgctggatatccgcttgcttaaatttttgttatgattttttattaatttttttccaaattttcaccctcaaatttcattttgaggaacttcagcagatacgagtggaacagcccattgctccaatcgcacgcgaggcgccagatgtaggcacggtaaacgtgcgtcaccttgtacccagagcggagggcggcctccagctcaatgtgcgtgacagttgtcgaaaatcctatcaagaaaaatatttgcttaattataagtttctaaacccacccctttcagagtcctcaaaatgtttgcagttgtactcggggtcgatcaagccgcgcgggtacatttccgaacacgtccggcagagggggaacagcgtccggttgttgagccgatagggaaggaccgggatgtcgtagtggcagtggcgtggcggcacggcgtagcacttgatgatcccctcgaggcggatgccgtcgtcgccaacaatgtccgctggactcctccattccacgtccttgtcaaactgcaccacagtcgggtggccaaccgggtaattggtgtacatattccttaaaaagccaaaatttttcaattattaattttttccggcatttcttaccgcgaaggataaagactgttaaagtccttcactttgattgtgcggcttttccagtcgcccgtctctgggttgatcactgaagcgcccaagtattcgggcccagttcgacctgtgccggaaaattagttaaaaattaaatggaaaaggtaccgccaaagaaggcatcgtggaagtcaattggtccagaatccggacaattgtcgaaatacgccttcatggctgggttgtcctccagcattgcgttcaggtggcactcccaaatcacttccacttcgaattcccgcgcaatgtcacgagtccgttttgcatcgcgggcccttagagctccggcagtttctcctccgcccacaattgccgcatcgtcggggaagcagctcgggcatccatgccaatagcatcttttcaatgggaaaattggcacatttttggaattttttccttacccgttgacctcaatggccaaatttttgtcctcatctggacgctccatcatcccatccaagctgtagttgccgaacttgaactcccctccagggctttcgacatggcgcagcacccgaccattctcccgcaattcttcttcggcacgccactgagagtcgacaaatgtaaaattaaataatttggatacaccttcaaatatttccgagcgatggagctttgcttgcct

SEQ ID NO: 172 - DNA, 1243 bp, Heterodera glycines
cgtcaggagtcgcgagcgcctacatgggagcctcgcccgcgtacgagccaccagcggttgtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaaataaattgaattgatggtcattaagcgtgtgtcaatttattaactgaaatttggtcctctccctccctccctccctctctctgtttgacgtagacatttggatggcataacgttttttggcgtttaaacattcgtcccctattagcgggtcatcacagaaaccgttggacatacggtacttatcctttttgtcatccccctgaattgttttaccttgttccccccattttcgaaaaaaatgaaaattttaaaaagtcgttaaacccagggctcggatcgacaatttttcaaaaacagaacagatttatttttaaaattattcgatcaataatgtattatttttttcgcctccgattgtcgaatttaacgatttttggggaggaaataagcaaatcgtaaatttcagtgcattcgggatcaaacaataagatttttaacaattttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaagcctccgaccaaacagacgccaaattttaccaccccgccccccttcctacaaaagcat

SEQ ID NO: 173 - DNA, 2635 bp, Heterodera glycines
ccctccatacacaaccatttcaatgaagcacaggagagcatttattaagcacaacaacaatacaattacatagtacaattaaatatacattcatttgaaatgatgatcacagaaatttacatacagatacaacaatttacatgatgggggacaaaatgacaattttgggacggtgggatgggatcctatcatgtccatgttgaggtgacgaagcatccttccatcagacgttgtacttgatcggcaaggccttgcggcgcaccttccggtctccctggaaccactcgagcttgaacgcggcggctgggtccggcgcgttggtccactgcacggtcacgcggtcgttcttggtgtcctcgctgccggggtcgaaggcgtcgcaggagacggccacgttgacggactcctttgggccgagcactccggtcggcgggttcacattgatgcgcttcggtttggtagtcttgaaggcgtagccgatgcgcttcgtcccagggttgatcacctgaaaaaggggggggggaggttattccgcataccacggcaccacgcccaaagcccaaacgcacccgcatgtggcaggtgaccttgtggtcgaaaggtgcgttgaagacgaccttctgcgtgggcattgttgcgacgtcctctggtggaagttgcgccattgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcagcaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagctaaagaagatgtcccataatcgtgatctgtatttattgatgtattgtacatttgtatgcatatatcatttgctgtgtattatcactttatttccatctgtgttccgaaataaattgaattgatggtcattaagcgtgtgtcaatttattaactgaaatttggtcctctccctccctccctctctctgtttgacgtagacatttggatggcataaagttttttggcgtttaaacattcgtcccctattagcgggtcatcacagaaaccgttggacatacggtacttatcctttttgtcatccccctgaattgttttaccttgttccccccattttcgaaaaaaatgaaaattttaaaaagtcgttaaacccagggctcggatcgacaatttttcaaaatcagaacagattttgttttgcgaaactgcctccaaattagttatttttaaaattattcgatcaataatgtattatttttttcgcctccgattgtcgaatttaacgatttttggggaggaaataagcaaatcgtaaatttcagtgcatcgggatcaaacaataagatttttaacaattttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaaccctccgaccaaacagacgccaaattttaccaccccgccccccttcctacaaaagcatttgaattgaagcacatatgagcatttattaagcacaacaacaatacaattacataggcaacaattaaatatacattcatttgaagtgatgatcacagaaatttacatacagatacaacaatttacatgatgggggacaaaatgacaattttgggacggtgggtgggtgggatcctatcatgtccatgttgaggtgacgaagcatccttccatcagacgttgtactcgatcggcaagttcttgcggcgcaccatc

SEQ ID NO: 174 - DNA, 2695 bp, Heterodera glycines
aaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaagcctccgaccaaacagacgccaaattttaccaccccgccccccttcctacaaaagcattgaattgaagcacatatgagcatttattaagcacaacaacaatacaattacataggcaacaattaaatatacattcatttgaagtgatgatcacagaaatttacatacagatacaacaatttacatgatgggggacaaaatgacaattttgggacggtgggatgggtgggatcctatcatgtccatgttgaggtgacgaagcatccttccatcagacgttgtactcgatcggcaagttcttgcggcgcaccatcccgtctccctggaaccactcgagcttgaacgcggtggcggctgggtccggcgtgttggtccactccacggtcacacggtcgcccttggtgtcctcgctgccggggtcgaaggcgtcgcaggagacggccacgttgacggactcctttgggccgagcactccgttcggcgggttcatgttgatgcgcttcggtttggtggtcttgaaggcgtagccgatgcgcttcgtcccagggttgatcacctgaaaaagggggaggggttattccgcatgccacgtgcaccacgccaaacgcacccgcatgtagtaggtggccttgttgtcgaacggggcgttgaagacgaccttctgcgtgggcattgttgcgacgtcctctggtggaagttgcgccattgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcagcaaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatgagcgacatgagcgcctacatgggatccggccccgccgagcctgcaccgtcgtccggcgccgcggaagcctctccatcgtcaggagtcgcgagcgcctacatgggatccggccccgccgagcctgcaccgtcgtccggcgccgcggaagcctctccatcgtcaggagtcgcgagcgcctacatgggagcctcgcccgcgtacgagccaccagcggttggtttaagggggacacgggagcaaaagcatcactaatcttttgtttttgcagcaggagaagtccccggatcagagcgcctacatgtgagaagatgcaacaacgaccggcggatggatggacgaaacctgaagagcgagcgacctgtcagaagatgcaaagataaagaagatgtctcataatcgtgatctgtatttattgatgtattgtacatttgtatgcatatatcatttgctgtgtattatcactttatttccatctgtgttccgaaataaattgaattgatggtcattaagcgtgtgtcaatttattaactgaaatttggtcctctccctccctccctccctctctctgtttgacgtagacatttggatggcataacgttttttggcgtttaaacattcgtcccctattagcgggtcatcacagaaaccgttggacatacggtacttatcctttttgtcatccccctgaattgttttaccttgttccccccattttcgaaaaaaatgaaaattttaaaaagtcgttaaacccagggctcggatcgacaatttttcaaaaacagaacagatttatttttaaaattattcgatcaataatgtattatttttttcgcctccgattgtcgaatttaacgatttttggggaggaaataagcaaatcgtaaatttcagtgcattcgggatcaaacaataagatttttaacaattttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgatttccaaatttgggcggctaacattcgaattccaaacgaaatgtgtgactggtagacttataggaaggaccacttttgtctaaaactcattttgacctgaatttacaaggagtgagcagaccgagttctacgcgagctaagcctccgaccaaacagacgccaaattttaccaccccgccccccttcctacaatagcattgaattgaagcacatatgagcatttattaagcacaacaacaatacaattacataggcaacaaatacatatacattcatttgaagtgatgatcacagaaatttacatacaggtacaacaatt

SEQ ID NO: 175 - DNA, 1330 bp, Heterodera glycines
attatcactttatttccatttgtgttccgaaataaattgaattgatggtcattaagcgtgtgtcaatttattaactgaaatttggtcctctccctccctccctccctctctctgtttgacgtagacatttggatggcataacgttttttggcgtttaaacattcgtcccctattagcgggtcatcacagaaaccgttggacatacggtacttatcctttttgtcatccccctgaattgttttaccttgttccccccattttcgaaaaaaatgaaaattttaaaaagtcgttaagcccagggctcggatcgacaatttttcaaaaacagaacagatttatttttaaaattattcgatcaataatgtattatttttttcgcctccgattgtcgaatttaacgatttttggggaggaaataagcaaatcgtaaatttcagtgcattcgggatcaaacaataagatttttaacaattttttgcgggtgcagtttttccataaaacttctggtgaacgggcgaggggagggggtccggcggaaaactgatttttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaagcctccgaccaaacagacgccaaattttaccaccccgccccccttcctacaaaagcattgaattgaagcacatatgagcatttattaagcacaacaacaatacaattacataggcaacaattaaatatacattcatttgaagtgatgatcacagaaatttacatacagatacaacaatttacatgatgggggacaaaatgacaattttgggacggtgggatgggtgggatcctatcatgtccatgttgaggtgacgaagcatccttccatcagacgttgtactcgatcggcaagttcttgcggcgcaccatcccgtctccctggaaccactcgagcttgaacgcggtggcggctgggtccgacgtgttggtccactccacggtcacacggtcgcccttggaggagtcgctgccggggtcgaaggcgtcgcaggagacggcca

SEQ ID NO: 176 - DNA, 1287 bp, Heterodera glycines
ctccggcaaacccccattttggtgaataacccgaaccaatttgcgaatttccaagttggttgaataccaatccaaaaaaatgcaaacaatcagcaacagtttggggtaaatggaatgcttccaccaccatttttctggccacaatttccaatgcaaaatttgcaacagccaatacaattttacggcgctcaaaatttggttccacagctaccagctcaaaattttcaaccattttttaacaaccaaatgcctgtaatgtttgcaccaccaaatgtgcagtacccaaacactgcaataaacccagagcgccaaatcgtgaatcagcaaaaataggcagcaacaaatttttccacaacagacaagtctaagtggacttgaatacgcaatgattttggaccggctcccggatattaggggaaatgaaggcggtgattcaatctgcaatttcttcaagaagtactcacagtacacagccgattggtcaaacaaaaaacgaatcgaatcgttagaggcaaaactaagcggtcgtgccgaaagagcttataatgccgctttggccaatgaaccatttgtctatgaaaatgttaagagaaacattttgcaacaattagaggacaatgattgcagagaaatgagcgcatttaatgacttaatgaatggggtcacacgaaagcatggcgaaaacttagacgatttggccgacagaatttcgagcctagtgcgtcgtgcttatccagggctaacaagaaacctggccgatgagtattccataaaacaccttatccgaagtttgaacaatccagatctagcattgaatttggagctccatcgccgtaacggaatgtcttttgatgaattcgttgccttggcttctcgtgcagaagcaacccaaagggctacaaaaaggcaaagtgcggaacaccgaccaaaccaggaacgaaaatatatgcacccaagcgaccgcgaagttgaaacaaatttcaaaaatcagttaagacccaatccagttgtttgttacaattgtaacgaacctggtcatatttcacggaattgaataagacaatttccgcccaaaccgaaatgaatttccatcgtcttttcctcaacggaatcagcagcaaaccccaaatactactgcaactggagcaaaccgagttttcctaaactcgaaaaacggaatgccctcagccggtcgctcgcagaatttttaaagcaaaattacattagaatggaggaagaagtgaaaaccgatgcaactgttgccggtgttaagttggaaagagaagt

SEQ ID NO: 177 - DNA, 2092 bp, Heterodera glycines
  misc_feature (2081)..(2081): n is a, c, g, or t
gacctggtactgaaaaaaggtacaactgggtacctaagtcccggttttgaccagttttgactgggaccgggaaaagttccgggttttcccgggtttcccagccaaaaagtcccggattttcaacccgaaaagtcccggtcccggtttttctcaaaattctcggtcccgtacaactctagtggcaattgttcgacaccttcggatttttagcttaataaattattatcatttttatttataataaaagaaattcaaacaaactttgatgaaaaaaacaataataaaaataaaccagaagaagaataaaacattgggtcttctttatttaaaaatttaaattatttcatttataggggaataattatatgaaaattataacttcaatcaatttgaatataaatcaatttcttctcattttccaaatttccttttaatgttattccaaaaaaaaacttcgaaaaaaggcatttttttaaaaaaatcaattaaagtgaaagaatttatttcttcagtaaattttgattcattactgacttaactccttctgctgatttgcattcgcatttaaatggaaaattgaaattgataggtcaataatttatgcggtgatttgccttgtcaaatttggtaaacaaactgtttacatattatttgaaaccaaaatcttacacaaattcatttggcttgtttatgcggctcgccgcttcatctgcttgggccagctcggtactcaattcgatttggcggtccgacccgacctgttttgtgagcataagattttgagccaaaccctgtcaggcactttaaggagtaatccgaatattaaaaagccatagactttcataatacaaattgaaaaaacagttcattgtaaataattttcgtaagttattgaatttttgttcctttttgaagatttttgaccgaatatatttaaattttgaataacttttttaatgggtatatttttgaaaaataagaaatttttgttgttttcaggtattttagaggttacaaatattcaaaagttataatattctcgagaaataaaatgtgtaaatcgaaaaattgttaaaataattttgttcacggtgaaatttttgtatgaagaaaatttattaggcactaaactactgttttttgaaaattttctattttcatttataggttcggggggggggggctatatccctctgctcactcgtcgtgtgatgttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtaggaaagcaaaaaaaactcacgcaataagttcatttcttgtaagaataacttgttctttttttctgagtagcctttttgaacactaaattttttgtaaaaaaccaaaattatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggcatgctcatttcatgcgcaattcttttatctgattctgaaggcattcgggtcttaaaatcgaataatccgcgacatgttcggggggggggggggctatatctctctgctcactcgtcgtgtgatgttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtcggaaagcaaaaaaaactcacgcaataagttcatttcttgtaagaataacttgttctttttttctgagtagcctttttgaacactnaaattttttgt

SEQ ID NO: 178 - DNA, 2891 bp, Heterodera glycines
  misc_feature (45)..(45): n is a, c, g, or t
  misc_feature (51)..(51): n is a, c, g, or t
  misc_feature (82)..(82): n is a, c, g, or t
ctgagtagcctttttgaacactaaatttttgtaaaaaaccaaaanttatgncctagacaattattaaaacttactcgctcanattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaatttaaaatttctaatcattgcattaggtgttgacctttttaccaaaatcatgctcatttcatgcgcaattcttttatctgattctgaaggcattcgggtcttaaaaatcgaataatccgcgacatgttcgggggggggggctatatccctctgctcactcgtcgtgtgatgttggaaatatatgtccgcctatttagcttctcgtcgtaccagtgcttttctagcattgaaaaatgtccgaaatttggttctgccgttgtttcaggtcgaatgttccaacgtttgctggacgaaacaggacggccaaacagtctaaaccagcttttttcctaatgataaccaacaatgttggatttggtaggaaagcaaaaaaactcacgcaataagttcatttcttgtaagaacaacttgttctttttttctgagtagcctttttgaacactaaattttttgtaaaaaaccaaaatgatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggttgatttgcgtcatatgcccatttttgcttttttaatacatcgaacacataaatctaaatttaaaatttctaatcattgcattaggtgttgacctttttaccaaaatcatgctcatttcatgcgcaattcttttatctgattctgaaggcattcgggtcttaaaaatcgaataatccgcgacatgttcggggggggggggctatatccctctgctcactcgtcgtgtgatgttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtaggaaagcaaaaaaaactcacgcaataagttcatttcttgtaagaacaacttgttctttttttctgagtagcctttttgaacactaaattttttgtaaaaaaccaaaattatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaatttaaaatttctaatcattgcattaggtgttgacctttttaccaaaatcatgctcatttcatgcgcaattcttttatctgattctgaaggcattcgggtcttaaaaatcgaataatccgcgacatgttcgggggggggggggctatatccctctgctcaatcgtcgtgtgatgttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtaggaaagcaaaaaaaactcacgcaataagttcatttcttgtaagaacaacttgttctttttttctgagtagcctttttgaacactaaattttttgtaaaaaaccaaaattatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaatttaaaatttctaatcattgcattaggtgttgacctttttaccaaaatcatgctcatttcatgcgcaattcttttatctgattctgaaggcattcgggtcttaaaaatcgaataatccgcgacatgttcgggggggggggctatatccctctgctcaatcgtcgtgtgatgttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtaggaaagcaaaaaaaactcacgcaataagttcatttcttgtaagaataacttgttctttttttctgagtagcctttttgaacactaaattttttgtaaaaaaccaaaattatggcctagacaattattaaaacttactcgctcatttttatcgcgggtttgctt

SEQ ID NO: 179 - DNA, 2057 bp, Heterodera glycines
  misc_feature (95)..(95): n is a, c, g, or t
  misc_feature (98)..(98): n is a, c, g, or t
  misc_feature (108)..(108): n is a, c, g, or t
  misc_feature (140)..(140): n is a, c, g, or t
aaaaaaaactcaccgcaataagtcattttctgtaaagacaactttgttctttttttctgagtagcctttttgaccactaaatttttgtaaaaacncanaaattatgcnctagacaattattaaaacttactcgctcaatnttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaatttaaaatttctaatcattgcattaggtgttgacctttttaccaaaacatgctcatttcatgcgcaattcttttatctgattctgaaggcattcgggtcttaaaaatcgaataatccgcgacatgttcggggggggggggctatatccctctgctcacttggaaatatatgtccgcctatttagcttctcgtcgtaccagtgcttttctagcattgaaaaatgtccgaaatttggttctgccgttgtttcaggtggaatgtcccaacgtttgctggacgaaacaggacggccaaacagtctaaaacagctttttttcctaatgataaccaacaatgttggatttggtaggaaagcaaaaaaaactcacgcaataagttcatttcttgtaagaacaacttgttctttttttctgagtagcctttttgaacactaaattttttgtaaaaacccaaaattatggcctagacaattattaaaacttactcgctcaattttatcgtggttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaatttaaaatttctaatcattgcattaggtgttgacctttttaccaaaacatgctcatttcatgcgcaattcttttatctgattctgaaggcattcgggtcttaaaaatcgaataatccgcgacatgttcggggggggggggctatatccctctgctcactcgtcgtgtgatgttggaaatatatgtccgcctatttagcttctcgtcgtaccagtgcttttctagcattgaaaaatgtccgaaatttggttctgccgttgtttcaggtggaatgttccaacgtttgctggacgaaacaggacggccaaacagtctaaaacagcttttttcctaatgataaccaacaatgttggatttggtaggaaagcaaaaaaactcacgcaataagttcatttcttgtaagaacaacttgttctttttttctgagtagccttttgaacactaaatttttttgtaaaaaaccaaaattatggcctagacaattattaaaacttactcgctcaattttatcgtgtttttgcttttcatcgaagagtgttagtagttcgcgtttgacgcgatctgacaatttgtgtgccttttgttcgatgtcgtccattaatgttttgttggatttaggcaaaaaatcagaggtgggctgatttgcgtcatatgcccatttttgcttttttaatacatcgaacacataaatctaaatttaaaatttctaatcattgcattaggtgttgacctttttaccaaaatcatgctcatttcatgcgcaattcttttatctgattctgaaggcattcgggtcttaaaaatcgaataatccgcgacatgttcggggggggggggctatatccctctgctcactcgtcgtgtgatgttggaaatatatgtccgcctatttagcttctcgtcgtaccagtgcttttctagcattggaaaatgtccgaaatttggttctgccgttgtttcaggtggaatgtcccaacgtttgctggacgaaacaggacggccaaacagtctaaaacagctttttttcctaatgataaccaacaa

SEQ ID NO: 180 - DNA, 1935 bp, Heterodera glycines
  misc_feature (180)..(180): n is a, c, g, or t
agtttgtgttatgccggccgatggcaaacaaataatcaatatttatttggagcagaaagggaaaaagacacaaataatggggaggaatatttaaataacaagaaggaaaataacacaaaggaatgaagtgaacggggggggggggggttatttatggaaggaaaagcgggcgtgacatanccaagggagaaggagattacaaacaaagcaaagggtcaaaatgggcaccggccaattgggtaccatccccaacagtttgttttattgtaaaataagtgtatatgagaatgaaaaatggatgcttaattaaacaaaggaaacattgaaaattattgcttaaaatggcaccaaattcaaaattgcgtcaaaaagaaaccatttttgaaggtttgtttaattattttgaaatttaaataaaaatgataataatttacgcctgctctccgtccacctcgtccactttgttcagcagcaacaccactggctttcggaccagcgcccggtcgtactgctccatctcgcggttgagcagtgccatcatttccagggccaaactgtttgtattttaaacaaaaaattttttgcgataaaacattggcgatttgaaaacttttcagcccaatcccaaaaatttaattttttttttatttacattttaattttttggctaaaaattgcaaaaaaaaaacaaaagcaaggaaaatttttgaaaaaattatgtatttgaaaaacctaatattttatttgcaaaaaatcgtatttttttaaccaaaacttttcatgattttgattgtctcgcgggttcgattccctaagagttcggtcataattttgcaacaattttttttggtgttgtgtccacttctatgtaattttcttaattaattcatttttcaaaactttttgtcgacgatccttttttttaacagaccgccaaaattttaggggtttaaataaattattttaaaaaaagttttactggaaaaattattatattttttatgatttttgccgccagcgactgaccactttttgcattggctacaaaaagtagaaaatggactcaaaatcccacatcgattcacacaaaatgccacacattttgctcaattggccaccctcttctcccttttgtggcaattttggccccaccggttgcgcgacgcatcatccaaaatgcccggaaggtcggcgatggacagagtgaacggtgccgtcgaagtattgacattttccgactcaatttcctcctcgtcgcccattcggattttgttgaccactgacaacgcctcggacaattctttttccgcatcgtctccacagtcctcatctgttggggcctaaaaatggaaagaaattaaaataaattttggaatttgagttgtttgtttaaatgtatgtcgttcaattagcgcatttgagaaaattagctttttataacacagccgaagaaaatttttgaatttttaatgaaatttgtagaaattttttagaattttcttaaatcttatttgataaaaaaaatcggctaagattctctgttgtagtagcttttgatcatactctcccccctccctcttaatcaactcgtcactcctccagattccctgatcattctcgcctcccttctccccttcatctcttagcatatttacccttccgccctcggcatctcttatcattctcgtcccctcctcccccggcattaccaagaccaccggcttttgaacaagggcccttttgtcctgctccatttcgtggatgaacagaaaaaaaacttagattgggattttcttaaactttttcgttaaaaagtggaaaaaataatgaaacaacatttttgaaataactattttgattggggtaaaatggaagtgaattgaatgcatatgaagacggccttgccccatccatgtatagggggggggggggggg

SEQ ID NO: 181 - DNA, 2563 bp, Heterodera glycines
  misc_feature (14)..(14): n is a, c, g, or t
catataaaaataantggcttgaatacacacaaattaaaattggtcttttttgaattttactgaatatataaagcataacttaatcgaaattaaaatagattattaattaataaatttaatgaaaatgaaaacaatgattgcgcatcatcaatttttctcacagagaatcaatgcgcaacaaaataagaaaagaaatttcaaatgaatttattaaaatgtttaatgggttttaataatttactgaatttgtgactttttcagtaaaatttttcttaccatattacatccatattcatcataaaagattaatgataataatgttgtaatttgatcattatagaagatgaacgaaaagaaataataaaaatataaaatgagcaatttctattacattttgctttttaatatgtaaaacaaaatttgctaatttcaatgatataaaatcaaaagtgttaaaatataactgtgatataaactaaaaattgaaatgatacaagtgttaaaatttacaaaaagtaaatatagaactgattatgaaaaaaaacgtcacggatgcaagaaaagctaatattaaaaataacgaatagattattatattcattattattttatgttaattgaaaatgctaaaagacacagaaaagcgagataaataattaagtaatagcattctataaattattgcaatatggtcaataaaataagaaaattgttatttatgcaaaattataattgatataatttcactttaaaaaataaacaatgaaaatagtaaatccaaataaaataattttaaaatattgaaatatatcaatttcgtttaaaaaactattataatttcttaaaaacactaattactaattaagtcaaataaatgaattgaattttttaaaaacatataaaaataatataccaaagtagttaacgggtaacaaggtgctacgcctcccttctccccttcatctcttagcatatttacccttccgccctcggcatctcttatcattctcgtcccctcctcccccggcattaccaagaccaccggcttttgaacaagggcccttttgtcctgctccatttcgtggatgaacagaaaaaaaacttagattgggattttcttaaactttttcgttaaaaagtgaaaaaataatgaaacaacatttttgaaataactattttgattgaggtaaaatggaagtgaattgaatgcatatgaagacggccttgccccatccatgtatagggggggggggtgggcggagggcggagcggccacacttttcccgcgtccagacatttccattggatgcttactttttcttgctcatatgcaatccattacatttctaccgtatcagttggatctgattttccatttacgtctcatatccatcggtgagcgggcgctgcaattgagtaaatgtccttcccatgccgcccgcctccccccccccggcgcatcctccgtccgcttctgtcccacccaattcccctttctcttcttctttggctaactgatgagaatagtctttttttgtcgctgctcttttgcctgtccgtcctactgctaaatcctccctcctcgctgtggccattttgccatttcaatgtgcatttgttaatttccaccgctgccgacgctacccgtcaacaaccccaacagccaaagaatacaccttcagcagctggtggatagctgggacaagggtgggacgacgggcgatgggggcggaaggttgagcgggcgcaacacagcacacatatttaaatgtaaatgagaaatgaaaaagtgtgatgatcggagcggggagatggcggggggggggggtcgatgggactttgcttcgtggctgtttaacatatcctattgcaacaaattgtctgaatagccgacgttttgtccaatgacaattacggcttataaaagatttcataaaagtttgaaattaaatataagaaattaattttgtgaaaaattgccgctactgtgggactccggtttcaaattgatatccaaatggaatggcatttattcttttccgatccgatgtgttcatttaataataacattttatccgtttaattactttttccattttttattcctatgatagtttttaaatagttctttttaaaggatttcaatagcccccgatatagtgtttttttggggggggggggggagggaatggaaaggcatagaagaaatggagaggggaagaatttgaaagaaaaagagacaaaaggaaaagaaaataaacagataaacttttatttgacaatttttacacttgtgcgaagcattctgatcaccgatcgattgggtatgccgtttttgaagatcaccctgatttcttcacacgcatttcgctcacctttcttggcaatttcccttaatttttattttgccatgccaatttattcgccaatttgtgtgatgattgatcgatgcggctgttcgcggaatgtctggcccaattagtagtcagcaggggtggacaattactttgacaattgcaaatatttgtgactgttctaagcttcggtttcgatagtgttggtt

SEQ ID NO: 182 - DNA, 1903 bp, Heterodera glycines
agaaatgaacaaaaaatgtccatcaggttaaatgttgccattactgcccatgccattatgagttttgtaaaaggtgtaggacacatagtcttttgaattttggcacagtaccctccccgtgggcagaaaaatggtggttgtgcccaaaatgtgcggcatatgtcccatacaaaattggggacaaacagtatataaatgagttgcaattagaaaaaaacaaatataaaaaatatttaacgcccccttcactcttatattatcgggcgccactggaagcggtaaaacccaatggcttatgagattgttgaagcactatacagaaatgattagcccgcctcccgaaaaagttttatattgttattccgaaatgaacgattcggtcattgatttgatgaaacgcggcatagaaactcataatgggattcccgatcagtcattaatcaacagtcagccaaaacctctcctacttgtgctggacgatctgatgctgaacattaacaatgatttgttagaccttctatttacgcgaggttcgcataattggaacgtaaacgtaattttcgtaactcagagcctttatgggcgaaatattcggacagcaagagcgaacagtcattaccttgtgctgacacgtaacccatccggacagcttcaggtacggacagtcgggtctcaactgtttccaaagcgcttaaatttttttatggaatcatataccgacgcaacaaataaaccgtttagctatcttgttataaatatgcatccaaatgcaccggaaactgagcgtcttactagtaaaatatttccagacgagcgtagagtaatttatttaccgatcgaataatgatacgctaagcgccgcattgtctatataaagaaatgagtacggaataaatctaaaatgtatcaatttagtccttacgttagagaaaatacagatttcttaaaaaagcttgcggccaccaggtctgatataagcttggagtgaatgagcttgcaaatcacgtagagacggcagtcaacgctttttaaattcaaaggtaaaggcaccaagagctcacgaagaccctcatttccccgctgggcaaccgaaacagaaccaagaatagcaaatggaaaagctgaaaccgacagtggaaaaagaacttgagagcagaacgaagccaccagtctccaaaatatctgataaaaaggaaatgaaacgcgaacctgaaaaggcgaccgtagaaaaagagatggaacgtgaaccgataaaaacaccagaaaaggaattagagcgtgaaagcccaaaaagcggacaaagagttggaacctttaataacagaacagttaaaacaagacgacaatttgttagaaaaagcaaaaaatgaaattaatgaaaagatgcaagaagaaatccaaacagataactatattcaaaaggggttagaaaaggaaattcccgaagagccccaaaaagaactggagcgggaaaaaagtcaacaggaaaaaacggaaacagaattcccctcattcgggccgccgcaaatgggcccagtaattgcgccactcgctcttccgccgctggcaccggcgccacttctgctgccatcatgctcgaccttcgcgaacccattcggtgtacgcgcaccgccaaacaaatgcgcggtgtgcggacgccgttttctggcgcctcgtcgccattttattttgggtctcttcaattttaaaaacgataagtaaattttagatgatttaaaaccacattttagcaaagaaataattggattttgcctgaaattgttaatacaaattggcaccttgacttacttttttgacccaacatttatgattacttttatttgagttttttgtcttaaatcaatttttttaagtattttaattcataaaatggcatccctag

SEQ ID NO: 183 - DNA, 954 bp, Heterodera glycines
cctgtactttaattctgcgttggatttttgctcccataattgtttgagtaccccaaacggacacttgaaaaaatcgatttatttttgttttcggggcagtccccccgaaccgatgcgcccagatttatggggagaccgaatctttccggaatagcttccctatagcctgtactttaattctgcgttggatttttgctccccataattgtttgagtaccccgaacggacacttgtaatattcgcatgcatcgttatcgagacagtcccaaattttcttaaatttggtttgttaatagagacaaagtttggctatagaatggtaccaagaatgtaaaagttggttgctcttaagcaaagttatgacatgttttgtcgaaaaagtcgctaaaatggcggattttacgaaacgcccaaggtggcggattttacgaaaagctttcccacagatttccatttaggaagaattttaaaagaaattcggagaattaaaaaaaaaagattggcacagaaagacaaacaaaaaattcctgccgagatcacttgaattaatttttttttataattttcatttaaaaacatgggtttattccgcagttttaataaaattaatgagaatttaaataaataattaaaaatagtttatattgaaatattttatcattttaagatataattaaaaattaccaccataaacaaaaaattataaatgaataaattaatcattttatgctgagaaatatttttttaagtaaaaagaacgaagtgaagattattaattatggtgactaaaaaaattattttaataagtacaaaattccttcacattcatttaaaattaactttaaaaaaatcataaaagatgtagaattggtttgaaactcaaagacaattggaagaaaacgggagagaattatttttatttatttgtgtataaataatttttaacttaaaatt

SEQ ID NO: 184 - DNA, 3457 bp, Heterodera glycines
  misc_feature (725)..(727): n is a, c, g, or t
  misc_feature (731)..(758): n is a, c, g, or t
aaaaataaatattcatttctatctaaatttaatcttcgttttcagaaattaatataacttaagcaattatcagtttttatagttgcaacatttaccgcccttcccccacaaagggttgacgactcaaatcaatagccgaaaaggcatttaaatatcgtttttttatttaaatgaaaatacatattaacattattaatataaataatagtaagtataaacttatttttatagcattttaatattatgcaaacattgtttaacaccaaaacctttcttttctgggtatttatcacaaggacgtccaaaaaatatcggatataaagtcgcgaaatatggtcataaaacaagggcaaaaatcgcgaaatatggacctaaaatcggaaaaatatggatataaattttaaattgagttatattttcataattcaccgggccataactttatcgaagtcaaagagaaaaccgtaattaatcggtgaaaagttggggctaatataagagaatatttggcaaaaaagcttcactctaaccttaaggttagggttcggaccccgtgggcgggggtggctttttcgcgggggcgggggattgcgggggtcagagtcgcgggggcgggggcgggggtgggaaatttctcgcccccgggacggggggggggggggtttggtttttaattagctccaaaaatctttttatgggggtgtttttgtttaaaataaggtttnnntatnnnnnnnnnnnnnnnnnnnnnnnnnnnnggccaaaaaataagattttagggtcaaaaataagaacattttgcaaaattgcttcaaatatttttacattttattcgatcaaaaatgtattctattattatattttttataaatttcagtgcattcgggatcactaaatcagatttttaacattttttgcggcacatttccaaaaaacttggtgaatgtgcgaggggataggtccggtggtgccgattggcgccgcaagcggaaaatttttaagactatatgaattttgttaaaaattagccaaattttttagaaatttccctttttagatgaaaataaggtactaccccaaaaccagaacatttcttagaaatccgcgcccggggacgggggcgggggatgcgggggtcagagtcacgggggcggggacgggggcgggggcggggtccgaaccctaagaaaaagcgaagaccacaaaatgccaaatatttttgaataaatttttaataaattcaatcaaattaaagccatttttctctcaaatttcatctagaatttgcaaaaaatttcactgcggcgcctgtcggcaccaggggtgggcgaagctcggcttagtactcgaagccgaagccgaaggcgaagcccaatttttattcgaagccgaagtccgaagctcgaagcccaaaaaacccgaagttttcgaagttttcgaagccgaagccgaagttttttcaaaatttttttttaattccaaaaaattttttcatcacaaaatttcggttaaatatcaaatagaccaaccaacaacccctttcgataaataaatataatgatttttttaacaatgtattttctaaatttttataattcttagaatactcacagtttttgagtcaatttaaaaaataatgggaattttggaactccggcggtgccgataggcgccgacgggaaaaatttgaaattttagtgacagatttagttcaaaaatgaaaagattttgcgattttaattgttatatttatattaaatttccgtcgaaaaaagaataattttgaaaaattagaagaaaagaaagtacttggatgggaactgatcaaaagaaacataatgaaaagagcaaagagcactaccactcgaccatgcgtgcgaacaaaaaaataaaaacaaaaaattaataaatatatattaatttaagtttatcaaaagcccatcactaagggtgcattttcacattgaaaactcaatctttaggggtgtatttttcccgaaacttcgggtaaaatagccgaagccgaagcatgaagttcgaagctcaaaaaacccgaagttttcgaagccgaagccgaagtttcgcccacccctggtcggcaccgccggaccggcttttacttgttaactcggtagttttggacagacaaaattttcaaaaaaatttcatggcggcgcctatcggcaccgccggactactgttcccgaaatgtttttgaaaatgcgcgccgcaaaaaaggatttaaaaagcaactaaaatctataattttatggattgatcccattaacaatttgtccgccgatttctctctccaaacctctgaccccttaaaaatcttgatcaacccattaacctttttcatatacatataccgccagcctctaaaaaatttcttctttttttaatgaccaggtatatttagttttttggagattttcaaaatttaattctaaattttttcgaaatttccaaaattccgcaatcccgcgcgggttcccacaaattttaaatgcggtatattcttcaggttttaagtgcgtcaattggcaactgatggatgaattaaattgtacttaaaattgcaaatatttaaaattttatttttcagaatttgtcaataagattttgccagtaattaatggctttttttaatttattttgatcatttgcgctatttttgccaccattttataattgccacaatttgtgaatgtgtttcaagtttcattttcatttaaatttacctaaaaatggctctatttcactttatgagtctaatcagagtttatgaatcaagatcaaatacttgtgaatctacataataaattttgattttgattcaactttttgaagaatttatttatttttatttacaccagcagcagtaaaaaaatatataaagaaatttcactttgtttttcgcaagcgatctgaaacaacaatacgaccactgttcggtataccatcggatgtagttcgttgatccaaatgaccaaagattgcataccagggatgacatccgagcagggattcacgcaactggatttcaattacggaaatccgtcatccataaaattggttaagagtaatttatgatcagaatgaaagctttgaatgttttttgaggcaaaaaacccaaaatattggccaaaatcaagagaaaaatagcaaaaatagggcaaaatggcagatttagagctgtggtagaaaagtccaaaaaactattaaatttcaataatcttttagaagtccttttaaaataaatttaaaatgattgtcctggtttggcgatgccgaaaggcaaataaattataatgtgtgacgtaaaatgctttctttttgaatttttagggctcattttgggaatgatttgtgaaggggtcccggctatgtaaattgacgaccttttttaagtttttaaaactgctttttcatggcgtgttttttccaaaaactg

SEQ ID NO: 185 - DNA, 5308 bp, Heterodera glycines
  misc_feature (5263)..(5263): n is a, c, g, or t
  misc_feature (5280)..(5281): n is a, c, g, or t
taatttccgtaatccggaaaccgtaatccgcaattgcgtgcagccctgattccgaggcccctaaaattgtcggaagttggaatttcctgccatccctggcgcatacactaagaagagctgatatggagggcacttaaaaatgatttacgacatttgcactgaactaactctgacatgttacactgcaattttatgtcaattatttttgttgttttttagattatttttatcgcttttttgggactttatatttacaattaatatctaaactttttgcgtgctgggtcgtttcttaaaaactgccaagtgggcgtttcttaaaaactgccaagtgggcgtttcttaaaaactgccaccttgggcgagaattaaactacaaattaaaacaactatatagaaatattttatctaaattttattgatataaagtttgtaaattaatatatatattccagtatttcttttttaaattttcttattctttaaaatgttcaccaaaaacatgaactgacaagcataacaaattctaaaaaataaactatttaaaatactaataaatacagacttttgttaatgaacattcagcactttcatacaaacatttgcaaaagcttttgtcgcaatcgtagcgttttttagatttgtttatatagcataaagcatggtaataacagcaatcatcgactatattattttaaaatgtataataaatataaaatacttttttaaaccttttttaaagttgcaaaaccatattactggtgctataaaacatgagtcaaaaaatgaagtgccacaataagtgctacaatatttctttgcaactttcaaagggaaattttaattataataagcttatcagtaaaaaatttaaataattaatttatcaagaaaaaatattaaatatatcgttgagctcatttgtaaattttattaactacaatcatcagaagcaataaatttattaatattttaattttactgaacttggtgttgaagatagtgttgacaaacaaatgatgtaaaaattatatgtatatatatttttattatttataacgttggcaaacaaatgatgtaaaaattttttagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgctcttttgaattcaaaaagattttcttgaccctttggataaaacaaattttatttaacaaaattttttttcatctttcattttttgttgagcaaattttacctttttcgcaaaattatttaattattttttctcactttctgaaacaacaaataaatgttaataaatgaagaaaaatagattttatacagaataaaaacatataatgctgagcagataaattcaacaaaaaataagttattttctttaaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagtgctccatttgaaagcaattaaatagtcaatttttaatgcattttttctctttggttaacttatcattaaccaaaacaaggattgttaaagaatttagaattcacttaaataaggtaaaaataaaagataaattcgatagtttttttcgaaatgaaagagcaaacattcggaattttgaattctttttttaactaatttcccaactgcaaatcggctgaaattaaaaatgatttatataaattttgaaatcatcgcaaattctctttaaaagcacatataaagccttttcctaggaacaatataattgttttgattagaaaaacctcgaaaacaaaatttcttaagaaaaattggttttggtggtgattttaagaaagtcatccacccatcatttttagtggttaaagtcatcttttgaggctccaatattaaattttattgtattccgttaagaaatttaaaaattcatttcggcacaaatgccaaaaaaggcaaaatggggatacaaaagtcatactaatggttttaaaccaacctaaaaatgctttttaagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgctcttttgaattcaaaaagattttcttgaccctttggataaaacaaattttatttaacaaaattttttttcatctttcattttttgttgagcaaattttacctttttcgcaaaattatttaattatttttctcactttctgaaacaacaaataaatgttaataaatgaagaaaaatagattttatacagaataaaaacatataatgctgagcagataaattcaacaaaaaataagttattttctttaaatatgaaaattaaaaaagaaaaaagcttacaacaccttcgattcccaggacgtctccgttccaagtactaagaaggcccaacgttgcttaacttgccagatcagacgggatggcgtgttttcaacgtggtatggtcataagcgcaagggatccaattgaaagcaattaaatagtctttttatatttttcttttttgattaatttaacccagaacaataattgataaggtatttagaattgaaagagaaaaatttattagttttcaatgaatcagcgaaaaatttggaattttttttaacaaaattatttccaaattcgcaagtctttagaaaaattgaaaaattgataacattttttgactttcttcacaaattctctttaaaacctatacataagccttttcctatacgtaatttttcgaaaatttgaattttcaaatgactaaaaaagctagagaatcagaaaataggttaagaaaattaattttaattgtcaatttttaagacaagtatcctccgttcttagtggtttaagtcactcttttttaaggtgccattttttttattccgataaaaaaccaaaaaaaaaacaatttcggcacaaaatgcacaaataggcaaaattgggacgaaaaattcatcctaatagttcaaaaccaaactaaaaatgttttttcaagcttatgacgataaaaaacataaagcgaatgacatttaaaaatgatgggcctaaattggaaaatctaatgaattaaaaaaagttaaattcaaatgtttagcctgactttatagctgttctttcgaatttaaaaagattcttttggcccttagggtaaaagaaaattcttttaaaatttgttcacttttcatttcacattttttgttcagcaaattctatttttctttctcaaagcggtttaaatttttattaaattttcgacttccataggcaacaaataaatattattaaaaataagaagagatttttaacaagccacaaagttataggaagaagtaatttcaagcaaatgaataatttaacaaaaacaaacaaaaaataattcattttcttacaaaacaaaaaataaaaatggaaaaagaagaaaaaagaaaaaagcttacaacaccttcgattcccaggacgtctccgttccaagtactaagaaggcccaacgttgcttaacttgccagatcggacgggatggcgtgctttcaacgtggtatggtcgtaagcgaaagtgctccatttgaaagcaattaaatagtcttttttataatccatttttcttttttgattaatttaacccagaacaataattgataaggtatttagaattgaaagagaaaaatttattagttttcaatgaatcagcgaaaaatttggaattttttttaacaaaattatttccaaattcgcaagtctttagaaaaattgaaaaattgataacattttttgactttcttcacaaattctctttaaaacctatacataagccttttcctatacgtaatttttcgaaaatttgaattttcaaatgactaaaaaagctagagaatcagaaaataggttaagaaaattaattttaattgtcaatttttaagacaagtatcctccgttcttagtggtttaagtcactcttttttaagatgccattttttttattccgataaaaaaccaaaaaaaacaatttcggcacaaaatgcacaaataggcaaaattgggacgaaaaattcatcctaatagttcaaaaccaaactaaaaatgttttttcaagcttatgacgataaaaaacataaagcgaatgacatttaaaaatgatgggcctaaattggaaaatctaatgaattaaaaaaagttaaattcaaatgtttagcctgactttatagctgttctttcgaatttaaaaagattcttttggcccttagggtaaaagaaaattcttttaaaatttgttcacttttcatttcacattttttgttcagcaaattctatttttctttctcaaagcggtttaaatttttattaaattttcgacttccataggcaacaaataaatattattaaaaataagaagagatttttaacaagccacaaagttataggaagaagtaatttcaagcaaatgaataatttaacaaaaacaaacaaaaaataattcattttcttacaaaacaaaaaataaaaatggaaaaagaagaaaaaagcttacaacaccttcgattcccaggacgtctccgttccaagtactaagaaggcccaacgttgcttaacttgccagatcggacgggatggcgtgctttcaacgtggtatggtcgtaagcgaaagtgctccatttgaaagcaattaaatagtcttttttataatccatttttcttttttgattaatttaacccagaacaataattgataaggtatttagaattgaaagagaaaaatttattagttttcaatgaatcagcgaaaaatttggaattttttttaacaaaattatttccaaattcgcaagtctttagaaaaattgaaaaattgataacattttttgactttcttcacaaattctctttaaaacctatacataagccttttcctatacgtaatttttcgaaaatttgaattttccaatgactaaaaaagctagagaatcagaaaataggttaagaaaattaattttaatttgtcatttttnaagacagtatcctccgnnttctagtggtttaagtcactctttttt

SEQ ID NO: 186 - DNA, 2757 bp, Heterodera glycines
tacaaatctcgtaatgacagggacagtaatgacaacacttaattttatgtgggcagttcatttttcaatttaattttattttgggttgctatttatagaaggggtatataaagggagtgaaaggaccatttgattgataccttgtatcaaaaatgcaaaaaccgataatcgtaaatataattgctctcgctaatctcggtaccggaattaaactaaactctctgacgatcaccgaatgcgaatttaagtataaccctagaaaattcaatgcctcggttatcaaatgtataagccccatcaaagccacggcattattatgggaatccgggaaaatgatatgtctggggacgaaaagtctgatagactgtgaaaatgcgataaaaattttcatagaaataattaagggctcggggtgtccgggggcttcttacaccggacacacgattgaaaatattgtttcgacctttaaattcggacatgaaattgaactgaacgaattcagaaaaaatcgtcgtgccttttatgaaccagaaatattttgcggtttaaatttcaagcggggtaaaagcatgacagcgttaattttctggaccggtaaagtcgtaattacgggaactaaaaacaattctgaaattgaggaaatgtatcatcatattctcccctatttgaaaatggctcaaaagaatttaatgagacgataaaaatttttatttattgagacggtcccgaaattcttgcagatgacctacttttgaaaaaaattttttttcaatcctaatttattattcatttttcaattttatatttaaattgaatttaaataattaattttactgtaaaattcattaatttgctgcaattattaattaaattagcacttctacaatccattatcgattaattggcgcggcggcggcatcgtggcgcggggagggagggcgtggaggaaatgcaaaaaaaaaacacactttggcaaattttcaaaatgagttttaatttcaggatcagaaaatcatataaaaatctcaggatttgagaaaataccccaaaaggtttgggatcaaaaaaaaggaattaattttttggaatcaaaggaatgcgcatccatcccttaggatttggttcttggcggtaaatgtccacggcggctacttcaaagggctgcgcccacgggctcgtgcgggaaacacccgcaacctttaggggtcatatactacttggggctataaaagtcaaactaaaatgctttttacaccttatcccggtaaaatcagagagtgaatgacattcttttaatctgaagaaattcggagaaaaaataatggacataaaatgagaaattcaatatgattttttaagaaactgaaattaacaaattgatcatcacttttatagctgcgttttcgaattcaaaaagattttctggacctttggataaaagaaattttatttaaaaaattttttgttcacttttcattttttgtttagcaaattttaccttttctcaaaattatttaattattttttctcactttctgagacaataaataaatgttaataatgaagaaaaatagattttatacagaataaaaacatataatgctgagcagataaattcaacaaaaaataagttattttctttaaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagtgctccatttgaaagcaattaaatagtcaatttttaatgcattttttctctttggttaacttatcattaaccaaaacaaggattgttaaagaatttagaattcacttaaataaggtaaaaataaaagaaaaattcgatagtttttttcgaaatgaaagagcaaaaattcggaattttgaattcttttttttaactaatttcccaactgcaaatcggctaaaattaaaaatgatttatataaattttgaaatcatcgcaaattctctttaaaagcacatataaagcctttccctaggaacaatttaattgttttgattagaaaaacctcgaaaagcaaaatttcttaagaaaaatggttttggtggtgatttttttttagtggttaaagtcatcttttgaggctccaatattaaattttattgtattccgttaagaaatttaaaaatccatttcggcacaaatgccaaaaaggcaaaatggggatacaaaagtcatactaatggttttaaaccaacctaaaaatgctttttaagccttatcctggtaaaatcagagagtgaatgacattcattaaatctgaagatattcggagaaaaaataatatacaaaaaatgaaaaatttaatatgattttaagaaaactgaaattacaaaattgatcatcacttttatagctgcttttttgaattcaaaaagattttcttgaccctttggataaaacaaattttattttcatctttcattttttgttgagcaaattttacctttttcgcaaaattatttaattattttttctcactttctgaaacaacaaataaatgttaataaatgaagaaaaatagattttatacagaataaaaacatataatgttgagcagataaattcaacaaaaaataagttcttttctttaaatatgaaaattaaaaaagaaaaaagcttacaacaccttcgattcccaggacgtct

SEQ ID NO: 187 - DNA, 3353 bp, Heterodera glycines
  misc_feature (3325)..(3325): n is a, c, g, or t
cgctcacctacagcaggtgggactggcgcgaggtggagaagttcaaccccaacttcttcttccttgtcctgttgccgcccatcattttcgagagtggttataatctgcacaagggcaacttcttcgccaacattgtgcccattttgttgctgtccattgttggcactgccatttcggcattggttatgggcttttgcctgtacgcgtttggacaggttgtgttgacatttttaggggccggtaccctattcggatgtaatccgatcccgaataagtaatcctaaccttgggattgacatgtttgtttccgcaatttttggagacctctcaattttctgattgccgaagtttttgaatttttttgaaccctttccaatcatcgagtccttttttaaaacttcggaataaaaagtgtcaagtttgatcggcccccaaaatgccttgaagaaaaatttatttattttttcaaggctgggctcatctacgagttgaacgccatccaatgctttgcgttcggctcaatgatttcggcggttgacccactgatcactttggccatcttccaagcactcaaagtggaggtgcagctgtacatgctcgcctttggcgagtccatgctcaacggttagaattttttttcaattccgagcaactcgaaaactgcataaaaccctcatttgtattggggttttctggaggtcggagcattcaaaaaatataggtgtacgacgttccccctccctcatatcgttcgttaccttcgaaaattaaaaaaagcaaatgagaggtatttcaaaaaatagaaaaaacacttatatgaaaatttcaataataacaatttttaaaattgaataaattgttaggaaaatggggaaggggcgggaactagctattcccaaaaatataccatggaagagaaaaattccatgaccgaatttatatcataactaaaaatagcacggagaatagctgtattccaccgtcccccgctttcgaaaatttaaaaattggaatttaaaaataataaattttgagacatttctaaacacttcatagggtaatacggttgctctcttttggattaagaattcccggtatttcaccatttttaaaggtatcccatttcagacgccgtttccattgttttggccaccactgcgcaagagctgtcctcgcccgacgttgccacgatgagttcgtttgccatggttcagttcgcttttctccgcttcctggtcatgtttttcgcatccgccgccctcggcgcactgatcggactcatttcggcgttggtaatgcataatttttaagtaatatactgaaagtgccttttcccaattccaaacggcattatgtgtattttcactaaattgcttttccatgtttagctgttcaagcacatcgatttacgtcgaacacctcagttggagttggcccttctgttggtgtttgcctatttgccctatggactggcggaggcaatttcgttgtcaggttggcaactttggaatggaaaccatcgattcccagtattcaaaaatggaccacaaactcaaggtggacaagggagtgggctcaatttcgtaaatcgtacggggctccgaggcaatctcgtaaaaaaaattggcctctgagaggggagggcggtattttatctttcgtaaagacaaattccagactctccccaccccttgtccatgtatgcatgccacaaaccctgttcattgcaaaaatcatgttaaacaccatttatttttggtccattttccttataaactctccttggtaattttttttttttgcgatttcctaattcaattcctatgaaattcaacacatccccccttttttcaggcattatggccattctgttctgtgcaattgtcatgtctcagtacacccatttcaacatttcgccaatcacccaaatcacattccaacaaacatttcgcaccatttcatttgttgcaggtcagtgataagatttaaatgatttttttaaatctttgcccttttgtttgtttctatttttttatttggtattttgtattttatttgttcgaaatttggggttttcctctttttgattccgttttttgcactgttttcggaacacataacaattgaatacaataaatactgttttgaatatcctatcacatccattttctgtcctttttttcaattcccaccaaattttcgttcgattttttaaaaaggtttaataattccacaattttttattacaaacacatttggtcaacctttttccccgttctttagagacgtgcacttttgcctatttgggcctctctctgttcgccatcaaattggtgttccatccgatgttcctcattttcagcattgtatttattaccacccacaaaagatgacttttttcaaaaataatcattttctaaggttcttctctttgcaagccgtgcggccagcgttttcccactgtccgacctcgtcaatcggttcagcaagacgaaaatttcgatgaaaaatcagatcatcatttggttcagcggtgattttttaatgttttttaataatacattgatatcctcagacaaaggtcttcttctaattgatattttgaattatataaaataagttcccgatacatttaaaaaatataacttaataagtttcaggtctcaaattcttgcttttttatgaaatttaaaattttattgaccacattaaaaattttttaaatcaatttcggtacattttaaaaaaagtttcaccccatacatttcagtttttccaattgctctcttatttttttttacaaaaatttaccaaaattttatatgaaattttaaattattactaccaaatttcaatgaaggaaaaagaaccctatagaactattaaaaaaacaaattatttaattaccccccccccccccccaaggaatgcgtggcgccgtggcgttggcacttgcgctgcacatggactggggcacggacgagaacaagggcgtcattctcacctcaacactgttcatcattttgttcaccatcattttcatgggcggttcagcattaccactgataaaagtgagttgcaatgatggcatagggctaacaataaaacaccgagcaaatttcacccattgcattattaaaatagttcgggaatttcaagatctaaacattttaatcttattacgaaaaaaaattttatttttaaaataaaagtttttgctgatttttaaccagattttttcaaaattttagatgaattactaatttttcgaaaaaaatttgtttttttgattttcatatgaaatgcaccccttactttgcagctnttacatgtacaaattttttgtttcacta

SEQ ID NO: 188 - DNA, 9690 bp, Heterodera glycines
gcccagaattttttttttgggaccatacttttttttttgtttgtcaattgtccgctcgcgcaatctgtttgtttattgttattttgccaaaagtcccaaaaaatttcgtttagtttcaaaaaagttatgccactcaaaaaactagtttcttggaacttttttgctgctccgatttttttttttttgtaaattttcacaaattttgctttaaaagagtttgtcaagtgcttttgaattatgccaagaatgtttaatttggttgataaagaaaaaatttatggtccaaaaaattcgtccgacgatgtttcggcagatgacattctgtcctattccgccacattaaacatttttaacgtcattagattgatctaaaaaataagaattctctcgattaacctaaaaaattttcatttggtttcaaaaaaaatatgatgaaaaaattttaaaaattaatttttctaacttttttttccataaatcattgaatcttaggtgaattttttccaatctttttttgttcttacctcgccgagcgaaaacgattaatattttttatttaacccttttcaaagcggggctttcattttatagttcacccataatccccaaaattctttattttatattcgttaattgaccattttttgaattatcattttccaacaaatatttttcgattgctgcaaaattcatatgatatttttagtatataatttctcgtccatcccaaaaataaattgctgattaataaatattatttaattttcaatcgatttctcagcattttttttaatcaaaaaaaattctcattttacctccgccacccttcagcaaacagcacatttttaccgctcaatcagcacactaaacggtggggttaacgtcaacatgcacattttgacgagaaaaataatgccatccatcaatcaaatctcgagagccaaataattacccactcaaataaaaaggacagcttctcgggagaagccaatttgtctaaatgaaaattcagagatcgcttcagcagcagtgaaagaaagccttgattataaactttcatttttttttgtttcaaaaatgattgataataacaatttttcgtttagtttattttccgcaatttttacgaaataatttttattttatttttatttagaaataaaaataattttttatcaattgttaggagtttataaacaataaataaaataaagacgagattaaattttgtaaatttaattgaaattataattttatattaaatgattcttttttgatcaaaaaattaaattactaataaattttttggttaatttagtttttttaattttatattattttctttattaaaatgcaaattttatttaattccatttttattttaaaaagagccaaagaattacccactcaaataaaaaggactgtttctcgagagaagccaatttgtctaaatgaaaattcagatatcgcttcagcagcaatgaaatccttgataaagatttttgattattttttgtttccaaaatgattgagtataacaatttttcgtttaattattttcagtaatttttaatgaaataatttaaaaacaattttttatttagaaataaaaataatttttttatcaattgttaggagtttataaacaataaataaaataaagacgagattaaatctctttaagaatcatttataaattaatttaaataataattttatataaatgatttttttctctaaaaataaattacaaataaaaattttttgtgttaattcaaattttaatattgtatcatttccctaattattaaaaataatttttattttatcaatttttatttaaaaaattcattaataaatttcaatatttttttattgtgtttttatttaattcaaataaaatttttagttgaaagaattcctgtaaacataaaaaaatatattaagaaggtttccagttaaattaaaaatttatttagaaataaaattttttgggttaattcagattataattttgtatcatttccctaattattcaaaatgtaatttttttatattccttttatttaaaaaatcattttgaaaaattttaaaatgctcatccgattttttctccatatttatataaaatttaattgcatttttgatattttattttatccattcccctctttttccattcccctctttttccattcccctctttttccattcccctctttttccatcaaaaaattcaaatcgataattcccacaataattatcctcctcaattaactataatgagcaaacgacttcgcagtgaaactgacgaacttctttctgccaaaaatcccgacctttccattcttgaacaacgaatgtcacgactcgaaaatttgcttgagaggcttttgccagtgggcgtgggtccaattccagaagatcctatccagcgccttgaaaagcggatggaaaaattggaaaatcaagtcacggcacttgttctggcactcgaaaaacggccaatttctcaacaacaacaaactccatggggttgtcccccggaccacatcatccggcacataaatgctgttgttttggactctgacatcataagagaaaagtcaaaaagagctgttgtggagaaactgcctgagggaatcgatgaaaaggacgtggtcaaatcgattgctgaaaaatgtggtgtggctgatgaccttattttggacgaaatccatcggcatcccaaggaaagaagtgagtcgaccagccaaaacacaagaaaacccagaattctcaaaattccattcgcatccactgaatctcgtgatatttttctgaaaaaattccgtatggcactatccaatttaccaaattttccaaaatttctgagtgccagacgggatatgactcagtccgagctctccattctttacaaccttcgctcccaagcttataattcaaacagtagctgtggactttttaaatattatgtgtccgatttgacaattcgtgaatttgctaatcccaaaccctttagaactcatacgaataaccactaggggcgactgagcaaaccacctaaaagtttaaatttaaactcagaaaaagcaattagcaaaatgccttggattaattccatattaataaatgcccgttcaatcgcaaacaaaatagctgatttagaatatctaattgagacaaataaacatcaaataattttgataaatgagacttggttaaataccaggaatacaattacaactgagttaacacttaatggtaaatttcaaactgttctagcaaatagggacaataagagaggcggcggatgtgctattttggttagcaatgaaattccatttaaaataattttatcagaaagcagaaaccaatgtgaaatcattcatattattttatctttaaaaagtccaatacatattataaatgtttacagacccccaaattgcacaacacaaaacactaaaaaaatgctaaaatatttaacaagtgtaaatgaatcaaatagaataatttactgcggtgattttaacgccccaaatattgattggaacacaaataaattattagcaaaaaatgacccagttgcaaatgctttcattgactttattgaccaaaatcaattattacagcacgtaaaagaaccaactcgagaaaagtcaattttggatttgattttttctggaaagccttccattgttaatgatattaaggttttagaacatttttctacatctgatcacaaaatgatcagctttaaagtttctcaagaaataaataaaacccgtgaacccaaaatttttgtaagggactttagctacaaaaactttcaaaaattaaatcaaatgatcttactaaataggcttagttgtgtcattaatacgaaattttatttagaagaaaaatataacacacttttgatagagttaatgaaagcatttaatcatactattcccaaaaaaccacttaaacaaatagttaagcaatcttatccacaaaaaattagagatttatacgatgaaaagcttaaactacacaagcttatcaagaactgcaaggggaatgaaaagtataaattaagttacaaaattgtttccagggtgcataaaaagcatttaaagcaattttgggataaaagggaaaataatattatctcttcagggcaaaaagcattaacaaattatgtaagaaaaaaattaaatccaaaaaactccattccttacttaatcgataacagtgggaatatttgctttgatgaaaaggaaaaaagtaagctattagcagaaacattccaaaaagtatttattaaaaacaatcaaattttcgattattctgaaaataattctccaagggaaaagcttctgatatagaaattaatgtgggaattgtatggaatttactcagaaaactgcctgggcgaaattccacgtctccagataatattccatatattctacttaaaaactgctcggaaacactagcagtaatattaagtgatatattcagactaacacttgattctggtcaaattcccaaaatttggagaacttctatcattgttccaatatataaaaagggtgaaaaatctaatcctgaaaattacagacctatctcacttacgagtacggtctgtagggtatttgaaagaattttggcaaggaaaataattgaatttttgaataaaaataatttcttttcgaaagagcagtttgggttcttaaaaaacagatccacgacaacccaactattacagacattacatgatttttacgaagccatacaaaatcaaaaagaggttgatgtcatttatatcgatttttccaaagcattcgattctgttcctattgatttgttacttgcaaaaattaaaaatgctggaatagttgggaaaattttggtgtttttacgtaacttcttgtcacaaagaagttttagggtaaaaattgaagaccattattctgaaagctataatacttatacaggggtaccacaagggagcgttttgggtccattattattcctaatatttatcaacgatttaccggcaaatatacctaaaaatgtaaaaattaaaatgtatgcggacgatgttaaattgtatattttccatcaaaatgattcaaatacaaatgatctatctgaagctataaaaattcttgaaaaatggtccaaatctaacggccttgaaatatcggtcgaaaagagtcaaacattgtatattggcaaaaataattcaaaaaaagagtattttctcaatggaaaaattattccaagcttagaaaaagtcaaagatttaggagtaataattgactctaaattatcttttgctgagcatataaataaaataataaaaaatgcttacttaaaggcataccatattttgagaataatgaagactagagagctaaaaactattataagaatgtataagacttatgtcagacctcaattagaatatgctgttgaaatttggaaccctaacttaaaaaaagatatagaaagaatagaaaaagtccagaaatttttcacgagaaaagcctttaaaaaatgcggacttttacatagatcatattcagaaagacttgaaatttgtcagcttatagaattagccaagcgaagaaatattgctgacttaactaccgcttttaaaattatgaagggttttacgagtcttgatgctagtaaactttttactttttctgatcgacccactcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtattttttgacattatttattttgattttttttatgcgccacataagagcactaatgtgcctgtggtttgctcaataaatatatatatattaaaaataatttattacaattgaaatataatcaaaaaatgttttgttttttttgattaactttttatgtgttttgctgcctaaaagcgtaaataaaaatttttatttgcctatttttagtgcctgtatcattaaaatcccgaaatgtcgggttactaaaagtcagttcaccaaatttcggatccccaaaagtcgttatgtccccaaatgtggtgccattttcaaaagagaaacattaaatgtaaagataatcgcattttgctgttcttcattgctgttgcacattgttattgtttctgatgttggcattgtttccggcataatttggtgccatccatgccatggcattttgcccgtttgacaccgaattattgccattgctccacaaaaagcgagaaatggcatggcaaaagttggcacaatcgttccgatctcaacaatccatgcaactgttaattgccagcaacaattcgtcacttgtttccgcaaaccacaaagctttaattttcaaaataataaataaatattaaacaattatttcatacccatcccaaatgctccggttatataaaacctcaaaaatgaaaaaaagtgtgatcaaaatgtatccgttcacaatgtttgtccgttgttccagtggattttgtccgcattaaatccgtcacatccgtataatttgtcaaattcatcatggcaaagagacaaaatggcaaccaattctcagaggaggaacgaacttttcaaattgtattcaattatttctttgtgaaaataccaaccagataattaattgcccaagctgtttattaaagcagctgaaatttactttttatgagtttacttcaacattactaattagcatgtgcattcaacaataattaactttattatgagtgtaatatgacaaggtaaaattaattataagtcattatgaaaaagaaaagccgcgactggaaattgctcaaaattaaacaaagcaattaaatgaatttaattgctatatactctgacaatcatttgggtgaaggatttgtcaagtataaattttcgacgctatttttcacccatattttccgaaggaaacatgtgctcaactgttgattgtcacctgcgatgagtcatagttacgacggcacagaataaaaaccgtgctggcgcgtttcttaaaactgccatccttgaaaattgttcaaaaaattttcaaaaattaattttttttaaaaaacttaaagaaaattttcaacgaaaaattctaagagaaaattagaatttttgaagaaatatttctaaataaaaaatgtaaaaaaaattcataactttactcaactgcaaccaatattttatggtatcattcaatagctttaattattttctatcaaaatattaatacttaaattttttacaaagtatataaaaaagtttgtattaaaatttaaaaatttttagtttttgaaattctagtgtttaatagattatacaaaaggttttaaactccaaaaagaaattaaatttcaagtcattaaaatgcaattcaacgattttttttagaaaagttcataattttttatttattaatttacgaataaaaattaattttcccatgtttttataatattccaaaaatttttaaaaatatttttcaagttttcaaaatttttcaagaattttcttgaaattaggggggagggcagttttaagaaacgtgcatggcttttagttttatggctggcagtttttaagaaacgcactagcaccataaaaaccacattgagaagtgcccggcgaaaatctcctttggctcccgtccgtacatcttccaaaaaaataatgaatattgtgcatttattgtccgtacatggtggcccccttttttggtgcaaatggaccgttatattttgtgttcctgttttaaaattttttaatccaaatttgcttacaaaaaatcgccgaccaaaaaacaagtttggaaaaattatcatcacgttaattagaaattctattttttatttatttacttatcacataaataaatttcatcagatatgcatgcataaatcacttattctgactactgttcagaataaaagtatcgtagatgaagtgagaaaagaagtggacgaaatcacaggattagcaagataaaaatgcgaataaaataaaatcaggtttaaagtaaaactgcggtagacggcataaaataaaaatattttcacgtaattcatattttagaaaataggggtgggtgtattatttctcccgaaatccaggacaatttatcagaagctgaagctcaaaaaactcgatgtttccgaagctcgaagccgaagtttcgtccatccctgatccccctacgccctcctcgattttggcgtcttcagtgcagaatctgatcagaaagaattctttaattgctttgtttaaattttgagcaatttccagtcgcggcgttactttttctaatgacatttaacaaatattacattgccgaaggcatttaattattgtttaatgcacatttgaatgccaatgttgacgtaaacacataataattatgttttcagctgatttaataagtacccaggggaattgtttggtaggaattttgtccaaataaaaataaaatgaacagaattcataaaagacgagacgacaatttttccatttggagttggttggttggcattttgtcactccgatggaactgttgctgtttcgtcatgatgaatttgacaaattgtacggctgtgagggatttaatgccgacaaaatcccacttgagcaacggacaaacattgtgaacggatgcattttaatcacactttttttcatttttgaggtcactttttctagggcagcgttttctagaacaatttaaaataattaaaaaatcgataatatttaagatactgtacgttccgtgtatggtatcaatattcaaaaaaatgtacgacaacccatgctacaaaatgctgtttttcattggcatattggacatggttataaaaaaaatgttttaaaataattaaaatataaaatttacttaattactatgcctagttggccttgctaatgaatgcgttggaaaccgggattcttggcatcattggtgccgtttattgtgattatccattgctgatttatacaaccggatcaatgggtctttgtatgtttattttttattaaacagtatttttttaaattattattttaaattttggttcagccttatggtttgctgaaacagctgccgaatttttgctggcaattaaccggtgcttggaattgctgaaaccagaactggcatacgtcattttcaatggtattttctcattgcattattaattagtgaaaaataaaatcaatttaaattgtccatatttaaattttgtgaattatctcgttctaatttcaaattaatttaaaaaggtaacaaaacttggtggttatgtgcggtgccaatattttattccattgcaatggccatgttcacgaagccaattctgttcagtgggctaaatttggcatggtttttcaacccatatgttggctacacggacgattttggaaaaattgtaagaaattaaataaaattttataaaaaaaaagaattacagtaccacaacacgctgcataccgtacacgactcttttgtc

SEQ ID NO: 189 - DNA, 1000 bp, Heterodera glycines
aatgatgtccgagactgaaaatttctcgaggcaaataccaaaaaaagctgttaattttctcgagtcgagactctcggacatcattcacttctcccatgctctctcttccaaccgcgcactccatccgtcgattgatttctgtggaattttgaattgaaaacatcattgtttctgttttatatcatcatttgtgtgctactattactgtttgtataactattttttttttcgatttttattggtttatctgccgggattttcctccataattcgggcccaattttcgacacattcgttagtcggctcactttttcgttcaaaaattcactatttatttctgtgctgcgctgaaacacatccttttcattttgttagaatgtacagtaatttggaccgaatttgtaaagacaaaagtaagtgtaattgtcaaaaaattattgaggaattgtcatttgtcttgaacatcttcacagatcacactaatgattcaacccccaaatccaccaaaatatccattcaaaaaaaattctctatttttgcaactcaatacacattttatttatattagtgctcgacgacgctccggcttgggctttgccccggattttcccacgctatcctcaaaaatgaaaatccggaccccgacgggtacactaatgtgtcatcgttttccataaatattatttgtctaatttatgtatttatttgacaattttttctccctgtgggtgattttttatgagtcgaaaatagccaaacaaatccattaaatatgcatgtgcaatcattcattcatcaattaatgtcaaattctttccatttttgttgtttatataattttgatcttttgcaatttatttttaaaaatattttagtctttttttcatcaacactaattagttaattggtcctaattatgcttctctgcctcctgttgtaagttctgtccctcactgtctgtctgtcttctctattcatagtttttaatcaaattcccagt

SEQ ID NO: 190 - DNA, 1048 bp, Heterodera glycines
aaaaaaaaaaaaggtaaaaccctaaaaatatcatccctagtgatcagtgatcactccagagcaaatttttgccgattttaaagcattttttggcatatgcttctatttaaaaatttcatcaaagcatttttctagggttgagcggtacggtactggtactgaaaaaacggtacaactgagtacctagtacccgttttgaccgttaccggtactagtaccggttttcccagccaaaaagtaccggtttttaacccgaaaattaccggtacaggtttttttttacaattaacgattaccgctcaactctacatttttctcataatttcaatactccgcctctattttcgtctatattgatactcagcaaatattttctatatgaaaatattttaaatatacaaaaatacgatgatctctaatttaatccatttaaaatttttacaaaaatgattttttcagtttggtttcctaactccatcaaatagttttgttatttttttagttttattgtttttttaactttatccttatgcttcttttttattttaatctgcattctatgatttctatttggcgattcccgaaaaaaatatcgatattaatagggtgaggatttttaggggcgaaaatgtccaaaatagggacctaaaaaggagcaaaaaattcgtgaaataggggcgaaaaagttccaaattttgggatatcattttttaaattgcagttttttatatgaaaataatttcaaattaagggaaacaattttattcactaattgcagttacaaataagatatattttagaaagttttttcatttcttatgggtctatttttgaaaaatttagtgtcgattcttaggggtatatttttctgaaaattttttggatcgattcttaggggtgtatttttcgtttttattgcatttttgttaataaattttggagaaaaagccaaaataggggtaaaaacatattttaggggcgaacactcaaaatatggatttctaggggtcggataggggcgttaaaacgaagaatttccgaacaagaa

SEQ ID NO: 191 - DNA, 2183 bp, Heterodera glycines
  misc_feature (989)..(989): n is a, c, g, or t
ataaacaaaatcctttagaattaaaatatctcttgaagtgctgcggcctttttcgccttctttttgcacacatagccacctattttcgccatggcacagtcatagtcggcccaaccgatgcccttcgataaaaattaattaaaaattttcagcaaatgaatgaaaacttccggatttttccgcaagaattttctcgagaaattaaatgtttaatgatgctttttagttatattttcaaaaataaaaaataaatcgaaaaaaattcttgataagcggcgggtggaaaactgtaattttagaatgaaaattattaaaacttactgaattggtcaacaacatgaacacacaattgctttcggggctgtcctgtttcggacgatgttcgggcgtgtaccacggcgtacggtcggcaactttgaggggattaccgtagtgtgtgttggtgccgtctgaccatttggcactcaaaattgtgccattgctcgcgcgagtcaaactcatgccaatccaatagccatcgtaagtgtacgagtcacaacaccacggtacattgtccttttggcattgggcgtacgattttcgaacaagttctaagtacagaaaaaaaaaaaattaaatctgaagttggggtaggatttttgcccgatatgtcgggtgaggggcaaggcatagggattcgggattggatgtcagaaattaaatttacttgtcttaaattcagacaatatttttggactcatctgctgttaaggtcaggtcggaccgacgccatcttgtgcagacatttgtgccccggacaattgtcctatgtccaaaatcgggttaaaacaagttttttccagtccctgatagcctaaacaacattaaaattaagaaaaccacaggtcttctagtttattaggggcattaattctgttgtttgaataatgatgatttttcaaaaatttgctgtctatcaaatgatcatacccaattaattcaatcacctntatttaatgctgtttaggttattagggattgaaaaaacttaagttagaacccaattttggacataggcgcaaatgtccgggataacctctgccgtcgttaaccttgaacaaactgattctcaaacgagctgtgcagtgaagccaaatttgcacccaatgcttcacaacgtgatttggcatcttttgaattggcaaaattttctgcgccatgtgagccataaaaagtgaaaacctatacaaaaaaaaatttctgaataataaaacacactaaaaagttgcaaccttaaaacaatttattccaatttttgaccatccttcctcacaagaaaatctttttgcggaagtcattgagcagcagcagccaattagggcaaaaagaattgaaaagtattttaaaaacatttgttatttatatattttattttttattttcctaaaaataagcgcaccttttatatttgtaaattcagagaaatggaaaaattaattatttatttcaacaattggtttacacattttttatgttattcatttatttttgtcattcttttattccttcaaactaattgcttctctgactttttcttttgttattttgctttaatgaaaaattattttataaataattaaataaataaaaattaaatttttatttttggcgtcctttttcgagttataatgcacaattttttccgcatcaaattttttggcattgttcatatttttgttccaaaactttctgtcctgctggtgcatcatcgattctctcatccgttgataaataacattcaaaaagtgccttcggccaaaatgccaatagaaagcagcactttggtgccacttttttttgttcgcccctacggcatggagtgaggaccacttcgttctctttcccagggggccactccattctttctatccaatgattcggcggcacattcttcattttcccccaaattttcgtgtgacgttcgctcaaacttacactttctttaagttactcacaaaaaaggatttttgagagcggacgaatgagccccaagaaagggactgaaaaattctctcctccatgagaaaaagctgttaaaaattttgtacatttatccgtctgcactttatgtaaagactcctataaataaatacgtcaatggatgaaaatccattagtggacaatacaatataattagggtgaga

SEQ ID NO: 192 - DNA, 4119 bp, Heterodera glycines
ataataaaacacactaaaaatttgcaaccttaaaacaatttattccatgttttgaccatccttcctcacaagaaaatccttttgcgcaagtcaaagagcagcagccaattagggcaaaaataattgaaaaatattttaaaaacatttgttatttatatattttattttttattttcctaaaaataagcgcaccttttatatttgtaaattcagagaaatggaaaaattaattatttatttcaacaattggattacacattttatatgttatatatttatttttgtcattcttttattccttcaaactaattgtttctttgatattttcttttgttgttttgctttaatgaaaaattattttataaataattaaataaataaaaattaaatttttatattttggcgtcccttttctatttggttaatgcacatttttttccgcttcaaaatttttttggcattgttcatattcttgttcccaaactttctgtcctgctggtgcatcgattctctcatccgttgataaataacattcaaaaagtgccttcggccaaaatgccaatagaaagcagcactttggtgccacttttttttgttcgcccctacggcatggagtgaggaccacttcgttctctttcccagggggccactccattctttctatccaatgaaggatttttgagagcggacgaatgagccccaagaaagggactgaaaaattctctcctccatgagaaaaagctgttaaaaattttgtacatttatccgtctgctgcactttatgtaaagactcctataaatacatacgtcaatggatgaaaatccattagtggacaatacaatataattagggtgagaacccaatgcctgcgaacatttttttcaagaaagaaattaaatgagatttttcccatttacaggaattttttcaataattttcatataaaataacaattttattcatagcaactttgatttttttttaatttattaactttcgccatttttgctttattccatgtttttgactatttttgggaattttataagaaaattgcaataaaataaaacgaaaattacatcgcctttttgaaattttcaaaaaatataccatcaaaattcgaaagtttgagtttcatggaaggagacataaaaaatttcaaaatctataaatttaatatgacattttatggttgtttaaaatatgttttttaaaattatattttggttaatattggttatttttgtatttttattttatttcctttttttagtccacgcttaatccacatttggcgtttttttctatacatacaacgcattgcctttttgttttctgaaagtgtccaagaatttttaacacagcctgctattaagtatagtccttttcttcataatatactaagaaatggatataatgtaaagcctcgggtgggaattgaacccactcctccaccaaatccttgcgtaactctaccattgagctaatgatgcacttccggctttttctttgggatcttatcaacccaccgctttccgctttttaaccacccagtcagcttcttccttgcaatatctcgcatttttaataataaaaaaagaattttattgacggattatccgctgatccattttccggacatccccacacattaacgcgacttgtgatgttcgctgttcaatgtgtcaaatttcgctttcaacaaaccgcggatgggatggaacttttgaattacatttctctttctgctgaatgtacatttttatatgtgtgtgtatacatcaacaacaggaagcagcttaaaacccctcgggcgacaaaattaccaattgaattgccaacgcttttccgccgcccgcgaaaaatgtgccgccctccccgcggggcaaataaaatattttgtcgtatcttttcggcttttcttttttttttcccccgtcagcattattcattcttcacacgaggtcaataaagcttacacatgtccgtccatccaacccattgaaatagccacagaaaagcaaagcaaacaatgaatgaataggccggccatttggggaaagggccaaaacaaaattatttttatacgtgagacatttagtttagatttttaatttaacgtccatagtggtaaaattaagaaactatctaacaataatttttcccataaccaattttaataatattagttcatgtcacgtaggtttctctaccccataaatctcctaagttttcaaaaaagatataaacataaattttgaaaccttaagttttcgattttttgattataactttttttttagtttttacaatttgttggaattttataagtatcccagtttgagaattcctaaagatctattcgaatgataccaagaatataattggctttttatcctttatttgttagtggaattaatgatacgacctacacatttttcgctcaaaaactggccttaaattgtacagaaatgtgttcgttaaaaatgtgtcatcatcgcccggctcccggtaaattggacaccgaatattggacaccagaaaattggacacaaatggaaatttggagaccggaaaattggacattattggatataaaataaattaaaaataaataaacaaaaattttggttttgctaaaagattttattttagtctgcacatccctgtgtttttataagcctaataaaatggcaataaataaggtttttattattgtaacatcaggagaagaaagccaccataacattcataaagaaagaaacaaagttttattttagataagattgccattttttatgcaagtttagcacattgactaatcatcgcccattttcgtgcatgttttggcattttttgctgttgttaagctacttttcgagttattatgcctattttggggggttttttagagcctaaagcctacctatttaggcggtttttagagcctaaaaattggaaccctattgatcaatcatcgtgcatgttgaatgcctgatttagtctaagtgccttaattcattaatccatttacccttcataaatttatttttcaccccaattcctggctttattttaggaacttggtgtccagttttccggtgtccaattttccttcggtgtccaaaattccaacggtgtccagttttccgcttggtgtccaattttctggtgtccaatttaccggtcccctcatcgccctccctctgtcgcgaaagcgacgagagaaaaaggatgggctttggatggccgggattgttcccggcggactgaaggaagcagggggcccgatgccaaacagtgattaatttatgatcacccccaccatttttgcttccttttcccttccttttgcttctcagcatttctcatttgcatttttgttcccccgctcactttcatttcaaatgttttcctttgttgccccgccgcggggcatctgctctccgatcgcttctttgtcccaattttgcccgttttttctccccattcatttcaattcattttgtaccttgggtcccaatgtcatcgggcaagtgttcttcccaactttgtccccgtccaaaatgcccattcacgtgatttgcatttctcattgcccggcctatttaacccccgccggtaatctcccaggcgcgtcccttcttcagttggcccccttcattcgtcgcttcttcattcgttcctccttcggtcttcccccatttcattcgtccttcccttcacttcgtctctcccttctgtccactcttccgttttcttcggttgccttttttttgctccctcttatcacattttcttccaaatattgtgcccttcccttcggcaataaatatttgtgtgtttgtccatctcctttggacagaggaaaattgcccttccctttgggcaatcaccaaatatcggagtcgggactcatcccggcaggcaattgggaggttcactcactccttaactgagtggtggtgccgttacatcacccccattttgtcagccctccccattctcctttctcggccccccttgggcattcaattcggaaaggggtcgacaaagccgagaaggagggcaaaaggaaccggcgatcacccctccattgatcgccagctttttcgaca

SEQ ID NO: 193 - DNA, 1194 bp, Heterodera glycines
  misc_feature (18)..(18): n is a, c, g, or t
  misc_feature (1176)..(1176): n is a, c, g, or t
tggtcgatggtccatccncggtttttccatcccaccccccccccccccccccttcattagagcctccaccctcctctgacaaatgagggggggggaggtttaaatagagggtctcgggggctctattagaaaaagacctatttttccacttttctcaataaaaaagcattcattttttgcccctgccgcttatcccaattcccagtggatatggatttgctgagatgataatatccaataccaataattttattttttcgttctcccactttccatcatggcattttccgtctttttcatattttctaataaataatgaaaataaattaataatcaaattaacaaaaatttgtttccgcaaaagtgcctcttttgtcttaatggataaaattttattctttttcatgaattttgttttccactccgtgcgccaatgaaataattaatggctttctcatctgctgcttctaccttttctatgccgtctttcgcgcgtctgttggcattttgccaagcgacaacagagacttaaggaataataaatttgctttttttcctttcgtctcctaaggcaacactaaatgagggcgatgaatggccgtcttggtaaccttgtccggtctccgctggcgcggaataagtacagaatttaaaaaaaaattaaacaaaaaattaagggcccggttcaggcaggctttcgttttagaaaaaaaaatttggatttatttgaattggtgtagccaggggcatggaatttaggggttctatagcgggattgccgcgagtcaagggaaaaacggtacgcgaatagaccgaacaagttcgggtcgggaaaaagctgggtttcaggtctcgggatcggacgacggcatcacatttctttagcctactctccaaccctgaaaatggaagactagttccctatgattatgggtattttgggaattttctgccgaaaagccgggatttaggtctcgggatcggacggcggcttcccttttctatagcctagccaccctccaaccctcaaaaatggacgattagttccatattattatgggcatttttttgaattttctgccgaatatatcatttgacagtatacatatttcagaaatagaacggaaggaaccccataataaaaaaaaacatattgttcagatatctgaataatgntgaagcaaaaatgcaacg

SEQ ID NO: 194 - DNA, 2531 bp, Heterodera glycines
  misc_feature (2522)..(2522): n is a, c, g, or t
aaaattaatatttatgtttttaagtgtttttaaaaaggcttaattttcaaagtttaaaaaatttaaatatttttgtaaatattttatttataaaattccaaaaaatatattttttaatttatgaatattaacatttttgcatttctcattaaaataaaaatttaaataaataaaaatcctcaccctattcatttataataaatagagaataataaatcaaaatatttgttgctttttttcttttgtctgttcaattattggggctctcaatttgccacaaaaacttttccagtccatttcgctgctgtgtctctttttggcactgattgtggccacaattgctctgttcactgatctgtcctcgttctatcgtctgttgaatgtggtgccgttcaatgagttccctggccaaacaacagtggcattttctgccgaaacatcggcccgtgtgtacacatttgttggcctctattttggcacatttttattcgaatgctggtccatccgcattatttacaactgtaataggtcggttggcaccagggctgcacgcaagtggatttacaattacggaaatccgcaatccgcaattgcggcgattttctcagttgcggaaatccgcaatccgcaattacgggtgtccaaaaaccccgcaatttccgtaatttccgtaatccgcaatccgcaattaaaaaaaaatttttttaaataattttaaattttattttaaaaaatcctataaatcttttaaagcaatttaaaagcatattaaaaagcaaatttataaaagcaaaatcattcaattgagaaaccggttaaaagcaaattgtgatgaagaaacaaaagttttgcaagattttctggtaataaactctttcgcaagtcatctgaaattagaccggccgttgagaaaagcctctcactttctgaacttgttgcaggtggagaaagaaatttccgtacaacgtcaccaatcattggccatttttgtgaattgacttcccagtataatgatggatcggccctggatttaatttttggatcccgcaaatattcatttacttcaacttcggctttttgtcttgtctccaaggcagatggactgggggatgttgccttaaattaattattatgaggggtatataaagtttatttacagtattcagtatttgctcaaattctgcgtccttttcaaaacgagaaaaaatatccccagccgaacttgaaccactgcagtctcttacgtcaatttgtaaatcaatttcctaaaaaaattaagttacaaaaatagaaaaaataaaatcacatcagtctttgcatggtaactctcaacttcacttatcaaccagtctttgtactgattcagccgactgctgtcaaggtaaatggtcttaaaacgtgggtccaaaatagttgcaagaactaggtttttttgttcttcggcttgtttaagccgcaattcgatggcattcgcaattgttttcttaatatttgaaaaacgattgtccttgtcctcacgtagaccgaaagaaattgcctaaattttctaataaataggaaaaaaattaacgctaactttaaaaagtggaatgataattgagcatgaagaacttctgttttgtaaaagaatggttgcctcgtaaatgggagaaagtacgcttttaattgatgacaaaagcagccaatcatcagcgttaaattttggaagctcgcaatgatcaattgaaaacaaattcaccgcagatctgtttctgataaaacgttcaatcattttatacgaactattccagcgcacctgaaattgattgcctttataagaatggtgaaatatagaagaacagcacctcgacatttttaatcaaaactgttggtggtacttcctccttttgttggagttcagcgagttgttccgtcaatactcttgattttcgcacctttcgtacaaatcttttgacattttccaaaagattttttaaacgctcttcctcttcaattgacctcagtccctctttaatgcactaaaatccttgtttttaatatttaattaaattattttgtcagaccaattgcaaaacatgcgctgcgcaatccactgacacaaaacccaagtccttgccaacctttttcatcgtattttctgtatcacgcgtcaaggccgaaattttctcctcttgaatttgaaaatcatttaatgcttctctaataaatgccacaattgcttcagctgtgtgtcgccctgaaaaataaaatgttcgaactctgactatattaaaaaccttttattggtttggtgctcaaaacaaaaaattttggcttgaatttttggtccaaaaaatgcccagtaactgaaatcaaagaatggcgattatcctttgaagtccacccatcagagttaaagcgatttttttaactgacagaaattcatcagtgactattttctaaattttagaattatgaaagcgcaaatttgattattactttcatcgcttcaaaacaatttggcaattcatattgagcgaaantgattgcgc

SEQ ID NO: 195 - DNA, 3342 bp, Heterodera glycines
gaactattccagcgcacctgaaattgattgcctttatatagaatggtgaaatatagaagaacagcacctcgacatttttaatcaaaactgttggtggtacttcctccttttgttggagttcagcgagttgttccgtcaatactcttgattttcgcacctttcgtacaaatcttttgacattttccaaaagattttttaaacgctcttcctcttcaattgacctcagtccctctttaatgcactaaaatccttttttaatatttaattaaattattttgtcagaccaattgcaaaacatgcgctgcgcaatccactgacacaaaacccaagtccttgccaacctttttcatcgtattttctgtatcacgcgtcaaggccgaaattttctcctcttgaatttgaaaatcatttaatgcttctctaataaatgccacaattgcttcagctgtgtgtcgccctgaaaaataaaatgttcgaactctgactatattaaaaaccttttattggtttggtgctcaaaacaaaaaattttggcttgaatttttggtccaaaaaatgcccagtaactgaaatcaaagaatggcgattatcctttgaagtccacccatcagcagtcaaagcgattttgttaactgacagaaattcatcagttactattttctaaattttagaattatgaaagcgcaaatttgattattactttcatcgcttcaaaacaatttggcagttcatattgagcgaaatgattgcgccgaggaattttgtattttggctgtaattttccaacgaattgtcgaaatccaacaccgtcaacgagattaaatggcagtaattgagtggccagcatttccattagtgctcgatttgcgccaattgttgcgtctccgtccgtgctccactggccttaatcaaaatgtaataacgcatagaaaaaaaaatcagatcatactttttgcatttagcccaattaaaataggtgattttgatgaaatcggcgcttccttttcttcgtcatcagtaatttgttgacttgaaccacaaaatgcatttgcaaaagccctttttaatgggtttattccactttgtcccttcttttctgttttttgcttctctgcttgaacaaaatcttcacgctgtttgtaaagttcagggtggtgatttttgaggtgaaaagtcagtacagttgtactgagagaagcatttaatgtctttgagtaggaacatccatcggctttacatttagcagttgctttgccttgacgctcaaaataataccaccaattaccaggatttaagtttgacatttttaaattgctaaagaaataagaatttaaacaaatgtacatattttctttaaataaaaatagaaaaaaattcattttataaaaaataatcttacaagaaatcgtctcgaaaaataatccaatagtcaaattacggatcaaaattgcggataaatcccaaaaatccgcaacccgcaatccgcaattacgggggtccaaaaaccccgcaatttccgtaatccgcaatccgcaatccgcaattgcgtgcagccctggttggcacctctttttttattttggcgccgcgcaaaaaaaccaaagacgtcgccagattcttagcttcgatggatttttttgctctttggtttcacttagtttttctggcgctttttcacaacatgaagggatagttttgataggaaaatttttaaattcatagctcaccaagaaatcatcatttgtacatttttcaggccaagtttaaaaaatttaagccaatttgcacctccggcgaaaatttttgggaattctaacgaactttttaagaataacattttttattaaaaattttttcgaggaaaaatttttatggaattctcgcaacaccttttaaataaattcctataagatacacaaggaaagaaattatattttaaggtatttttatgagcggcggaggtacatggagtactgtctcgcctacagtactcctctaaaaactttgtacagtgcgcggtgacagacagcgaggaaaagcgacaaaaaaagtaccgggaaaattcggatttttgaacagggatttgttggccaaccaatcactcactgtgtgtaaattgtcattcttttgcatcatagaaaattttcatttctaaatttgtcttaatcacacataaaatttttccaattaggtaaattcatttatttttgtataggttaaattaattaaaacctcacgcttttttatgttttactcattttgccatccattttgataataaatttttttataccgaaatataaaagagaaaacgcttttataaaggaaatgtttaaattaataataataaagtcgcgaaaagtcaaaaatatgcattttcaaatcgcgataaatgagtcatagagcaatttctggcaaatgaaatacctattcggcataacaaagcccccctccccccccccaaaaaaaatagccttttgcctaaaattaccggctttgccactaataataaaattaactgtctatgcctgtttatgcaccgtctacaaaaatgtgagtgatatacagtatacatatgatatgattacacaaaaatttaaacatagtccttctttgtcggtctaagctcgcatgcttcaattatctaaaaaggcaaaaaaaaatcattgataaattgagaaatcaattggcaaaacgcggagtggacaaaatgccacctgacaaatagcaaaccaaaaaaaaaattattattcaaaagaggaccaaagcttttttttgccgccacatttgccatataaccttttttgtaattaacgaatcgttcgttcattgacatttgggggcagtgatatatatatttttttttgggtgggtaagtgaccggcactaattgacctccactaaaattgtccttgcccgtcgacgataccattgtctgttgagatgccgccgtcccattactgctgcttacattaccgccctcctcctcccgctccggccgtaattgtggcggcgtttgccgattgttgttgctgttttgttgtgccatgcccgccggcgtcgtcgccttttgtccaccaccgccgccgcgttcactgcgaacactgccgccgccagcggaggacgcgttgcggcgcattttgttgcgccgcaacaccaacacatttgcggtgcgtaaaaacaactctttgaaggtcggattgagccatgcgtacagaattgggttggccacgttggttgtcatcgccaagctgtaaaagggccagggaatgaatgaataatgccacttgaccagcaacagcagcagggggtcaacacacttacaaacgatattaggggggg

SEQ ID NO: 196 - DNA, 1777 bp, Heterodera glycines
  misc_feature (1765)..(1765): n is a, c, g, or t
atcattcgaaagctctttagatgctctattagcctgcaaaattccaaaaaatttcgtcaagttcaaaaaaagttcgagccaaaaaagttggaaaatttggttttttgaattcttctggccataacttttttgaaccttaacgaaatttttcgaaattttgcaggctaatagaggatacatagggctatcgaatgacaccaacaatgttggatttggttggcaaagaaaaaaaaagttatagtccaaaaacatgtgttcgtacgaaaacggcccgtacgaaaacgaccccgacccataattaagggaggaaaacgacaattttttaaattatgattatagatatgtttcgggaatgcagtaaaaatgaaaattataaactcctaaaaattggaaaatttcaaaaattgatcccaattaaaaaattttaagtttttagatcagttacatattatttgatccttttttgtcactatttagtaaactatttgggattttttgtaacttaaacccgcactttggcaataattatttgccctttttaatttgattgacattttttttttaattttcacacctgtgagtgaccatcgataagaaatatgtgtagttgatcccgtccctatgcagcagttgctcgtcatattcgataaccatttcgcgaatctttaaggaaacttattttgatgaaatgcgcctaattatgttgtctaattagtatatctcggcattttgaaaaaaagcctagatcttgaaaagtgactaattaaaaataggcaattaaatttagttaaaaaatgaaattttaaattttaatggcagcggcaacaaatattggcatatgctttagaaataaataaaattaataaattatttaattagacaatttaaaattgtcacatttacattatggggaagccaagcaaagaagaagaatagcacaatggtgaccaagattaaggttgtccgacgttgttgtttgttcactgcattcacacgatgtgcccgattgtcggaccgggacggcacacagctcaaaccgtcgtcaacactttggcatttttctccattgcttcctccttccgaaaactgctaaataagaattaacttttttaaaaatctaattaaaaatgtatttttcatttaatttatggttttataggcagcgtgacgctatttgaaagtggctattttcgaattttataaaaaccatgggagggacactttttaaaagcaccagcggcggcgtcaattttataattaaattgttattattttaattaaaataaaagctgtcttgaatttgatttaaataattcaataattaaaaaatgatcaaacggaccacattcgatgagttgatcaacattttttggcgttcatttaattgttgaatttttgtgttggcacggcgcctaagcagcgcaaaaatggatgcataacagaaggacattgtgacaaatgggatcaaaaactgcaacaccaccacactgagtgaatagccgcgacgaatttgcatgcttggccattgttcagtacaaaacttaaaaattttaggacaatattaatgagaactttaaacacatgaattttaggggaaaaaaatccggacccattttattaatttgattaaataaaatttaatttttaaattcaggatttttcggaatcgatttcagcagttttttgaatttgttcaaaaaggtacattttaaaaaaattggattttccgaaactttagtagggcagttatttaatgaaaacccangattttataaga

SEQ ID NO: 197 - DNA, 3141 bp, Heterodera glycines
agattaaataaatttaaaaacacattattattattattaattagatatttttagaggtttataagcaattaattgaattttcaaacctttttttgattttaaaatgagtttcaaaaaatccaggtccaggcctggatccaggtcccgaggaacctggatttttcctggacctggattttcctggatttttgtccaggaaatccaggtccaggtccaacatggaatccaggtccaggtccaggtacaggcttttttcaaaatgtcgatctctagccattttccccgacccaaaatcaacgacggactaaaaggaacaggggcggggggggagggagaagttcaaggagtaagaacagtaaaatcggaaattaccgttactccggactcgtactttacttgtttccaagtgcgtactttattttctttcttttttttttgctttgaaaaatttcaagttactttatatttcaaatgaaaacggcggcacttggccccaaaaatttggcattctgtaagaactaatagtcaatgttaacctattttacgaattcttttttaaggagcaatttgtagggtccttttcttaaaaaagaagcaactaaaatgataattattagggctactcgagattctcggtctcagttcttgagtcaagaaatttctcggctttttgggctctaagtctcgtctctcggttttctcggtctcggtcctcgagaatcttggaaaatttgtactctcgatcagtcttaataattatttataaattacctgaaccatcggtaacagatggcaaatggccgagccaaacatcccactcccttgtaaatatatgagactggtgtgaacggcagtgacagcaggcacacaatgacgtcagagatggccaaattcaggatgaaaatgttttgaacactgcgcaactggcgacactgaaccgtgaccagaacaatggccaaattgccgagcaatccaagcacaaaaatgttgctgtacagccccagaaacagggcaattgcccactgcgaattgctggggtccggctgttggtcaacatagtgaaggcattgctgtcgctcctgtaggatggaataattaaaattaattggccaggaacctcctcgatctttcagtattgtttttttttgggcggaggacgacaggtgtcagggaaataaatgccttgaaaatagggaattgagggcgtgagacaatgatgccgagtcccactgtgaaaagccgggctctgagctagttaaaaagatcaaggtgccaatttgatccatgccagtttatttaggcacttttcggttatgggctcacagatttttttaaaaggcaagaaaaagggcgctgagtgtgcaaaaaaaaagagtcaatgggaactcgtacaaaagacaactcgtattttacaaaaatatagcccaagcttaagcttaggcccaagcctaagccttggtctagcctaagcaattgtacaagttgccttttgaagaagcggaacgtggaaccatttagtggaattttaacaccagatacaataattacttttatgcctcctaaatagattttttacgtttgcaccctcatttgtcagcgtcatttgttttctttttttttacaaattaatttttaaattcctatgtttattagttataaaatatttattaatttatttatatttttgtttcattttttaaataattttttattgcctgccgctgtggctgatcaacatttggccctattgtgtgttgaacagctatcaaagaaggcgataactgcgtggcatcgatattagaaaacatttccatgtctcctccactgatttgatttaatcttgaagaaacatgcataaattgtctctctcaattatggactcgaatttgcggacaattaaaattttatcagaaattaggaaaggttgtggaatttttttggaaattcatacaacagaaaattgtgacatgagaatgatgtcagcaaataattaaaattttttaaacaaatcatcttattaatttaaattttattgagagcatgcgaattgagagccatgaaaaaattgaagaaacattaataatctcattgtcagacagattattttggcaggtgaaacacatattatttgtcttattatttaataaaattgaataataactattttatggcacaaaatttttgagccaggaaatttccctaattaaaatgcttaatgaaatctcaattctgtttaatgaagcagctagagaagaattgagcacaaatatttgcctatgtggcaatttaagacaaaatctgtaatgaagattttgttgttttttaatgtagaaaatttttgaacatttaattcagaaggaagaagaaaatattatcgaaactatttttggggggcttttaggtcataaagcgaatgcataaaagcccataatgtttatgttctgtgctaatgaataaccgattatggcaaatgggggattaaaaatgcctttttcttaaaggaaatccatctttttggcgcaatatgagggaaaagagcttttactttaagtcatgagctcattaagtacgaacgaatcaatccttacaaaatttgggaattgagaaaaaaaaatggtgaggtaattaaatgttaaaccaaccttagttagaaatcatagcaaaaatttttacgcaatctaagaacaccataaaattggccttttccgtaaaaaataattatttttcatccaattttcttggaatttctaattaaatttggtgcaattctttgtgaattaatggtataaaattaatttcaaagtttaaatcaacaatatatcagcagaacagatatatttttatataaaattatttatatatttttttgttaatttatatattttttaaaatttttttaattaaagcataaattattggcttacgaatttttggcgctggtaaaattcatattttaccaattgtctttttacttttgtgagcagaaagccaatggacaacacaaattttcaaaagaaaaatttagaagaggacaaatttttgaagcgtaaacaaaattctttgctaaattatttttggaagcatttgctttaacaaaattagagtcagctcgctaggtttttaaaaattgaatgaattgtt

SEQ ID NO: 198 - DNA, 1073 bp, Heterodera glycines
agtatttttattaaatttcattttggccaaatgtataccgctttctaagaaattaatatttaggggccaggcaaataattgttagtgtttgcacaagggttaaatttcgtcacaaacataacaagattgcagacagaagggcagaggacagacattgtgaatgaaaatatttaagaaaatttggtttcccccccccccccccccataattatagcctagggcatgaaaaacaacttaattagtgccattatcataaacagactacggaatcatcactaatcgcttgtgttaatatatagaacatacctaaactaaaatttttcaatttcgatgcctttgcaaaatttggaaacatttcaggctttggatttgagaaaaaaaatattattaaaatgaaaaaaattgcctgttagaagtattagcagtaaattatgcttttttacgcttaaatttccatatcaaaattaaatgaaaaaatataaaaatttactaaaacatattttgataataaaaacataaaaattcaaatttatccttcaaaatgccaaaaattgtcataaatggttaaaatattacagcttaattaatcattagaaaattgcagcaaaaaattgtcatcttcgggacttcattaacatcattgttggcccacattgcgcaaaaatccctttttaatattgtgtgtgaattggggattaatcaatagaaaaagcccacgcaaatggcaaacaatgagtcaattatttttcctcttttttcaattcaaattttcaattgaagccaaaaattctaattctaaatgaaaaaagaaatatttattaacttgccaaaaaaattcaaaaaaaattttcaacctgctctaatttaaagttttttgttttcgaatattaattttaattaaaaaaagaaaatttcgccttattagggaggtaggttatatgcaaataattccgcaccggaaattaaatttctcaccaattcaattttgggtatgtgctttttttgttggcaccggctttcccgccactacgcggcacgacgccacttattcaaatcccttgaatttttttttt

SEQ ID NO: 199 - DNA, 1545 bp, Heterodera glycines
  misc_feature (77)..(77): n is a, c, g, or t
agatttcaaaattatgcgtgcgtttttttacccccgaattttcaagtttttttatatttttctttttaaactgattntaataaacaatttaagctttttcctcctaaacaaattcattaaatatgtagttacgcaaatgctcaaacaaattcaaatataaaattggattttttgaactttttctttgcttattgtcaccaaaatgaaattcatacattagtgtcacacttctttgtgaatgtgatgacattttgtctgtttttttcggacaagaaaattaattttgtcacgcaaacaactaaaaagtcatttacgtcgtgtgtgacattctgcggcaatttgttgacacttttattttgcaatttccgggcaaaaaataaaagaaaaaataaattaaattaaattgggtgggtgagagggacaaaaaatcttttaaataaaaaaaattaatttgttttaaataaaaatgtcagtagagacattttgtcgaaagaccaattcaccactcataattatctgtcactaattagggcgtacactttatgtttgtgtattagtactgatattcatgagttggcacaagcaaaacaaacaattgcctggggcgacttaatcttcctctttcggacatgtatttttgtattttatggcagaattatgggtcaaccactcccccgccctcccggccccagcatcggataataattggtcaattaatggattaatgatgatggcgtcgatgagagagagagtgtgtattggcgagacggacgggttggagaagagagggattttgagtgcaattggcacagaaaaaagtggcaccggaaaaggtgccgtggcgaggaaggacggaatgggcatggacaaaccacataaaagcagcattgggggaactaacccatctccaagaagcccatcaaatgtaattaaggcatcacatagcaaaaataaaaaataaacaaaaaaaaatagaataaattgaaaatgatgaataaaatttaaaaagcggcttaaaattaattacttaaattttcaagtccaataaaaagaatttttcgaaattttaataaaatattaaagaggatataaaataaattttaaaattaattacttaattttagagaaatacaatttctatttaatttttcttagggtattaattttcaagtccaataaaaagaattttttcgaagaataaatggttgttctttaatacctttttgtacgatttgaaatggaagaaaacataatgccaaattagttccgctcaagtttgatttaaactgttcaattctcgccaattctcttccaatgcaaacaaattttagaaaattaagcctcctttgatcgaagaattttgccgaaataaaatttcttcttacatgattttactttttttttattttaaagatttatatgttaaaaatagagcctggcgagagcgggacggtgctatgacgatagtcaaaaaccatcataatgggcgttagtcaaaaacccaaacgagatgaaaattattttttgatataactttttcaaaag

SEQ ID NO: 200 - DNA, 3933 bp, Heterodera glycines
ttctattatcctacaaaatatcaaaatgtttcgttatcgatccaagaaagttaagactaaaaatgttcaaacaaacttggttttttgagcttctcaggtcataactttttttaaacttaaagaattttttaaaaattttgcaggataatataaaacacttagggctatcgaaaaatatctatattataaaatttgatccattttatgcgaaattatgaataattttctgtcaaaaatgattcatttgatggttttttgactaacgcccattttgatggtttttgactaacgtcccagcaccacatagactcccctcccccctcccgccggagttttgcgcgaatccaggtcccgttctccgaaaatttctgactcccgatcccactcccgcccgtcaatttttttaaaaactaaatctatatagtagtaaaaatatactgataagaattgaatttattcggtaaaattagcaataagacagttcttcaaaattcggattttatttgaaacaccccaccccactctatttttatgaactaattaattttttgtttgaaatacataccacccccccccctccccctgggactcccgttaaaaatctcgggctctacttaaaaacctacatacaaacatttattttatttttttattttattttaaatatcgagttttttggttttcacttttcagttgcagatgattgtttctcttcattactttcacatttttaccccttctattttttttaatttgaaaaagcaccttttttgatgtatgggtgggggtagaaaaactaaaactaggagattggcttttcattaaaaaacgcttattttattggccaatccatgtccatgtaaacagtatccaaatttttttatgttacattttaatgaaatgtccttaaattgctttataggtgtgttaataatattacatggattggcaaaaaaaaaatcaataaatttctggcaatttgcttaaaatctctgtctgctattcggcataaagaatttgccaatattttttgtttcccttttcttctgggcgtagcgtccccaattttcactggtcggaagcacaaaattggttccctaatgacaaattttacataaacccacataacatttaagcgaaaaatgacagctgctgtgccgtgccgtgccggcttttactgctggacaccaatttaaagaaaatgtttgtttacttgaggacgaaatttaaaaaagcgacaaaatggactattttttccaataataatttacattatttattattttatcgctcgctattctttatttattgatttttaatttattttaataataggcatttttggcattagagcagggatgtgtgatttgttatgatttatcagattttctgatttggagggttcaaatctgacaaaataaatgtcctgatttatctgataaaatattctgatttgggggtagtgactaaattttattttgatttcttaaacaggctcataattttgaaaatttatggcataatttcatttatctagaattttttaaattgaatgaaaatcggttttaagtgattttaaaaattttctgatttttgacccaaaaatctgatttttttgtagcccgaaattttgataaaataattccaatttttttaaatgaattttatatctaaaattaggtccaataagaaattttcttgtaatataaatgccattttgaaaggaaagaattaaacttttaaatgccatcaaattttcggcattttattttttgtttggtcccacattttttgttcagccggttcggctttgtcaatgcacatttggcggttagcaaaaatacgccatgcagcatgcagtcatcacaaagcaaaagcatcatggccgtactgctccaagactatgacaaagcatcgaacccaaccggtggagtcatagaggtgcaggcggaggtaaaatccaattgtttgggttactctttttgggcgcaggattatgggtgaaagaaaggcatgtcccaaggtcggcacatccgtttttaataaaagggccaaacatttaggatccaccagggtttggtcatctgctgattagattctgagggtcagatatgtcggaggcggataagttggtgtcgtggcttggcccaaaatttggtattctggagcgccctgggtaaaaccacagcaaggctgggcgaaatttcagattcgttacgtcagatttttaattttgaatttcgagttacaggttcgaaaatatttactttagtgtcgagtttgggttgctcgatgagttattttgatcagccctaatgaccagacagagaatgtgcctattcgggaattacttccgccctaataaaaatcaattaatctctctaatcccattgaacagataaccgtgcaggatattagctcattatccgagacgagttcctcctttgtcgttgatttgtggttctcccaaatttggtctgatcctcgtctcgtctactcccatctgtcgtgcaaatccaacctatcgcttgatgagtcgttggcacaacaattgtggaccccaaatttatgctttattaacagccatgacacttacatacactcgtgggtttttccagtcaattaattagcgcattgataacccaaaaatatggtattagttagctcttgggcaaatattttaaaaagcgtaacagctttcttgatcagtgtaaaagggaattgcagttttactgaatttgtatgtactccccaggaagtaaaccccatgaaaatgggaaatactacttcagggaaaggggggggggcggatacgaattcaggtaaatacggtatattatgactggggatgggatttttaggtaagaaaaatcccagaataggtacttaaataggtaaaaaaaaatctcaaaataggtattaaataggtacaaaaattccaaaataggtaccaaaataggtaaataaaattttttattaacgatttttagtggaaaaaagcaaacaaaaggggaaaatgttggttctatttctttgtaaacgaataatttaaatatttttaatatgttcttagaaaacattgacattttaaattaaaaattttgttacataaaaaaacaaataaatttttgggaaaaattttccaattcttaggggtgtattttttgattttattgcatttttgttaaggaattttctgaaaatccttaaataggtataataggtagaaaaactccaaaataggtaaaaataggtattataaaagtcatcgtagacacccaaaaccaagtggaaaatgcttttttcgtgcttatctgtgcgtattaaatgcgcaaaattttaggtatttaactaaaattcgcatccctaattatgactggggatgggatttttaggctctaaaaactgtcaaaataggtaggctctaggctctaaaaaaaccccaaaataggctctaaaaaatggaaaataggcactaaaaaccctcatttttagggggtgtaaaatgacaaaatgtattcaaaaaaaaaagtaaaaaaattaggccaaatcaatattgagataaataatttttaaatcacattcctgtcaagaaaataaataaataaataaattttggagatgaatttttgaaaatttttcatttcttaggggtgtatttttgaaaattttgggtcgattcttaggggtgtatttttcgtttttattgcactattattaacaaattttgggcaaaacgccaaaataggcaaaaataggttctttcaaaattttttaggctttttaggcgttaaaaataaacgcctagaaaataggcagtaataactcgaaaagtagcttaacaacagcccaaaaacacatgtttttcgtgcatttcaggccacggggagctcaggaaaaaatagccttttgcctaaaaatcccatccctaat

SEQ ID NO: 201 - DNA, 3982 bp, Heterodera glycines
ctggaggtcgtggaatgggcttgttattgggttttattgacaaaatctactgcgcgccggccagtacagaatgacgaaatccgtgcgacgctccgaagccacgacgacgggccaaacggcggacacaacggccaccgcatccggtggcatcgtacgtaattcgttttcggacgtcgtcgcaacggtagcggcggcggtaggggtcgtaccagcctaagccaacgaatgacctttaccataattatcgcttttaatcgccgcaaatcgacggcaagatcaaaagcgtgttttattttagcggagaaatagtggtttgaactcacaggttttggcttgtaaagtgaaaacttgaacaatagtaagtgatggaagcgagagttttcatgcttctgatacagtaccgataggtactgtaaaccaataattatcccgattttttcaccaaaaatcccgccggtccggtgcaaacagcgaaaaaatagaacaaaaccgcatacctaattagctaattaccaagtgatgcactttctaggaatggaccattcacaaacaataaaaatgattgtaatgatgaacatgcgctggacgccaatgtcggatattacacaacagtcaggactgaactggcgggccgatttcacgccggattggtgcgcaaaaaaactatttttattttcaaaatttattgtttcaagaaacaaattacctaatttcccgcctaattacccaccaggaaccgtcattcaatcgctacaaatatggcaaaatgggccacaaaattgacttcatttgtgccagagcattcccattaatttttgccggtttgaaaaaaaattctgttctattatacagtataccatttgttcagttttcaacgctgtttattgggcctactatctgagcagataaaattaagaatgatttgtttaataaaaaggcaataacattaataaattttaaataaatcaattaatttgtattatacttgcttcataagtgtccttatttctaagatagtaaattctggaaaagtattaataattttgtagcaaatttcaccaatcccattaataagtgaaatcatttttacaagttaagtgccctgttgaattttataaaattaacatgaaaatatatttgattaagatttttaattaaatttaatttttattaaaataaatctgttaaattttggcagaaaataaaatttgcatttacactttatacaactgatccattttctgacttttgtgtttgcgcttccatttcaatcaatcgtttgcttattgtcagcaagaacggggcttgcttaaaaaatgtttggcattatgttcccaaaattagtaggggtttttcttccataacttttccaccggtgccaaaataatcagcgatactcaaacactcattttccatacacacttgggcgagattttaaagtgctttgaatatcaaataaatgtgcaaaatataatgtctcggcgggtgggaatcgaacccatgccttccacctagcccgtggactgctctaccattgaactaccgaagcaaatcctcctttactctctcaagtagtctgtttacaaatcagcaccaaaactgctttttaccgaatctgttctagattgtggcacaaatgtgctggtgttgttgttgttgttgctgttgttgttcctgttggaactgctggcaacatcatggactgtcgttgtccgttgacattgtactggtacaatttcgtccatgcacgcatagattaggtcgtccaaaaaggcatcatcccccggtgccatgttgttctaatagcgtagaagattgggtattaaaatgaaaaaaaacataagaacaatgaaaatgaacgtcgctttacaatcactagaaatgtgtgggattcgcaattcatcgactcgagaatttcccgagtttttcggatcccagtctcggttcccgggatgatttcccggtattcgtttccgattcacgataagaatcaactataacgcccaatttagattagaaccttgtgatgctcaagctcaggttcaaaaaaatcgaaaaccaatcgttacgttatttcaaaaaaaacaccgtaccatcctctgcctatcattatactgctggtggtgctgctgctttaaactgttcattgctgctgccgctggtgttgtttgatgctgtttggctttgtgcattgacggaatttgttcgacaacgcccagcgcggcgagaaacgcgtccgccggcgcgcaactgtcttcactggccaacgagcgcgtgtctgaatcaacaatgcccgagtcgggcgctgaacgacgactcccattgccaatggttgccaggcgagaaggtgtccggtttggcacgttgacgtagttggacgcagcggaacgcgcggaggagggcactgcagaccgcgcatgatagtgaaagttgcttgacgtttcgcgcgcaggcttagcaccaggcggagacgttgtccgcttcacgtagctgaacagcccactttcaacggacggcgagaaaaatggcgctgcagatggtgcacctgcaccgttggtgttgcaatcagcagcactctcttttgtgtgccgttgaagttccctgaaaaagtgcataaagcagacccggaatcccggttcactttaaatttacctaaatgttaaaccgggtgcggaattccggcaccaaaaagtgcgtaatatggaaccggaatataggtcacttatacatttccggaatgcagtaagtgaatgcatgcagaattccggtgcgaaatgcggaaccggaattcggtttaattacataaatgcaaaaccgggtgcggaattccggtaccaaaaagtgcggaacactggtcacataaacttccggaataatgaaagtgaatgcagaattcaggtgcgaaatacggaaccggaatactgattaaatttccggaatgcggaaagtgaatgcagaattcggtgcgaaatgcggaaccggaattcggtttaatttactttacctaaatgcaaaaccgggtgcggaattctggtaccaaaaagtgcgtaatatggaaccggaatattggtcacttatacatttccggaatgcagtaagtgaatgcatgcagaattccggtgcgaaatgcggaaccggaattcggtttaattacttaaatgcaaaaccgggtgcggaattccggtaccaaaaagtgcggaacactggtcacataaacttccggaataatgaaagtgaatgcagaattcaggtgcgaaatatggaaccggaatactgattaaatttccggaatcggaaagagaatgcagaattccggtgcgaaattcggaaccggaatactggtcacttatacatttccggaatgcggaaagtgaatgcagaaattcggcacaaaatatgggaccggaacactggtcacataaatttccggaatgatgaaagtgaatgcagaattcggtgcgaaatgcggaaccggaatactggttacttagaaacccgataataatagagattaaattatttttttgtttgttaacatgcctgcatgtggccacgctaaacatccgcttttttggcgctgcagggcgtaaaaagttggaaatgcccgcgtttttggatgctgcggtgccttgagaacgcaaaagccgcgtgagtacgagcatagaaaggagacaaaagcacaggaaaagagttggaagcaccatcagactcaataggtcaaacgaactcaacaaggagtgatcatcaccagccaatgtcgggttgacagaagaaaagttgcccatctatgaggggatatgagaaaatagccagtcaacggaggtgccagttttggctgaaaaatccggcattatatctggactaatcgccggcaatttctttgacaatattattctgaaaattatatattttactttactaggaaaaaagctctaggaaagttagaaaacttaaaattttgaatttttttaaactttttacc

SEQ ID NO: 202 - DNA, 4324 bp, Heterodera glycines
ggggcgggtaacaaaaatttcggaaccaactcgataaaaaccttattgaaataaactcattaaatcaatttaaaaataaaattaaaactatttcatttctgtaagattgaccggaaaaataaagtcgaattattaattcattaaacaaaaagtgatttggtcattatttttatttttttattgacctcacattatattttattttttggggtctgagtgaaaaattagtgaagaaaattggagtcaaagggaaaaaaaaaaattaatatattctttaaaagtaacactgcccaagtgtgcaaatggcctaatggctagtctccttgactttcccttcttctttcccctggttcaatccctctacagaaattagattattttcaatttttttttttgtatacccatgggtttcctataaagaaaatatgattcctcatagttttttttaaattgatacatattttatcatttttaaatgaaaatcctaccaattgagcttaataatcgcaaaaaccaacctttttttgttgaaaatctgttaacaaattgcacccaaatttttaatatttccccccggcggcgcctatcggcaccgccggtccccctttcttcccaaaagttttttggaaaaagcgctccgaaaaaaagtgatgtgaaaagcaaatctgaatttctattaatattcgatgatttagtccaaaaatgattaattgtttgaaataattgaagaaaatttgtttgaaaattttcattaatttaatttattaaataaaaaaccaaataattttgtattattttcacttgatataaattaaaatttgaatttttttttaaatttttaaaatttttttgaatttttaaaatttcccggttggtcccggttcccggtttttcttgcggtcccggtcccggtcctgaaaaaaaatcgaggtcccggtcccggcttctcaggtcccggcaagtcccggtcccggttttggcaaaaattcccggtcccgtggcactctacttttttgtatgcaggatttattttgaatgacctccgaaaaagtctctcgcatgaaaatctcgaacggcttatttttattcatcataatattatcctttacaattttgtttattgataatatgggaattttctaattatgcttttacaaatgtgcgatccgcggcgttttttgcgcgatccgcgatccgcgaccgcggcaaattgaatccgcgatgcgcgatccgcgaccgcgggattttttttgcgcgatccgcgatccgcgaccgcggcaaattgaatccgcgatgcgcgatccgcgaccgcgggatttttctgtgcgcgccccacccctgcagtgcatgccatcattttggagatcaaatacgataattcaacccaaactttcatcaaatccgatccacatttgctgtccttcttttcagagatacttcccaatgtctttctacgacccttttgaacttgaagatgaacccgaggtttttgcggaggtggtcgttcgcatggtctggaggcttgtagtcaaccacggacttctgattgtattcgtctattgttgcttctctcttgggggcgttttgtttcgcaaaatttacctcgagggccttttttcctcatggagtgcgtttttctgaaaaacattcctccttcgttcgttttcagaagtgtggcaccaatactacgaaattctcagccaaatgaacgaacggcttgaggcgaattatgacgtcgaactgtgggagaacgcggaattctgtcgtaattacattaaggtgtctgtcgtttactatatgatatgtcggccaattcattcgctttcacccccccccccccccaattttattccttttcagtttttcgagtcctttcgtcgtttccgtgcgcgatgcgatcgcgaccataagggcgtttcgatcactgggaattggcgcaaagctaccgaagccgaaccattgcaggaattcttcgatgccgattacattttgcacgatcgtcttgtctatgcggttaaaggcgctgagggaattccacgggaaaacggtgaagaagcaaacggagaagagaaagaggaaaacaaggagggaaaagaagcaaacagagaagagaaagaggaaaacaaagaaggaaaagaagcgaatggagaggaaaaataagaggaaaagattttattctgtgactgcatgttatgtatgttaattttggcgctagttaaaaagttaccgattttgaattctatcaaaaacaaaacttcatgattgccaaacaaaagggggtaatactttggtttgttccccccccccctttttttttgagaaaataaattttttttaaagttgtataatatactttattatgggcttttcggggtcgctggtcacgacggatatgacattaatttcggtacttgtgggttatctgtgctcagattttcaaaattttttttttgagaataaacttgttttaggggtttccggggtcggaaaaaccgattctggcacctatattggcccaattcgaaccccaaacccggattcgaacaaaaaagtcaaaatccatttttcaaaaaaattcacattttatacacaaaattgagtcatggcctttttttggttatacgagtcgtcatcgtggcattttttggttatacgagtcgtcgtcgtggcattttttggttatacgagtcgtcgtcgtggcatgttttggttatacgagtcgtcgtcgtggcattttttggctatgcgagtcgtcttcgtggtatagtgaagcgattttgtgtataaaatgtgaattttttgaaaaatggatttttatttttttgttcgaatcctggttcggggttcgaattgggtgaaaatagatgtcagaatcggttttcccgaccctgaaacccttaaaacaagtatattttcaaaaaaatttttttttgaaaatctgtacaccgataaccgtaaagtaccaatgttcgtttctgacaacaaaaggctttatttatcatcccatgctcgctaagagggctttttttggattttttttataaatcctattcatatttccgtatttttttaaaaataaatccattttagcttttcatcgataaaattatatgatgaaaagcatagatttttgcagttttgaacataagcacaataaatacatacatattaatcaggaggaaattgggagtgtgttcagtatacaataagtgccgaaatgaatgcgtgggggtgaaaggacaaatggtgaattatatacaatataatgagcaaatagatcagcgtcatcggcacgatacaatataatgagtagggctgggatttttatgtgctaaaaatcctgaaatatgtaataaaatatgtgctaaaaaatgctgaaatatgtgctataagtaagcaaaaaaaaatgccaaaatatgtgcgaaaatatgtgctcaaaattggaaaaatcaagtgtatttttgcataaaaattccaaaaaactcattcttttcattttcgcccgcacaattgcaaataaaaaacatttggaggtgtttgggggtaaaattagtccttttttgataaattgttttaaagattatttttccatcagttgagtaagttccagcaagaaacttcgatatccagtaacgaattaatggagaatccgattttcggtacacgaaataaataaagaaaattttgaaagagcctataaaaatgtcaagaaagttgatttttaggggtgcatttttgaattttttgtgtttttcttagatatttttttcaaaaatgccaaaatatgtgcaaaatatgtgcgaaactccgaaatatgtgcgatatgtttttatgtgcgaaaacgccaaaatatgtgtttttatgtttttataagtcgctctaattcgaaaattgttcggagaaaatgttatttttgggcttctctcgccataactaagccgcagaaaaaatatgtaaaaacataaaaatcccagccctatttattacagtttgatcaacttcacctcatccatttgttgtttctctgctctattttgttgggcttcatctgtcaactttttaattggttttgtcaaaaatgccacttttttctcgttgttatgcgttgtagaagctttaagtgattttgaagatgacaattttcgcattggcacaatgcctaaaaggacaatatgcaaaattaaacatttaaaacaaggcaaagtttgataccattatttgtcatcggcaccgaagaatgcccccgaccaaatgcagttttatgaacgctggtgatggcacttggagaactgctgctggctgcattgccaatcagagttggcca

SEQ ID NO: 203 - DNA, 1257 bp, Heterodera glycines
attcgggttcggggttcgacataggtcaaaatttaatgtcgattaggatttctgatccttaaaacccctaatatgatattttctcttaaattttcgactttttttcatggttgccgaataaacaaaatatctaacgcaagaaatggaaattgcgaacattggacaattaaacacaacacaacaaatttatttttcggcggtgaaatttacagtatgatgagaacttacagtgtgtacaacacaatatacatacatatgtacaacagcgaatatacggcaacaacagattacaataattaatacaggcaaacatttaacatcaatcaatccaatttcctcataatatcacacatcggtacgccttgccggggtgaacgctgtcgatggcactacttcttcacaaaaatttccgcgtccaagttctgaagcgtcccgtagttcggatcggtcgctgaaaaggggattaaaaaggaattaaaatttgaaattttcgccatttttttcacttggtgtcagtgcctgtccgcctcctccatgtggcgccggtcccgcctttggtgccgctgccggttttgctggcgcgttcttcgtgaagatgtcggcgtccaagttcttgagggtcccgtagttcggatcagtcgctgaaatgggaaggaaaagcccgtaaaatttgaaaatgttcgccatttttttcacttggtgtcagtgcctgtccgccgcctccatgtggcgccggtcccgcctttggtgccgctgccggttttgctggcgcgttcttcgtgaagatgtcggcgtccaagttcttgagggtcccgtagttcggatcagtcgctgaaatgggaagtaaaagcccgtaaaattcgaaaatgttcgccatttttttcacttggtgtcagtgcctgtccgccgcctccatgtggcgccggtcccgcctttggtgccgctgccggttttgctggcgcattcttcgtgaagatgtcggcgtccaagttcttgagggtcccgtagttcggatcagtcgctgaaatgggaagtaaaagcccgtaaaattcgaaaatgttcgccatttttttcacttggtgtcagtgcctgtccgccgcctccatgtggcgccggtcccgcctttggtgccgctgccggttttgctggcgcgttcttcgtgaagatgtcggcgtccaagttcttgagggtcccgtagttcggatcagtcgctgaaatgggggggaaaggccaattaattgaaaatttcggcttttt

SEQ ID NO: 204 - DNA, 2845 bp, Heterodera glycines
gctgctgacttctgcgacatgtctcctccggcggctgacttctgcgacgcggtgctcagtgccgaggctcctccagcaggcgctgctgacttctgcgacatggctcctccggcggctgacttctgcgacgcggtgctcagtgccgaggctcctccagcaggcgctgctgacttctgcgacatggctcctccggcggctgacttctgcgacgcggctcctccagctgccggttttgctggcgcgttcttcgtgaagatgtcggcgtccaagttcttgagggtcacgtagttcgaatcagtcgctgaaaaggggatgaaaaagaattaaaattttaaaatttcgccattttttcacttggtgtctgtgccggtccgcctcctccatgtggcgcctgtcccgcctttggtgcctctgccggttttgctggcgcgttcttcgtgaagatgtcggcgtccaagttcttgagggtcccgtagttcgaatcagtagctgaaaggggatgaagaattaaaattttaaaatttcggcattttttcacttggtgtctgtgccggtccgcctcctccatgtggcgcctgtcccgcctttggtgccgctgccggttttgctggcgcgttcttcgtgaagatgtcggcgtccaagttcttgagggtcccgtagttcgaatcagtagctgaaaggggatgaagaattaaaattttaaaatttcgccattttttcacttggtgtctgtgccagtccgcctcctccatgtggcgcctgtcccgcctttggtgccgctgccggttttgctggcgcgttcttcgtgaagatgtcggcgtccaagttcttgagggtcccgtagttcgaatcagtagctgaaaggggatgaagaattaaaattttaaaatttcggcattttttcacttggtgtctgtgccggtccgcctcctccatgtggtgcctgtcccgcctttggtgccgctgccggctttaccggccgtccgcctccccactgcgaactcatgttcaggtaatccagaggaaaatcatatgtcaaattctgcgatgcggtgcccagtgccgatgttcctccagccggtgccgctgcggtcttctgcgatgcggtgctcagtgccgaggctcctccagcaggcgctgctgacttctgcgacatggctcctccggcggctgacttctgcgacgcggctcctccagctgccggttttgctggcgcgttcttcgtgaagatgtcggcgtccaagttcttgagggtcacgtagttcgaatcagtcgctgaaaaggggatgaaaaagaattaaaattttaaaatttcgccattttttcacttggtgtctgtgccggtccgcctcctccatgtggcgcctgtcccgcctttggtgccgctgccggttttgctggcgcgttcttcgtgaagatgtcggcgtccaagttcttgagggtcccgtagttcggatcagtcgctgaaatggggggaaaaggcaattaattgaagatttcagctttttcatttcacttggagtcattgccggtccgggcgcctgctgttgcggctgtggggctcccatcggtggcggtggcatgcctcctgaaatgggggaatttcaatggatttgcgattgcgccgtgccgttcgttcgtttccgacccccacctttcgcctgctgttccttcgcgaaaatttccttgtccaaaccgacaagcgttccgtagttcggctcggattctgaaatggggggaaaaagcaatgaatcatttgttcatttgtttacgtgggacgagttccttcgatgctgcgggaggcattggccccttcgccgaccctttgcccgatttcttctgcggtggcggcgcttttcctttgggcgacggcttcttagcggcggctgccggaggtcctgaaaaacaattagcattcttcttgaatcccaaaattgttcgcgttttgtgccacctttttttgcagcggcgcctttcttcggtgctggtccttaaagccggcaaatttgtttatttaaaaagtcgttcgttcgtccacctttttttgagccgccgcttttctctgacgatttcactgacgagggcgcttccgctgctcccggtggtccgcccactgccgatgtttgtggcgttggcaccgctgctccggctttgggctgaaaaaggaatgaattcatttgtgaaaaagggaggggtgatcaaaaaacggtggcacctttttcttcttggagccgccaccacagcattggctgaggatgatgaacacagcgccgatgacaaccagcagaagttgaacgggcagtaataagacgacggaggaggagaaagtcattattgttgggacgcaaattgtgttgggagggaggcaaaagtcaccgtttatatactcattttttgggcaattctgaagaatgggtgtctataattttcaaaaatttttttttaattttcggctcaaaaccagtttttaggggttttcgagggtgctgattacggatctgaactcggatttacctaattccgaataccggacactaattcgaacaaaaagttgaatgatttttttttcaagaatggatttattggggtaaaagcttctaattcatttaaataaaagttttgaatttttaagattatattatggattttaagggtcggagaatccggatctgacattaattttgatctatgtcgaaccccgaacccgaattcgagcaaaaagtctaaaattcaaattttactaattttgtatttttggtctaaaaatggcttacatacatattgagaaacaaacataaatggacaattcactaataaaaaatcatttcaaccatttagaccaaaa

SEQ ID NO: 205 - DNA, 5717 bp, Heterodera glycines
aatttttttagcgagaataccaatgaattttgaaaaaaatgttttctgaaacgaatgttttaatcttattttaacataatgactgaaattaaatttttctcacaaaacagtgccggattaattcttcccgatataatcaagttttttgttatttagcaaaaatgtcaaagtctttgaagggttgttaatggtgtcagtttaagaacatggcagccaattcacctatttttgaatcccggacccgaattcgaaccaaaagtcgaaattttgaagaaaaaatttgttgggacattaaagcagaaaagaaccatgaaaagacatttcgtttccgaatctaagctatcaaaaaatatttctcagccccagctacatcgactgaaagcgaacggcttttctccaccgctgggttgattgtgacagatctgaaaacgtttattgcctgagaatgtggacaaacttttatttttgcatcacaatctttaaatttatgattttgattatgaataaaatttttgggaaaaaattatttaaaaaaaatcggaatcgtaatcggaatcgcgattttgggccataatcgtaatcggttttaaaaccgtatcggatttttggccataatcggaatcggcgatttaatcggaatcggattttgtctggctcggcacatccctgttttgtaccattgccaactcatgcacccacacgttggactaccctatcaaaagtggtcagccggatgttagagaaatggcaccaattaaaagagctttttgcaatgccgaacaagccgcgtgttttacatgaattttttcaatcggaaaattctgaaccaatttgttactttttacaaaattgtgctcaactacattgatcgctggttccaactccaattactaccaaaaaatatttcatggacaaatttacaaaatcatcctttgaattatgcagaagttgtgcaacttgctgagcaaatttgtcccgaaatagcgcaattggatgaactgtttgatgaagtgtctgctgtgaaccaaacattggccgacattcccgaagaattttggctcaaatcagccgaatgcattcgtggaacgagttttttcactggcaagcattcaatggaccaaagaaagaaattcattggaagttgaatcggtgaaagcgctcttactggtgaaggtgaactttgatctctcgtgcgcggaaatgaggaaaatgatcagcggaaacaaaaaaatattggaaaaaatccattccggtgaaaaatacaaaccatttgaataaattaaccatttttcattgcatataatagaaattttaaatgtccttggatttcatgaattttccccactatgtccttgaaaatcggcatacccgtccttggaaacggaggatggacgatggcagccctgatttagaccaaaaataaaaaaattcgaattttgaattttcgactttttgctcgaattcgggttcggggttcgacataggtcaaaattaatgtcagattaggattctctgatccttaaaacccctaatatgatattttctcttaaattttcgactttttttcatggttgccgaataaacaaaatatctaacggaagaaatggaaattgcgaacattggacaattaaacacaacacaacaaatttatttttcggcggtgaaatttacagtatgatgagaacttacagtgtgtacaacacaatatacatacatatgtacaacagcgaatatacggcaacaacagattacaataattaatacaggcaaacatttaacatcaatcaatccaatttcctcataatatcacacatcggtacgccttgccggggtgaacgctgtcgatggcactacttcttcacaaaaatttccgcgtccaagttctgaagcgtcccgtagttcggatcggtcgctgaaaaggggattaaaaaggaattaaaatttgaaattttcgccatttttttcacttggtgtcagtgcctgtccgcctcctccatgtggcgccggtcccgcctttggtgccgctgccggttttgctggcgcgttcttcgtgaagatgtcggcgtccaagttcttgagggtcccgtagttcggatcagtcgctgaaatgggaaggaaaagcccgtaaaatttgaaaatgttcgccatttttttcacttggtgtcagtgcctgtccgccgcctccatgtggcgccggtcccgcctttggtgccgctgccggttttgctggcgcattcttcgtgaagatgtcggcgtccaaattcttaagcgttccatagttcggatcagttgctgaaatggggggaaaaggcaattaattgaagatttcagctttttcatttcacttggagtcattgccggtccgggcgcctgctgttgcggctgtggggctcccatcggtggcggtggcatgcctcctgaaatgggggaatttcaatggatttgcgattgcgccgtgccgttcgttcgtttccgacccccacctttcgcctgctgttccttcgcgaaaatttccttgtccaaaccgacaagcgttccgtagttcggctcggattctgaaatggggggaaaaagcaatgaatcatttgtctaagccatttcggattcatttgtttacgtgggacgagttccttcgatgctgcgggaggcattggccccttcgccgaccctttgcccgatttcttctgcggtggcggcgcttttcctttgggcgacggcttcttagcggcggctgccggaggtcctgaaaaacaattagcattcttcttgaatcccaaaattgttcgcgttttgtgccacctttttttgcagcggcgcctttcttcggtgctggtccttaaagccggcaaatttgtttatttaaaaagtcgttcgttcgtccacctttttttgagccgccgcttttctctgacgatttcactgacgagggcgcttccgctgctcccggtggtccgcccactgccgatgtttgtggcgttggcaccgctgctccggctttgggctgaaaaaggaatgaattcatttgtgaaaaagggaggggtgatcaaaaaacggtggcacctttttcttcttggagccgccaccacagcattggctgaggatgatgaacacagcgccgatgacaaccagcagaagttgaacgggcagtaataagacgacggaggaggagaaagtcattattgttgggacgcaaattgtgttgggagggaggcaaaagtcaccgtttatatactcattttttgggcaattctgaagaatgggtgtctataattttcaaaaatttttttttaattttcggctcaaaaccagtttttgggttttcgagggtgctgattacggatctgaactcggatttacctaattccgaataccggacactaattcgaacaaaaagttgaatgatttttttttcaagaatggatttattggggtaaaagcttctaattcatttaaataaaagttttgaatttttaagattatattatggattttaagggtcggagaatccggatctgacattaattttgatctatgtcgaaccccgaacccgaattcgagcaaaaagtctaaaattcaaattttactaattttttatttttggtctaaaaatggcttacatacatattgagaaacaaacataaatggacaattcactaataaaaaatcatttcaaccatttagaccaaaaataaaaaaattcgaattttgaattttcgactttttgctcgaattcgggttcggggttcgacataggtcaaaattaatgtcagattaggattctctgatccttaaaacccctaatatgatattttctcttaaattttcgactttttttcatggttgccgaataaacaaaatatctaacgcaagaaatggaaattgcgaacattggacaattaaacacaacacaacaaatttatttttcggcggtgaaatttacagtatgatgagaacttacagtgtgtacaacacaatatacatacatatgtacaacagcgaatatacggcaacaacagattacaataattaatacaggcaaacatttaacatcaatcaatccaatttcctcataatatcacacatcggtacgccttgccggggtgaacgctgtcgatggcactacttcttcacaaaaatttccgcgtccaagttctgaagcgtcccgtagttcggatcggtcgctgaaaaggggattaaaaaggaattaaaatttgaaattttcgccattttttcacttggtgtcagtgcctgtccgcctcctccatgtggcgccggtcccgcctttggtgccgctgccggttttgctggcgcattcttcgtgaagatgtcggcgtccaagttcttgagggtcccgtagttcggatcagtcgctgaaatgggaagtaaaagcccgtaaaattcgaaaaagttcgccatttttttcacttggtgtcagtgcctgtccgccgcctccatgtggcgccggtcccgcctttggtgccgctgccggttttgctggcgcgttcttcgtgaagatgtcggcgtccaagttcttgagggtcccgtagttcggatcagtcgctgaaatgggaagtaaaagcccgtaaaattcgaaaatgttcgccatttttttcacttggtgtcagtgcctgtccgccgcctccatgtggcgccggtcccgcctttggtgccgctgccggttttgctggcgcattcttcgtgaagatgtcggcgtccaagttcttgagggtcccgtagttcggatcagtcgctgaaatgggaagtaaaagcccgtaaaattcgaaaatgttcgccatttttttcacttggtgtcagtgcctgtccgccgcctccatgtggcgccggtcccgcctttggtgccgctgccggttttgctggcgcgttcttcgtgaagatgtcggcgtccaagttcttgagggtcccgtagttcggatcagtcgctgaaatggggggaaaaggcaattaattgaagatttcagctttttcatttcacttggagtcattgccggtccgggcgcctgctgttgcggctgtggggctcccatcggtggcggtggcatgcctcctgaaatgggggaatttcaatggatttgcgattgcgccgtgccgttcgttcgtttccgacccccacctttcgcctgctgttccttcgcgaaaatttccttgtccaaaccgacaagcgttccgtagttcggctcggattctgaaatggggggaaaaagcaatgaatcatttgtctaagccatttcggattcatttgtttacgtgggacgagttccttcgatgctgcgggaggcattggccccttcgccgaccctttgcccgatttcttctgcggtggcggcgcttttcctttgggcgacggcttcttagcggcggctgccggaggtcctgaaaaacaattagcattcttcttgaatcccaaaattgttcgcgttttgtgccacctttttttgcagcggcgcctttcttcggtgctggtccttaaagccggcaaatttgtttatttaaaaagtcgttcgttcgtccacctttttttgagccgccgcttttctctgacgatttcactgacgagggcgcttccgctgctcccggtggtccgcccactgccgatgtttgtggcgttggcaccgctgctccggctttgggctgaaaaaggaatgaattcatttgtgaaaaaagggaggggggatcaaaaaccgggggaccctttttct

SEQ ID NO: 206 - DNA, 4576 bp, Heterodera glycines
tcattcttttatttcttgctgatcgccttcattttatttcattttctccatctatctgccggagaatggattaatgttgagctgagtgtggacccaccaaattcttttgaccgttcattccgcaccatttccaagacttcacctgcgcaacattggttcggctataatcgggacacagcatgtcatgttgagctggagaggaatatcaatcggctgtacaccaacccggatacgtggaacattgccctgacagatgtggataatttaatgagcctgggacggacaacaattgagataccgtcaaccgccttaccatgggcatgttttgggcatggcggccatagttttgtaattttcaacctccaaaatgctgcgggtgaggtgaccgtactgcgtggacaccaacaaaaaatagcacggcaattgagcgcgtatggccgcattttgtttgatcatattgccgcccgattgtacattgtggacaagagcgaacgcagaatcaatgagttgctcattgccgatttggagcggtggtggactctgaataatacggacgatgcgctgaacaggacgtcacatgttctgagaagcaattttgttggctttttgccggagcaaaaaacggattatttcattgcagctgatcatgtgtacctgatttggcgaaggcgagtgtacaagttccgcattggacactatttcaacgatccttcgtcacagctccagtttctgaccaactcaagcgacatacgcttcaacttcctcttatttgaagcaggtgcagaaaggctgggtgaaggcggcggcgatcgtagaaatagcagatcagctgttgttgtgccagcggtgtcgtcgaacggaattgaacgtctcttgctcgcgttgacttacctattcgatcttgtcgtcatattgattgccatttgtgcattccgccagttccgccgattgggaggtggtgcagccgcacgaaatggggatgacgcgattgaactaaatgaatacgatcttttccattcactttcgttgcaaaacaacaacaatgggggcggagcctatgacgtatctgctgcatacaatccaacgaatacagcaccaaggaccgcccaccagctgagatcttgtgcaactatttaaacggctcacttttttttttttgaattttccaacacacacttgcataaatttactgttattttatgacagccaaaaaataattatattgggtatttgctgcggctatttcatgcaaagagcgataaaacattttcaagaatccttggcactagacaccgttgaacagctgtatgcgcattttaaagaggaaattttgagcgcacctggtgaatattatccaaatcctctttgtgggcttggttgtgtacacattgtcaacgacgatcatcctgatctgccggtgttcgtcgaaggaacgcttgatttgatcgcgggacttgaactgtactccacatgttatccgaggacggaagcagggacaatcaactggtcagcaagcagagcaatcacaatcatagattataaaattttcaatttaggagcaaagtcctgtacgtggagctgaaggacatgatgatttgcccgggcgagtcgccttgctgtcgctgcgcacaacccatcaacaacaacctgtcacactaccagctgatcgtggacgagctggaccgttggtgggtggacaaccaccaacacaatcgggggcacgtcgtcgaacgagaagaagaggaaagcgtcgaccactcaacctggtgaaggcactgtgtcgtttcaacggaggctgcatgccatcagttttgccccagatgattcagaggagacgaatagaaaatttgtgctttcttcgtgatctcaggctgcgaacagtgcacctgaagaataacattatgatttccgccaactcattgtcatttcacagtgcaggcagtttgcttgcctaccgtggctatttgtccataacggtagagcagcacttgtacgttcgccatcgtgttcgtcttaggttccccttcctgccctgcgttgtgcaatatgggggaaatcaccatcactattattttccattagaactgcttgaaatatgttctcgtccaactgacgaatcctcctaatctacacaccttccgaatactgttttattgttgctgttgctattgtgaaaaataaatgtttgttaacacaagtgccgatttggggttattattttggggtgagcacttttcctctattccaactttcttccctcctgtgcgttattctggactatttagtttgccgccgcctcctcctcatcatcatcaccgctatcgtcatcagtgacttcggcttcagactcagttgaagaactctgggccccttctcgatgagagtcgatagctattttttaattttgtaataatcatcatcatcatctgattaccattggaacaatgcgcggcctcccaatcacgaaccttttcctcagaacgttcaaccctacacaaaaaaaaaaaaaaaattggttgatcgagtcaacgcagtttatttttgctaatacttttttagtatggtgtccaaagagtcttccccaaaatcgaccacgtccgaggcattgtcgtccacacccatttcttcctccagtttggagtattttttttccaacgcatccagcctgtttttaataggaggcatctatgttatgccactttcacaatttaccattcggcacgtgcttcgccctgtgccttgatcattgcgcccaacattgaggtagcggacccatcaaatgaatgacgtcgttttcggctatcaccactgctcgtggaaggcggtagctccttcttttcatccttgggcgtttcgtttatcgtcatgccgagaaaaacaatttcttcttcgcccttttcctctccatgtcctttttcctccggtttcagatccatttccttttcagttttgcattcactgttgtccatgttgtcactgctaatttcttgtccttcaattgctctttaaaggttgttgattagtcattaatgaaataaacattgccaaaaaaaccaattgaaaacggaattatgaaattcttaaaattttatctacggcgattaaataggtatgtgataggttcattatcgcttattcattgataaccaaaaggaagaacatcaagctcatcagtgataattcccttctggcagacgggcagatatcgcttgcgctgctcacgtgtcacaatctgactcgcacgagtcggttgaattttatcataatggaacacggctggctcctctccttgacgtccatagttcaacactttctgacgaaaatgctcaaactgtagggtctgactgttttgcacgtcaaaagttattcctctaattttttgcacatatcggatttcgccagttcgctcatcaaccatttttagtgcatattgttttgctcctaagcggaaagaaatatgtctattacaaatctatacgccgctatgtacctccacaaacgaagttttttatggaaaatccggtgtattcttctgacatttggacaaggaattcgccggtttgaagtggcgccaaatcacgactatgcttcacaatgacactgtcagtgtcctaaacaacggggtgctaattgtgttacaaaacacaagacaaactaccgtataaagcaattctgctccttcggtgttgtacacttgctgcatataatcgagtaacttcaaccttgcacgaccttaaaataataatgggagcaatgctagtgttgacaaaactaactagtggtccacagactgagcacgatattgctggacgaatgttcatcgataaaatttttttggtcctgtacgaaacacgaatgacttcatcggaaaggggaattatggcataaatttcctgcgttggaaaatttccataataaattaaggcgagcattcaaatactactactactacttacgactttatggtcaaggatgagcttgtaaaattcctgaggctttgtgatcacacgatttgcgcccaactcattgcgcatgctgaattttcccctaaattttgggttacttttttttttttttttttttttttttttttttttatcgttcctaaaacataccacaaactgttcagcattaacttaaaaatgaatcggagtccaggatttttgttaatgcgtgccaaatccagctggacgttgtaccttcgcatgtattcatcggcaaaaatttttctgtcctggtctgtttcaacgccatccgggaagccgcttgcctccacctatatgacaattgtgaaacaaaatgagtgcaaattgtacgtattgtacaaattacctttagctttatcataaggcgaacatattctttgaaaattttgtcactcctaaatgtagctgatggatgttaggcggcaattcatacactcttaccattgctcataatgccaagctctccagaatcggtccacccggtagccgcactctaacgcacgtgccagctcaatatgagtgtaggttccggtgtaggctcgctgctcggctgtgtgttcacattggtgtgcacgccttgtgcccatatg

SEQ ID NO: 207 - DNA, 11126 bp, Heterodera glycines
  misc_feature (135)..(135): n is a, c, g, or t
  misc_feature (11042)..(11042): n is a, c, g, or t
aatcagggtgtcgtgtccgccacttaccaatcaaccattatttcttcaacgcttgggtgaataattttcggtataccgacagggtaatttgtgtcgtagttgacctataatcaatataaaatcgatccctccctntaatcacaaaatttattgtctgtctaatagacacaacatacccacggatacaagctcacaatatcataaacgctgattttttcatcgtcagaagcctctgcaaacagcttcagtggaccagttcgacctgttaggcaaacattaacgaggaaaaaaaactgggtccacttcacctccacagtaagcggcacgtgggtcgattggccccctttcattgcccaaatcgtcaaaaaattcgcgcatctgcctgttacgggggtctgatagcagagcgttgatctcgcattcctcaaaaaaaagaagagcagttagatttataaattgcgctgtgttttaacccaaatttcttccacttcaatgcatcttcgatactcgtctggctcacggagtttggtcagacggtcctgggttgattcgttcagctctctgcacgtttttccgtccaccagcttatcaccaggatcatagcaacgctcacatccatgccaataactgtagtagcaatagcacccgcacggaatgaatcacacttaccatccaagcacttcaatgcatttgttctgttcagcaatccatccgtcaattttgtaattttttatgcgtttttctcttccattgcctgcgtgttgtacttgtactccttcacttttggctctccagtccaaatatttaattgcctaaatgtcaaaataaattttaaaatcgccccgaaagctccaataccagaacactagctctgtcgtttctctcgtaccctgtctctgggacgatggccaactgattctctgtcatgaacattgtacgaaaaatgttcatacagacgctattttgcaaattgaactcataattatcggtcatttcctcccttcccgtcatcctacctcgcaattgtacaactaattgggagaacatctaacccgttggttatgtcgcgcaacaaaatttggcgaaatttcagaattgcaagcatcagaatttctgtgtcattttcacaataatcgcgcaactcttcaggaagaaagaatggcgtgtgtcggttctcttcgtacctttttttagttcaaaaaatttattgtatgccatatagcgtgtgtaaacaaaattaccattgttcaaatttttcaagttttgccggcttcattgaaccgggaaaatatgcttcttttggtggtagatgcgggagccgaatttcataattttcccttaaaacatcgatgacaagtggtatctgtgtttgagagatgtgtcttctacctccgattgaatccgtagggaaaaaaaggtttatcgggacagtcgagatcaaaggtgcttttcagtccatccaaacgtatcgggaacagcaggcatgagtcgcgccaaattaggaaggagttcaccgccgaatgttgtaaacgaaactcaaaaattttaagtccgttcatcacaacgtccggtctccttctggtctcgcccagataacgaagaacaaaatgtccgtcaaatctggacgcgttatgggccttttaaaggggcgttatggccaaaagcatgacttaattcactccttgttcttacccaaatgtaagtgtcgaatttttcactccatgctgtcattatccattcaacaaaaccagcaacgggctcatctccctcggtctcgctcctttttgagcgtcattgcgttaaagggtggcccgcccccacaaaaacataccagtatttgattcgctccactgctccgtcctcattcttgcatatttcacaatccccattttcaatttggtggggcaaatcggcgcaatcggtgcagctcacacgcgcagacaaaaagtttactttatgaacttgttggtgcccgccccccattggctcaagccgcgtttctgtgtcccaacagacgatacggtaacgctgtttttccaatggaatccgctgttttttaataaaacaaccagtgtctttgccgtgatagacctgaaaataacaataacaacactgtttggttcccgcaaaaaaaaaaaaaaaaaacggcagttactttgcaacgggtgcaatatttggtgaaacatttatgtggccgttttgggtctcgctgatacacgcgccaacaacaattgcaccgcttcagcagtgaacatgtctgcccctgatggtcgtgatagcaacgttgcgagaagaagaatcgattgcatgccgaacaaaggatttttacaccaggttcctttgcacacgggtgctccggcccaactgaagcaacaatgataagcgaaaaaaaaaactgcgtgtactttttgcacattgcggacaacggcgaatgcattccagcgtgtgcttcaatgggcgcccgtacgagcattcgcaatcaacgcaataaaaattgccaagcttgaagaagcagttaatttttctgattccatcatagtgagcgttggacaaaaagagcacgacatcgaaacgacgccctgatggacctttccaaattggtttaggcaactcctctggatggtcctcgaacagtacaatgcgatacagagcgggaaagcgctggtcctgttttggaaaagagaaattcacgtgttataagttgttgtttgtcactgaacccaatagtgttgaacggtttgcaaatggtccatgccatatgcgtgttggccttcgggtacgccagctgcatgcattaggcggtgcactgaggaactcatcaactctcgattgatgataagacggcgaaaagcttctttggtttcacaaaaatcctgcatcagcatcagtcgtgccaaattctgctgttgtggctgttgatcagctaacatccagtcgttgaacagcatagggtcgtggtacgctcgagcaccaataagcgcgtggaacatacaataattgtcttcccaatctctgatccttatgcgatgcgcctcattgtagccccaatgctgatacgggtagaagcgcggtcggcccgccccggtaggtggagttaaacaggtcacagtgatttgcaccggttcgctgagtagcaatgatcgtttgtcgagcgcttcaccactattctctccaacaccaattcctccgtcttcaccatcactttggccaagcttgtccagctcagccatcagcgtgtcacagctgttttgttctggcggtcgaagcggcaatacgattgggtcatgtaagcctatttaataggtaaggaataaaagggctaccagccgaccaatcaaacctcttccctgtagcgtaacaccaattttgagaactttccggccactttgctgctctgcattttggattgcccgttccataaggatttggaatgcaccgcgcaagacttcgtccggttcctcaacgttggcattcagcacaaactctgtgatgtgtcgtgacaccgaaaagcgctccagtctgtgcactgagtgtgagacctgttgaaaaaggtcgtttccggtcgattggctgccgccttccgctctagtcccgcgtccctcgccctgctggtgttcatcattatcgtcatctgtttgttgctgttgtgatgttgacaaagccgacgactgttcaggtgggctgggctgctcaaaaaagctcattgaacgaaagtcccagcgccttttcattgtgctgttatttaaggtgaaaaacaaatttttttttcagagtgtttcaaataatttggcaatttctctatgcctttttttttttgtcggctgttacaagtgcaaacatttttttaacaattgttttttctatgctaaatgcaacatcaatatcatttaagataggttcatcattactcagcactcttgtcaattcttttttgcctttttcacggcctcggtgctggtcgatttcgtctccccaaccagctgaatttcatctccatcgtcatcctccgactcttccttcagttctccatcctctttcttcacctttttcttggccttctcttcctcctctttttcgacatctttgttgtccgcgcacatggacatgattatccaatcgaaatcctggccttcgaaatggcctttggactcctgattaaacacaaagtttaaaaacaaatttagcggcacacactcaaccgaccttgatttgcactttgacgaccacctctttgtccaattttgcctccaaaatttctgcgagcttttcgggctctttttcgctcaattcgtcaacatcaagcgcatttattcccaggtatttttcgcccacgtacgagaacatcgtggtgaccacactgctctccggctgaacacgatcggcgatttcgacgcgcaggaacaggcttttcatgggcgatttcacaatgtgatcgcatgaagtgcatctcatttcgtcatccaacttttttcggcagaagaagcccctatttttcagggggcaggccttgaaaattcaaaattaaaaaaaagcgctaaaaacacaaaactcaaccttataaattttatattgcaaattcacgacttttgccgtgacgtgaaaaactccggcgcttttgaagtccaacacttccttcagagttttcgtttttgctggggcgccatcgcttttacgcttttgctggccagcagtagcagtggagagttgaaatcgggagaggccgctcatttttggcgataatgttcaaaaatattgatataatctaaagtattattattattattatttctatttttatcaagcaagttaaatgaataaatttgttgaaaaaacgttattaaatacaattcgatgaaagattagaatcacatcgctggttaaaataagtaaattttaaatggacacataaatgcctaaaagaacagttaacaagaatatttttaaacatttttaaattatcaagcctttctgacttagtccaaataaaaaattttaaaaaatattggttcaatagtgccgacaagactgtcgccggaacgaatctgagtgaattgttggcaggttttacgcaaatgtgacaaattttgtggcttttcgtggccaaaaatgaaaattagtggaatttgggttggcgcggtgccgacaaggttatcatcggaacgaatctgagtgaattgttggcaaaatttgtggcttttagtggccaaaatgaaaattagtggaatttgggttggctcggtgccgacaaggttgtcgccggaacgaatctgagtgaattgttggcaggttttacgcaaatgtgacaaattttgtggcttttcgtggccaaaaatgaaaattagtggaatttgggttggcgcggtgccgacaaggttgtcatcggaacgaatctgagtgaattgttggcaaaatttatggcttttagtggccaaaatgaaaattagtggaatttgggttggctcggtgccgacaaggttgtcgccggaacgaatctgagtgaattgttggcaggttttacgcaaatgtgacaaattttgtggcttttcgtggccaaaaatgaaaattagtggaatttgggttggcgcggtgccgacaaggttgtcatcggaacgaatctgagtgaattgttggcaaaatttgtggcttttagtggccaaaatgaaaattagtggaatttgggttggctcggtgccgacaaggttgtcgccggtaaaaatttttagactttaattcatttttaaaaattaattgaaaatttaaatacaatattgctggaaaatttttaattatttttaaggggagattccccttccctggctaggtaaaacgtaaagactaaattgttataagtttaatataatcaattttttgaagaaaaatccataaaccattttttacctttcatacaaggaatgtatgaataagacgctcaccaaaaatcggtatggaaagcggaattccgctgtccaaaatttgggacaatatgcaaacagaattccgccggctaaaacgccattaggcaaacggaattccgacagctcaaaaatgaggcaatcggcaatcagaactttgccacaaaaaatttcaacaatcggatccctaaatggaaaacgaacctgaaatcgacatgccgacacatcgtttattcatacccataagactaaaaattgtattaaatggctaaataaatgtctttaatccgtttttggaaagtagtcatttttgggggtaaattataaaagttttaaaaatgtattcggatatggaagagatgttcgaatacccgttgacgcttataataacacaaaaagtaaagttttcataaacagatgagatgccctgaaaaagccagttcagaaatatcagtcctgaaaaatccagttgaaaatataaaaattgtttgcctcggaagctgaatattggatttaattaaatgcataatttttcgattgaaaaggtcacgtataagcaacctcccacataagtggtaattgtggacgcatataatttagctatgcttgaaatgctagagcactttagggatcggatttttagcggagcaataattggcaaacaaaaaatgctgtaattaaaataggcaggagaatcggtgattagggatggctgcgttggtcgtttgtcttttccttcctcatttcatttttctgtaaaggtcaatcctgtaaattgggtaaacattggtgcatcaggtcaatcacgtaaaaattgacgttaaattaaaatgagaaaatgaatacttaattagctgaaaatttaaggtccgataattaatatgtgatcggtgagcaattaagtacattcttttctttttaattagctgaaaatttaaggtccgataattaatatgtgatcggtgagcaattaagtacattcttttctttttacacacatttaataattgtagttatcaattgggcaagtaaatatcggcaaaatatacaatgttattttaattcacattatgtagcatttatctgataaaattaaggctataaactgtatgcactaatagccaaatatgcatttcttaaagtctagaaatttgtctaaagataaatatacgcaaaaattttaaatgttaaactacttttgagctcgttttcataggatatgggtagaaaattttcaaaagtcgtaatatttatagccttaataatcaaaatatcatattcattcaatgcgaacttcgttggcatgaatttgtttaatatgtttttgtaagtcaatctatgtaaattagaataaatcttcaaaaaatgtgatgtgttacatactttcctgttaaatccactttgacagtattggcatagatatgcaaatccgccatgtatttgtttaaaatgggacttaaacaaatataattagggctatgcattgtatggactacaattaagtcttctaatttgcctaaaatccttaatatgcgctaaataaacaccataatgccagaaatagatttaaattgaaagtcaaataatttttgtaaatttaaaaaaatcattaaattactaaaacgaatttgacggaaaaaatttttggccaaaaatcctctcacaaaaactctgaaacattaaattagcaaaaatacaaataataaatttatagcgaaattcgcatttttctcgaaaacacaatattctttaataggctctaaaagattcaaccaaaagttaattttgatgcagaaatgctaataagctaaaattttaagcatatgcctagaaagacaatcaaatgcatagccctaatactaacttttaaattacttacaaccatattgtttgctgcagagaattttttatgacaaatgcggcactcaaattgcttttctgaaaattaaattaaaattatttttcaaaaatatttttctttgatttcgatttcttgaaaacaaagggtaaaatcatttcattttatttagttgcctactatacctccatgaagtttttggtgttttctaagagatttgttcgatttaaatcccttttggcacaaattgcaacgaaacatggcacttaataagaaagaacaaaaagttcaatttattatgaattttttacttctgcctgttatgtatttgcatatgaacaccgaggccttttttgtttaaaaaacgtctgtcacagaattggcaatgttccatttcatctagaaatattttaattataaattttgaaaagaaaaaaaaaagttggcaaaagtccacgatttcgtaaaatgtagtttgagtaactaatgtcagaggaaaatggtcgtaattgcctctcaaaactttgaaatgggtaaaaagcgttatgtgcttaagtttgttaattatcactatacatgtagtttctgattaaaagaatttaaattattaaatagaaaataaaaatccacatattttttaaatttgaatgcctatcacaggccaaggtcttagtcattagaattgcctgcaatccgctgattcggtattggctgaggctcctgtgccgctatttggggttccatgtttctggcgcctaccgcttgctgaattacatttaattagttaaatcattaaattaaattatttaaatctcaaattttaattttcaaatcagcctgaatttctgcaattgcttcctgcactttttgcgcaaatactcgattgacagcatctctaacatgttgaggctgttaatacataataaaagaaaaagtttacattaaaattttcttacaaaattcgttaacaaattgccgatcgcctctgcgttcgcaattaatggacgcttgaattcaaaataatttatttttaatattattgtataaaacatactgtgcttgcttccaaattggtaattgagtcgcgcagcggttgaattatttggtaaacaattgggcccttaagcttatacatttaaatattttaattaaaaattacaaggtgtgccattatcggtggtaccaaaagacggaaatcaatcggtctcaacattatatgttgcattttaaattgtttaaatatttttaatattaaattattgtattttattttttaaatgaagatttttcattggtcttagagcctttaaatgcaagccattttcagtccgaattccgccgtacgttccaattaagtcataaaaatttttccgtaaacggtggcagtgaatttaatcctcattcacccgcgcacccttaggatattttggtctttgcgatttatgactgtggcagcgaagtgtatgtgtttgcactcaaatcggaaaatacgaaaaataaataggaaaagattaaggcaaagccaaaatttggtgaaatcctagtgatctttgactcctgatcaaattttaattcaaataaattatataatttattcaaggcctttgctgatctttggtatttggcgagtataaaagggcttttctcggttttggctttcatttttcataattaaaatgagaccccgttcaaaatcgctattccaccctaattctaatcacaaaaataaagaaacgtcaatatgtcgactttatttaaaattaattgatgctgttcacggaaaaagacgattgccaacgccgcataggagcttctttccgtgccagattcatataggttttcacaaaaatattttattaattatcccaaataattcaaaattacttttttttgcatatagaaaaaaaacacgaccatattgtgcttaagaaaatgcgaaaaaatttttggcaagtgatccggcgggtatgatcatcagacaaaatttcttttttaaaaatatttttaaagtcaaaacgtttggcaaacaaaagaatgtgccgtgctgagaacaacaaaaaaattatgcaaaataattgtgtgatttgctaataaattgtgataagtcattgtaaactatttatttttcttttaatttcatttattcataaaaatatgtaagtaaaagaaacgtgaaaaatacaatcgcaataatgcacaaatgattaatgttttttgtccaggtttgtagttgaattccgcttcaaatattcgtccattccgctcgaatattcgttcaatgttaaagtaataaatttagcattagacatggaattaaaaccatatttaatcatatttaaaattaacgtttaaacattaagtaatgcgcatttgctttatgcgttgatagcctaatggttagtgtgaattaaaaccatatttaatcatatttaaaattaacgtttaaacattaagtaatgcgcatttgctttatgcgttgatagcctaatggttagtgtgatgggctgacctgtcgaaggttcggatccgctagatggataatgaattaaaagcaatataataaggttgggacaaatggtcgacaaaatggtcgacacttaggacaaatggtcgacagggatgggggcgggccatttgagcgccagtcactggtgttcaaatgggaccgcagttttccatggcgctcaaatggccggctgagcgctgggactgaaatgtcccggcgctcagatggccccagttacctgaccttacactactcaggggtattattttgtaaagtctttttttccccaataaacttttcataccccatttttcgcaccgtgaatgttatttttattgaattctgaaccgttttgagtagattagactagaaaaaattgaaaattttgaaatcatgtttcccactcccttctcccaggggtattattttgtaaagtctttttttcaaaataaacttttcaaaccccatttttcgcaccgtgaatgttatttttatcgaattctgaaccgttttgagtagattagactagaaaaaattgaaaattttgaaatcatgtttcccactcccttctcccaggggtattattttgtaaagtcttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtcttttttccccnaataaacttgtcaaaccccatttttcgcaccgtgaatgttatagaagttgaattctgagccgttttgagtagattagactagaa

SEQ ID NO: 208 - DNA, 1296 bp, Heterodera glycines
ttgtagcaatgatgcacgtggtccttggaaattcctcttttattaatccctgaatttcttctattttcttatcactcacttatcactgggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctctggaattaatccctgaatttcttctattttcttatcactcacaaatcactgggggaaaattaagatgattgtgatgattagcgttcttgttcgatttggcgct

SEQ ID NO: 209 - DNA, 2983 bp, Heterodera glycines
  misc_feature (41)..(41): n is a, c, g, or t
ggcattttgacattaaaatgccattaaggcaccgtgtagcnaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtactcaggaagtatttcgatttttgtaaataaaccatcagctgatataaagaaaagcattcttgtctgtccttttccaattatattgccatttcggcatcggtctaacaaagctgcgcatggctttgggaaattcctcaggaattaattttcgttgtctaaagaaatgcactagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgatactgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacactaaaatgccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtaatcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattcatctgctgcaccggccgaagaagcgatggagccgccgccaccaactccaggaccagtgccaacgccagaaatggacgaggaaattttggaattttgcttttcgctgccatcggcatctgtcacaccaatcggcgatttggtgccgttttcgacaacaccaactgcgccaatggacaccggagagacgaccccgccaccgctggccattgacgagcgatcagagcgcatcgaacaactggagaagcagctcaaggaccgggacgacaccatcaaatttctgcgcaagcaggtccgaaaccgagaagcgctgatcagtgatctgcgtcgtcagctggagcaatgtgcggcaccaccaacggcgacaccaacccattcaatgaaaaattcattacggaacatggacattgaatcatcaaaattctcgaaatccttcaattttcctgaatgttcttcaatttgaagaccgatccccgtcaccaggccatggatttatttcaccattgttgttgcatttcgcgtccgccaaaattctcataatgacggcgtcctggaggatgtatcgtttgtgtcgcttgtgaatgaaatggcgagcagatcgggcagcgtccacctgtctgtcgatgctttcattgactccacagatgaagtcagagagtgccgggtggtgacagagacctttctaaatatatttttaaaaatttgcccgtagtaaattaaaaaccataaaatgcagatggataattttttattaaatataaacgaaagaatcgtgaaaaaatatatgcctgaaggcgttgttttgaagtcgatagcgagctcaaagaatattgaacaagctgttcttgtggagtcacggtggtggccatgtaagaaagagttgatggcgccggtgagccaatgccgaattgtattggagtagccgcgtagctgtgttctgagatgatggtcgaaattgttgtcactggttcagctttaaaataattaaacttttggaaatcgatgcaaaaatacgaaaaaaacattggtcggcgctggacaaaaaactcatttgattggctccaaatgccttagcaccatccaacaactggcgctgcgtcaagccgatgtatgttcgagaggtaaaggaaaaactcatgcattcctgcaggagcagacgccacaataattgagaaagccattctgacaacgctggaagccaagtggcaaagaaagaacacttgtgaaaaggaataatttttctattttttttgtcgcttcaaacataccattgagccataggcaatgtcccccaaaatatgtttttccgcgctcaaagttcattattaagacttcagcctcgttcaaagtctatcaacgttgtcgaaaattatcacggcattcggttcgctaagctccactcccaaattcaggcatcttcatttgtgtttgaaatgtctgaaattaacgcttctctcgacttttttgtagaatttcaagcttattacgaatcatttggtccaaatgaatagaaaaatctaaagtcgtcagtacaacacacatttaaaataattcttgaacttatttcatgttcgggtggatcaagggatagacaaggggcaatgtaaatgtcatattcgtactcagcgactccaaaaaccctaaattagatccgttttccgggtttttatgtactttttagacttttggacatttcgtgtttttacccttatggacatttcgaggcttggacatttcgtggcttggacatttcgaggttggtcagcggtagggagtccaaaaatatggatataaaatcgcgaaatatggccataaaat

SEQ ID NO: 210 - DNA, 1465 bp, Heterodera glycines
tctttttttgattgttttgtcttggatacttccattttctttccctttttaaccaagtgcagtattttggcatgtctatgtacttgaattttaatgttggattttgttggcaaaacttaaaataagccgttaatgttgtatcttttactgatgcttcttctatttgttcttcagaagcattttttataaaaaattctttgcatattttcgaggtgtacatctaataagtcgacagaatgagattttccttgcattggatattttaaaattcgccagcaggcttcacatgggcttaaataacgcgcctcaagataggctcccacttcatcatattttaatattttttttgtgccattttcttcgatttgaatacattcaacggtcgcagaatcattctctctatatttatatgagcattaaatgttttactcaaaaaaggattatacggaacaacatattgatttgttaatttttgtccttttctataaataaaacgtccattatcaggccttttgtagagtggataaccatcttcattaagctcagtattttcacgaaaagtttttggaaattttttaccacattttttctttagtttattccaacacattgatttttcattgcatggtccatgcatcatgcagtttgtaattattttaaaaagaacaggatcttctttttcgcttggtatttcagcgcaactaaatttatctatatctgcggtcgaatgccacttattttttggatgcaacgtaactaataaatgtaaatgtggaagacctcttttttgatattctattacccagcaattggctataacttctccaaaaatatgcttattcaaaattaagtctaataaatgtgttttctttaaataaaaaactcgtgttacaatgtcgggtctatcagatggagtttgacctggtaaaagacattttaaaatatccgggtcattcgggttacatgtaaacgtaataaataaatctggtttgccagattcgtttactatagccatcgcattcataaaatgttcatgcatactgcggggtcctccagaaaaagttgacggaagtataactttcttccttatttctgccccggtttttgaagctctatttttaagaaaatcctcaacatttaaataattgctactccatagtttggcttgatgtgttcttatatattctaaacggtcccactcgattttagctgcttgatctactaaccattgtcgaaatagtttgcttgcataaaaatgagggaaaaacttttcattttctcgaaaaaacaaaaaatttactgtagtcacataacgacaccttttttcctgatgtctctttaatgttaacattatatccttcgatatttgacggataaagcaaaggataacacattggatcaacacatttatctaatgcgtaaatttctttttattctttttgtccctttcggatatacaactatt

SEQ ID NO: 211 - DNA, 913 bp, Heterodera glycines
tcaaaaaatttttattttcgaatatacttttaattaaccacaacttttaaaaaaccaggtatatttaggctggggtaggctgcgaagtaaaagaatttttacttttttttctaaattagttattgattttaaaaaatttgagtccaaaaatatttgaaacggaactggctcttttaccactaagacggaactggcgagacggaactggccagacggaactggcccaagatggaaccggcccaagacggaactggccagacggaactgacccctacggcgcccccaccgctgcccgtcaaaatgtccctgcgtcataatgtccccgcgtcataatgtccccgcgtcataatgtcccccaagctaaaatcagtcaaaatgtccccgcgtcataatgtcccccaagctaaaatcagtcaaaatgtccccaattaaaattagcgaaaaaaccgaaataaacgatgccgaaattcattccctcttagtcatcatatcgagggacacccagaaaaaataaaggaccatgaaaaaattagtttcaaccatgcatgtcctttaaaatttgtccatttctgttttttgttatcttttcaattaattggaagtatttcattgtctttttagcagcttttattgtttttttatgattgataaattttctaaggtatttcgtatttttaaaccttaggggacattatgacgcagggacattttgacagcgcgccgcccccacaaagtgtccaagccacgaattgtccaaagccacgaattgtccaagccacgaattgtccaaaagagtgaaaacccacaaattgctaaaagacaaagaagttcctaaaaagacggaaaatgtgtcgatgttacggttgtcgggatcattgaatacaaatcctgcatatatatattcccttgccta

SEQ ID NO: 212 - DNA, 3208 bp, Heterodera glycines
  misc_feature (3066)..(3066): n is a, c, g, or t
  misc_feature (3071)..(3071): n is a, c, g, or t
  misc_feature (3082)..(3082): n is a, c, g, or t
  misc_feature (3093)..(3093): n is a, c, g, or t
  misc_feature (3099)..(3099): n is a, c, g, or t
  misc_feature (3101)..(3101): n is a, c, g, or t
  misc_feature (3148)..(3149): n is a, c, g, or t
  misc_feature (3151)..(3151): n is a, c, g, or t
  misc_feature (3159)..(3159): n is a, c, g, or t
  misc_feature (3161)..(3162): n is a, c, g, or t
attctttttgtcctttcggatatacaactattcttgccgggggaacatcatcattagcatcacttaccattatagcgcaaacttcgttactcagtggtatattatacctcctttggtcataattctcctttaagctaaaaagtaactttatgttaggcattttatggcctctttctttacactttttttcttcttgctcatacacttctttcatcattaaatatgactgtgcgaatggattattttttcgtaaatatttttcaatatattccaataaatccgggagacattccttatcaatttcacaacgtatatttatagcctcttccgaatcaatgaaataaagttggccgtttgtaggaagatctttttcattttttggcatcgcacttggattgaatttatggtaaatttgcccttgaattttataacagggcggacccggtgttggaaatttaaatttaaagcaactaatagatgcacaggcaaaaatactattataccttctaatatttttaataaaattcttataaaaaggattattccagacatttaatattaaacttgccaagttgataaaattcggtattttgatgttctgtcgcggcgagatagtgtaacgaacaaaattcccttttgcgttttctggtattttcttgtaaagctaaatttgttgttttttggttttttaattcttgatcagtcatttgcattcgctttaaggcatgcctaacacggccattttttctcacataagaaatttcttcttcagtcattttagccctttttagtccaattctaaatctattttcaaaaagttctttttctttttcatcgttatccattagctttctttgttttgcttttctttgcgccacatatgatttcatagtatgttcttcatcagaagtataagaaaaatcattcatttcatcgagatttatgctttctttgttaccatttttttcatttgttaagttcgtttctgaccgcttttgttttccggagctttgaaccggttcaatccgcttttgttttccggagctttgaaccggttcggcgtctaaatactggagagaagaagagcaacaggcagaatcttttggaaaattttgtttagtgcggaccattattatctgtgttaaaaattaaataaataggacaatataattgataattaattaaattgaacaattacaaataattttttttgattttattgcactttaggtctgtgtttaacgaccgataaggggatataatgatttggttctacatgacaatcaattttagacaatccaccaaataaacaattcaccagtggataatccgttattaatggaaaaatgccatcaattttttaaaagataacatttttcgttttagagagcccgaaaaaataataaaaacttttctaagttgtaaaattttttgtgatgatgaaaattagtctattactaaacccttatttgattaaaaaccaattccatggtattttggaaggttttaaatgaatttgaatttattcatattcaggtcccggctgaaataaaaaaaaatttgaatttaattcctattaccattttaggaaaagttttcttatttcctaaaactcagctacaaattatgtgttcgaaaaattattgattaattcaccaaaaaaataaaattactgttgaattgtccattgaaggtttttccgctgacggattagccactggtaaatgtcgacggattatcattgaaaattgtccgaatattatggattgtccattaacattaacaatatcaataaatttaattgttattgaaataattaataagtaaaaaaaattattaaaacttttctaaaaggggtaatatgataaaggcgcaacaatcaactgttttttaaaaaaatgtaattaaattaaatgttgaaaaaactaaaaagtttatatgggaatttaaaacaaaagtgattcttactattacaaaagttaaaattaattgttgtttctaaacataaaaaaccatagtttaattaagaatatgaaagcaaaaagaaaaggatcaaatttcacaatgtttgtttttttcacaaagcagccatcattactttctattttgttttcaacacattaaactgctgccctttctccgtttttgctctctaatctttaccttttctctcgcaaaaatttaataaaagttttcgtttcaataaatattccgtttaaaatgtgacatacggaatgacggtgctgtaacatttcgacagtggctgatttcgacagtgaccgatttcgacagtggatttcgacagtggctgatttcgacagtgaccgatttcgacagtgaactattttcatttattttactgttttccgacatttccgacagtggctgattacgacagtgaccgatttcgacaatgaacaaaattttaactttgccaattctaacatttgaaaacttcaaattgatatcgaaaataacgacaaaattgtgtaaaacgacaatgctaaaatcctataaatgtttaaaagtgcagatgataagcgcaagcgcgaagaaattggatcggatcacgattgaaaaaatcctgcacaagtgcttccaagttttggtcttgacgatgaggccctttaatgccgtcagccggtgcaatctgataatctgcaacccgaattctccacagttcatcttcctcgatcattttccgagcaaatgaactcggtcgttggttccccctaaggtgcacattccaagttgaatgccaaccctgaagaaaagacatgaaaaaatggtcacatcccaccacacttcaagcgaattgtttgttcttccaagcccttctgctactctgtccaccacattccacaattcaattggaaaaagagcgtcgagtctgtgccaaattaagcgcctcaattctccctcgaatccaattatcacctactccgcctgcatcgtgaaccaaaacttcttcattttgcatgattcggcgaggcccgatccacgtgttaatgaaatagatgatcagctcttgaagctcaggagtcggctcaagccttgaaaaggcgntgccncctttgttgtnggcgccgtcgncggggncnttagcctgcgcttgtagaggccgcaaggataggtgacccccccatcnncncaatatcncnngacccccagtagagatcgctgaattcttcgcctaaattacttgtcc

SEQ ID NO: 213 - DNA, 3804 bp, Heterodera glycines
  misc_feature (3793)..(3794): n is a, c, g, or t
  misc_feature (3796)..(3796): n is a, c, g, or t
ggcttttgcaaactctcaagaatttcgcgaacagttagcatttcttaatataatctgaatagaaaaaaaacaaattctaaaaatttggcataaaaaatagaaagaatgatatatttgatatcagaacagattcatttcctcttatttactattccttaataattcttttttatcagttggcgaaatgtcagattttggttgagttggcgaaatgaatgtttttgactgagttggcgaaatgaatgtttttggctgagttggcgaaatgtcagttggcgagatgtcagttggcgagatgtcaagttggcgaaatgtatgcacacctacataaatattaaagcaaattttagtttcaaacgaattagtcagtggacattttcgtcagtgaattaatgtttttaaaaattacttaagacaatttaaaagaacaaatggtaatcacaggtcacacagaacacattcaagagtaccactcactatttcctatgtcctggaaaagaggatttaattattgtcttgcctaacaattctatacggtctatcacattggtgctgtaacatttcgacagtggctgatttcgacagtgaccgatttcgacagtggatttcgacagtggctgatttcgacagtgaccgatttcgacagtgaactattttcatttattttactgttttccgacatttccgacagtggctgattacgacagtgaccgatttcgacaatgaacaaaattttaactttgccaattctaacatttgaaaacttcaaattgatatcgaaaataacgacaaaattgtgtaaaacgacaatgctaaaatcctataaatgtttaaaagtgcagatgataagcgcaagcgcgaagaaattggatcggatcacgattgaaaaaatcctgcacaagtgcttccaagttttggtcttgacgaatgtatttggcctttctcgtttcatgaggccctttaatgccgtcagccggtgcaatctgataatctgcaacccgaattctccacagttcatcttcctcgatcattttccgagcaaataaactcggtcgttggttccccctaaggtgcacattccaagttgaatgccaaccctgaagaaaagacatgaaaaaatggtcacatcccaccacacttcaagcgaattgtttgttcttccaagcccttctgctactctgtccaccacattccacaattcaattggaaaaagagcgtcagtctgtgccaaattaagcgcctcaattctccctcgaatccaattatcagctactccgcctgcatcgtgaaccaaaacttcttcattttgcatgattcggcgaggcccgatccacgtgttaatgaaatagatgatcagctcttgaagctcaggagtcggctcaagaattgacatggcaatgcaaaaatagttgtagacaaagtcgacggggacaaaagccagcgcttgtagagaccgcaaggatgttctgacaacttcatcgtcacgatatcgcgtgagcaaatttggcaatcgctgaattcttcgccaaattgcttgtccaaagtgaaacaagcatccggttcttatggaatttggaaagacgttgccagctgcagtgatcgctcccgattcgaaatcgctcataatacggtacgggaaccaattattgccaacagactgacgaattgtttcgaagaatcttgtgtatgtggcgagagttttgctgggcagtaaaccataaactgccggaactgcacaatgatcgatgacaactgccattgtgtagacttgagtaaatccccttgggcatgtctaagataaaaacaattttacttattttgtggtatattggtagcggcacattttatatgcctctcgccactatcagctaaaagtgccctttagttattcacctcaaaagtgccatcgattgccacttcattctgataattcgccaaaagatcaaggccaaaacgagaacaaaaaatgatcattttttctccattaacagtttgatcataaatcgtacgatcacgcaatctgtccggtatgatgatttgagatgcgggtaagacatccaatccaacatcgccgacctaaccatttatttttaaaattatttttgcttattaaatttatatttttaattatctaattatcatttgcctcttcctgatgcttccgtttctgataattatatgttcgcctcatatcagctgcagagggtgcactgattgcccgaatctcatcactaaggttcgaccgaacttctctgatgatgttacggcttgtggtcgggaattcgctttgcgcctcttgtcggagacgttcagatgcttgtctcacctaattagctacttaacacccgttacattttaaatttctaccatatgaccccccaaaacgggtggatggttatgctgtccggtagtgcgtccaattttatatcgcgatccatcggcatcgacttcccaacggcactgtacacaagcacgccctgggcaataaggtggacggtttgggcaacgccaatactccattccgtcttcagttttcgaaacagccttagaatttttcgtttaacattttcacgaaattaaattagccttttaacctcgaaagtgtagtcatatccgctacgagatagaagaattttcccacgatttgttttggtctctgcgaatcggagtagagccattggtcaatgaattcggaaaaaaacgaatagagggaacagcaaatgatgaacaccagcaatgacaagtcgagaatgaccatcagcattcgggaacaccaaaacaattcctctcaaaattctcttatcaaattgacctccaagaaaattgacctcccaatataaagtgaacgaccggcccttccactatcaacggcctacggccaaagtacagtacaactgagttttacctcattgaaaataaaagaaaaatgctttattttactacatcatatataaatttcacccattaaatagtgacttttttaaataaaaatgactaatacacaaatataattttgttcattgtcgaaatcggtcactgtcgtaatcagccactgtcggaaatgtcggaaaacagtaaaataaatgaaaatagttcactgtcgaaatcggtcactgtcgaaatcagccactgtcgaaatccactgtcgaaatcggtcactgtcgaaatcaggcactgtcgaatattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatgcttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacagtatattcggctaaaaacgggtttgatcatttttagcgcatttttaggtatacatttgagacaattgggcaggacaagaaaagaatgaagttgatgcctcatgaaactcggaattggttatgttttgtcgaaaatatccttanncnataatact

SEQ ID NO: 214 - DNA, 836 bp, Heterodera glycines
  misc_feature (61)..(62): n is a, c, g, or t
cttttcgccgccaggattaaaaaatctcgaagttttttgaaattatgttaaaaaacgctannattctggtacgattgctgaatttgtttggaatctacgtatggctgattattttgaagctagtaagaatctcggccatatttgtgcatcagagattgataaaaaatttagacttattaattttttttaggcccggaactcaacccctcctttatattcggtaacattttgacgaaatttttgtttaaaccaatcggcttcgcctttttcaatcgatccttcttttgtattcatcgccagaattttatcctaatataatatatacagtaatttgcccaaaataaagagaaacgtaggtggccgatcatttcgtcactgatcgtttcgtcactgttcagttcgtcactgagaaataatttttttaaatgttggcaaaatgtcattatttaaattattttcattaaataaaatattttttatttcagaaaaggttattaaataattatgttgaaactaaaatctgcatttaatttttttttaaatatattttttaaaattgtttgttacatgcgatggaaaatatgcacaaaaagagttcgaattgaccgatacattttgatttgggctaatggatcgttatcttaaatctacacatttgttgtttacttttaccaaccttccaacgaattggacgggttcttggttgagtttgtcgtcgattaactttctgatgagcgcaattgtacctgttcagttgaaattgaacccaagatccattttaagactttttttggcactaaagggaggataccatccatacaatttttcgaatttta

SEQ ID NO: 215 - DNA, 1762 bp, Heterodera glycines
ataacaacagttgatcgcagcggacttcctgtgaagcggcatatcaaagggggccggcacatcaaaggtggcgccagacgccgtctggcattcgtcaaaaatctaattcatgagaaatgtttgattaaggtggtgcttccagctttctttatcatatgaacaacttgtaaatttaagatcaaaacggtaacgttatgccaaaaatataataaaaatgaaggctatattatattcgtttaaatatttttttcggtttattggattcaagactgtaagcatcaaaggaagaagaaattgaattcccaagtgccaactaaggaagcagaaaattaggaaaattacaatttgaaattaaaatgtacactatattttcaataataattatataaatcatatattcatcaaatattttggtgtcagatcgatttgaaaaataaatatattagttatttttaaattattaataataaataaatagatttttcaaaatgaaagtggatgcgataaaagagtgaaatacaaagctatccaattaaataaaaaataatttccaagtaactacaaaatttaaaataaaattattttatgtcaagaaaaaagttcactaatatgacaaagaaaatgaaaatttaatttaaatacaaaataaaattcatttagtttgaaaaataaaatagtcataaaaacttaattcatatcttatttgaaaaaagccataattgaaaaatataagttcagagaaaacaaaaatagaatgaaaacttctttatttgaacataaaaataaaagaacttacaattagatggcattttggataatttgctttaattattttaaaaggaatttacattgttcaataaaatgataatttttcttatttattctagaaaacatgaaattttacttaaaatgttattaaagatactaataaaatatattacatcaacttaaaaaaatcaaaaaattcgaccaaaatcagaaaatatgacatttgctttattaaaaactataagacaaatgcaaataaaatggtgtgtaaaaacataaaaaatagtgtaatgtaggcattaactcgggataaaaccgattgcattgcacgtgatttgaattaaattgcatcttgacaactaaagtattaaacgaaaaagaaactataacacaatttatctgaattttcaaattaaaatatttgtgtttataaattttgctttttttagaccctataaatatgtatgtcaacacagtggaaagtgaatccgtgacacgacagctgggtcatggtaggaataatttaattaaatcaagaaaaacaaaaaaaatgctataataatttttaaagagtatataaattcaagtatcagaaacaaataattttaatttctttctttgaaaaaatatcataaatgaaatcgcgtgttattttctatgaaaaagtttattaattgcttgacaattaatcccaaataatttagctaaacaaaaggaggagtgattcatttaaacataattttgtataaaaaatcactttatgaaattgtaacaaaaaaaattattatatatataatccaattttataaacaagaacaaatgaattgcatagttaacaattaaaataaatgagctagccctaatataaatacatatttataataatgctttttttcggccatagttacactctttaaatattgattcttatttatttaggctctaattttttccatgagatgaattaagaattttttgttaattatctcataag

SEQ ID NO: 216 - DNA, 5381 bp, Heterodera glycines
cagctttcatttattcattaattttaaagtatttaacaggaaaaatgattaatcaccgcccgtctgaactgaaaatgtatataaatgacaaaggcaaattacaaattgcaaaaaataaaaatgtttattgccccattcactctaattctgtcaggggccactgggagcggtaaaacccaatggctaatgaaattgctgagaagctacgctgaacttatcgatcctccgcctgctaaagtattgtattgctactctgagatgaaccaatcagtcattgagctgatgaagcgcggaatcgagacacataatggcgttccggatcaagcactgatccagagtcagccgaaaccattgcttcttgtgcttgatgatttgatgcttaatgtagggaatgattttttggatttgctgttcacacgcggttcccataattggaatgtcagcgttatttttgtcacccaaagcctgtacggacgtaatattaagaccgcaagggcgaacagtcattatctggtactgacaagaaacccgtcgggccaacttcaagtcagaacggtcggctcacaactttttccaaaacgattaaattactttatggaggcttacaatgaagcgaccagtcagccgttcagttatttggtgataaatatgcacccaaatgctcctgaaaatgagcggctgaccagcaaaatatttcctggagagaaccgtgaggtgtatttgcctatagaacagtaatatacgcgtgcatgtgcgtgttgtaagcaataaactatttaagaaacagaattttcccatcaaaagtagaatagtccatacattcgcgataactcggattttcttaaaaaattacttccaccaaatcggcaaaaagaaaaacgatttgcttcgcggtgcttcagcagaacaaatactaggcttggtggaaatttgtgctaatattctgaagtttaatttccgactaaacaggcgtcagaggaggcggttggccgtgtacgcagactactaccgagcaatcgcacgttcacgcagtgagcccacagccagacagcggctacaacaaggcagcggaattgctttaggagctattttggcaccaataattagcgttttggctgagcagttgatccaaaaaattgttacagccgcaccggcgtcaacaacaaaaacaacatgaagcacactaaaaaaatggtccttgtaccggagagtgaatatctggcgcttattaacatgttgaaaggaggcgccggcagatctgactcacttctgaatgagaaagctgctctcgatgcccaaatacaaagcaaccttagcgacagcaaagcgggtgcagatgtcaaaatcaagcgacattcttggttgtacaaacaaaggcatcagttgaaggatatgattgagaacaagccacaaaaggtgatagtggaaaatgcaacgggcacagcgccagcaaacattgccccgtatatgggcatacaaaaacccacggtcaacaaactcgacgcagtggacagtcaagatgatgacaaaaaaattaagggccctaaaaaggtcagacggaaagcgatgaatgctgctacttccagaatacgaatgtccgccggcggcattacaagttacggagaagaaactgatgattacacatctgcgccagagaccgatctgttgccgatgagcaaaaagagacaacaaaaatttcttgaactgaagacaagcaaggaacattacgctaaaatgatgagtatgatcgcaaaagaccctgacaaatttggtgtcgacaaaggaacaggcgaaatcttaactaattttaaaaggccaatcctacgttccaattatatggattctttgttgtatattacgggacagagaagtgaagcgcccaaaggtcaccgcttctttgcacaaaaactggctgctgatccgcggatgatgaaattttttgaaaccaatcaaaaaggagaaggtaaaggcactaataggaagcgagaccgtacaatgaaaaagaagattgttcttgtgagagcaaacgctataaaaacggatggactcagtcgtgtggtggcacaaccagacaaagggttggctactcgtaaatttaagccgactttatgggcaaaactttagctgcggaaaagttgttggaacaagtgtattatgaccttcggtcgccagcgagttacgctggcattcaaaaagtgttggcggaagcgcagaggcgaaacccgagcattacttataaggatgttcatcaatttttgcataagcagcgcacctacacgttgtttaaacctagaaaaaaccgtttccgtagactaaaaacagtgcccagcgggcttcatacggactggcaatgcgatttgtgtatcatggatgcactgaaagagcataatgacggatttcgttacatcctagtgtgtattgatgtgctgagtcggaaaattctcactgccgaggttgagtcaaaaaaaagtgagcacatgattgaggcttttgagaagatttttaaaaaggcgggcgtgttgcccaacaagctgtacagtgatgcgggtcttgagtttcaggcgaagaaaatgaaggactactggattcaaaaacaaatcatcaaacacgtgatgtatagcccacatttgcacgcaggagtcgttgaacgtgctaaccgtacgatcaaagagcgactttacaaatattttagcgaaaagaacacaaagcgatgggttgatgtcttggaccgcattgtacacaatctgaacatctccgcgaaccgaacaacaggaataaggcctgtggacgtgaactttaaaaatgctgccgcactacgcaatcgcctatataagcatagtgaagtggataaaaattctgcaaatagctcaaaattacaactgggtgacattgtgcgaattagcaaggaaaaaggtgacttttccaaaggttattttccaaattttacggacgaactgtttcgcatttctaaagttaacccaaccgacccaccttcatatagaatccgcgacctcgacggagaggacatcaaaggaattttttacgagcaagagctggtaaaaacggttgcagaaacatcacatagggctgaggtgttgaaaactcgacgacgaaacggtgccaaagaacattttgttaggtggattggctactcagacaaacacaatcgttggattcgagacgaagaccttgtgcgaaattagcagacaaaaatggacgaattttatattgtacttccgtccaacacaccgggctctgctaacacgacatcaaattttacggtcaggcttccacacacgctggagctggactcaaattggactgtatctctatcatccataatctacccgtattcatttccttcagttggaattgatgaggatgacatcattaatattaagcttgtcaatccgaactacaggtttctggatgataaaaaatttgtgcatgttgaactaaaggttccaagcatgcaattttccagtgtcgagcatttacggctgaccctgaacagtctaatacgggaagcatatcatcaacaaatacctaaccttggtgaagccagccgaacgaaacggcaggcaaatgtgacagatttattcttcctagaaaacccagtggattactgggaaaagattggagaacagcggacaaaatatgaacagttagaatgggaagtgaaacaggaggagaatgaactttctgctcaaaatacagacgcggaaaggaaaaagcaattacaagaagagcttccaatcaaacggctccgcatgcggaggaaaatggaggagcttgaagagcttgaaggagctgcgggacgacgtgatcaggaaagcccagaaaatgagcagcgaaagatcagcgagtttttccaacaccatcccgaagattacaataaaaagctgaacgaggcaagactggtattcacaaaacacctgtcagggttgcaagacgtgatgagcaaatacattggtgaaaagaatgtagataaaattcgtgagctcaacaaagaggttgggaggttgcgtgaaaagatcaaatacctacagcgtaacttgaccatcttcgagaatgctgtgcttcagcgtgaacaccagaaatcgttgtccgaatacgagagtcaaagccatcagcagaatggcgcttttgttaccgaattctttgacaaataccccacaaattattggcaaattattcacaacaattataagggtctcacggaacattttcagaagattgaagaactgcaaaaaaaagcagtaggattaaaggacgatgcctcgttccagaagaagatcgagcaagcaaaaaaactgattgagtacaggcgtaagagatttgctgcgcttgaatttgaggcaaaaaagcgtgatgaacaaaaacaacaacaacatcaattttcttcgactgctgctgctagtgcaattccagggccgaccgcatctgcattgattgcaagagagtcattaaaaccgcgtacgggtaccaccatcaatgtggttggtgctgacgataaagttgatgacagtcaacaaacaacaaaaccaataagcacgcatggcgaggcattaagagaaaaaatatcgcagaagaaaaagaatgatggtgatagtgataaagctgatgccagaccacaaacagcaacaacaacaacaacaacaacaacaacaacaacaacacatggtgaggcgttaatagagaaaatagtgaagcagaaaacgaatggcgatgttgacgatcaagcagatgacggtccacaaacaacaacggcgatagcaaaaacgcatggtgaggcgttaaaagagaaaatattgcagacgaaaaagcagcatacggatgacgctaagcaaactgcgaccaatgtagagcaggacaatgctggtggtgatgttaaaatgacgcgtggtcaaacgctaatagtcggacttaaacagagtgatgaccagaaaaaagaatggagacctcccaaggatgatgatgctgatactgatgatgatgatgatgatgatggattagctctgaagcatggagaagtgctgtggaaactgttgctgtcgacggcgccgcctaataagccgcaaacgggcaatacccacagccaattggttgatgttgaacatactcgcggacaggtgctgatggatctgctgaaaaacatcgtagaagaaaaaactgatgcacaaaaaaaacaaaaacatcatcatcatcaccattatcataaacaatctgcccaagttttccagaaagtaagcagaggtgaagcgctgaaagaactggtcaaaaaaacgaaaaatgaacagctgccacaatcttcggctaaaacgcggggagaaattttacaggtgatgttggagcatatgaagttttctagggaggaagag

SEQ ID NO: 217 - DNA, 8550 bp, Heterodera glycines
catggcgaacaggcgcgctatatgccggatttgtcgggcggcgttaaacagttgtatgtgtatgcaccgaagcttatagaggagtgtattataggtgaccggatggcccctctgcttcgggtggtcaatgtctccgccgtacctgcaagcggaggcgggaccgacgtgcctgaggttatatataccaatgaaatttttcattcacttcaaaacaaacgcatttccgaaatttgcattgaaattcagaacgcgtttggacgctacgtgaaatttaattggggaacctgtattgtgacactccatttcaaacgaaaattgttctaaggcatcgctatcaacaacaacaaccacaaccacagaaatgacccacgttacgtttaacccggacaccataaattgggcacctcttcttgccctacaacaggagggaaggggagaaatgcaatattttgtaggctcgcgctatcagcgtggcgctggccttttgaaaaatgttgcacgattcctgatgccggttgcctctaatgtgctaagagcagtgtcacgagagggtttgacagccggaagccggatagcggaggatctttcgcaaggcaaggccctgaaggaatccattcaagcacacgctaaacaggggatggaaaacttggcggaaaaattgaaacaatgtgggaaaggtgcggccacatcaagaatgagaaagagagcggtaaaattgacgacgaaaacatcgaagggactgccagtgcgttcgcccatgagaggcaaaagacaaattatcgatcagcttactttcgcaccttaaaacgacatgggggtgtgccaacacacgcacgcgcacacaaaaagcctataaatagacagcgcatacctgttctaactcactttgcaaaacatttagcacataataacataaaatgagcgtaatcaaaaaaattgacaaagacagtgttgaaggcttggagggtagtctgtcactgttttcgcttccgccaacaaatgtagccataaacaaaaccagcgttcgagagttgctgccactgtccgcgttgaatcagaccgggccatatttgttccgattgttctcggacagtcaatactgtgacttgagcaaaacatacatgtacctgctcagttcaattgagcgcaagaatgccgcgggcgaatgggtaccgatcagtgacgctgaaccggatgataagcgtgtgagtgtagtgcagaactatggcagcagttttgtccgcgcgttgaaggtcaacatctcgggcattgaggtgtttgacagctccatctattatcattacagggactacataatgaatgagctgggctactcccatgaaattcgcaaagctttccacgaggcggcctgttactatgccgatgaggatgatggtcaagacagtgccactaacgagggcttcatcgcccgggcatcccgattttcaaacggaaagcagtgtgagacgatggtgaagctgaactttgaccttgctcatcagagtgcactgatgctgaacaaccaagacgtagtgttcacgattcaccgcaacaacgatgccttcctcctgctcacgccccattggaagaaagcggacggtacaatgcaggaaaatacgaaggaatatcgtgttcgtgtgcacgatatgcggctctatgttcgcacggtggacgttacgccaagccttaacctggcaataagtcgtcagttggagtccgcctcggccaaataccctctgcgcaagattgagatgagctccatttttttgggaaaaggaagaactgagctggcccataacgtgttcacttcaacactgccgcgtcgtctgatttgctgttttgtttcaactgacgcttattcaggcaaccgaaaactgtcacccttcaaatttgagcatgcaaatgtgcgagcaattagtgccgaggcgaacggtcaatcttttcccagcaccccgtacctgctgtcgtttgatgctgcgcagcaacgttttatgcgcgcgtttgtggacatgtatgccggtcttgggttggatgactcggacacaaaaacggtgtccattggactccaacgtttcctaaacggatgggctttcttcgtcatcccaatgacctcaacgctggatgatacagatgggtttgagctgatccgacagggtacgtgcacgcttaaagtccaatttgagaagcctataaaagatgacggttacgaaatgttgatcctcggcgagtttgattccgtcctttccattaacgctgaccgtgtgttgagcacagacggaagtgtttaaacaaagagagatagagagagagagagaaaatgaattctgcacaaattgacacgttgctgagaagattgcatgcaacaagaggtaagttcatcggtgtctacccgtcaaacaaagtgccgctgattcacgacagacagagacgactgcagcgctaaccaaaccctgatctgtctgcctatctcaacaattttcgccatgttcaagtgaacacgcagcaaattcagttcccctcatcggacgcttgcggccacttttgtgtctatttcttggccagccgttgttccggtgtcccgttttgcgtggtggttgagacgttacgcaaaacgcgcgggatggcggactggttggtcaaatggtatgtacgcatgttagtccatcatgtataaaagggtgactaaaagagagggatgccacacaaatgcccgctcgctataaggcggataggcactagaaaaaatggcgttattttccatactactaatgctgctgctactcctgctccatctgtccggcggagaatggatcaacgtagagctgagcgttgacccacccaatttctttgaccgcacctttcgctccctttccaagacatcacccatccaacattggttcggctacaaccggaacaccgcgtgtcacgttgagcgggaaacaaacataaatcgactgtacaacagtgctgatatgtggaacattgccctcactgatgtggacaacttcatgagcatggggcggcaaactatcgagttgttgtccagcgccttgccgtgggcgtgttttggacatgaccgccacagttttgtgatttttgaccttcgaaatgacgcaaatgaagtggcagttgtgcgcggtcatcagcacaagatagcacgaaatttgagtgcatatggacgcattttgttcgaccatatttccggccggttgtacatggtggacaagcacgagcgccggatccatgagctgctcatcaccgattttgtgcgatggtggactctgaataacactgacggaggtggtggtggtggtggtcataacggcggcggtgagaacagcacggcaacacactcgttgaggagcaactttgtcgggtttttaccagaacaaaaaacggattttttcattgcggccgaccatgtgtacctgatttggcgtagacgtgtatacaagttccgtgttgggcactacttcaatgatccttcctcgcagctacagtttttgaccaactccagtgacattcgcttcaacttcctcatattcgagagagatgatgacgccaaattggaagacagcactgatcgtagaaacagcagagcagcagcagaagcatccgcaggactaacaccatcatcacagatgatgaacagcattgagcggctcctgctcgctttgatgtacctctttgatgtggcagtcatctgcattgccgtttgtgtgatccgaatactgcgccgtacaacatcaaattcgggcccggacaacaccagccaagctcgcagcaacgatgtagtacacactacggaaatgatggcactgacaagtggtgaatatggtctgatccagtcactttcgttacctaactcggggggcggagctttcgcctctgtctacaaataatccagtgtacactgtgacgcttttgtcgacagcgaagctatgtctaaccagtcaaccactatttaagccgagcattttgtaccattgacttgctggcttgtttgatgattgttagtatttgttctgttgttattatttttgttgcctttctttctattgctgccgcggctgctatttaatgcaaagagcaataaagcattttctacaaacatttgcgctccaaactgttgaagagctgtacgcatattttaaagaggaaattttgagctccccgggcgaatattacccgaacccgctcgcagagttcgtttgtgtgcacattgccaacgaggatcacgctgaccaaccggtgcttgtgaacggcacacttgacctgatcgaaggcgtagaactctactccacatgttatccgagaacggaaacggggaccatcgattggtaagtttgtgggagcgcacgtgtgcgtctgtgttttaactgaagcgtaaccaaccagccaaccatttaaacttcttctaactattcaggagcgagccgatgtacgtggagctgaaagacctgcgcatttgtccagccaattcgccgcgatgtcattgcgtacaaccagcgagcaacaacaaccaacagcagaagctgccgcaggaacagtatttgaccctttggatgggggaagtggacgaggtggacgaccatcaccctcacatcaatcgccgcctgaatttatgctggcgcgacaacgtcgacgacacagaaggcggcagcgaaaactgagcaatttggtgaccgcgctgtgtgatttcaacaaatgcggaccggcccgactgccgatgttgctccgaaagcgacgagcggaaaacctggattttctctcgcgtctctgtctgcagactgtgcacttaaagggcgacagaaacgtgcatttttcggccgccgcattgtccaattatggtgctaatcgcacgtttgcctaccgcggccttctgtccataacggttgagcagcatttgttcactcggcaccgtgtccgcctcaggcacccatttctgccctgtgttgtacaagctggaggcaacaatcactgttatttctaccctcttgagctggtccgcgtttgccagtcgccttcgtctgggtcacataccgacaataacaaaaacaacatcagcaacaacaacaacaacaaaacaatgaggaggatgccaatgcagaggaatcaacggctctcgcgggatcgtcttcatcaacagccgaagcgttctagtgtttgtttgagagatgtgtacgatccataatgatttttatttttttcgcgcacacataaacacaccttatataaatgattgttaaaccgtgttgttgagaaataaatattcatttttttgtttcaatgagtttttctgcatgccaaatagcgcaacaatttatttttggttaacaaagctgcctgcatgcacatcagcagcaacaacagaagaacagataagttgccttatttttccacatcaacgcattcttttgcagtgttttccacttctccacactgtttctcctcttccacctcccccttcggctcctcacctgccttctcctccttctctccgccctgttccaccaccgccactccttcatctaccttaacaacttctacgtactcctcctcctcattttctttttcctttttttccttctgcatctcttccaacaattttttctcttcccaggcacgaacctttgctgcagaacgttcaaccctgtttgagatgagcatgtatgcacgaaaaatttttagtttagttaaaataagtcgcacttgctaacaacagtctccagtgaatctcgtgcaaagtccaccacagcatcatcatcatcatcttcagcacccaattcccgctccattctcgaatatttggcctccagcgcttcaagcctgccaataaatcaatattaaaatctaacgggcagcagagcaataatcgtagtaagcactgtagcttttattatagaaagaggcgcgcgcgcctgctcaccattcacagcgctgtcgctctcgcgccttcatagcccccagcagccaggacgctgacacaacaccaggtggcgggccatatcgtctcttcctacttccgctgcttgtggacggttgatctgggccaccgctggaagacgaggaggaggaggagacggaaggggatgaagttttcagagcatcaccagcgtcttcatcagcccgacctactccagcatcgcctccgccctctttgccgcctcccttctccatttcatttgaacgccccccgtttttattatcctcactttcctgattgtccgagcggtgcattttgggcaaaaatctattcggtttgggctgctttctttatgcttattattattatattcaaggcattgtcacatattatggatggatggatgtacacgggttgcgtgttttaaaaaaaaacattgggcgactcctgtgcttttgatcaccaatagaaaacaacactttattattattgagaaccaaaatttgcttatgatcgatatgaactacggctgctgctgctgattctgccttatcggtagccaaagggtaaaacttccagctgttcgttgattatgcccttctgacaaacgggcagatagtgctttctttgcttgcgtgtgataattcggctctcccttgtcggttgtattttgtcatatgtgaacacagctgcactttgctgcacggcgacatcaccgtcctcatcatcatcatcatcatcatctcctccgccgcgatcggcacgtcttccttctactcctccgtagctgagcactttgttgcggaagcactcaaattgtagcgattgactgttccgcacatcgaaggtgatgccgcgaattttttgaacatatttcacttcaccgctccgcacatttgtcatacgaaaggcgtactgctttgcacctaagtggcaaacagttaacacatccccacgccgttcgatggtactaattggcatagcgcatacctccgcatatgaaggtttgtatttcaaatcccgcgtactcttcggacatttgtccaagatattcgcccgtgaggattggcacccgatcacgtttgtgcaaaacaatcacgctgtcggtatcctggagacacaacgggaaaaggtaactcttatgccaaccactgtgacaaatgcatatgttcgcctacgataactgactgtataaagaagctcggctccatccgtattctgcacttgcatcatgtactcaaacagcttcaatcgagcacgacctggagtagaaaaaaacaaacaaacatttttttttgtttgttatacagaatcctggttgctgaatgaattgacaatttacttgttgtccataagctgagcactatgttgcttgacgaatgctcctccacgaaactttttttgtgccggtacatcactcgaatggctgtgtcggatagcggaatgatggcagaaatttcgactttatggtcgagcaccaatgagtagaattcctgcggtcttgtgatgaccttgtttgttcctagttcatttctcatgctaaattttcccctgaaaacagattgattgattgattggagatggatgcgatcatagtggccaaaaaaagaatgaggcgactgtttgcataatttttttttttgcttaccaaagactgttcaacattagtttagcgatgaagcgaagccctggattcttatgcacacggtcccacgtccagagtgacggcatacacggtggcatatgcatcaataaattggtgcctttgtgcctcagttgtaatcccatctgggaagccgctagcctcaatctgcgtaacatatatgtatgtgcaatgtgcttgtttggataatggttcgggaaacgggtgaaaacacgaaagaacaagaaacctgcagccaaccaaccaaccaaccttcagcttgagtaaaagacgtacgtattccttgaagatttggtcgctcctgaaaagcacagtttttgtttccaatttgagaagaattgctcagtaaggcagaccactgctcatagtgccacgctctccagaaacggtccacacggtagccgtaccgaagggccattgccagctcaatgtgagtgtaattgccggtgtatgctcgctgagcatccgaatgtgcgcactcgtgccggcatcgcgtgttcaacgtacggaactgagacgcacaacgatgacagcagctgaacaatagacgttcatccaacttcatgggcagcacagggatgcgtagccctcgtggcggaatcacacgaacgcggtaaattcctttgtactccagctgatcaggcgagctcctggttattagtgcgtgcgtttgattggttctaccagtaacagtgtgtttgataaatattaccaattaaccagcatctgtacagcagacgggtatataattttaggtactccgattggatactcggtgtcgtagtttacctaaaacagacattcagaataagcatatcataatgctgattcggatgacaacctacccacggataaagactgacaatatcgtataccgatatcttttcatcctcttttggttcggcaaacagcttcaacggtcctgtccgacctgaattgttttgtgaacatcaaacgaccg

SEQ ID NO: 218 - DNA, 7183 bp, Heterodera glycines
gagcatccgaatgtgcgcacacgtgctggcatcgcgtgttcagcgtacggaactgagacgcacaacgatgacagcagctgaacaatagacgttcatccaacttcatgggcagcacagggatgcgtagccctcgtggcggaatcacacgaacgcggtaaattcctttgtactccagctgatcaggcgagctcctggttattagtgcgtgcgtttgattggttctaccaggaacagtgtgtttgataaatattaccaattaaccaacatctgtacagcagacgggtatataattttaggtactccgattggatactcggtatcgtagtttacctaaaacagaacattcagaaaaagcatatcataatgctgattcggatgacaacctacccacggataaagactgacaatatcgtataccgatatcttttcatcctcttttggttcggcaaacagcttcaacggtcctgtccgacctgaattgttttgtgaacatcaaacgaccgacccactgaccgaccgatcgacatgagagcacctcagcaaatgtgtaccacacctacctccaaaatatgccgatctgggatcaattgggcctcgctcgttgcctatgtcgccgaagaaggctctcatttgatgattggctgcatcagacagcaaggcgttaatttcacactccttaattcacttttttttttggtttgcacacggtgaaatgaatcattattagaattgatattgttgggtcatcaaccatcacaacatacccaaatctcttcaaccgtcatgcactctcccgtgcaatccggttctcggagctggtgtagtcgatcttgggtggcctcattaagctctcgacatgttttgccatcgaccagcttatcctaagggtcaaaacaccgctcgcaaccgtgccaatagcttggaacatttattgttattattattatagcagcacccttatttaacgtaccatccgagcacttcaatacacttattttgtgattgaatccagccgtccagcttgtggttacgaattcgtttttcacccccatttccggcatgttggatctggagcccttcactttttgcgcgccagtcaaggtacttaatggcctggaaatgcggtaacatttcttatttcttgatattttcaattttaataaacagaaccatgacgctggcccgatcgtttcgctcatagcccgcctctggcactatggccaattgcttctccttcatgaaccgggcacgaaataggttcatgcatgcgcttaatgggaaaacagattactatgcttcggcgcccgtgtatgcttaaaaaacctcgcaatcgtacagctgaccggtagcacatcgtacccgctcgtcaccttacacatcagaaggctacgaaatttgagtattgcttttagcaaaatttcagtgtcattctgacagtacacccgcagctcgtcgggtaggtggaatggcgtgtgttgattttcctcgtacctggagaggttgtttgtttgtatgtttgtttggtgctgcaaaaaaattcaagtgcagcgtgagaacagacacactaccatgccatgaacttctccattttgtctttgctcattgaaccgggacagtagtcgaccaacggaggaagatttggcagatgaacattgtaattttccctacagcaaaaaaaaacaatacaaacagcgcatagtcagcggtgcccatcacacatccaaccttttgttgaacgcgtaaggaaaaaatggtttgtcagcgcagttgaggtcaaaggtgtttttcaggctttcgagacgtattggcatcatcaggcacgagtcacgccaaatcagcattgagtgcacgcgcgaaccttgtagccgaatttcgaatattttcagtccgttcatcacaacatcgggtcgcctccgtgtttcgccaagatatttgagcacaaaatgaccatcaaaacgggacgcgttgtgggcctggaacacacacacacacacacacactttactacggttattgtgttttacccaaacataggtcgtaaagcgcttgtcccaagcgtaaagaatccattccacgaactcggaaaccggctcatgcccgtccacttcggacctgagagagagagagagcataaattatggtttagttgtttttgttgttgttgatcagataatgaatgagcttagattatgttgacatagtaataacataaatatgattctaactcttagcgctgtgctaaccaatctttcgctcgttccaccacgccgtcaatatttttgcatatttcacaatcctccgctggcaaccgatggtcctcaggctgacctatcgcaccggcgtcggcatcagcgcagtcggtgcacagcacacgcgcggatagataattgactttgtgcacgcgatgaccgcgatcgtccagcggctccagccgcgtttctgtatcccagcagacaattcgatatcgatttcgctcttccggaacattcagctttcggatgaaacatgaccccgctttgttctcgtggtaaacctatcgatgacaaataaaagaacatacgaaaagtaaacacagagcaatgaagagagaaagagaacagagaggctggaatttttgaataaaattggctaccttgcatcttctacaatattttgtgcgacatttgtgctgttccttcgggtcacactggtacactcgttggcagaatttgcatcgtttgagcagcgcacatgtcgagccctggtggtcgttgaagcattgaagggagaaaaagtagcgattgcattccgcacaatgaatctttacgccatcatgcttcgcacagggcctattgggtccaactgtgcgggagtggtatagattaattgaatagggtaaacaacaacaacaaatgagttatgaatattaccttttgtgcactgtgggcacctgaccttacagtgcagcgtatgtttattgtccaccgtataagcacactcacactctacgcaatacttccttgccagtttgaagaaacagttgatcttcgtcagtgcgtcatagtggctgttggacaggaaaagtggtacgtcaaaatggcgtcccatcggccccttccagattggccttggcagttcctccggacggtcttcaaacagtacaatgcggtacagaccaggaaaacgttcatcctgagcaacaacagtacatataacaacaaaaaaaattttttgagcaaacccaataggcctggacttgctgcagatgatccatgccatatgccggcaggtcggcagtgatgcccgtatctctcatcagacgcgtggcagccatccgcattgcctcgtcactggcaaccagacggttgaacagctcatgtgttcggcaaaaatcgggcattagcagcgccatttggatgatcatgttgttgttcatgttgttgtcgttgttcagtccaataaacagagtccgatcatggtaggcacgccccgcaacaagtgcatagaacatgcaaaagcgacgctccgcttcaccagtgttccggatccggatccgataccggtcgttgtagccccagtgctggtatggatgaaagcggggcccactgccctgcggaggcgccacacaagtgatggtcatctgtactggttcggacaacagcagtgtacgcttgtccatgatgccggcgtccgggtccgctccacctccaccttggtcgtcatcgccgccgccgtctgtgccgctctggcccaatttatcaagctcgcccatcaaaacgtcggcattgttttgctcaggtgggcgcagtgggagaacaatcggatcataaaggcctgaacgcgcaaatcatgtaaagctatatagcatccgtgccgcgtgcacgcacgcacctttcccatgcaacgcaatgcctattttttgcaccgagcgcccgtccaattgctgctgagcatttctgagtgctcgccgaatcagttggctgaacgcgttgcgtagctgctcgtccggctcctcgtgctcaacgttcagctcaaattcgctgatgtgacgtgtcattgagaaacggtccagcttgtggacgtaatttgctgtctcacggaacattttctgctgctgatgctgctcatcatcatcatcatcatcatcatcacgttcatgatcggattcatcaattggtgctgccacggtagtggggccggctccaaattggacatgttttgtgcgatggcgatgctgctgctgagtgccaaaatttgaagccaaagaagcagcctcaaatgaggaggtcggaggagaaggaggaggcggcggtatgtattgttcaaagtaggccatggagcggaaatcccaacgaccgggcgttgctgtgacaggagcagcagcagctgcagtatcatcatccgcatcaccgattttccggcgttgctgctttctttggcccccgctcgaagctgtgccagcctgtgtcacccctcttttggatgatgatgatgatgatgatgatggctgcatactgtcaattcaaactgttcataaatgcgcattttaataaataatgcaatgcaatattagcaataccatatcggttcaagcgtttgacaaaaaatgaaagcggaagcattattataccatttttcaacaaatttcgcttccaattaatgaaagtgaacattttggatgtctaaaactagcaaacaacaacaacatcgtcttgacagcaggccaatcgacgggcaattattttgttttttcactatttggtttctcctttccctcctgctcgtccacagcagaggtggatggagcagtgacggcggtcttttgatcgacaacaacaatttcgtcttcatcttcttctcgttcagcctcaacaattctggcttttttagcggtctgtgagctgccttcagcttcgtcatcagaggcaaacacctttgaaatcagccaatcgaattggccttcgaagtcttcggcagtggcttccttcatacaaaaaaacatattccgtacatcgttgtataataataataataataataataatcacacatttttttgtaccttaatagtcatttttacgactaactccttttcaagttttgcttcaagcagtttctccaatttgtccgggttttggtcacgcatgtcgagcatcgatgccgctttgataccgatgtacttctcagcaacgtagctgaacatggtggcacactgcgtaacttccggattctcgatgtctttgagctccactcggcagtacatgcaaactagcggttttttggcacggtgatcacacgacggacatcgaagctcagaatccagcttacgtctgcagaacagtccgccagaaaattttaacgggcatgcctgtgaccggatggaaccatcagcaacaacaacgcaacgaaaaatttaattaaaaattgatgaaaactgacattgtaaaggctgtattggaggttgacgagtttggcgcgtacataaaacacgcctaccgagccgaaatcaacgacttcggcgagccccttcagatttgcgggcagctcttcggcggatgacccacgccgtttccccgcggcgccggtggatgacgaaatttcgaagcgagacaggcctttggcaccgcttttgctcattttgatagataatgttaaaaattcaaaattcctgaatgcccattagaattaactatgacccttatatcttgttaatatagtttattttttacaataaattgtttattagttttatgagttagtttttgattaatagggtgtgtgaattgaatagtaaacaaatttgcataatcatttgaacaaatattttgaaaattttgtgtcagagacaccgaaaaacgccaacccaacaaagaccaataacacagattcaatagtatttcaaatactaataatttccaaatttattatcgaaattctgtcactgtcaaaaacaacgctcgatacctaaagcactgtatatcaagtggacattagcaccataatttatgttataattaaaaatacgaaattaagaaatattctattattattatttcattatgttttcatttttctgtatacaatatggtcttgcgtttttcgtcttatccaaattgtttttaatattttagcatttttttcacagaatcaaacgcaactgttttcttcgaaaattttaattagcatttaatgaagtatttttaaaattaaatgaaaaaaattggtttgggtatgtcaccaaaaagtatcgccatgtgaatatttttgtaaataaattcatttttgttaacagatttttggcttaaaagtttgttattttaatagaaaatcattaaataattatttatctgtacgcgcttaatttgatacagcagcgcgcaaaaggggtagaattccgagttcacaaactatccggaagccgaaatttaggctcaaaaaatagttacatgaaaatgaaacttggaattccgaaccctcaatagtttctcggcataaaaactgttttatggaactgtacattttttaaattttgaaaaaaatcttacggtaccactctcagtaatttttgactcaagaaaatgttgcttaaaataataataataataataatatatttaatataatttaatccattttaaataatattaatatttatccatttttctttttttatttaattttgcgttttttgtttacttcttttttgttgcggtaaattttacttgttcaacacaattcggtgacaagattaattaccaaaagaggcaaaaaaaaagggggggggagggagggagggagggagggacacaatgggttaagagggaggagcaaatgccgaaagtgcaaattgccttattcattgccattcagttatttcctctccgatctcctaattcgctattctgcaatttatttttcctttatttattttctattaaagtatttggttagctatttatgaggtagaagtttttgaccacacttcaaaatgattgtggcacaggtagtatgtcgtagatagaaaactgaatttgaaacaaatttatttatcattaataatattcaaagccatgaagggctttgttaagtgaaccctttttacaatttaaaacacagcaataattgtatgaaggtttcacttagctgaaccctgaaggattatgaagaaatttgaatgaaaactggaaaaatgagaatgagttag

SEQ ID NO: 219 - DNA, 1604 bp, Heterodera glycines
  misc_feature (747)..(747): n is a, c, g, or t
tctagagtcaaaaaataaaaacaaagggttttcagttgttcaatagctcattcgaaagctctttttcagttctacaacaccttttatgagttttttacgccctaaacttatttttcgtcgggaccacaattctacccaattgccgtgtttgataatatttgttattttagccaatgggctgtctaaacaaatggtggacgaacttcttacccaaacattgaagcgccattaacacggttttgcagtcattgatgagatgtgtgacaaacagtaaattgtaattggaaatggatattgccttctttcatctgtctgtgtttattataataactcatatattatgttgtttttgggttgtttaacctctgccagtcccattagttttccttccttttccactaatattgttagacaatttgttcaagtcaattcttcaacctcactgatggaaagtgacaccgaattaaaaccaaggaacactttgtcaccattgatggtgaatattttcttttccgttgttgtaatatgatctgtatttttgacataaatgaaatcatttgatagttatgtacaacaaataaattatttgaaacttttctctaaaactcactattattttattttgacgactgaaatggacaattatgctgaaaaaagagtcaaaatattcaattttgaaaaacaaaaacgacgtgagcgtcggattcggcgtcgggcgccggagaattgctgcgaaagcgggcgggntgaagaatgtacggacttaggtacgagttgggcggcctttgaatgagtcagtttcatttctttaggtagaagcaagtcggtccccctacaactgtgtggttgtcttacttcaaaaaggtgctcaataacatcggcctgcgaatgctcgaacggttgttgagggttgattaccacggagcactgatgagagtcggagacgcaccgaacaaaacgcaggtggatggagaaaacatggggaaaaggtaatgaaaattccaaaacagattgggttgcatggcattgtgctccacgagtccaaatccacttttcaaatgatcaccaaacggaaccgactcatcggcaagtccattcattttttaagataaaattgattattttacgctgtccatttagtaatcgccaaggagaatgccatatttcaatttgtggtcgatgggaaattgtttactctctttggcaatgccatgcgacaaagaacgcatttgagaggaaggaaagcgaaggtgcccaccacgattcctttcttgttggattgatttatgaaaccgatttattcaaaataagataattatgaaattaaattgtcattctcctccccccacccctcattcatcgatcattttccatttccaaatccgcctgttgacccaaaaccgtttgccccacgttctgtcacttccaaattgtcaacctctatgaacttaggccgtgtgtaaaactcgcagatcaactgggcaattctatctccgacattcacctggatagggattataggggaaattattgtttctgtcactctaaacaccttgaagtccttttctccgaagttaaataggagtaccttgaatgatattttg

SEQ ID NO: 220 - DNA, 21602 bp, Heterodera glycines
  misc_feature (975)..(975): n is a, c, g, or t
  misc_feature (21484)..(21484): n is a, c, g, or t
  misc_feature (21529)..(21529): n is a, c, g, or t
  misc_feature (21553)..(21553): n is a, c, g, or t
tccggggattcaaaaatgggtcagaaattaatgtcagaactcatatgattcagcggacccagaaaaaacccccaaaatatgttttaacaacttttaaaaaagaaaattttttaatttatttttcgccgggacaccaaatttctcagttatttcccacaaagcaatataagttcaccctcaattctccgcgataatccgagtcaatgacaccggcgccaacatcgattgaatgtttaactgccaatcccgaacgaggtgccactcgtccgtagtgcccctccggaatggccacactgagtccggttgagattagcacttggccttaattaggtagtttggtcatgtgtcatacaattataaaatttagtaccttttgctggcaccacataactttcggcactatagaggtcagctccagcagaattttcagacccgaaagttggcggatgagcctaaactcaaaaacattaaaaatttttaatttatctaatattttgtttggactggccttatcggaaattctaacaaagcgtaagaccgtttcctgggccatcgtcaaaaccctagcaaatttaaacgaagaatgaaaaatattggcgaaattagaaaaggtagcaatggaaagttcaatatcttattttttcgctttatatttgtatttgtaatttcccgcttcaaaatatttaaaatatgccacacatgtcaattttctattgtcaattccgtaccgcgctttgtctgggtcccttattcccgaccccgtccaggcctctatctgcgactaacgaatgtgaaaaattgtaatttatatatttctggttgtattttttttacagattataattcattttatcgccaaaatcacaaatgagctcatccgctttggtaaagataaagttggatcaggaagtgtgtgctgatgctgagaaattagtgcgcctttacactgaattggcagatgttcaccggaccagnaatttgtatcttttaaaattcctttttttccctacaatcctaaggaattgtgtccttaatttaatttttttattattattaaacctgatcattcattttcaatgaaactgcacaaaaataccaaaaaaaaaaaattaaaataagagaactggatccgcaaatttgatttttgtgcgggatccggcctgatccgctttaggtaaaacaaaaaaggtttaaattaggggatcacaccccccgccccgctcattctttacaattgtcatttccatttaagcaaaattatattcggcgcatgatcctcaaatcgtatggaacggaaatccttacaaagggatgccagaaattgaaacattttggcggaatttacccgaaacttcgcatgagtaagcaatatttgcctttgttagttaatcaaaaacgagtagcaagtttaagcgtcgcttgtttggatgctcatcgaattgacccaaccagcgatgacatgtcattggtcgtgttggcgatgggcacagtcataatcgggtttggtgttttcctaatatgtctgcataaactttcccgcactttttcttagcgatttatttttggaattatgcacttttattgattaaactcttccatttgtgcctacgcctcaaaatttaaaaaaggcaacaaaggtgctcgttcctttggcgcaaggactgcaagagacgcaatcttcacccatttgttggagttttagcgtcgattgtcgtcttaacgagttaccggcacatttttttggtaccaaaaaatttcctgatgaatcattaggtatattcaaaaaaaatacatttggcaaaaacagtgaaggaagtgcgggaatttttatcgcgctctgtattgctaacaatatcacgttttttaaccaatttcagcggattgagccacgcctacaatcagtcccttttgctagttcttgaaggaagtacttacaaaatcaaaagtgacaattacagggtgatcgactgaatttaccacattgataatttgttcaaatctctatcaaagcgagtaaagcaaagaatgcattcattttactttgtatttcattgagattttccggattaacataaaacaatacacacttgacagctaatgtccggggaagtgggaacgcaccaaaaacctatttttcaaatatgggtctatgattcccttctttcacgacaacgaatattattaatgatataaaatcgaacatgggttgtcaacgattcttttatttcaaaaaatccgcaacaatataacgcaacaaaaaacagccatttactcagtccggatcctttctccatctatcactcctcactctccacattgaccgttgtcaaccttttgaacgaagtaacaggcacatgcgtcacctaaacaaaacagatttaactagtgtaattgttcttccattagtcaccaaagtgtataatttgtgcggagagtcttcgtcgtcattgcgtctgcgtgaaagtcggacgcgaacgcggaatggaacattactacaggcataggtagaaaaaagcataaaacagtgcttttgcaattttgtatgtcattttctacaacttgtatttgtagagttaattataaatacataccgaacgcctcgagaccagagaaatttattcagacgcgtgtcaacgcgtacgtcgggtgtgcccatctgctgctcagcgaactttttcacttctttgatcgctcgcggagctcgatttttgaagcctctaaatcattttcattaggaagacggaatatgagatgctttctcctatttctccactccctttctaatcatctaagggataattgcttaaataatctcagcctcacattccgtggatgcgtttgtgcaaatggatggtatattcccgagtgaccactttgttgagcgcactttttcctttcttttcacccttttgtttagccatttgtgagataagttggtatttcgaactaaaaaaaatcaaagttagtggcgcagttgtacagacaaaaagaggaatctacaaatgcagaaagtaatttagcagaatttcagttttacatttttatttttatgaaaattttggcgtgatgttcattatttaaaaaagggtttgtatctgtgggatcgagccaattccctaccgtcaattccctaccagccaattccctaccgtcaattccctaccagccaattccctaccagccaattccctaccagccaattccctaccagccaattccctaccgccaattccctactaaggcatttgatttccataccaaaagtgttgaatattgataaacattgagattaaaacacacaagaaaatttattcactgccttttagacagctcgtcaagagctttcggatgataccaaatttatcaagattcgatcgttttaaaaaagttagaagtgtcaaatctctcaaaatacggatagaggaaataaagccggaatattttacagaaatgacttcgacttctgctgatatttcaagtgattttgatcagacgaatcaaaaacaagacccagatgactccggagaatttcaacgtgatcctgatgaatttgttgagtatattcagaatgaattaacgcaatggcttgacgaattacggcgaatcaaaaaacccggcgaaagggatggacgaaaactcggcccacttgagaagtctctaggtaaatgatttgcagggtgcagtacgacatttgaagcagaacattgaaataccagaagttgtgcttgaattcgattccaatattcaacagattgtggatgtggcaagaaaggaaaacagaaaaccatttcctcaacaatctgcagaatcatatcaatatttggattaaagcaattcaaaaaatgacgaaattagaccgagacccgacgtcaggcacagcacttcaagaagtgacattttgggtcaatttggagcgtgcgttgttgcaaattcaagagatttgcgaatctgacgaatttattgtcacaatggaagcgttgaaactcggaaagcgttttcatgcaactgttgcattcgaatcaaacacaggtttttttgtgtaattttacagttttttaaatttgattatttaaagggctgaaagagatgctggttactgcccaggattacaaccaaatgatgaaggatgttcaaatcaatgaccttctgtgtgctttcgatttggctgcagttaaaacggccgtttcaacaattttgggaagtatcaaaaaaatgcgaagcaccaaatacccattgaaacgtgcttatggctttattacgacaatttcaacggacctttgcgaaaggcttgttcaggttattcgtggaggagcaaaaaaaaaccacgcttattttatacttttagcttttgaagccacgtcttttgatgcatgcgcctatgtccgaattggaggaaataatggatcagtgcaaaaaaatttttactgcttgggacgaagaagcggacaaagtgatgatgatgtttcgtgaccttgccaagaaacagcggccagcagatgcgaagccaatgttgcgaatgatatatcgacacaaattactggaacttcggctcgaacaactctaccgatttcgaacgcaacatgaacagctcagcaatatgatatcccgcgttttgcgctttgctggtccaacttcgcttgaaagttttggtgtcatcgattcagacccggagaaggaggttgaagataatggaataaattgttcttttaaaatattttgcagattggaaaagcctatgatgcagtgaaagagctggattatttggacatgggtcagcagggccagcaagcgtgggaaagtgccatgcaatactacagggaccacatcagtcgagtggaggcggaactcgcgtcccgactgcgtgaccagctcggaggtgccaaaaacgcagatgaaatgttcaccatattctcgcgatacaacgcccttttggtccggccgcacattcactcagcaattcgagaatatcaaaccgcactgattgacggagtgaaggcggacattgtcgagttgcaagagaccattttggacacaaagaagagagagctggcgatcagatgtgctgaccggtatgagaagaattaagcaattcacagttttaaatcgaatcagatatgacattcctgctttctcggcttcaatgatgtgggtcagacagattgagtctcaactgaacatgaacatcaaacggattgaaaatgttcttggagagggatgggccaatcatttggaaggtaataccgacaacagtccattcaagcattcaattattagaaaaacgacggacaaattggagttttttaggcaaagaattgagcaaagagtgtgaactgcttcgacaaaaattggacacatcgcatttgcacaaggaatggaccgataaaatgttggcaaaatgtgaagtccaaaacgacagactgttcattgttgacaaacttcaacgtgatgggaaaataatacatcgaattcgcgttaattactcgccggactcaattcgcatcactaaggaggtaaaaatggataaataatagctgtcatgcgacttcgaacataaaatgaaattatgtttttaatccactttgtgtcccttttaggtccgtaacttgaaaaacttgggttatcggatcccattcaaaattatgagccactctcatacgattagcacatactacccaaatgcgatttccctcatcgagtcaatgcgtatttacgagtcgacaaatgaaattgttttgaatcgccagtcgatcgatcaactcattgcaagctatcgaaacatcattcataatctgttgaatgaggtgacgaattctcaaaatacaaaaagtaatttcgtcaccaataaattccagggtgtcaaaactgaatggacaaactttaaattggaatcatttgttgtcaaattggccgatgctgtcggaaattatcaagagaaagtctcagatctgattgaatggctggacaaaattgagctggaaatgtcatcaatggacaagtgtcaattcaagcaagaaatcatcgcccaaattctcggctccattcaaaagattgttgaccaaatggccttgaacaattattcaaacttgaaaaaatggattgaaaatttggataaaacggtcaacctttgatttcactaatttttaagccaatcgttttctcatttcagctggaaaacaaaatggctcgtcgtcttgaagaagcaattcgtgtttggattaagctgcttaaacaaagtcgggatgagctggaggatgaaagggaagtcagcattgtgcccgaaattcacccaattccactggaaatccgaatcatatcgcaatgcattgtggttgtccctacactggaaaaggcgcgccttagcctgttcaaccagttttcgtcgtggcatggaattgtgacaaaccagacaagaatttcatgcaatcgtttccaggtttttttcctcgtactatggttcactatcacttcgggttggtttaaggtccttcaaaacaacgccgacacacaaacatacaaaagtgttttgttgaaaatgccacacagtcagcagataatacaagaaactcactttgcaatcgaagacatcatgatgaaattaggcgactatgtcagccaatggacgcgttaccaggcactttgggactttcaacaggaaatgttttttgagcgacttggaacggacttgtgcaattggatgaaggtgcttttggacatcaaaaaagctcgaacaatggtcgactctccggaaacgcgccacaatatttttccgtttgtggtcgacttcactcgggtccaatcaaaagtgtccataaaatacgacttctggcaacgtgaagttctcaataaatttggaagcgcattgggtattgtatttcttttcatacattttcaaaatttaacccctcacttgtcaggctcatcaatgcagcagtttttttccgacatctcaaaagacagacatgagttggagtcgcaaagcattgattcgaccaacaccagttccaccgtggctttgattatgcacgtgcaatcattgaaaaagcgaataaaagcctctcaagaacaggtaatagcttgtttagttggcctatattttaatattttgacaatttgaatgggtgcaacagattttcttaaaaacaggttgacactttcttgtccggacaaaagcttctgactgtgcatcgttatccgtttcctcaatcatggctatatgctgaaaatgtcgagggtgaatggtctgcacttttggacgtcttaaatcgaaaggatgtcgcgattcaatctcaagtaatcaattacttatttttatcccgttttaaaatgcattttaaggttgccaatcttcaaacgcgcattttggaggaagacaagttgctggagaagcacatcaacgatttagttgctgaatggaacaaatcaaaaccggttcatggcgctcagagaccaaaagaggcgttgattttgctgagtggcttcgaagacaaatttaagcgcctcagagatgaacgatctaatgttttgaatgcaaaaaacacattggaaatcagcgattcgctgattcacatttccaaccaaacaacaaacaaattggaaattgccattgaagagctgaacgacttgactggttttatttattttttgttttctttgcatttatttaatcaaaaggtgtttgggattctcttttgcccgtgtacaacaacatcgacgaattgaaggagatcccctggctttcggtccagtcgagaaaattgcgtcaaaaccttgaagagcttttggcaaaactgaagagtcttccctcacagtaccggtcttacgagtcatacgattacgctaagcgattgctgcagaactatttgaaggcaattgtttatgatcctgtttcatattatcttatgtttttaagatgaacagtttgatcattgagttgaagtcggattcattgaaggagagacattggagaagtgactttttattcatttttaacgtattacgtttaattcactcaagatttgactcgggaaatgcatgttaattgggtgctcagcgaactcactttgggccaagtgtgggacatcgatttgtcacgacatgaagagaccatcaagaaaattatgattgtggcacatggcgaaagagtgctggaagattatttgcgccaagtcaaagaatactggacggattatgcagttgacttagtcaactaccaacaaaaagcaaagctgatcagaggatgggacgacctttttaacaaactcaaggagcacatgagcagtttgggtcagatgaagctgtcactctattacaagcaattcgaggaggacgcgctttcgtgggaagagaagctcaacaaaatgaacacgatttttgactcttggattgatgtgcagcgaagatgggtctacttggagggattgttcaccggttctgctgacatcgcccatttattaccatccgagtcaaaccgtttcaacatggtctccaacgagttcttgggattgatgagaaaggtgcttatattacttaatttcgattaatctttagtaaatttactttccctttgttgttaaggtttccacttcaccccgaattcttgatgtcatccacattcaaggcgtccagaaaatccttgagcgtcttgcagacatgctgtcgaagatacaaaaggcacttggggagtacttggagcgtgaacgcaattccttcccgcggttttactttgtcggtgatgaagacctgcttgagattctggggaactcaaaggatttgatgcgtgttcaaaaacatctcaagaaaatgttcgccggaattatggccgttgagttcaatgaacaaagccgcacaatttctgcgattatttcacgagagggcgaatccgtcacattgaaatgtccggtggacctaaagcaactaccaaaaattgatgaatggctgcgtgggctcgagcgcgaaatgcaatcaaccttggccactctcttgggcgagtcactctcgtctttctccaaattggtcatcgaaaacattcaacatgaagaacttatggagttgatggatctttatccggtattaatcaaactattttatttttgattttttgttaatttaggctcaaatcatcgggatttgtgttgatgtgtggtggagcagtgcagttgaatcttgtctgtcaaagcatggaagtgcggaaaatgtgctgcagactgttgaaaaatggttgtccatgctttgtgaaagtgttctgcgtgaccaaacggcaattagacgcaaaaaaatatcgaatttggtgattccagactaaatagtttttttattgcgttttctttttagataactgaatttgtgcacaaaaagaatgtctgccgacaacttgtcaaaaacaatgtgaaaaacagtcaagacttttggtggcttcaggtttaccgaacacatttgctcctaacaattctgatttatttttagaatttgcgcatttacttcaattccaacgagaaagatccacgcaaatcctgcttcatcaaaatggccaatgccgaatttttttacggtttcgaatatttggggattcaagagaagcttgtccaaacccctctcaccgatcgttgttatctcaccatgacgcacgcattgcactgtcgtcttggagggagtccttttggcccagctggaacaggaaaaacggaatcggtgaaggcacttggccaccaacttggtcgttttgttttggtgttcaattgcgacgagactttcgattttcaagtgctccaaattttttttcgtttataaaattcatgacttaacaggctgttggacggattcttgccggtctctgccaagttggagcttggggatgttttgatgagttcaatcgtctcgaggaacgcatgttgtctgctgtttctcagcaaatccaaatgatccaggaaacagtgcgtgcagactctgacatgaaggtggaccttgtcggcaaaagcctcactgttaatccgaacatggccatcttcatcacaatgaatccggggtattctggacggtccaacttaccggacaatctcaagcaactgttccgttctcttgcgatgacatctcctgatcgtgggctaatcgctgaagtcatgcttttttctcaaggatttcaatctgccgagatactcgcaaacaaaattgtcccattatttacgtaatattcatttttcaacttaaattgcatggttgctttagtctctgcaaggaacagctttcgaaccaatgtcattacgactttggcttacgtgctttgaaatatgtgcttgtttcggccgggaatatcaaacgcgatgcgattcaacgttcttacgatgaaccaagccaaagcggggatggagctggagaacaggcagtggcaagccaaatgtctgaacaacaaatgctcatccaatccgtgtgcgagactttgacaccgaagcttgtctctgaggatatcactcttcttcaatcacttttgcatgacgttttccctgacatcagttacagcccaaaacaagtggaaaggtgcaaatttctgggttttttaagaaaaaaattgtttgttttattttcagcctcaagaacgaagttttgaacatttgcaaaaccgaacacttctcatgttcacctatcactggggagaagggaaatctttggctggagaaagttcttcaggtttaccaaatcaccaatctcaatcatggcctgatgcttgtcggcgcgagtggatcgggcaaaaccactgcgtggaagacacttttgaaggcgttggaaaatcatgagctcgttgaaggcgtgtctcatgttattgatgccaaatctatcagcaaagacacgctctacggcactctcgacccgaacacacgtgaatggactgatggattatttacgcatattattcgaaagtcaatttattattaatttttaataggttgacacaattgtttagaatcattgacaatgttcgtggagaattggataagcggcaatggatcatctttgatggagatgttgatccggaatgggttgaaaatctgaattccgtacttgatgacaacaaattgcttactctgcctaacggggaacggctttctattccaccaaatgtgaggcaatattaatttcaaacttatttcttttatattaggttcggatcattttcgaagttgctgatctcaaatttgctacgatggcaacagtttcgcgttgtggcatggtctggttcagcgaggatgttgtcacccccgaaatgcttttcgaaagctttttgctccgaattaaaaatgagccgcttatctccgggaatgcgaatcgactgctgaatattcaaatcatttgtgaaaacacgctttccatgcacatggacgcaaatgggctcgttccgctctgtttggaattcgctgttgagcaattggaacacattatggagccaacccgacaacgccttctgctgacctttttctcaatgcttaatttctctgtcaaacaattgctgcaatacgattcagatcaccctgattttccaccatctgtaagttattatgttgtgaatcaactatgaaaaaatttcaaggaggaacaaattgccaatttcatcagccgttcattgcttgtcaatttgatttgggcttttgctggtgatgggagttggaagaaccgaaaaagcttgagcgattttgtccgcgcttccactacaattcagctaccgccggaccaatcggtattttgatttatattttaaaaattgccttctttgtcctagctcccaattactgattactttgtgaccacggatggcgattgggaatcttggctgacaaaagtgccacaaattgaaattgaaccgcaacggatcactgatacacttaccgtaattcccactctcgacacagtccgccacgagatgctgctgaacacttggctcaacgaacggaagccacttgtgctgtgtgggcctccgggatcaggaaaaacaatgacattgttggcggcattgcggttgatttacttttctatttgttttcatatgatgaattttttttatttgttaggtcactgcctgacatggacgtcattaatgtcaatttttcttcatctactacccccgaattactgatgaagaacttcgaccattactgcgaataccggaaaacaccgaccggcgtcgtacttgccccagtacagatcacgcgatggcttgtgattttctgtgacgaaataaatttgccacagccggacaaatacggaacacagagggtcatttcctttatgcgacagttggttgaacaggttcaacgccgacgttgtgcaatgcttttactcttgttttttagaacggcttctaccgcacgaccgaccgcacttgggtgacacttgagcgtatccaattcgtcggggcatgcaatccgccaactgatccgggcagaaacccattgtctgcacgttttcttcgccatgtgccagtcatttacgttgactaccctggacgtacatcgctcaaccaaatttacggcacttttgctcgagcaatgcttcgtcaaacaatgcaaatacgaggaatggctgaaccgctcactgaagcgatgactgatttttacctgcagagccaggcattacatatttcatctatttgtaaattacagtaaatatttaggagcattttactcaagatgatcaaccccattacgtgtactcacctcgagaattgactagatgggtgcgagggataagcgaggcgattatgcccctggattccgtttctcatgaagagcttgttcggctttgggctcatgaagcacttcgtctgttccatgacaggcttgtgcgggacgacgaacgagtttggaccaatgaactggtggatcaagtcgcgcacaaatattttgctgcttcctgtaatttggacgcggcactcgaaagaccattgttgtattcatgctggttgaagaaggtttagtccgtctttttcagcattaaaaattgtttggtttagcattattcgccagtgtccagtaaagaattggaggactatgtcatgcacagaatgcgacagtttgctgaagaggaattggatgtgaagctcgttcttttcgaccaaatattggaccatgtgttgcgcattgatcgcgtattccgacagccacagggccatcttctgttaatcggagtgtccgggtcgggcaaaacaactctgtctcgtttcgtcgcttggttgaatggattcacgacaatgcaggtagtttttttttggtttactgttcgttttcaattttactttatattattatttttcagcttaaagtgcattccaaatacaaagctgccgactttgatgaggacattcgacacgttcttcgccgagctggctgcagaaatgaaaagatatgctttatcatggacgaatcgaatatgatggagactggctttttggagcggttaaacacgttattggcaaatggaaaagtgcccgggcttttcgaaggcgacgatttcaatacacttctcagtcaaatcaaagaaggagcacagcgccaagggtttatgcttgactcacacgaggagctatacaaatggttcacggcacaggttttaaatttaaaactttgctgtatatatatcaaatataaaaagatcgttcaaaacctgcacgtcgttttcacgatgaatccctctggagatggactccgtgaacgggcttcaacatcgcccgcactgttcaacagatgcgtccttgactggttcggcgactggtccaactcggcactcttccaggttggccatgaactgaccagcatgtgcgagatcgacaagtccgactacactccgcctgccgcgctggagcattgttgcgatcgtttgcccactgaaattgcctatcgcgacgcggtggtgaattcattcgtgcacattcataacattgtccggaagacaaatgttaccgagtcgcgcaaaggtcaccgcgtgatggccattactccccgtcatttcctcgacttgatcaaacattatgtgacaatgagcaaggagaagcgtgatgtgattctgcatttagtttaatttgtatcataacaaatatttaggaacttgcggatgaacaaatccatctgaacaacggattgagaaaaattaacgagacggagcagcaagtcaaggagttgcagaagtcgctgaatgagaaagaagtcgacctcaggaagaaacaaggggaagccaatgcgaagttgcaactaatgctgggggaccaacgcgaggcggaaaacgagaaacgcacctccgaaacgttgcagaagcaaatccgagaggaaaaacaatgcattgatcgaaaaaaggacgaagtgaaacgggaattggccgaggtttgttcagttaacaataaaaaaacttattcattgaatggacacgaggggagggtgaaaaaccttcctaaaaattccaggttaaacctgccgttgaggaagcgaagagcgcggtttcgggaatcaaaaaagctcaattggtagaagtgcgctcaatggcatcgcctccaaatgcggtgaaaattgccatggaagccatctgtttgttgttgggcgaaaaacaaacggaatggaagtcaatccgcgcaatattggttaaagacgacttcatcccgcacattcttcaattcaacacggattcaataacaccggaaataacggagaaaatgaagcagtatgaaggcaaccctgactgggaatttgagaaggtccgttattacaatatattaataaaataagaaatccaacaattcaaggtcaatcgggcatctgtcgcttgtggaccaatggttaaatgggcaagggctcaactttcctacgcaaaaatgctgaacaaaatcgaaccgttgaacaatgaattgaagcgtctggagaaagatgcggaagaaaaaacagtgaaaggcgaagaattgaagcacaaaatagaagcgctcgagaaccgaattcaggaactgaaggtaactgccaactgaattacaggtacaaaatattttcttaattgcaggatgaatacgcacaactcatcggagaagcggaacacatcaaacaggacctgcaagttgtgcaggaaaaagtcaacaggagcatccatctgttgaaatctttgcgggtggaatgcgatcgttgggagacaggcagagaacgatttgctcagcaaaatgagacattggtgggcgatgttcttctttctgccgcctttctttcctactctggctactatgatcaactgctgcgcgacacaattttccaaaaatggatgggaatattggattcctcacaaattatgttccgtcatgagcttgctcgcattgagtatctgtcaactgcggacgagcgcttacaatggaacaataatggaatgccgaaggacgaattatgcacggagaatgccattatgctcaggcggttcaaccgtttcccattgatcatcgaccccagcggacaatccatcgaattcatttgcaaagaattttccacagcatctggcaaggaacatcaaaagggaggctcggtggcaacaacggttcaactgactagttttaatgataattcgttcaggtataaagtgagaaaaataccaaattctttattttaaattttagaaagaatcttgagtcagcgcttcggtttggcacaactttgcttgtgcaagatgttgagtcctatgatccgatcctcaatcctgtgttgaataaggaggttaagcgaactggcggacgtgtactgatcacaattggtgaccaagacattgacttgtctccagctttcaaaatatttctctttacgcgcgattcttcggtaatttaaaatttcgttaaaacaattgaatttttcacctaaaccccaaaggttgaattcccggcggatgtgtgctcacgtgtaacttttgtgaactttacgataactcgtgctagtcttgagacgcaatgccttcaccaagtgctgcgcagtgaacggccggacatcgacaagaaacgaaatgatcttctgaaattgcaaggagaatttgcagttcgactgcgacatcttgaaaaggctttgctaaacgcactgaacgagtccaagggtaaaatactggacgatgactccgtgatcgcgacgctggaaaaactgaagaatgaagcacaggaagtagcaaagaaatctgccgaaactgaccaagtcatgaaagaggtatagacgttttttaatgatcgtttcgaatcgattcttctaaattctaccgccaattcccataggtcgaaattgtctcacaaaaatactacaagttggctaatgcgtgttcgctcatctatctcatgttgcatcgtttggacgagattcatttgctctacaattattctctggactttttgctggacattttcacaactgttctcaagtcaccacaacttgggaatgtgaaagactacgatgctcgcctgtcaatcattcttcaaaatctcttttcggtcttttttctttactttactgctacaatagttcctcttgcttaaggtgatgtactctcgtgtttccataggaatgcttcacaatgatcaaattctgctcgcttctcttttgctccggatctattctcgctgttgcggtgcagagaatgcctacgagcaggaattggagcagctcacagcccttcctcctgagcaggtgctttcctcggcacacatgcttatgacgaaggcgtttggttcggaattcatgcaacaggacaaagtggttaacctccgtgaaataattttgaatgaggtcagacaaaatgtaagataccacttgcttataaaacatctcttattaaaggttcaatgtaaagtgcccgttttgttgtgttcagcgacaggctatgacgtctctaatcgcgtggaggaccttgcatttgagctgaaaatggacattttgtcaattgcacttgggtcagccgaaggatttgaacaagcggacaaagcgttgcaatcgacaagccgatcaggaagatggattctgctgaaaaatgtgcatttggcaaccgaatggttgactcaacttgagaagaaatttcgccttcacaatccacacccacattttcgtctgattttgacagctgaaattggctccgctctgccaatttctatgatccaggtgtataatttaaaaatttacttttttcaagttccaactattttttcaggcttcacgtgtacttattttcgaaccatccacagggctgaaggcgaatctgttgcgttctctttcctccatttccccggcacgaattgcgaaggcaccagcggagcgagctcgtctgtacttcattatttgctggttccatgccattgtgcaagaacggctccgctatcagccactcgggtgggccaattcgtacgagttcaccgacgcagacttccgagtcgcgtgcgatactctcgattccactgttgacatggtcgcacaggtcattctttgtttttcgtgatgatggttttctttttctatttagaacagggcgaatgttaagccggataaattaccatggctggctctccggactctgctctctcagtgcatttacggaggaaaaatcgacaatgattttgatcaggcaagtatacagtgggtttataagggaaagaaataatataaattttcatagtattataaatgtttgggtttgaaaatcttttcgccattttctcacctatctcgctagatgcattatttcacatttaatataatttaggtgcttctcgatactcttctcgacaaactgttcacatcaaattcatttgacgctgactttattctcattgaaaacatcggagtgaacgccttgaacatgccagacgaaactaactcaaaggatggtttgatcaactgggttattaacatcaaagccttacaaaagcctaattggattggacttccaaacaacgcagaaaaagtgcttatcgccgaaagaggtactgctttcacaaaccgaaatgccatcatgaagaaatcatttatttatcaattatagggcaagaatttatacggaagatgatcaaaatgtcggacgatgaacttgcatacgaagcggatgatttggaacgtaacaagcaagcccctacctggatggttcaattttctggacagtgcaaatcttggctcgatgctttgccacaagtataccttctttccctctgaaaagaattgacattcatttaattgttttcgtttattgtttcctattctatttttttagcaactacagcgtcttcgacggactaaagaaaatgtgcgcgatccgttgttccgattctttgaacgtgaaatcaacttgggcgccagacttttgtccgatattcgacgtgacctcaacgaattgttgtccatttgtcatggggatcagaagcagaacaatcacagccgtgaattaatagctgcattggtcaagagaaaacgtgtgccagacaattggctccaattttccgtgccaaaagacgtaacagcacttgaatggatgcgagactttgtgcaaaggatggaacaactaaagcgcttgtcactttcggaaaatctgagatatgaggaagtctggctgggtgggatgttctttcctgaagcgtatataacggctacgcgtcagctgatagcccaaacgaatggctggtcgctcgaacagatgtacatgcatatcacaaaaacggaggaaggacaattaaaatcaacagcattcacattgacaggtggttgatgatgatgaacttcgttttcatcgcacatttatttatagaccttcgcgcaattggcgttctttgtgaggccgacgaaattaagctgacagatgaagtgcatgttggagtgccacggcttcagttcacgtggaccttggaaggacattctccagcgagtgttgtggtgcctgtttatctgtactccaacagggccaaatttttgttcggacttaatttgttaccaattggatttgatcattctatgctaagccagcgaggggtcgcctttgtctccaattgttcgctttgattgacttttgtaccctttgtctcaaagaatatttatttatctgtctattgtttttaatttgtttccaatgaataaattttgaattgcattttttgcagactaaattagggaaagggatttttatttttcccttatacttccatgatttatgaatagtaatcgaattaattgccttgtctaatgcactgcttcagagccttattcgtcatataaaacaaatttggaatgaatttaaatttacacacaacatatggaggacctaaacctgggaccccccccccccctttggtgacattcacaaaccaccgactgtgagaaaaaccccttatttgcaatgggagcccaaaactgaaaagctgtgagcattaagtcgccaagttactttatggccatgtcttttatggtcctgtaaattgcaacgaagccgcttattttgcactcagcagctcataattctacagtcatggtcatatgtagggttggtaattatatgcacatgcatatttttttcctggactgtgggaggcctgaaacgcacgaaaaacatgtttttagcttgttttgaagcttctaggatgactttccatatgcatatttgtgcatatttcgcgatttatgtgcatatttgcatatttgtgcatatttcggcatttcatgcatattttatgtgcatatttgggcattttttcaataaatcctctattaaaacggccccctttattgaagcggccatttgggctctaatgaccgaaaatttttcaaaaaaatcacatttttgggtatattttctggtaaaaaagtaattttttaaaaaattggaattttatgccaaaaatagtcagaaaatagaaaattctcctttttttgctcaattttcttcaaaataaataaatattaaaatttgaaaatttgccctcaatttggaaaaatttatgtgcatatttttcactttttatgtgcatattttgcaatttttggtgcatattttatgcgcatattttgcgattttatgtgcatataattaccatccctagttattttacccttgattttatgaattttttttagcttataactttttcaataatagaccaaataaaaccattttatgctcattttgaagggaaaattctgaagaatatttctcaattagtcaaaagtttaaaaaaattgtttattggcaaaaaaatgaaccatgtgttatcttatatgttagagacatggaaatagtgcgtcaaaatgagagaaaaagaaaaaactttgccctgggaaaagattttttcctgtgggtaacttttcttaaaattttgtataggctacatattttaacccaacctataggatgatgctttgttttttatcaaaatgctttttaactcgagatcggctcttccgtttttacaagggaaaatccccaaaaaatgttcagttttgcaaagttttggcgttctgattactaaataaataataaacttatttgtacttggagcccaaaattgaatcgccgtgttcaaaaatactccccacatattgaccaaataaatccaaaaaagtcataattttatggtgccaattgaaataccaattctgtgaaaaggccagggtcactttcaatcaaacaccaatttcctgcttcgttggtcattaaaatttagaataggtaaataatatatgctctaaatgtgttagaaagataaagttatcgtccgaaaacttggctggcgccaaaacgacctagtcccaaaaagtgataggtaagtgaagaaaaagttaagtttaaatagcagaagggagagagaaaaagtacaaatgacaatatttttttggcacagtaatacctaatgcagtttgtccccccattctctgaaaaaattaaattttaaaaagccctgaaacacactttcctagggtttttggggtcgatgatcgcgaatcacatttaatggccggtcattcgttgatgtcattcgtctctccaattcaaaatctgttgacatttgtcgctttttctgcccaccattctttgctttcgttcgttagatgtaagcagaatccaccgatgctgacatggcacggtgtgtattggcgatgaacctcctcaaaaccctgtcaatatcgaaacgccggagccagaattctccgccttttcatgcttattttttcctgttcaactatccaatttcccttggtttttcgaattcgcgcgggtaacttttctgtttacaatcatcaattaagtcattttttcgatgttctttattcaatgacttggacaaaaattgacagaataatttatattattaaatctttttttttgatggagtgaaatcatcccaacaaaaaaaagataaaaagaaaaaagggcatttcaacaacaagaaaatgcgatgaaattggacaaaaagaggttatgtatatggttagttatcctgccgaaggagaacaacaataaatggataaatganaatatgcgaattttgtgaatgttttgtgagggatgaaaccgttgngattaatctgaagggactgctggngattacagggaccaaattttaaacagctaaaattagcaaatccctgcat

SEQ ID NO: 221 - DNA, 1767 bp, Heterodera glycines
tttctttctttctctcagttcattcctctctttttctttcgtacctcatcactccctctttttctttctctctacttatttctctctctgcctttctttctctctctctctcttactatccccatctccattttcttctatcctttcttctcttcctctcttcacctttctctctccatctctatttctttctttctttctctctccctctctctcttactatatcccccccccctccatcttctcttctctctccatctctatttctttctttctctcagttcaattcctctctttttctttcgtacctcatcactcactctctttctttctctctacttatttctctatgcctttcattctctctctctctctctcttactatccccatctccatttttcttctattctttcttctcttcctctcttcacctttctctctctatctcatttcttcttttctctccctcctcttttaattgactctctctctttatctccacactttctttctctctctcggtacctcttctctttcctcattctttctctctcacattgacgtaaacaactgaaaaataattctctcttttttgttttgtttacctgtcactgtcatgggaagttattgcaaaattttctttttttctttttctaacgctcttttttgatttttcattcttttttattaatgaacaaatcgccacaaatcaaagctttttacgccaatttaactcgaccaaaaaaaggggcggagcttcgtctcgattagtatagagtaagggataagggatatgtataaaaacctaaaatatgtacgaaaatatgtaaataaaaattttttaaacagttatttttgaaaaaaattttgctaaagggttcatggggaatccaggaaaaaaatatgtatttacattaaattgacatccctagtgattttcgttaaaaaagattgttttccgctttgtttctcattatattaaaataaagtttccaacgcaattacctaattattctgctatatatttgtgtgacatcattcgaaattcaacagcaaattgtgctaattaccaaaaaatgaactggcaaaagcgaattgacaatttggagacaaatcgtaattagcaaggacaaaggaccagaaacggaactatctgtgtggatggatgacaaatttgtggaatttccattgccggacgaccgtccgttgcccagcaaaatccgttttaaatggcttcggattgagtaattaaaaaacagttttatggcaataaaagcggctctattgcagttcacaggaccataaaaaaagacacgaccataaattatttttgtcaactttagtgcaccctttttcaagaagcatccaaattaaacattattagtatcattcgatagccgtagctctccagttgcggaaatgccaaaaaaccggtttgaacctgtttaaaactcgaaaaattgagtgaaaaagggggccactgaccctttaaaacagtcaaattcggacaaattaggtatcactcgaaagctctggatcagctaagtctaaaaaacaaggtataaattcgaaccgatgccatctaggcactgggtcaactgagtcccagtgaaaatggacacttcagtaccaaaagaaataaacgggaaataacaatttaaaagcaaaatttcgcaaaagggagtatgcgaagacggagcaagtagtggggcgagacggagggcggtggaagcagtctgacgagcgccacaggcggttgactgcgg

SEQ ID NO: 222 - DNA, 10247 bp, Heterodera glycines
  misc_feature (27)..(27): n is a, c, g, or t
ctacgtccctcgtgaagttatgcctcnggaggacaataactacacgaaactatgaacactagacaagcctcagagggtcttgtctaggctctctaatttgcttttcccttccccctttgtcaccgggatccgtcgatttcagtccgtggttcacagcaaatccacccaggagcgccaatttgtcccgacttgctctggggtcgggccaaatgaattccacggtgcggggttcagggacaggcagggacgagacacagaatgaataaaaaatttattccgggaaatgacctcaaacttgggtaattaaacaaaaattttgaaatggtgaacgaattatcacaaattgatcacagaaatgccatcaccggggaattatcacaaatggaattgggcaccgggatgggacaggaaatggagggcactggggccacagaacaaaaatcaataaccgggggtcaaagaatgatcacgaatggggttatcacagttaaaggcaaatggaagggaggggagagaaacggcaaaaatgcctaatgaattttggttgtgaaattgggggcatttttggccgcttaaataacaataaagttaaataaaaagtggcaaatgtgagcagaacgaaaatgggccgaaaattgggcacgaaatgaaaaacgggggacaaaatgaacagatgaacaaaatgggcggaaaacgggaaatttgggggttcatcgttctttggagtctcattcgccgaattggggacggcggcagaaaagttgcggttttgacaaattggtcattaattgtgcgcgaggcatggaaggaacgcagaaaaacaattaacaatttggagggaaatgggggcagaggagtggaacggggtgtgacgcatgtgaaagggagggggaagggtcgccacttcctttcttcaattctgctgatcaattgatcggcagtcggaatcccagagttccgacattccggcgtgaaaaagatgggcccgtcagaattcttttcgtctgggcctcccaaagggcgagtcttctgtgaggtcgagatggctctgtgttcgtggttgttggtaccgagccgttctggcgatcatgtccaatttgattggtgacatggatcggtgctctgccctgcgcgctggtggtttgggggttcgtggcatttcacgcagcggcattccctcttcgatcccgagtggtttggaaacggtgggtcggaatgtcggatgcgggcgtactccaacgaggctgagaagagtcactcggatgggattgagcaaatacgccagagtgcatgggagaacaatgtcgcgcagcatgaggaaggttgaataaacgcaggcgactcgaatccaccatgtgattgcttcgtcgatcaggccttttagccagcgcatggtgaatccttctattccgcccttcaacgcgcccaaagcttcagtccttgccgtaatgtgctgttccagcttgtccttgaactgctccgagttgatgaattcgttgatgtgcgggaagcgtgtcgcttcagactcattgtcgagttgccatgcgtggaagatcaatggatgaagttccaaattgctattcgtttggttgatcgttgttttgtacaattcgtggacgtagtccttcggcattcgtcgtgctgtgccggttcgagagacaatccataaccagatgttgggattgcttcgcagttgaagatgatggaaccggtagctattacagcttgcatgttgtgctgtcagcgagaggatgcgaagttccggatccaggaaagctgcgatagctcggtcgggaaagtgcgcagtcacgggaatgtagaggcgacagtcaatcattggcctccattgtcgtttcgccgatccaacgagcttggacgtttggttgccgtagtaagcgtctggcctggagagtcgggttggctgccctcgtgtttcgctgatttaacgccacgcttgttgccacttgggatgccgagagctgtgatgcgagctgttctggtcggatgcctcttccatcttgtcgtggtgctgacaatgtcgtcgtattgctccttggcaattccgaagttctgttcggacatgacgatgcgtgtgccatcgcaggcgatgagttctggcgcatttttggcgaaagttaatgccttttggtgatcttcggagatccaaatggccattgattctccgtaggccgcagtgaattttccgttgatgacttccgccttctcgtagtcgcatgtttggcattcgttgccattgcaggttgatttccaaatcagagttgagttgtcgggcagttggcagaattcggttgcgtattgacagttctgaacttggtggactggcgaaaacatctgcagattgtgccgttttacgaaaagtgttgctggttgagcaaagcagtttgtcgccgtgctgatttgttcgcctttgaaaagtccggcgattggtccagggaagttgacttccaattcgtcattcgttgaccacaattgtgcttcgtgattcgtcatttcagacttggcgaatgggcattcctggtgaatggccatttgtttgcagatccgcttgttgaccggtggaaattccttctcgatggtgacgaaggaacaatgccatgcaaaggtgatctgctcgggcttgatgattttttgcgaagaggcgatctggggcgtgtcgttggctctttcgtggtctgcgttctcgccctggtgacgtactggattcgtgtccttgctctcgttgcaagggttgttcgctgagtcgtcgtcgtggtccagtgagtgccattgcagaagacgcagggtgaaggcggatccctcgaccctgcttgtactgtgccatcccggattggcatattttaggcgcttgagttggccttagtcccctctgttgtgacctccgcggttgcggtctgttgtggttcattcgctgctgaacctcctcaatcgttgaggacatgtgaatttgcttccggaaacgtgctgtcagctgcatgctcgagtgcttttgcttgaattggtgacgtagtttaacgtccttatggaccaattgtcgttgcttgttggacgtcatttcggaccctgaccgtcggatggattgctagtttagcgtattttcggacaatggttgcttggtggccggtgctttgctagtttaacgtcattgcggacaattgatgctttgctagtttaacgtcattgcggactttgggtggtttgtttctctagtttaacgtcattgcggacatgtgttgtttgcttttctagtttaatgtctttgcggacatttgttgttaggttggttctttagtttaatgtcattgcggacgattgttatgtgggttggccgatgctttgctagtttaacgtcattccggactcgtggcagccgggtgattagcgtttcggacagttgttgatggcttaggctagtttaacgtcattgcggacgattgatggtgattagcttagtttaacgtcttctcggacgagtgctgttggcatggtgtcttactaattgttgccgagctcatgtttgggcaattctgttgactgcccttatcaattactgttgttgagtccgagcttctggccaatgtagcgacgcaatgatggttggcgcctgatccacttgcggttggcgacaaggctttcatttttctgttgagttcatttgtttggcttgtttgtgcgggattcgctgcttttccttttggttgtttgctgaaagaaaatgctggtcgcttggcaactgatgaactcttccttgttggtgttagccattgcactgccataggaattggtgccgttgaatgctcatttggtgatttggcttgtctatccctgactggattttgtatgatctcaatgccggatgcgtcgctgtctgatgaaagatcaatcacgattgattttgagctgatgggagccgattctctcttccgtcttgatcgcaatgttgcaatgctagacaagagtttgttgcgttgatgccgtctcagttcgtccttttctttttgttgaatgtttttctgcctctgagccgctttactgctttgtggcgattcatcgttgttgaccattagcacgaaagagatgttggacggttgcttgagcttgattcgccctgttccactgatgatattgccgattttcgattggcaaatcgtaaatccgcttggcagttgttcaattggttgaacattcagctggtgccaaacgtccattccgaggagaatgtccggttgccgtgactcattcggcagggaaagcttcttttgtcgaagttcgtcattatccaatgcgtttagttgtagtaccggcaaatcattcagcaggaacttcaaagcgttcaggttgaaaatgaacctgtcctggtcggggcataaaatgccgattgcgacgcggtcgcttatgtatcgcttcggttctcgttcaccgaagctggacaagtagcattcttccgtgctgaggacgttcagatccaattgttcagctgcactgctcgagatgaatgatcggtggcttcccgggtcaatgaagatggttcccatcatgctgagggatggccgtgacggattgaagatcgttgcttttgtcgtcattagcaacgctctggtttccttgctttggatggcattacacatttgttgttgttcgatcactgttgatcgcttgcaatcgttggcatttggcttctcttcactgcaagaggtgctaggcgtgttgatgccattctcggctttgtactgatctcggcagagtgccgtgggatgccgacgtttgcagtgatagcacttagatggtcgagcgcaatttgatgcgcggtggtttggcttcatgcacttgaagcacagcttcttttctctgacgatgctgatccgttggttgagtgtgtcgacgttttggcattcgtcatgccaatgattgctgttgcagaaaatacaggggtatggcggaccctttttgacgctctgtacttggtttcgcatttgttggcagtgtttctttgcttgttgtgtgtgctgttggcttacatacccttgatgtctgtgaccctcgtccagtgatgaggcgataaatgtcatatcacgcagtgccattggttggttaggccttcgtgacctttggtttggtgttctcggtgcttgtacaggtgctgctgagacgacttctgcttttggttggacgtagtgatggccatattctcccatcacttcttggatttggacttctttccggactgcttcggttagcacatcccggaatttggttgtcgtccagtttgccggatcctctcctttctttgtgaggatgcttcgtaggaatggtggagtcagcttcttctccagcatgaggaacacctgcggtccctcgatgtcctctccggcattgttcagctcccttgtaagccgctcaagttgaagcagaaagtctttggtctcacggaggcttcggcacggcttgagattggccagttcgaagtgaagacttctgatgtgttcctccggagctccgtacgtgtcctttaacagctgaaggaccgtctcgtagtttgcgtcttccaaccggaagcccgctatgagttctcgcgcttctccgcccagtatattgcggagtaagttcagcttctgcgctttactgattgattgactgccgattgccgatttgaaggattcgtagaattcgggccattttcgcttttggccgaaaaatttatccagttgaattggctggaattggtagagcggtgctgtgaatgttggcattgtcattggtgctgccattgctggtggcatgggcggttgttgctgcggattggccaattgatccgcctttgcttccctgtcggctctgcctctgtgcagtttggctgcggcactgagtgttgcttcgagatctcgcaaatcccgaagtttggttgatgctgcgtcgtatcgttcggcgattttctcatttttgtcgaatttgatgtattctttttcgccgttgtctttgtcgtctccggtcaggcgggcgagaagttcaatccaagcgttggataagtctcgtagactgtccatctgcatttccatcgagcgaatttccttgacgacgcgatcaaattgagcctccaagttgacggcattttcccagtttgacaggtccgggtcggggtgtagaaggagtgaagtggcgcttttggcattgtcgagagctttgagtgcattgatgatccctttttgtattggcccagacattgcgtgcagtttggttgtgcgtgtgtgtgttgtggtgcacttgttgttttgtgtctttttccgagatcagtctggccttggtcctggaccttttgtgactaaacacctgcctcggaggacaaggtgtttgccttttgccttatggctaaactaaagcctcggaggactgttagtttgccttttgccttatggctaaactaaagcctcggaggactgttagtttgccttttgccttatggctaaactaaagcctcggaggactgttagtttgccttttttccttatttgtcaatggccttgtgcgcgcttgaacacccttttgtacgaagtacttcctcggagggcaagtacttcgtccactacacaacaccttccaaccctctgttcggacgaagtgcttcctcagagggtaaacactaagtccgctacgtccctcgtgaagttatgcctcggaggacaataactacacgaaactatgaacactagacaagcctcagagggtcttgtctaggctctctaatttgcttttcccttccccctttgtcaccgggatccgtcgatttcagtccgtggttcacagcaaatccacccaggagcgccaatttgtcccgacttgctctggggtcgggccaaatgaattccacggtgcggggttcaggggcaggcagggacgagacacggaattaataaaaaatttattccgggaaatgacctcaaacttgggtaattaaacaaaaatttaaaaatggtgaacaaaatatcacaaaattgatcacagataaaatgccatcaccgggggattaatcacaaatgaattggggaccgggatgggacaggaaaattttcagaaaggaagcattcggtactggggcaaatgggaaatcacagaaatcaatgaatgggaccgggagaaacagaaatggagggcaccgggccatagatcaaagatcaacaatcggggggttcaaagaatgatcaaaattggggggccatcacagttaaaggcaaatggaggggcggggagagaaacggcaaaattgccaaatgaaatttggttgtgaaattgggggacatttttggccgcttaaataacaataaagttaaataaaaagtggcaaatgtgagcagaacgaaatgggccgaaaattgggcacgaaatgaaaaacgggggacaaaatgaacagatgaacaaaatgggcggaaaacgggaaatttgggggttcatcgttctttggagtctcattcgccgaattggggacggtggcagaaaagttgcggttttgacaaattggtcagtaattgtgcgcggggcatggaaggaacgcagaaaaacaattaacaatttggagggaaatgggggcagaggagtggaacggggtgcgcggggcatgtgaaagggagggggaagggtcgccacttcctttcttcaattctgctgatcaattgatcggcagtcggaatcccagagttccgacattccggcgtgaaaaagatgggcccgtcagaattcttttcgtctgggcctcccaaagggcgagtcttctgtgaggtcgagatggctctgtgttcgtggttgttggtaccgagccgttctggcgatcatgtccaatttgattggtgacatggatcggtgctctgccctgcgcgctggtggtttgggggttcgtggcatttcacgcagcggcattccctcttcgatcccgagtggtttggaaacggtggatcggaatgtcggatgcgggcgtactccaacgaggctgagaagagtcactcggatgggattgagcaaatacgccagagtgcatgggagaacaatgtcgcgcagcatgaggaaggttgaataaacgcaggcgactcgaatccaccacgtgattgcttcgtcgatcaggctttttagccagcgcatggtgaatccttctatttgccacttgggatgccgagagctgtgatgcgagctgttctggtcggatgcctcttttccatcttgtcgtggtggtgacaatgtcgtcgtattgctccttggcaattccgaagttctgttcggacatgacgatgcgtgtgccatcgcaggcgatgagttctggcgcatttttggcgaaagttaatgccttttggtgatcttcggagatccaagtggccattgattctccgtaggccgcaatgaattttccgttgatgacttccgccttctcgtagtcgcatgtttggcattcgttgccattgcaggttgatttccaaatcagggttgagttgtctggtagttggcagaattcggttgcgtattgacagttctgaacttggtggactggcgaaaacatctgcagattgtgccgttttacgaaaagtgttgctggttgagcaaagcagtttgtcgccgtgctgatttgttcgcctttgaaaagtccggcgattggtccagggaagttgacttccaattcgtcattcgttgaccacaattgtgcttcgtgattcgtcatttcagacttggcgaatgggcattcctggtgaatggccatttgtttgcagatccgcttgttgaccggtggaaattccttctcgatggtgacgaaggagcaatgccatgcaaaggtgatctgctcgggcttgatgattttttgcgaagagctcaattgccaggttgagccattgagcagtgagtgatggcgggggagcgatctggggcgtgtcgttggctctttcgtggtctgcgttctcgccctggtgacgtactggattcgtgtccttgctctcgttgcaagggttgttcgctgagtcatcgtcgtggtccagtgagtgccattgcagaagacgcagggtgaaggcggatccctcgaccctgcttgtactgtgcgatcccggattggcatattttaggcgcttgagttggccttagtctcctctgttgtgacctccgcggttgcggcctgttgtggttcattcgctgctgaacctcctcaatcgttgaggacatgtgaatttgcttccggaaacgtgctgtcagctgcatgctcgagtgcttttgcttgaattggtgacgtagtttaacgtccttatggaccaattgtcgttgcttgttggacgtcatttcggaccctgaccgtcggatggattgctagtttagcgtcttttcggacaatggttgcttggtggccggtgctttgctagtttaacgtcattgcggacaattgatgctttgctagtttaacgtcattgcggactttgggtggtttgtttctctagtttaacgtcattgcggacatgtgttgtttgcttttctagtttaatgtctttgcggacatttgttgtttggttggttctttagtttaatgtcattgcggacgattgttgtgtgggttggccgatgctttgctagtttaacgtcattccggactcgtagcagccgggtgattagcgtttcggacagttgttgatggcttaggctagtttaacgtcattgcggacgattgttggtgattagcttagtttaacgtcttctcggacgagtgctgttggcatggtgtcttactgattgttgccgagctcatgtttgggcaattctgttgactgcccttattaattactgttgttgagtccgagcttctggccaatgtagcgacgcaatgatggttggcgcctgatccacttgcggttggcgacaaggctttcatttttctgttgagttcatttgtttggcttgtttgtgcgggattcgctgcttttccttttggttgtttgctggaagaaaatgctggtcgcttggcaactgatgaactcttccttgttgatgttagccgttgcactgccataggaattggtgccgttgaatgctcatttggtgatttggcttgtctatccctgactggattttgtatgatctcgatgccggatgcgtcgctgtctgatgaaagatcgatcacgattgattttgagctgatgggagccgattctctcttccgttttgagcgcgggtgttgcagatgctggacagagagtttgttgcgttgatgc

SEQ ID NO: 223 - DNA, 1348 bp, Heterodera glycines
caaaataagtccccatttgggctaaaaggccgacaaatgtcaatggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaattctcgaaaactgacatcttagtgagaactgaaaacggtacggaagaattacaaaataagtccccatttgggcttaaaaggccgacaaatgtcaattggagcaatgttttcggcatgtagtgctggaatttcagaaatctcgaaaactgacatcttagtgagaactgaaaacggtac

SEQ ID NO: 224 - DNA, 2693 bp, Heterodera glycines
gagtagttatcccacggtacccgtccgcgtccggtgtgaagtttcacacctttggtgtgaaaccggcaccgtccgtagggtttaggacctggttttcgcgcactttgcggacggtaattctcccatttaaaactaaaaggtttgggaccaaattttcgcgcacttgggggagggggctaccgtaataaaaaaaaaccaaaaggtgtggagccgaaatttaagggcgttactgtaaccaattctaattaaaattcaaaggttcgtggccaaattttcccgcattttgtgatactgtaatataaatttgacttttaataaaatttattttatccaaaattgggggtcatctcaccccccccccccattttttccattcaattgacaatattgttgctttgcatattctgcctgcgagacgatgtgcggctaagggaagagaagaagggacagagtgaacagtgtatgctatctctgcttttctctcttcctcttcggcgcacttcatccaaattggtgtcattctttgatcaaacgcatctgcgttttgggccaatagccatcgcggcaaatgtgtgaaaagaaatatggaagagaaatcggggaagggggggggggtttgatcgcagattgcttttaggtgtgtccaatggtcaacattttggacaaaggatcacagcagacaatggccacgacttttggtcccattgaatgtaagtttgggatgggcgggatagtcatacccgaatacccacaggccacatcttcaccatcatttgtacaaaatttggcccttttccttttttttagcacaactgatcaaattcccttaccctaatgagcatcattcccatttctgttcgtcccaccaatttgacctggatggtcattgagggttgcgtatgcaaccggccggatgctgtatgcatccggccggttgattatacgaaaccggtagagtgcattaatgtggcccatttggggtcgtttaccgaccatctcctcagcaaaccgtgcgacaataccagcaacttcaatgtcaccgagttggtggctggaatgaccatcaaagggacgggctgcgtcaactcgatgaattttgtcttttttctcttcatcttcatgactcaggtgatttttaaattttttaaaataaaatcttaaaaaattttcaaatgaaatttcaaatttttaatattggtttaatttcaggttttcattttttgggcaatcttgctgaacgtgccgtctcgcctgcgacgcattggagggctgcgtccgcgtcgtcgtccgccggtattcgatgatgtagacacccgtccgcttcgtccgcttcatcttctggttcgtgaggtgagccccccccccccctcatcctatcatccgattacacaatcattttcccttcagcgttcgtcggaccatcgattgtccgccgagaatgacggcaacgagcgccgcactggaggggtcagtgaatggaggagaaaaatgggattttttttaaaatttattttttgttgcaggactcaactggtacccgcaaccgtttgtctacgatccaggaggtgaaatgactttattattaatttacaaaatttatttttttttgtttttttaaagaaaaacgagaacgcctttgccagcggctgagatgtccatgaaaaagaatggaaaaaacggagggaataactttatataatcctttttgatggtgatggtgatgattttatcttatatatttttagtaatttatcatttaaaatatttaaatacatgggcaagctgaatggaggattttattttagagttatgtgcttaattaatttttacatagaagctggatttaaattatcagttaaaataaagaattaatcagataattataatgcattacatttttatgatctcgttcttgctttttgatagccgttttggatcttgttgaaactcttctagtgcctttaaaattttaaaaatatttaaataattttatttttaatttataaaaaattcaaaatttaaattaccaaacaatccaaagaaagaagatgcacgcaataatcagagatgcacgccaaaaactgcacaacgaggactgatgacctcgttcataaaagatcatctaaataaatattaaaattataaaaattattaagtactaattatttaaatattaaccgttccaacgctgtagtgtcggttgtaggctcttcgttttttaaaaatcggtaaaacaggacgggacattgcttctaaaatcagtaaaaaaattacaataaatatgaacaaatgatggaggagggtcgatgacgatgatggatccatattatttgccattcattgggtgtgccaaaaaaaatgagaatgtaggtcactcccgacggatgacaaataagagggaccatcttataaatgataaataaattaattatggattcactaatgcggtatataaatggtggtaattttggataggttcattttggataaattttcttgaaaatgagcatcaatattcgtgacaaaaaatcgcttatggagaacattttgccagcagttgaaatcagtcacaccactaatggaattacagtgagcagtgagcgcattgctgttgcgaggacaattcctttcgacattgtcggcaaatgcagggagtgcaagtctacagaatgcgaaacggaatggtgcatatc

SEQ ID NO: 225 - DNA, 1085 bp, Heterodera glycines
cactcagacacccgcaccagtctaccaattaccacctcctccacccccgccacaactcccaaaaagaaaacagaaggaacgacaacaagcggatgctcccgcatttttttccgcactttcggcagcatcattaggagttgaattggcccaaactaccgtcaatccttcggctcagcaaactcagtcacaagagtcaaattttgcttcttctatttcggcggctacaactgggctcgattttggtcaaatgtcgactctaccaccgagacatcagagccattccgaagcttctgatttcttttcgccaattgcagcagctacaatggcgatggacgtggaacaaaagaaacccaacccaaagccgagacaacagcaaacagacgcctcaaatttctttggacctatttcagcggcaacaatgggaatgggtgcagaacagctaaagccaacgataaaacaacaacaaaatcaacagcaaaacggagttgcttctgagtttgcttcggccatttccgctgcaacaatgggtatgggcaacgaacaacgccaacatcagcctccgccccaaaaagagaaggaacagacggaccaagaaattttggatgagtttcttgagagcgtttcggctgcaacaaccctattggatgttccgcagaagaagccgaagaagaaaggaaagaaggaggtagaagatgaagaagccgcagcaatcgcatcgatcacccgtaaacaataaactatttaagtacttgtgatgcaattgattttttaaaaatatccagaatgtttggaaatcaattttatacagataaagagctaaaattaaaaatgccatttggtatgctcatttctgggccatcggggagtgggaaaagcacttttttaataaaatttattgccgagtcttccgaacttattcatcctaaacctgttccattctctatgcttttggagagatgtccagcatcgtgccaacgctccaaaatgtggtatcagtgtgtattctgggggtcctcctgaggaaaatgataatcgtttacctaaaccattgcttctcatccttgatgaccctttgctatcgatcg

SEQ ID NO: 226 - DNA, 5832 bp, Heterodera glycines
  misc_feature (5814)..(5814): n is a, c, g, or t
ccgaagcttctgatttcttttcgccaattgcagcagctacaatggcgatggacgtggaacaaaagaaacccaacccaaagccgagacaacagcaaacagacgcctcaaatttctttggacctatttcagcggcaacaatgggaatgggcgcagaacagctaaagccaacgataaaacaacaacaaaatcaacagcaaaagggagttgcttccgagtttgcttcggccaattccgctgcaacaatgggtatgggcaacgaacaacgccaacatcagcctccgacccaaaaagagaaggaacagacggaacaagaaattttggatgagtttcttgagagcgtttcggctgcaacaaccctattggatgttccggagaagaagccgaagaagaaaggaaagaaggaggtagaagatgaagaagccgcagcaatcgcatcgatcacccgtaaacaataaactatttaagtacttgtgatgcaattgattttttaaaaatatccagaatgtttggaaatcaattttatacagataaagagctaaaattaaaaatgccatttggtatgctcatttctgggccatcggggagtgggaaaagcacttttttaataaaatttattgccgagtcttccgaacttattcatcctaaacctgtttccattctctatgcttttggagagatgtccagcatcgtgccaacgctccaaaaatgtggtatcagtgtgtattctggggttcctcctgaggaattgattaatcgtttacctaaaccattgcttctcatccttgatgaccttttgctatcgatcgatgaggcctatctcagtgcattattcaccaaaaaatcgcaccaccagaattttgccgttgtgtttgtcacgcaaaatctttttgaacgaagaataaaagttgcaagacaaaatgcccaatatttggtgcttatgcgggctcccaactcagctttggccgtcagaaacatcggagtacaattatttccaggaaaattggattattttctttcagcttaccgcattgcaaccaacagaccgtatggctatcttctcgttgatatgcatgctgcttcaaacccattgctgaggcttcgaagcggaatatttaaagaggacgaagaagaaggagaaaaaatcattttcattccaaaaaatgggctcttgtaaaattggagatattgttcataaaaattttaattttattcgcgcattggcaaaaactaaatcgaacggaaaaagaaaacaaattttaaaacgcgcaaatgccgatcaattgttaacacttgttgaaatttgcctaaacatcctttgccaacgtttcaaaatgacaactcgacaaaaaaaacgtcttttaccatatgctaattttgttcggagtcttgctcgacgaagaaccgagaaaggagcccgcaaacttttagttcaaaccggaggcggacttggcggtgtttttgcagctctgcttacccctatattaattgatttggctcgatccgctataaattcgagctcatcttcggagaattaaccatttaggatggcatcaaaatttgttcttgtgcctgatgaaatttatcgcggtctaacaaacagtgattcggaaaacatcaacttggattttgttcagcgtgctttggaaagaacaaaaagaaagggcgaaaatgtgacagcaaaaaatgtccattataaccaagaattgtcgcgttacctacacctgagagatgaagatcaaaataagccatcaaaagtagaaattaccaaaggtctaaatgcactgatcaaaagaggaaacgaaagtgatgaagaagaacaagtttttaatttggagtcagatagatcacaacagccagcttcacaaattagcagaccgcgtcgacatcatcatcatcataataatgacgatgaggaaatgccattgcagccagcttttccagcgcttcaagctgaaaataggggacaaaagcggaaagcaaatgatttttattcctcatgggaggagggcgcaaagagacaactgcgtcacgaagatgaaacggttccttcttcctctaaaattggtaatagacaaagaagaagacaaccgccactctcattgagaagagaacaacgacaaattcccgctgagattcagcaggaagaacccttccaaccagccccagaaccgtctattcccatccacccacaaattaacagaaaacgcaaagcccataatgctctaaatgatgttcgagaaataaaaaagagacttataggcttggaagaacttagacctccctctctccagcaagaagcatcccttcgctttcaacagaaaagaacaaacaaaccccgagtaaaccaaccccagcattcgagttcatcggccttggtaacaagaagaaatcctcagaggaatttactggccgaggcggcctttgctccattaccagataatgacgatggcgatgattttgaactctcacaaccaccagccaccgcagctcaggcccagcctctcccacctagaccttcattaccaagtaaaactaaaaagaggaaaagcaacaaagcggaagaagacacagaaagaaaaagaatcaaaattagctctcgaaaaagggacttgctggcagaagcagccgctgctccattacccgttaatgatgatggtgacgatgactttgagctctcacaacaaccgggaacctcggctcaggcccacccacctggacctccgttgcctagcaaaaccaaaaagcggaaaagcaacaaagatgaagaagataccgaaggaaaaagaaccagaattggttcccgaaagagattgtcgtcaccaactgtgaccaaaaatgagccaaaaagacaaaagagctctggaaacgaaggactatcagaagaacagcgtcgtcagtttgcggacgatcaacgccttttcaccatcccgaattcccaacttaccaatgagcaaaagagaagacggctccagttcgtatttaaccgaaacccggtaaagtatggtgtacgcggagacaccattttaaataatgcaggaaatccaataacggatagcagtgtgacacaagcacttgaatatattattgaacgcagagctggaagagttcctcagtttagacagccaccgggaacaaaaattattcaaaatcgaattaatcgagaccttattctacgaacatggacggccccaccggtaccaccgaggggagccaaacggaaattaccacagacagaccaagacgcggaattaaaccaaaaatcacaaaaaataagaggattggggcaggcgagaggcagagcacaggaaggattgatgcttccgtttccaacgaggggagtcaagcggaaaacaacggtcccaccagaagcagcaatggaaataccctcaaagacacaacgtctgagaccacagaaatggaaaaaccattaaaaattcaaaaactattagaccgtctatacaatgacccaaattcgcctgctgcattcgctggcgtaaaccgtttgtggttggaagccaaaaaggaacttgggtataaaatttctaaaaaggatgtgaaacactacttggagggacatcgcacatacacgttaatgcgtccaagacgtattaactttcctcgttctcggacaactgctgctggctttatgacagactgtcaggtggatttggcagactttcaagcactttctcgacataacagtggaaaccggtacttgatggtactaattgatgttctttctaagcaaatttttgtaacaccacttcgtacaaagaaggcagatgacatgattgaaggatttaagcaacttttttcacaaatgccaatgaaaccctaccgaattttttcagacaaagggactgagtttaaaaatcagcagctgaaaaagcttttcgacgaagaagaagtcgaaaaatatgagagtaatcactctgagaaaaaggcagcattagccgaacgtgccattcgacaaattaagaatcgagtctaccgctatttcgcccaactcaaaactcttaattggtttgatgtaatctacaaaattgttaatggaattaacaagtcaccgagtcgggtacatggcatgcgaccaattgatgtgaattttaaaaattctcaaaaagtttgggaaaaaatgtttggtgaagaacaacacagatcactttttggaaagcacagaaaaagaccaaaatttgttcccgaccagaatgtaagaatgagcatagcaaagggtcaattcgagaaaggatacatacctaactatggcgatgaaattctggaaatcgatgccgtcaaacgtcacatgaaaccaatgcgttataagttacgtgatgcaaaaggagaaaagtttaaaggattcttttatcctgaagaattaactcccgtacgtaaggaaactgatacgacttatagaattgaacgcgtttttcggaaacggaagcggactgacggaacgatggaagttttagtgaaatttatcggttatcctgaaagagaatggattcacgagacccaacttgtataaatacttgcaaaatgtacattgaaccattatagtttttttaaaataaatgtctaacacattctttgtccatttaccaagtaatagccctgagtatgttgataatgctccaaataaatttcgtgtccgtcttcccaaaccaatttattttaacggctcttgggtttgcggattacacagcataaattatgcgtattcgtggccatccactattgggaccttagatgatcagtggataaacattcattttaaggatggattagacaatgaaaatttaaaagttgtccgaattccggtcccaaaagcttcaaatacaaccattgaacatttgagagagtttcttacaacaaccctaaagaatcatgctgagtcactagaatcgatcataaaagatggttcccaaactccaatacgaagaaagagagcagcatctcaaccacaatcgcctccaagtgccgcaatagtgccaaagtcgcctccaagtgccgcttctaatgtcacttttaatgtcaaagtatcaacatcaccgccacgggccggacaaaaacctaatgaaaatgtccaagaaatgaatgattcttctttaacaaatgtgacaaagccaccggaaaaacaaccaaaaattgaaaaacaacccgaagtcataaatgcgaaaactggagaaatcaaccaaaaacataacatttcacaagtaccaacatcaccgccacgggccggacaaaaacctaatgaaaatgtccaagaaatgaatgattcttctttaacaaatgtgacaaagccaccggaaaaacaaccaaaaattgaaaaacaacccgaagtcataaatgcgaaaactggagaaatcaaccaaaaacataacatttcacattcatatccaaagcctacggctccattaccagtgtctattgtgccggatcagagtgtttcacaaaaaaatattcctccaccacccgtttcgaatccatcaataaatgtgactaaaaagcaggaaggagtaaaaagcagcagtgggctaacacattcagtttcaaagcctccagcgccatcgtcagtgacgaaccagattacagtatcacaacctcagcaaatagtagtcgcccctcctgctcaaaggaatgcaactaaaccacaatcagcaattagtgaagtgaatcagaaggaaattgttccaccaccagaacaaagaaacgtaaaaagtacagtcgagagagtctcaacaccaaaacatcccctagcagctccacctaagccgtccaataccaccgagaaaaagccacttctcctcctcgcgncattctcactgattatat

SEQ ID NO: 227 - DNA, 5453 bp, Heterodera glycines
gagcagttactttccgtcttgttgtggagacaagtgaatgggaaaaaaatcaacttgagaattcttaggcaaattattgaaggagttgaattacagtatcatcaaaattttgagcggttcaaagcggtttttacagacccaagaattgaatatatctcattttctcctcagctcggctatgtgttgggttttgaaaatcatcagaatgtaagaaataatgaaattgctaaatatggaagtgatctccgtggtggatttgcaagctttgccgtctacgcaaaaggtctaaccgagaatatgattgttggaaactcgttgagctcacttcttcgtgttgtatcagtgtcaggggccataccaggcgaatacacggaaaaaatttacgactctccgctctatgcacgtgttttaccaaaagaagtattagaaattgaaattgaattgcgaactatgactgacggacgactggtaccattttcctatggtacagtgctgatcgtattgatatttaagaaggtgataaatttttgaaatcactcatttttgttaccactataattgataaaatggttcacattctatacgacacatcggtttcgggctatgatgcattttttgtgcaaaatggatgtggagtcggggatgactcctcctaccaagtttttcgaggcgcgcaaccgtttcagcgcgggtggggcactgcacaaacgggtgcaggaataggagatatttttcgtggtctctggcgctttttcctgcctctaattcgcagagctggagatactgtagcagacgaaacaattcagactggaaaacgctttataaatagagtaatcgatgaaaaacccggcttaaaaggaagtatagagacattgacaactgagagtaaacggggagcagacaatgttttagagaagggcggatttcgacgtcaatttggcacaggaggacgaagaaagcgtataaaagctaacaattctcccactctatcacatcagactttaatcggaaaagcaataacgaaaccattaattaaaagcaaaaaaaggcttcgatcagacgcgtttggtctttattaaaaatgacatttcacaaaattgacgcgagtagcatcgattcgattaccaacgccgtggattttttcagtataccccctacaaatgttacagtatcatcgtcaaaggttttcgagattttgccgagtaatcccctcaccgacacaccttaccattttaaaatacactcgagccaaaactacattgacctgtcaaagtgttaccttttgaccgaatttcgaatgcgaaaattgacagcaccaaatggtgaatggggatatttggatgccactgatcaggttgtaccgatacaactaatcggacacactttcatacgagacatgaaaattgcaattaatggtcgcgaaattttcaactctaattctctgatggcatacaaaacttatctctctcatgaactttcacaatcacttgaagctaaagtttcgcatttaactgctgctggatacgaccgtgaagatgctagtaatctacaaaacgcaaattctgaagggttcaaaagtagaagacaacggtatttgggaggtcgaacagcacaatacattgcaaaaatcgatgctgatcttttcaatgtaccccaatatttgattaatcattgtgaaattgacataacgatacaaccccatgacgacaattttttgttaattgacaccttagacccacccggtcagccatataatattgagcttgttggattgaaactctactgcaaaaaagtcagtcttatggatggcttggctcttgagttggcgaaaaaattggaaatgaaaccagcacggtatgctgtacgaaagacaatgatgaaagcactgttcataagcccgggacgctatgaatttaatgcaaacttgttcatggaccaagttccacgccgcgtaacaatgggacttgtcgcaaattcagattatgtggggaacaccaaaaggagcccattcaactttcaacattttaatgtacgggaattgagtgttgtggccaatggtcgctcttatccccaagccccgtatgatattgactatgaaaattggaaatttgtccgtccctacaatgacacgcaggaggcgcttggttttgccaactctacatatggaaatggaattgattacttttcttttttgcacactcactgtatttatgtgtttaacatgactaatagtggagatgatcatggcggtttatttgacctgattaagaagggatgtacagcagtgaacataaaattcaaaaagccagtgcccgatgggggaattacattgattgttatgggagaagcagactccatctactttttggataaaaacagaacgatcgcgaccgatacaaccatttgattataaaaatgtttaatttattctttattgtcttattttttcaaccaattgtttcattgattgttgaagaaggaataaaaactgatgaaattccccaatataatgagtggaaaagacttttaggatttaaaaattcttcagaattgcgaaatataacaacaacaaaaataacaacatttaaaaaggtatcaacaacccgaaaaactacaatacaaaatacaactataaaaactaaagtcactacgataaattcacaaccaagccgtgtcttaaaagaacaacagcgtcaggacaacattaatttcccttttgtccccctctgcaaagaattaccgaaagaggcaaatgtctatgcgcatattttttgttgggctatgatcatcctttttgccttgtcagtcataagcctcatcatctatcaatttcgctcaatactttggttaaagcttacgttaacagaaaggcgtagtaagacgaatggacagcacgcaaattaccaaaattttaatgtcgtccgagaaaacgggtccgaggttccttggatgcttcccatgcgatcaattacctgacccaatgttcataaaattcccgtcatcgttgattgttaacttagacccccaccaattttccggctcgcattggattgcaatgtttgtttatggattaaataagaaagcaatttattttgatagtctagcgctaccgataaatgcattaattgttagctcttttctcaattcctttcccggagtaatgtttaaccaaaaagccgttcagtcattttcatccaattcatgtgcacatttttgtatttgttttgtttattttatatcttctgggtttactttcgaacagtttcttcaaaaatttgataatttacataatcccgaattatatgttaaatattttattcgcaatttcccaataaaattgtaaagaaattgcatttattttcattgtgtacttaggtctctcaaaaacgaaagcaatgaaaggtaaagtaaacacaatgtaccgtctagtgtcaggcaccaatgaatgaccactgaaccttgcccttcttcaacgacccgtcggacgctgattggctgagagcatattccgcgcctttatttatatgacatttcctccgcagaagagaggggagagtcgtgattggttgaaaggttaatcccctcctcagtgagcagtcaaccaaatgagtaaatatgaccgacaaaaatcattccttcttcggcaaacggaaggaattttcttgagagaaaaacattaaaaaaaactgcttagaaaattgataaaaatttaaaataaagtgtaaaaattgattaccatagtcttaaatacagaaaaaaaagaaattttgttcatttaaatttaaagaaaatgtcaaattctactccttcttctcctccatcaaaacgttcgcggcgttttttcattgatgaattacttcgtgaaccatacaatgaactttcaaatccacgaaagtctccaaaagactacgtaaaaaagctcgactcggaaattgagcgtgtcccaaaatttcaatggttaaaaaacaaatcaaccttcatcattgaggatgtaccagcagaccccgaagggcttctaattggaatttttcaacattgcatggacgaagcaatgagcgaaagcgttttgggaggcattaaaccaactcatcttggttgcattgtctccagtcaacttcttacatccgacatttggataccaatccgtcagatcactcccgataccatcaataccattctcaaccgattcaatgacgttgcacagagcaaaaagcaggacggtgtaacgctttgggggcagccgtttaatgtcactgtgataactgttaaccggaagggtttgccagagaagcggcaactgaaaggaggagctccgagaaaattagcaccagtgaatcaccaaatccacgagcaatgtcttatcaaggtttttaagtaaaaagattaatttatggagacaattaagattatcaattccgacaactattgtttgttttatgcaatgcaagcaacaatggtccgcgcagtaggcggtttgaaccgacaaaggtttcatgattatcttcgaggagtgggaggaaggctcaaaaaagaaacattcgaaataatgaacgctcttaatgtttcatttggacaacaaaattacgatgctgagttttacgtgccaaggatcattgattggtggaatggcaccaaattcatggggatatggaaattcaaagcattcatctttgggtcaactggacactacaagccgcttttcaaatatgggccggaggattatgttgtaccaattatactttactttgatgcgagtcatttcaatggtgtacaacgaagcggcaacttgtttggcaaaccttattgtctaagttgtgaaaaaacatatgatcgtccaaagcagcattccaaaagctgcaaagctcgctgcataaaatggtttcaaaaaaggttcaaaataatattcccagtttttcattagctcacaaatgggtcccacctttccgtgcaaacccattgatggatttcgtcaaaaatgcagtggatgcaacaaaatgttttataacaatgactgctaccaacatcacctcgcttcagatttttgcaaaaacagcaaggaatgcaagtattgtggtgtagtgtgggacttgaaagacaacacaaaagatggaagagaggtttttttatttctctgatcaatcaaaaattgctttagggacataaatgccaagagcgatggtgtgaaaactgccaaattttccatgaattcggacgaggctgctttatccgcccattacaaccaaatcagaagaaggaagccacagggtggcggttggtgaccttcgatttggaaacaatgcagcatgcaccagccgaccctaactttccggaacgacgaaagcatcaagtcaacttcgtcactgccaaagttgcttgtcccgactgcatttcttcgggaaaatggaaagagagcttgcgaggaaaattttgcaatgtttgcggctatcatcgga

SEQ ID NO: 228 - DNA, 7654 bp, Heterodera glycines
ccttttaataatacaactggtggatcgacaaacaattgatcgccatcctttggtggcttttgtcaaatggattctctacaagctgccaaaacaatatgaaacaattgcctattcacatttcggtggacgattcgacatggttttggtcttcaaagaattgctaatggaggggctcaacccatcaatgattaaaaaaggaaatcgcttattcgaaatgaaggtggattaattttcttattatatttttattttcaattcaggtcaaaagcagaaagaagatgaatccgaatgtaacttttcgggactcgtggaatctgatcccaggaccgctttcttcaatggtcccaatgttcggcctggatgtccaagacaagccatttttcccacatttggcaaaccgaccggaaaattatggatgccaaattttcccatcgaaaacggattatttggctgacggaatgaacctggaaaagcgcaaagaattcgacacttggtaccaacaaaaccgaaacacaccatttctgctcgatgaagcattggctaggtatctcattctttgttaaattaaattttctaattttaagctactgcaaaaatgatgttgatattttaatggctgggcttattgtatttcgtttggaatttttggagatgaccaaacgaccggctgggtcctatggaaaagcggacagggccgcctacaaaacgcctcatgagggaattgacccgatcaggcattgcataacaatcgcctcagcatgcatgcgacactttcggacaaatcatttgaagccagcccacttggcgctcgtgccagaaaagggctacgacagctgtggcgataatcaaagcgacttggcgctcaattttatgcagtggtatgccgacaaatacggagttcacattcaaaatgccttttccgctgaaggagagaaaaggtaatttcttgaacaaataaaggattaaattttgctaaaagggttggaaatttccgccttgacggatggatcgagactcaaaagaaagggcttgagatccatggctgcgtttggcacgcatgttcaaaatgttatccggatgataacgaaattttgccatgcggtaaaagtgcaggacggattcgggagaggaacaaacaaaggatggatttcataacggagcgagtgccaaatgttgaaattttttggcaatgcgaaattgaggcgatgttggtcagagacaagcagatgaagaccaagttcagcgaatatacaggagatggaggaccaatagatatccgttcctgcttcatgggaggacggacgggagccttgaaactttaccatgaggcagcaaaacacgagcaaatcagttactatgacttcacaagtctctacccatatataaagtaattcaataataaataattaattaattaaaaagaaaattagttatgtaaccgattacccaattggccatccaactctccatgttccttgtgaggatgttgattggcggcgccctgaggataatccctacccgttggcaattctcaaagttttcgtcatcccacctcgccgaattgatgtccccgttttacctgtcaaagtcgatgatcgtctatgctttcctctgtgcatgaaatgttgcaaaaaattcccaaatggtgctgttaaagcggcatacagctgcacgcataacgaccgtgaacgagggtggattagcacgtgtacttcgctggaagtaagttgcttttttcgacagttctaataaataatttagctcaacgcagcattagaagaggggtaccgagtaacagagcttttgcgtgtacttgagtacagtaaaagcgacaatgaattattccgcccgtacatgagcgaatttgttgtccaaaagctgcacgcttcgggatttgatcagaacatccgtgggaatcttgaagccgaggagcaatttattgcagaatgttgtgaacaattcggaatgaaaattgatcgcaacaaaatgataccaaataagggaaagagagcccttgccaaattggcagtcaataatttgtgtatgttttttttaaatttttttcatctccttaatttagggggtcgtttttccctacgcaactatggactctcccaaacgctcattactgacgacccgtcggagttaggcaactacttggacaacaagaaaatcgatgtcacagggcttgacatgttgaccccggaccgaattttgatcagctaccaacagaaaaaagattgggttaaggaacacccttgctcgaatgttgtcgtctcactttttaccacttctgcagctcggcttcatttgttaaaagcaatgcaaaaggtcgttcgaacacccggctgtgtccttttatatacaggtaagaataaaatttctatccaaaatatttgcaattttagataccgattctttaatatatgctcacccaattggcaaaaaccctcttagtacagggccccatttgggtcagttcactgatgaattccccgacgttagtttaaaaatattaatttttctcttaaaaatatctttagcatgacatattggaatttgtgagcggcggctcaaagcaatatggattgaagctcaggcggaaagggactgaaaaaattgagcacatgctgaagctcagagggattacactcaattatgatgtcaccgaaaaccaagggcttcgatttgatacgttcaaagaaaaagttttacaatttgctcgtaccggaaatgttgagccaatcaaagcagtttacccaaatttcctccgtcctacagtaaacgctggcagcgttatctccgccccccttcaaaagatatacaaaccatatgttagtaaaggaattgtttgttctcgtgactttcgtgtgatcgattttggatatgttgcacagtaaaattgtattttaattaccgaacaaataaaaaatgtaaaataaagtgtaataactgacatttttgtggtatgagtaatgcaaatatcaaaagagaagatacacttttttaaaaattaaggttaagaagaagtcaattttggctgggaaaatgaaaaattaatgaatagaagatacaattttatgaatattagtagataagttttatacatttgaactacctacctaccataaagaataaccgtcgctttggctacattcttggcgtccgcttgatattagtgatgtctcagtgcttgcattttcgtctgtgttaatgttgttattgttgtcacttccggtttcagtaaaaatacgtcccagccaacccggttcaatctgtccagcattaattttgcatagctcaagcgggtagaagcgatcctcctgaccctcgggaaatctctcgattacacagtgcaggaatgggtgtcgaagtttaatgcggtggcgaacgtaaaaatgcgctgtcacattcacattgaagggtcttcccaatcgcccgtaggccatagttgttgatgctccttgcggtgttatgccaccaaacagaaagctctttgtgaaaccgttccgatccttgtatgttgtttgtacgtgacatcccttcaatgctttaacgacatgtttaaaatctgaaggatgattaagccgatcgcggagctcagacacacgacaattcaaaatttgggcgattttctcagtaagaagcataataatcaaattcaaaagctaaaatattgtaaaaattaatgaagaaaagatgtaaatttagggagaaaaagagcagaattaacgaagtgaagaataaaactgaaaaatataagtgtgcatcaactatttataacaatcttggttttgtttttctgggttaaacaaacatcaatctgtataaaaacggagaacaagatcactttattcaatcctttattcaaatatatttaatttattaaaataaataatcctagctaataatgccgactcctcctcatgacaacaaaatttacaaaaaatctgaatatttaaaaggtatttttgtctcattatttattaataatattcaaaaaattagtcgatgatgctgatgaagtggatacggacccctctcctgaagaagttgagaaatggacgcccgagcaagtgattgaatgggaccagcgtagttatgaaaaaatgcctgccgaggaagagatttggcaagaattcctcgacaaaggagaagcgaatgtcggtgatatttatccatttttatgtttaaattaaaactttaggttctgcgtgagttctttggcggagagggggctcttaaagttgagaaaagtcttcgcgaatatgccaagaagaaagaacagcgagatgaaattctgatgcgaaagcggaaagaatatgaagaaaaaatggaaaacaacaaaggcgaaaattaaacactcctttgtactgttattgttattgattcaaatttggattaataaatcctttatcaatgttcaaaaaacgacttcttgaattgggttaggttaaacaaatattaggagctataaaatcaaaaaaattcgtgatattattgtccattcattcattcattcattcattattaacatatcccaccagcccattcattatctcaatgctccaaaacgaagattcctgcatgaatgagccaaaacaagaagtcaacatttcatcaccaaaagttcaatcctggaaactttttcgtccaaaatacatgttgacttaccgcttgtgcgactgtaagtttatcaaattagcaaaaatatttgactttgtggtttaagtatgtctttcggctctttggtccaacaaaaacaaattcacgactaacgaagaacgatcagtgatcagttttgaactctgtgagaagtgcaccattgacaattgccgagcgactgatgttttggccccgtacagaccaaagaaataactcttcataagaatgcaatagttagggacaaatcaatatttttcattcagtacatcattaaatttgttatttaatttctcaaataaaatgtcaatattcggaattccctctcaattattttccccgattaatcggcacctttcagtcttccattgctctcgagttccttaatgtttgcacaaatattgccgagaaaattttcctctccgcgattagcaattgccctttcccgtcatttgaattacgcttgcccttccgcgcagagagtgtttatattagttgagcattaggagctaatcggcggtagctaaaaaaggattttcgctcggcagttcaagcactcttcggcaaaaaacgacgatgagcagagaagaaatctgagatgtcagaatggcttccaatattaggtcgactgtatggggcgggaccaacaaaaatggtaaaccgagaggaacgacaattttagtcatttttgttagatttttgcgaaccaaaattgtttgttttatcgtttcgcccattctatttaattgaataataaattttaattttcagatagcaagcaaaaatgagcgattcgaccaacgatgccattcgtgaattacaacgagcactgcgtgaacaacagagaacaatttttgttttgcgcagtcaaatggttgatcaccgggcggtcattctacaaactgtcgcacgcacggaagccctggagggatacgcggctaacgtaaatttgaattcaaaatttcactagaatttaccctttttaattaataattaaaataattttctaaaaattgtttcagagccgaggagggagatttcgttcccgttattcacctatggtggcgcttgaaatgaccaccataggacggcggcttgaagagagacaacaacgtcgccatgcgcaagcccatgcatcgaccaattcatcatcaccagggcgcggtgagcccggcacatcctctggcgatggtgccaatggtgattttttgaattttcatacttttcttgaaatattgaatttaaaaaatatatattttaaggacaaggctcaaacgagccgagtgttggagctatagcagtcaactcgggtttgactgaaacttgtaattataaaaaaaaacccaaaaaaataaattatcatattttttcagtcccaccaaccccactcagctctcgtggacaaaacagtgctccattgcgtcagagtgcgtttaaaacaaattaagtgagagaaatctgtttaatttaattttcagataccgctggtgctggtcccagcacgggaattgcagatgggggcgctgaaagcggcggtaagaacatttttctttctttaagtcatcataatggaaatatattttaggtcagtggttcgggcccacgattgaaaaccacatgaaccgatcacgacttcgacttgtgcgcgaggaaatggcacaccgaacgatgcagcaacaggtggaacatcagcatcagcaattgcttgaacgggcggaaagagtgcgacaggccaatgttgaacaacagatggaggaagcagacgttctacaagaacagctgcagcagcaggacgaagaaaacgacgagaaccgcgacccagaaatggagcagcgacgactagttcaggtcgctcgacaggcagaatacgagcgacttgtccgcttgcaattgcgggaagctcgccgttttcacaacggagtcgcttcttcggttgtggtccctcctcccttgttttgggaggaggaatgcgtcatttgcaccaacgcccgtgcaaatttttataatcgtcagtgcgggcatgtttgcctttgcgcggagtgcgcagtcactgcggtaatccaaaaactcactgtctgtatgatgtgccgtgccccagttaacggcatatacccatatgttcgttaactgggacacgaaaataagtgttagcataattttaaaaatttggaaaaaaataaaagtacagaacaataagtatgtttgcattacactaacacttattttcagcattttgtgtctgtcactctatcccataatatgctgatcatttatttgcttctctgattgtattacctaattattttaaaattggataactttttctttcatttttgtaaaacattttcattataacatcgatcaccatttatttgaccgtaatacctatttattttaaaattggacgctgtttcttttttttcaatttttgtaaaaaaattttctattttacacttcaacataccctcaagcattatttttttttattaaaaagtgtaaatgtcagaatcattaacaattatggccactgtgggcaagatgcttccaaggcgcctttcctccgttttattgggccccgtgggaggggggatcctcgatcagcccctcccggacaagaaattctttgtaaaggcgctccgccttaattttataaaagttttagaatgattttctttgaaaacaacagactataaagacaaagaataaaagatgaaaatgaaaaaacaaaaggggggcaaataccaggagatgcccgccttatgctctccactttacagaaaagagcattggtaagggggcaaataccaagagatgcctgcaaaccaatgcccagacaaatatgagaaagagagagattgagaaaggctaaacagagcacaaactccaaacccaccttatcaaattgggcctttgtgacatctgtgtgaaaagcaaagggctgacggcaaatcggtgcagcataacgtcgggccattcggcgccgaactgaatt

SEQ ID NO: 229 - DNA, 733 bp, Heterodera glycines
ttcactactgacatcgatacggattacgtacttacgtactaaaaatacggaaaatccgtagtacgtaaaaatacgtataagccgaaaaaatacgtattacggactacggatcagtaaaaatacgtatacggatccggtccgtatccaatctctagttttgttgggtgagtaattatttttttatcgcttaaagttgctgactttaaataattatttcattttcaactattagatttaattgattgttggggacgaccaatgatatgctttttacttatttttgtattgtaatatgtaaattttagagtatttatcaatctagatttatttagaataatatttatattaatttttttatatctattaaaaatttatcgtaaagaaaaaagaaattaaattaataaaaacataataaaacgaagaaagaatctccaaccgatttttgagtcggaagaatacacaatactaccatactgcatatgcaataagtaaaaaatgatattagttaaaacaaattaaatacaattattttatatcaattaattaagtgaatcttattttactagataataaaaattgttaaatttgttcctttttctataatacaaattaaatttgaatttattattttggtcctttaaaaatcgaatgtatttgcaatgcatttatattttaaatgaaaatttatgtttattttaatatattcttaaaagtttctaaaatcaattagatg

SEQ ID NO: 230 - DNA, 4301 bp, Heterodera glycines
  misc_feature (4208)..(4208): n is a, c, g, or t
ccgactccagcaaatgcaacggttgctgcgaccactctatttgccgcaccatcatcatcatcaaccaatttgtcaatattggtggtggtctgtattgttttggttgcggttttgtgtatcgcacaggtgggtttcatttgattattttgtaattttgataataaatttttgtgataaaggcagtgcgtttcgcactgaaattgcgccaatggttggccaagcgtgccttcaaaaagaaaatgttgcgccgcaaccgtcaaagtatgtttggaaatttttatataaaacttaatcaaaaaaaatgtaatttctttttttttttacaggagcgagcacaattcgtcgctaccccaccgcaatgccgtcgccgttgttcttgcccggggcatttccgggcgtgactcttcgccctacgggcatcaatttggtcgaagaggtgcggttttgttttctcattaaatcctgtgagcaaattttgtatttttcaagcgcactgaagatcacgcggtggatgccggcccggtgtatgcgccgactgtatcttccgccaggatcgatgtccacacagaacaggcagaagaagaagaagatgatgagttttaagatgttcggaggaatttacgatcttttatttttaattattcgatcttttatttttaatcattcgatcttttttaatcctgcgatcattttaaataaatcactaatacaatctttgtcagataggaaaattgaatttttggcgtctaaaattatggtaattaatgataatcaagccaaatgtgtggaattagaggatttgaaaacaccatatggtgaattaggtcaaggactaaaataactagaatataaaaggcgactcgttagttcactcgctcataagaaaaattaaaattattattattaaaatgacttcctcaccaaaaagtaaataataataaattttattttatttttcaatcaattcctttagcttccctctcccgtcgttcacctacccctgagattgatgagctagatgaagtatccgcatggtatgacatgatacaaacggacgacgagaacgtaaacaatttttttatattaatatgattttttcgctcattaagatacttaattggttcacacctaagatggcccgagttgtgtgccaggaggttatcgaatttgctcagcaacgcaacatgccgtgtgagaaggttgtcaagtggaagaaaattctggacaaaatttgcgcacaacttgcgcaaaagaagtgatcactttccaaaagacgcaaagaatttcctgttacttttttaattaaataaaagatttactcagtgtaaatggctttctttgaactgtcaaacgggactcaatcctgagtgcccacccaccgttccttaatgtttaaagtgggtgtgagatactttagggtcatgcgggagctgtatataagtagctggtcaacttgtccttcatttcattcttaaatattttgaaaaaaaaaatggcaatcaatatttgcgacaagaaatcgctcgtcaaccaaatcctcgggcaggcggacctcaccataacaacaagcggcataaccgttagtgggcctcgtctgtccaccccacgatttatacccttcgaagagtgtgggcgctgccgcgcttgtaaggctaccgaagttgaggttgacacaatggtgaccaaagagggggtcacattgtggtgtagtcggatcagcaaggcccaattcgtcccatttgatgtcgcacaactcaaggagcgcagaccgatgagaaacaggacctgaaacgtaaagcgaaggtagctctagacttggtggaggcaggtctaatggcagatgcgatgcaggacggtgcgcgttggaagaaagcaaaaaccgcaatcaatgttctgggtaatctccttttggcggaatcgttggacaacaacaataacaacaaagtgacaaacagcccagcagcggaggaagacaatgtacaggaggaggaacataaagaagaagaaaagaatgaggacctcggagacattgacaagactctggacgagttcttcaacagtattaaagcttccacctcaaacttgtaaatcatttttgtccacaaaaatgcttaacacacaatcctttacaaataaagatgtttgtttcaaattaccgtttggcctgattatttctggtccctcctcatcagggaagactgagtttttattaaaattcattgcggaatcggaccaattaatcaccccaaagcccatctcaatgctctactgctttggtgaaatgaacgcggcggtaccggcgcttcaaaaggcgggagtcgatgtgtacgcaggagttccatccgaagaattggtcaagcgtctccctaagccactcttgctaattctcgatgacctaatgctgtctattgatgagaagtatttgtccgatttgttcaccaaaaagtcacaccatcaacaatttgcggtggtgttcgtcacacaaaatttgtttgaacggaagatcaaagtggcccgcctgtccgctcaatacctggtgctgatgagggccccgaattctttgttgtctatccgtaacattggtgttcaactcttcccccgtaagctcgactttttccttgatgcctatcgcaaagcgaccgcccgtccctatggctatttgttgattgatatgcatgccgcgtccgatccatcgctacggctgcgaaccaacatatttaaggacgagcaggaggatgaagacgaaggaacagttgtattcatccccaaaaatggagcggcataataaaaaacaacaagcaaacattggacaattgattaaagaaaattgtgattggctttgtgccttggccaggactaaatccgcaaaaaaatgcaagaaactgataaagaaagcgaacacagaacaattgctttcacttgtggaaatttgtctaaacctagtcgcttcgcgtttccgactgaccacccgccagaaaaagagattgctaccccatgtggataccgtacgccaaatgagcagagcgagaagtgagcggggcgcccgacgtgtgcttgtccagaaaggcgcaggatttggaggactgtttgctgccgtattaacccccgttctaattgaattggcaaagtctgttatgaccaaaaatgcataaatacccacaactgctttgtttttatgtgcattcatcatcatcattcattcaataaaacatggcaaataagtttttacttgtcccacaagaaatttacaggggtttgacctcaatgtcggacacgggtgacattaatttggatgctgtacgacacgatttgaaccgaaccaggggcgaacgaacaaatccctctgctaaaaatgtcaactacaatcaacaacttaggcggtatttgaaaatgaggagggaactaacaaacatgccgacaaaagttgagatgtcaaaaggaataagtatactgttaaggagaggtggcgaagatgaagatggagaggttgtggatactccacctcgaccacccgctccaccaccaccaccacctccaccgtcaggtaaatgccctccacgtggaccaaatcctcccgctcctccaccacctccaccgcctgggagacgtcctccacgtccacccagccctcgttctccaccaggaagtccaccgcctcgtccacaacgtccccctagaccatgtagagctgctgcaccttctcggagaggtggtctcatagagcaatggcggaaaagacgatatgatatacaacaacggcggcccgtggtgcgggatcttttggcggaagcagctgctgctccattgcccgaaagtgacgatgaatatgactatatgctggagagtggattcgcgctgccagcaccatcacagtactatggagatttgcctgtactacccgacaacgcagacgaaattgaggagatggacactgttcagcgcaggattgccaccagacgaagattaaaaaaggacttggcagatgatgatgatgatgatgaagttgatttacagcgaaaaagaaataggatttatcacccttcacctccacggctcccatctccgccacggaaatctgagccaagacctcctctaacagccaagagagaacaccaaaaacaaacaaaggcagaattgaaatcctcgacatcaaagaaaaccggtcaccccacccctacgcctcgtccaaaaagagagccggagtttgngctggaccccgcacatccacatcaaggaaagctgggtacaacccgcctccctcaacacctaaaataaaaacacgatccaacaaagagacccaa

SEQ ID NO: 231 - DNA, 3607 bp, Heterodera glycines
tccaacaaagagcccaaaccgttgccgtattctgaaaagagagcttaaaatggagtgaaccccacaacaacaacaacaacgccaacctcctccagctgctattgtcgaagaaatgcctcttattcctcctcataggagagggaccaaacgccgccaccccgtaaatgatgatgatggtgacggggaggtgcgcataagaaaaagagtgaggcaaccgagaagggtaagagtacagtactctcccgagccaggtccatcaacatctgcacaaagtgatgagcaacaaccaacaacaacaacaacaacaacaacaacaacaacaacaacgtgagctgtttgccattccgtcaaatcaactgaccatgacacagagaattgagagattatacatcaaaatcaacaattatgctgaacgtatgggcgttagggggaatacaattcacaccgcaaacggcaagccgttggcgcatagcaatttgcgaatggtcatcaggtatataatagacagaagagcgggccgccccaccattaaaccgccaggagcggctatattggaagagaggcttagacaggacccaattttgtattcatggacggctccaccaaagagaccatcacagagcaaaaccacccggacggcacgggcaatcaagaaggaatttcgcccgaaaaaatggagttgatcaacaccactcttgacaaattgtacaataatccatcttccccagcggcgtttgcaggtgttacagcgctgtggaaagaggcgcgaaaaaagattaaacatttacggaaaaaggacgtgcagcattatttggatgggcaccgcacctacactctgatgcgtccccgcagggtacgttttccaagggccaaaactattgcagcgggattcatgacgatgttcaagtggatttggcagattttcaagctctttcgcgccataatcggggtcataggtacctgctcgttgcggttgatgtcctatccaaacgtctgtttgttgtaccgctgagaaacaagagagccgagcaaatgctggaggcattcaagcaactcatcgatcaaatgcccatggcgccccaccgagttttctccgacaagggcaccgagttcaagaacagattgctcaaggaattctttgaggagcgggagattgagaagcacgaacccgtccattcgacagtaaaagcatcaattgcggagagagccatccggaatgtgaagcagcgattgtataggtactttgcggaaaaggagacactgaattgggtggatacagtacagaaaattgtggacggaattaacagctcgccctcacgtgttcacgggatgcgcccaattgatgttgacttttcaaatgctcagaaggtgtggaagcgaatgtaccgaccgcaatcagttgacagaaaaactccccgcttccataaagatgaatttgtgcgcatgagcagagataaagggcaattcgagaagggatatttaccaaattacggggatgaaatactcgagattgatgaggtgctgaaagcggtacgtccaattcggtacaaactacgggatgagcatggcgagaaattcaagggaagcttctatgagcaggagctggcacacgtaagaaaggatgcagagacaagttaccgtatcgagaaggtgttcagaaagaggaaaagagatgatggatcaaccgaggtgcttgttaaatttataggatatcccaatcgggagtggattaatgagtctcagcttgtataaaagcatttccattttcattatttatgcggataaacaacaatcatgtcaaacagtttctttgtgtttttacccagtaatgtgagtgattacccggacaatcagcccaacaaatttcgtgtccgactcccaaaacctttgcattttaatggaacgtgggtgtgcgggttgcacagtatcagttacccctactcgtggtcaaccattggcacattggatgagcaatggattgacattcacttcaccgaccgtagcgctattgatgaggaccgacaaagaattatcagggtgccggtgcccaaggcatcgcatagtagggttgaacagctgcgagactttttgactgctacattgcggaatcatagtggtgcaaaaatgttgccactccctcgtgagttggaagagaatcgaaatcggacaaagcctctcaactcaccaccaccggcgaagagaaacaaaagagatgagtcaccaccagtttttgatgagaacggcaacgagcttggctctcccccgtcttacaatggagataaagaggatgaggaggaggaagggataatttctgagtcaccgcctcattatgaaggaaacgagactgtaacaattgactttccctcatcatacaatgaagatatgaaggtgtgattgcggattcaccgcctcgttatgtagaaacgcaaaacgaaactgtaaaaacatcaaaagcgacctctcctcagccgccgcctaccccaagcactgctaagccggctccccctcctccaccaccaccgtctacaaattcgactcctatttcaataaagacaccggctgtccaaccaccaaaacctacagtatccacccctccaccacaaacaacaataacaaaggcaccaccgccaccgccgcctactaagtcggctccaatagttaacccatcaattacaacaactacaaaaacaatacctacccctccggtaacaaaacctactacaccaacccctccggtagcaaaacctacgacatcaacccattcggtaacaaagccaacgacaccaacccctccggtaacaaagccaacgacatcaaccactcagtcgcccaagccaccaacggcagctcctaaaccgataaagcctgcatcacctgcacctcaaccacccaagccgtcaacgcctgcttctctcactacaacaacaaaaccaccagtcccaagcccatctgttaaaccaacaatttcagcaccaccggctcaacaaccaaaaagcccgacaccatccaccaaaccaatagtgccaaaaacagacgcgccacctaaacccccacccccggtttctctttccgctaaattgatccctagtgcaccgactccgccattagactctacacctcgttttgaaggagaggaaaataaaaacgtcaaatcatttgcgaagccaccaccaccgccgacatcagcagctcaaattgatccatcgcgtttgattcacacgctcgacccaccaagaatatattttaaaactcctccagctaaccaaaaccctttgaactatgtgccgaattcggtgatagttctctttaacaatgatgtggaacgattcaaggttgtgttcaacgaggaaatcatcagtcatttgtccttctcaccgcaattgggctatgtcattgggttcgaaaacccccagcatgtggtgtcaaatgaagttgccaaatacggacatgatttgcgaggtggcatctcaagctttgctgtctactcaaaaggactgaccgagaatatgatcatcgggaacacattgagctctttgctccgggttgtgtctatcagcggtgccacccctggggactacactgagaagatttacgactcaccgatatt

SEQ ID NO: 232 - DNA, 10031 bp, Heterodera glycines
ctatttcaataaagaacaccggctgtccaaccaccaaaacctacagtatccacccctccaccacaaacaacaataacaaaggcaccaccgccaccgccgcctactaagtcggctccaatagttaacccatcaattacaacaactacaaaaacaatacctacccctccggtaacaaaacctactacaccaacccctccggtagcaaaacctacgacatcaaccccttcggtaacaaagccaacgacaccaacccctccggtaacaaagccaacgacaccaacccctccggtaacaaagccaactacatcaaccactcagtcgcccaagccaccaacggcagctcctaaaccgataaagccggcatcgcctgcacctcaaccacccaagctgtcaacgcctgctcctctcactacaacaacaaaaccaccagtcccaagcccatctgttaaaccaacaatttcagcaccatcggctcaacaaccaaaaagcccgacaccatccaccaaaccaatagtaccaaaaacagacgcgccacctaaacccccacccccggtttctctttccgctaaattgatccctagtgcaccgactccgccattagactctccacctcgttttgaaggagaggaaaataaaaacgtcaaatcatttgcgaagccaccaccaccgccgacatcagcagctcaaattgacccatcgcgtttgattcacacgctcgacccaccaagaatatattttaaaactcctccagctaaccagaaccctttgaactatgtgccgaattcggtgatagttctctttaacaatgatgtggaacgattcaaggttgtgttcaacgaggaactcatcagtcatttgtccttctcaccgcaattgggctatgtccttggtttcgaaaacccccagcatgtggtgtcaaatgaagttgccaaatacggacatgatttgcgaggtggcatctcaagctttgctgtctactcaaaaggactgaccgagaatatgatcatcgggaacacattgagctctttgctccgggttgtgtctatcagcggtgccagccctggggactacactgagaagatttacgactcaccgatatttgcgcgagtgttaccacgggaaataaacgaaattgagattgaactgcgcacaatggacaaaggtcgattggtgccgttcgcctatgggacgacgatggttgtgttgatatttaagaaagtgataaatttctgatttcattcattcatttttcatttaataacaataaaatggttcatattgtgtttgacccaagcattgcacagtatgatgagtatgtacaatacggtggtggattagaaaaggacgattttgactacttccggggcactagcccctttcagcggggctacggtattcaacgaggggcgggtgtcggagacgtgtttcgtggactttggcgctttttcttgcccattcttcgccgtgttggtactacagtaggatcggaggcgctgagcactggacaacgcgtgctggaaagagttggtaatgagggggtgcccctgaaggaggcatttgtcaatgagggaaagcgaggaatcgataccgtactcgagaaagggggcctgccaaaacagtttgggagtggaaaaaggggtataaaaagaaagagaacatatgtgcctggtcatcaaactctaattggacggcctattgtaaagcaagcaaaaaagcgtattcgatcggacgcctttggactttactaaataaatgacatttcacaaaatcgacaacgactcagtgaactcaatcaccaatgctcttgactttttccgtatacccccgacaaatgtgagcgtctcatcttcaaaggtattcgagcttctgcccagcaatccgcttaccgacacaccctaccacttcaaacttcactccagtcaaaattacattgacctctccaaatgctatttgctcaccgagtttcgaatccgcaaggaaaacgttaatggtcaactcattaacctaggcattgatgacataaatattgcaccaattcaaatgatcggacaaaccttcatccgtaacatcaaaatgagcatcaatgggcgcgaaatttttaatgcaaacgccctgatggcctacaaatcatatttctcacatgaactctcctattcaacgaccgcaaaagactcccatctgaatgcagctgggtactaccgggacacgggcgatacattggagatgggaggcggatgcacagcgcgacgcgatttatttgcgggtagcaacgtagctcaattcattgcaaaaattgacacagacctattcaatcagccgttgtatctgatcaatttttgtgaattggacattgaaattttgcccaacgacaacgactttgtgctaatttcaccagtcgtaggtgcacccaaataccattttgaggtcatgggtttgaaaatgtatgtgaagaaagtgtctttgatggacggattggcgctggacattgcgcgaaagttggagttgaaacctgcgcgttatgcagtgaggaagacaatgatgaaatcgatgttcatcagtcaaggacgatatgagtttacagccaatttgttcatggatcaaatcccccgccgtatcacaatgggtttggtggctaatactgactatgttggcacaattaggcgcagcccattcaactttcaaccatttaatgtgcgcgaaatttcgattattgccaatgggcgctcttacccacaagcaccctacgacttgaattacccaaacggtaaatttgttcgtccattcaatgacatgaatgaagcggtggggttttcgaattcatcagagagtaatgggattacttttgcccaatatggaagaactcattgcatttacgttttcaatatgaccaacagcggggacgatcaggcggcattgtttgatctgataaagaatgggaccaccgcggtgagcatcaaatttaaccacccagtacccgatggaggaataatgttggtggtaatgggagagtgtgactctctggtgatgttagacaaaaaccgatcaataagcactgacaccactatttaaaccaccccgcattgtcatttcattaaaataaacatgttatcaaaaaagttgcctctaattttacttttccttcgcatttcgattcccgtaactgcatatagagaagagtactcttcatattcggaatatttaagaagaaggacattatctaggtttactagcacaacaacaacaacaacaacaattactcccaataccacactaaatgtgacaacgcctgtactaccaaagcaagaaaaactaattgatgaacatgtctctgctgttctcccaccacttattcaattgtgcaaggacacgccggaggaaagcagcatattccatcaggctatttgttgggcccttttcactctctatttaatgttgatcatcagtttggtgttgcatcaactctgttcaattttttggctaaagaatggacagcgtacaaatcacaaagattttgagcgaaaatcgtcggacagagcgagtatttcggggctgctacgccagtgaccaattgccgtcgcccaccacactacagtaccccgcagcactcgttgtgaacagagacccccagcacaaggagggctctcattggtgcgctatttacgcgaaggaattgggtgcgccagtgctctattatgatagtcttgctcagtccatcccgcctgccattacatcatcttttttgaccaaattccccgagggattaaggaagaattcttgcccattccagtcccctttagtgtctacgtgtgccgcacattgtattgttttcatttaccacatgtcccaaggagactcgtttacccactttcttaacgtgcttaataattgtgcaagccccgatatgtacatgattattttattacgtaaaataataaattgttaacatttgtacgagaattactcaactgaaaaattgaaataaaacgagccagggtgtcgagatctttcaatgacaatcagttgaccaacatcatttgagtggtgcgggttcatcagtcgatacatttccattccgtcggtgcgcaccaacagtccaactccccgcgatgccatctcagtggcagtgagcttgaggatcggtggaaaatgctgacgagacagataacctcccgcagttcgcttcttcatggtcagcggatttacgctgctcaatgcatagtcgagcagaatgccgaaaagctcaccgatttgagctgacttaaatagcaataacaattttttatgattaaattatccgcgcttactgccgcatatgtgatgattctcgtcgttgcaattgtgcccgagcgcccaaagcacaagtagtgcacaaagtcggtgaagtattgaggatccagcagttggtcatctttgaagctgaactggatgaagagctctccaccagggaggttcctttttgcgcaagccaattcgaaatccagagcaatttcgatctaaaaatattaatattaaagtcctaaaaatgtgatcacaaaccaattttacgaagaaacagtgtcggtttgctcgaaaaatttcgaacccacggtttacaaccggtatgccagatggtgggcgtgtaactccttcaaaatttaattagttgattaaataaaggtgtaaaaaacctggttttttcacaactcctccgaacaggtacatgattgggatagcagctacaatttcccaaacaagttcggatggtaaacgacgtttgttgttgtcgttgttgcacattttttcagtgaaatagacaatgaatgaatgaatgattattagagttgggtgtaggcgtcaagcaagggctataaattattattacagtacaccaattcccaagggaaaattttgaattggcttctaaaagtattgatcaacatgaccttgcaaacacctggcgtcatattgatattcccggggatcatcgattgatgggaggagcttaccaatatttggatggctttataagagctcactgacactctatttggttatttttacattttcaaatttgctgttaaccagggcggtttctcaacttaaagagctccgtttatcctggcagcaattttgttaatttgccttttaggtcttgaggtagtgcactagacatatctaatttcacggaacgctttaggtgccctgtcgtcttgtgcttcatgggtggcggtgcgctgctcatcaggtcatggttggttgctaccgatttcacaatgatccatgcctatataagcatgctttttctctcatctcatcattttatttatgcacaaaattcaaaaatttattatttaatttaaatagatttaaaaatgtccaaacgattcactgacttttctattgactccattctcggcaaaaaaccccggcaaggattccttatcaaccaaatcctgggcatggcccacctgctcggatcagttcaacacggcgaaggttcttccaaaaaacctgtcaacaaatacgtcaagaagttggaaggcagtttggaacacaacgaaaagttccactacacgaaggtcaagagccgattcagcattgaggacgtgcctgcaaatccggaagcactgctcgcggaaatcttcaaacactgcatcgaccaatcaatagcaaacagtcgcggcaagggaatcgagccaactcatcttggttgtctcataagcagcccgttactcagcggcggtgacataccgatccccatccgacaaatcacggacaacactgtcaacaccatcctaaaccgcttcaatcaagtggcacagagcaagaaacaacaaaacgtcacactctggggtgaaccgtttaccgtggttgtgacaacagtggatcggtctggactccccgcaaaacgacaagtgaagggaggtgctgctcgtccattggctccagttcggcatcaaatacatgatcgctgtttgatcaaggtttaacctcaattggaagcctcttggcatatatcaatgtgttagtttaagatcaggaacccggacaggcaaaatttctgtctcttctatgcactgcaggcgacaatggttgccaagaccagaggatggccacgatggaagttttacgattatctacaaaaccgacatggacaacgggagaacttcaacatgatgcaattcagcttatgaatcaaattggtgcacctttgaatttgaacgcgtatgatgcagatacttatgtgccgcgcgttatcaactattggaacaacaacaacaacaacaatcaacagcatcgattctctgtcttcatcttcggtgcaacaggccactacaagcccatctacaaatatgtggacaacacctacaacacaccactgctcctttatttcaacaacagccattttgatggggtgcagaagcagggtggccttttcggaaagccttactgtttggagtgtgaacgaccatactcgagggcaccgcaacacaataaatcgtgcagggctcgctgtttgttatgctcacggacgggcccactatttccatgtcaagcacatgctggattctttatgcattgcgatgggtgcaacaaaaacttcaacaacaatgactgcttccggcaccatctccagtcaggtttctgcaagaggtccaaaaagtgtaaggactgtggtgttgtttgggacgtgaatgataacaacagaaatggaagaaaaggtcacgtgtgtggcgaacgctactgcaacctctgcaaaaacttccacaatcccgaacgtggctgcttcatccaaccgcttgagccaagggaaatggagccttatcggattgttgcgtttgatctcgaaacaatgcagcaccagcctgttagtcctcgtgagccagagaaaagggagcatcagccaaactttatcgcagcaaaagtgttctgccctgagtgcattgacaacagcagatggcggaacggaactgcgggttgcaaagtgtgcggtcctcaccgaacagttgccttttgtcagcgccgctttgtcaacactaccgtcgacaaacaagttgtcgctgacaaccctttggaggcctttgtcggctggctcatcaacgctctgcccaaaaaattcgacacatacgcgttctctcactttggaggacgcttcgacatggtcctcgtgttccgcgaactattcaaaattgggttcaatcctgaaatgatccgacaggtaacttaattgttatatttttttattgtgttattatttttagggcaataaaatgttcgagatgaaagtcaagaagcagaagaaccgcaaccccaacatcgtgttccacgactcgttcaacctaatgccctgcgcattggcgcagctggtaccttcctatgggctggaggtcgaggacaagcccttcttcccacatttggccaaccgcccggaaaactacggtcgacacatttacccaacagtggatgactacctcgcaaatggaatgatgccggagaagcgacgacaatttgacctgtggtacgagcagcatcagcatgagccatttcaactggatgaggcattggcttcctattgcaccaatgacgtggaaatcttatcggctgctctcatcgccttccgccgcgaattctttgaagtctcgaagcggaatgactacgtcgatggagttgatgaccgcgaaaaccacgacggcatcgacgcccttcggcaatgcatgaccattgcgggcgcctgcatgaaacacttccggctaaaccacctaccagcagaacaccttgccatagtccccgaaaagggctatgacaacgctcaaaaccaaagccggctggcacttcagttcctccactggtacgctgaggaaaacaacgtacaaatacagacagcctattcgcctcaaggagaaaaaagaattgccaattacacagtggatgggtggattgaagaggagcgcagggttattgaagtgaacggtaatttttatctatcataataataatttttatgagaaatttttacaggttgtgtctggcacggctgcaaaagatgctttccatcggacaacatgatgctaccaaatggaaaatctgcaggagaacaacggaggagggatgccaaccggctggaattcttgaggacgcaagtggcacgagtcgacatcttttgggaatgcgatattcagcaaatggtggagcggagcaaagcgataaggaagtcatttgcggactatgtggatgctggaccgctgatcatccgcgacgcgttcacgggaggtcggacgggtcctctgaagctcttccagaaggcaggcgaagggcagaagatttcctactacgatttcacgtctctgtacccgtttatcaagtgagaaaaacgtaaagatttttttttgatttttgaaattttcagtttcacgactcgttatccagtgggccacccgaaggtgcatgtgttgaatgaggatgttaattggaccaacccagcagacaacccttccctttggcactgatcaaatgctgggtggttccacctcgcaagtgtgacatccctgttctacctgtgaaagttggtgatcgcctatgctttccactgtgtatcaagtgcgcgaaagattaccccactggtggggtcgacgacgaataccactgccaacacaatgaccaacagcgcggttgggtcaacaccagcacttcaattgaactcaacgcagcgctcgaggagggatatcgcgtcaccaaagtgttccgcgtgctggagtacgagcagagtgacgaccagctgttcagaccatacattgctgagttcatggcgcagaagatccaagcatcaggatttgactccaaaatcaaaggcaacgccgaccaagaagcgcagttcgtccaggaatgctatgagcagtttggaataagcattgacccattgaaaatggctgtcaacaaaggaaagcggtcgattgcaaagctgtgtctgaataatttatgtgggttttccttttcaagtgtcaataataattggattaatttcaggggggcgtttctcattgcgcaactttggactttcgcagacgctgataaccgacgatccggttttcttcagagagcacttggacaaccggtcaatcgatgtcactgccattgatgagctcgatgaggagcacatcctcctcagctacgaaaataagaaagagtgggttgaggagcacgactgctccaacataggtatggatcaataaattagcgcacaaataataattataaatgttcagtgatatccctgtggacgacctcggctgcacggctcctactcctaaaggcaatgcagaaggtggtgcgaacgcctgggtgcggactgctatacactggttagattattattattttgtggcaataaaaaaaaatttacatttttcagacactgattcactggtctttctccacccggaagacatttgcccgctcaaaactggcccacatttgggtcagttcaccgatgagtacccacaacatgaaattgtggagtactgtagtgggggtgcaaaacaggtaatgttttattttttacaaaggtaaattaaagcttttgttttagtatggtttgaaactgaggaggctgaacgcacctgcagatgcggagtttgaatatgtgctgaaggtgcgagggatgacgctgaactacgacgtcatcaacaaccaaggactgcgctacgattcaagcagcaggtgctgaacttcactgcgacgggtgactatgaaccaatcatcgtcacatatcccaacttcctgagaccaagcattaaagatggagggaaagtggtgtcgggaccccttcagaaatgttataggccatatgtaggaaaaggaattgttaactctaattttgatgttttgaattttggtcacacattgtaaaacttacttttgaataaaattaacaattggaagttgtcgattttgggtagaaaaatagcataattaagcaatgaaagatgtaaatattgcataattaatcaccacatttgggaacattcatttcttcctgtgtccagtactaatga

SEQ ID NO: 233 - DNA, 1263 bp, Heterodera glycines
ctcagtaatgccgccgacaaagaatgttttgttcatcccattgcggtctttgtaggtagtcctgactttcttgcccatcaactctttcaacacattcgaccggtcgtcggggtggttaaatcgatctcgaagagatttaggtgagcaagagagcaggttggcgcaaaagagactgacaagtaccattttggggtatgaatgtgctaattgaaatgtttgagcttttatagctttgaaataagctccgcctacttaaagccaattaaattcacccgctcaaagctcaaattcattttataaaatgtcatcattatctcccgaaagaattatgtctcaagctccgtcccctagaaaggcaaaagttgacgagcgagctctctggaaaatcttcaagggcaagtaaatgctggcaatttatctctgcgacgatgactggcgaaaactgtacgagaacaaagagaaagtcagacgactagaggacgacgacgacaatgtggcccttagtttccaaatgtgtgaggattgcgcgcgcgtgaattgcaatgcaactgacataatggcaccaccgaagaaacgaaagatcgagaaagcttaaggacttcataatttattgttttttttcatgcttatctcttaaataaatcgttgtaattcttttgcgcaatgattgggtgtgaaagatggtagcggagtgggttgggtttggttgttttggtgtttttgtttcaatctcgactcattcacccatccgcatcccttctcgtccaattttcaccgaagaacaattcaactgctgccatcaacatggaagctaattcgggatccttgacggcttcattgcaagcagcagaagctgaaattggcgctctgaaggaaatggtcaagctgcagaatgagaaaatgaaggacatgcgccaccgttttgtgaacttccgctcccggctagatcagctggaggcgtgggctgctgacgtaaaatttaaacttttttatttttattttttttttatttttttatttttttaatcattaaaatgtgtttagaacaagcaaacgaaatttgtgcgccccgacacacgcaaacgcgtgttgttgaacgattcgccagagaaggaaatgccggcgacatcaaatgctgctgcttcaggcaactttttcttagttatcaatttgacattatttacattatgatcactttaaaggtgatcgtcaacaaaactttcaagaagaattttttgaagttaaattcaaaaaattcatgaa

SEQ ID NO: 234 - DNA, 14818 bp, Heterodera glycines
  misc_feature (14750)..(14751): n is a, c, g, or t
  misc_feature (14789)..(14789): n is a, c, g, or t
cggctaaaaacgtcttttatgatttttagcgcatttttaggtatacatattgagacaattcgggcaggacaagaaaagaatgaagttgatttctcatgaaactcggaattggttatgtttagtcgaaaatatgcttacatgatactcataaaaaatacaaataattcaacccacctattctatgaccacattctgaaaaaaatcccagaaatacgaggaaagatatgcttggtcacaataaaataaaaaatggctagtgtgtaaaaatttgcggtcactaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaatttgcggtcacaaataaaataaaaattggctaatatgtaaaattggcgtccagaaagacaacgacttggcaaaacgcattgacgagaatctttacgtcgataatattctaatcgaaatgaaagccgacgaacaactcaaatcagtggtcaatgaagccaaatcaatcttcaaagcagccggcatgataatccgagaattttacggcaccgacattgaagggctcaaacaattgccagccgaagacttggccaaagaattggaagagacaaaagttcttggaatcgcttggaagccgaaacacaatcgtatcgcattcaaattgccaattttcgagggaacaatcaccaagcgcacaattctatcacacattgccaaagtgtacgacccgcttggattgatgtcaccagcattgttgtcagccaaacttttccttcaagaagtgcaaaatgccaatagcaaatgggacgaaacattgtcgagccatctcgtcaaaacgtggctcaaaatcgtagaaacttggtcgcacagtggcacaccaatcaatgtcgaatttccgcgattcattccgtccacaacgaaggacgaatttcattgcttttgcgacgctagcaactatggcttgggaattgccatttatcagaaagcagacacgacatacgcaaaatccgaatgcaacttgatcttcgccaagagcctggtcaagccgctaaaattggtcgcccacgattcaacaattcccaaactggaactgcaagcactcacgctcggagttaaagcagtcaacttcattcaacagcaactcaatttcgatgacaagcaagtcattctttggaccgacagccaatgttcggtcgaacgcctcaaagacggcagaaaatccgatcgattcgtgaccaatcgactcaacaaaataagggctgcaaattttcaagttcgacacgtcagaacagactcaaacccggcagacttagcctcaagagggatcgaccctcgcagcattcaagcatcgcttctttggagatttggaccgatttggttgtccaaatctgatcaatggcctgagtcaaatgtcatttatcaacccggcgaagaaatcaaagcttacgaagaagtgccgatcgttgaaatcagctgcgcagttcaagaaaagcagaaattcaagccaacaattcaatttgaacgattttcgaattggaaccgactcagagccacagcagcatacgctaatcgattcatcctgcgactgctgagagcaaaaagaaggaacaaacagcttcctcaaaacattcaaatcaatggaccattgaaagcacacgaactgcaacttgccgaagaatggatattgacagaaactcaatcaacttatccgccaaccgaagatcaaattcgagatcttcggctcttcaaagttggaagactgtggagatgcggaggaagacttgacaacgcagaaagtctcagtttcgacaacaagcaccccattttcctgccacccgacggctggatcaccaaactgatcattcgacattatgatcaacaacacaagcattgcggcccgagaattcttctgtctcaaattcgagagaaattctggattccgcgcggcagaaagacaattcaacaagttctgaattcgccacgtcatggatgtctcaaatgtcgaaaagaaagagcaaaaccatactcatacccagaggcacctgatctaccagctcaacgcgtcaatcaagcccgaccattcaactcaacgggcatcgattatttcggacctttgaaagtcaaaaggggtgccgaagtcgtcaaaatttacgtcgcgctcttcacttgcttagtgatcagagcaattcatttggaaattgcggaagactactccgccgaagcattcatcaggacgttccgacgatttgtctcgagacgtggaacgccaacactcatcatgactgatcaaggatcaaatttcgtcgctggatcaaaaatcatcaaagagcattggaccgacacgcttcttcccgaacatgtgcaaactcgactcgcgcatcaaggaatcacatggaagttcaacacagctcatgctccgtggaaaggaggcacttgggaacgacttgtcggcattacgaagaattcacttcgtcgaacaattggccgaaatcttttgggatttgacgaaatgcaaactttgatctgtgaaatcgaagcaatcgtcaacaaccgacctctcacgtttgaatcggatcaagaaccgtatcaatcgcttcgtccgatcaactttctcattccatacgaacaaatcgtgatcaactttccgctcttggatgaaaacttcaacgatccggacttcgaaccgcgcacaagcaaccgtaatcaactcgtcacgatgctccgaaaaaccagcacgctgctggaccgattctggcacacatggaaaacagactacctgttttcgctccgtgaaacagacagaagcaacgcaacaaaccgatttcttcaccccaaagaaggggatgtagtcattgttggagacgatgaccaaccgcggtcattgtggagtttggcacgagtcattcagctccacaaagggcgagataaccaaatccgctctgccttactgtccattaatggacaacatcgatcccgggctataaatcagctttattgcctggaaattcccgacagttcagaaacagaagcaccagcacacaccgaagtgatcgctccaatcatggcatcggaatcgatcgaagtcatctcattggcgagcagtgacgaccaaatgtccgacgactatcacattccgaagaagaaaaatgtgatcaaacgaaaacaacgctttattactggtcacaacgtcggcttacgagaagtcgagcaacgacccacggacaacgatcccgtcgaaggattgttgtactccaagcgaccggacaacaaaaccaaattcttcaaggacggaaacttgaagatgcttttggaatcaatcactctgttcaagcgcatcgaaggcaaaaagatggcagaaaaactgttggaactttacggaaaagttccgatgatcgaatgggacaaacgcttggccaaatacgaagcaaaactgaggaaaatggatgaagcaagggacaaaaaggataaagagagagaaaaccaaagaagagaaaaacgaaaattggatgaagaagaggaaccggaaaaacggaagaaaatttcagtcgaaactgacccattggaagaaactgacccgaaaaaggaacggcaacttcaagatgaaaatagaatccgctggtctgcgcaaaggaaagcagcagtggatgaactccgtcaacgcatcaaattgaggaagaaacaatggtcaagggaagaaattgagaaggaaatgaaggaaagcgaaaaagaggatcaaacacaactgcgcgaactggccaaaaacggaagcaaagaagcaacacaattattggaaacagccccatcactccgccaacagtcaaatgttcaagtgactgcgacaattcaacgaaaagctgaggattatccacaaaatggagaaaaagttttgaagttctgccagcggatgtaccaagacaatttgatgtcagcgtggagaagaaaccgagttcaaaaggaattgactcaacttttggaagatggccgcttcaaactccgtcatgtgaacggacaacaagcaattctgcatcgaattacagaaggcaaaaaggacctttgcggtgaatttctcatcggaagaatttgttcatggcattatttggacgaaatcgaattcgaagacacaaaagagccaccgccggctcaacgagactcaactccggaaatcacggtcgtcgaaaccaaaaacgaccaggacaggcagcaagacgaaccgcaattcgttaccattcgagccggacgtacgccgccaccattatttatccctcaacgttcaaaatcgccatcgcctcaattcatagtacaccgtgccgctcacacaccgccgccagcacatcgcgattcaacacaaacacaactcgtggaagagtaccatttggccaaaagcaaacccaacacgtttgtggatttcaacatcttcactgaatgcgatgaaactcatctcacctgcgcaaaaaatgcgacttatggtcaaatcgcggacaaacacaatcgagagaaaatcgaagaatttgtcaattgccgtgcacgcactttgtttgaagcaataatgctccattggcttaattgcaacatcaatcggccaaataacgaagtttgggccatgcacgaactgcacactcaacaattcgacactttggaagaatcggcaaaatttttccatcaacaacaaatcgtcatgcgtaaaagagacatcggcaaagacaaacacttcaaagaagcgatcgaaatttggcgcaactcatgcgacctgttcaatgaaaactttcaacatgtgaacaagcaactcaaattcagcccaacacattcgcctgaaatgcaaaaaacggattatgccaaatggatcgaacggatcaaccaacgtacaaacgaaataagctcaaaagagagatcaagaatgcaatttcccgacttcatctacttcaacgttcgaacaattttgattggagacaacaccgcagaagctctccaatctcatttcccaaaatcccgctggtacactcattttgccgatcaaccgcttcgacttacactaggcccacaagtcaagcacgccatctttgcgtatcaatcaactgatgaggacatgatccgacaaatcactccgttgctttatcagcacaagaacactgacatcgaaacaacgctgatcctacgaaaggacaacaacaacgattggctctacaacaaaaaggaattcattggcttgactaaacgacttgaggccggattcttcgttttcaatgcacgaatcggcgaagctaaagaattggccgatcggatgaaagagacaatggaggagtcaatgcaactcaacaccgagcctacaacttcaaatttagccgggaacaaaaagccataccgaaaaggattcacagttgggcaacgaatgctcaactcgctcatgctcttcagcctttttatgctcatcgcattacaaggagcaagcgcacaaccaatccgtcaaaaacgatttggcggagttggagtttggcatggaagccacgcaatcagccaactttggggcaataacgccaccagggaacgattttcgacattttctccctcagtgcaacgctacataagtcgtgtgttcgctctcaacgcaacagcaactcttccaacagtcccaacctcatcaaccgcacacacaactccaatttcaacaactccgcccccattcacaaccacaaaaccacccgcaataactatcaaaccccccatttccacaaccacacgccaatggaaaacgaccaagcttcgaacaactcaaacattgcccccaacaagcaccgaaactccgatcacccgaaccaatcgccccaaaatccaacccccattattcttcgctcaacgacaatcccaatggaagggagacccgatcaacgccaaaggaatggacatcttctggtgtacggatcgtggcagcacaatttgtgaactgaagggacctgaaaactcacccttttgtcgcccaccgccagtgttgaccgccaaatggaccgcacttaccatcacgctgtacacaaaaatccatcgacccgaaaccgtacaatcaggatggaattgtgcagtgagacgaatcagtgaggtgtattacaccaacctgataggagataagttcgtggacgtcaacaaaacatttctgcccgtgtccaaaacaatgtgccgacaaatggcacttcatcaaatttgccctatggcaaaaacagaaatgacacaaaccagcaaaaacacatggacaaccaacgacgaactcagtgtcaactttcctggtccaatcgaaggactcttcaaaggaagtcaaaccagcgaaacgacaaactgttttgtccaaccagcaacattgttcgtcaaacgccacaatttgcaacttttgtcgccagttcatcatgtagaacattgcgactactcatcaggattttgccaattgcccgacaacaccacaatcatgtggaaaccagattgccccgccgaaggatgctacacctgcgacttcgagaaagccgaacaaatccgaggcgaatttaccaaaactcgaggacaaacctcagcaatttggatatcggaagatcgtcaaaaagctttgaccttcaccgactcaacggcaataatggcatgcgatggcaaatcgattgttctttcggagcagaattttggaattcgaaaggaacaatacgacgcattgatggacaacgatcattcaagaacaaagcgcttcgtagaaccggaacaactcgcctctcagttgtcagcagctcaaattgcaaccaacatggcactttcgcaactctacatgaaagaatgccaacgcaacttccgtgttgcgaatccgacattgcaggcccgaaaactgctcaaccgcgagaatttgcaagctcgatggatcggagaaacaaccatcgaagttttcccatgcgtcaacatcactctgaccgacatcagctaccgagcaacaaaaagttgctacaaattcattccggtcaccgttcatctgccaaatgccacaatggatgcatttctcgaccccgaaatgcgcatcctttcgctcgtcactcacatagcaagctgcacgcatttccgctaccaccatctgcaacttaaaaagaaccctagcatttggctgcggatcgacgtcaatttcggcatcgccaaacgactacctcagtctgctgtccatgagctctacgaatcgattcaaaatcaaactaacaacgatttcgaactcaatccattgatcttccatcaatggcaactcagcaacgacaccgacaacgccattttcccgcacatcgacgaattcgcggatttgacggatttcaaatcaaaactcgagcagcatcaaactgcgagagccgaagcattgggcgcaattcccggaggactggaaggatggacaattcggaaggtcaaggagtggctcaacgaactcatcaattggtggatgcgactcgcatgcgcatacgctacatttctccttctacgggatgtgatactcccgtgcatcttcgcctatctgatcaaccccgtccgtgtcacattcatgagcctcgtaggattccgaccacgccggcaaccacttccgcaacggcgatgcttcgacgaagtcgtaccaatgcgccaactgccccgggcacccaaacggccatcaattcgtctacgtgccgaccgcccatcctcgccgatcgctttggacttcgactcaagatcggcaacttaccgatcacgcgcatcaagcttgacaatcgacacgccattcgggaagtcgcaaccgttcaaattggcagacgatgattgaagaaaggaagaagatggatgagcacaccgtctcgcgcggggaatgttcgaattgggcataatttttccatcatttccccaattctcggccaatcaattaattgattgcctttctcatgaccctcattcattcgccctatttttccctcgtcattatcattgtgatttcgccaaatgtgggcctcctacgcatcttccccccatttttgcccatcatcatcattgtgttcatgccaaagtgggcctcccactcatttcttcgccccaattctgcacatttctgtaaaatcgtatagttccacgtcgaaatgccctcccgattacgcccgtcaaatcccattcacatgcatttcattatcgcccaacatcaattcaacgatatttaaacccctgccaatcatccaccttatcaacacaattttatggggaggcaaaatcacaccaccatttgtcttcccttctccccccaattcaattcgatcattttgtgtaaaattgtaaattgtacaattttccccccattcattcattttgcgctcatttatatgagcgcggtttaattacccaagtttgagatctggataaatttgttgtttttattcgcttttgaatttgggcacattttgcctatcgaccactcgccgaccccgaccccacaaacaaactttggactagcgtgttcgaagtaaaagtggacttggaacgcccacaccgcgtcccaacaaggcatcaacttcattcttttcttgtcctgcccaattgtctcaaatgtatacctaaaaatgcgctaaaaatgatcaaacccgtttttagccgaatatcctgtcaatatttccctattagaaacgatactgtcaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtggtttgaattatttgtattttttatgagtattatgtaaggatattttcgacaaaacataaccaattccgagtttcatgaggcatcaacttcattcttttcttgtcctgcccaattgtctcaaatgtatacctaaaaatgcgctaaaaatgatcaaacccgtttttagccgaatatcctgtcaatatttccctattagaaacgatactgtgaattctttcgcctctttaattcattcgtgctttgcttcggattagtctaaaaatttctggacgccaattttacatattagccattttttattttatttgtgaccgcaaatttttacatactagccattttttattttattgtgaccaagcatatctttcctcgtatttctgggatttttttcagaatgtggtcatagaataggtgggttgatttatttgtattttttatgagtattatgtaaggatattttcgacaaaacataaccaattccgagtttcatgaggctgttcgaattgggcataatttttccatcatttccccaattctcggccaatcaattaattgattgcctttctcatgaccctcattcattcgccctatttttccctcgtcattatcattgtgatttcgccaaatgtgggcctcctacgcatcttccccccatttttgcccatcatcatcattgtgttcatgccaaagtgggcctcccactcatttcttcgccccaattctgcacatttctgtaaaatcgtatagttccacgtcgaaatgccctcccgattacgcccgtcaaatcccattcacatgcattggacacagtgcactcaagcccgttcagcaatccaatcaccgcgcactcaatcaattgtgccggtactcatctcatcaacaggtggattacaaaatccgcacaaatttccttgagtatttggtttcaaggccaatacttttagaaataagggaaggggtcgaaaagtggtttcaaagaattgagtttgagacttcaaggtcttagctttattctcaatcgatcgatcattcatttttagccacaggcttcttggtcttgactaaatttgggtaacggaatcaaagtattgggtttcaaggctcaaacttagtttctgacaaggttttgtagtatcagacttcaaggtcggaactataaacctataggggtctaatccgtgcatttgcccctcgtgccaaactcacacaatcaaaagtgagactgtcaatttgctgttgtgaacaattcaatctgtcaattcaatcgcggcacaaccaatcacaagcaactcaagcaatttaacaagcaattgacaaatcatggcctctccaatccaacaaaaattgggagccgcactcaaagtgatcagccatgtccgaaccgctgctgcactgacaatcgcaactgatccaaccgcaagcaactttgaaaatgcactcaatttcgaagcgcaacttgagaaagttcaaaaagaagcaaaaacattggaaatctttttggatgacattcgcgaatcgctttcttcgtggactgatcttctccgcaaattgccagcaacagaacgagaaacaggcgaaaccgaattcaacgcctacaacaaaaaggagaagatcacagacaaagtcgatgatgcatcaagcaaactccgggatcttcgtgatttgaatggcacgttgtcaattcatgcaaaactcttccgcaacaaatacgacatggaagaacgagcaactcaagctgcacaagcacaagcagcacccgcaactcaaggcagaacgattccgccatcacgcccatcatcatttttccaaattcaacccgtgcaactcgagagattcagcggcagcaaacggcaatggccggaattttacgaatcattcaaatctgcaaccggatcacattcattgagcaaggccgaaaagttcaacatcttacgcaatttgttgactggcgaagcacgtgaactcgtcgctggctttcgtcttgaagacgcaaactatgatgtggtactccaattactgaaagacacctatggagcgcatgacgaacacatcagatcgctgcatttcgaattggccaacctccgaacatgcaaaacattgcgcgacacaaaagagtttttgctgcaactcgaacgacttacgcgggaattgctcaacgcaggagcagacatcgaaggaccgccaacatatctcatgcttgaaaagaagctgacgccgccatttctgcgcacaatcctcaacaaaaagggagaagatcccgatcattggaacacatcgaagttccgcaacattctcaacgaagcagtccgcaaagagactcaaattcaagaagtcatgaccgaatatggtcaccatcagcagcaacgaccaacaaaaccatttattgccggaccgagattccgggatcgcgcaccgttcaatcaatttcgagaacgatcattcattgcgtccgccgtggacgaaaatcaaaggcgattcagcaataaacaattggcgcccaaaatcgcacacaatggaccaaaaccaactcaattcgcacaacgcacgcaacacaacccggccaaacccaatcaattcaacaggccgtcacaaccgcaaacaagtggcaacagtcaatcaaatgcaaatccaccaaggccatgtgtattttgcaacggcaaccattggaattccgattgccgaaaattcagcacaattcaacaacgagttgaaattgtcaaatcaaaaggcttatgcttcaaatgccttttcgcacatcgtacatttgactgtccaaaaccgagaaaatgtttcaaatgcggacaacttcatccaacagcactttgccgcaacattaatgcgcagaaccaaatcgcagcggcaacaatcatgccacatttgtcaataccaagcccgcaaccaatcgaaaatgctgcaatccaaacccaaccaatgtgcaacgccgtcaatgcaactgacactcgcgccttactcatgacaacgacggcaaccattttcaatccggcacaaccgcacctcagcatgatcgcctcaattttcatcgaccctggcagtcatcgatcatttgtgtccaatcatacggcacaacggcttgatcttccgatcgtcaacaccgaagaatgccttttgaccagctttggtgagcgcatgccaaagaaatacatcagtgacatggtcaaattgggatttctgtgcatcaatggagaaagactcatcttcaacctcaatgcacttcaattcttggtgaatgaaatgccaatgatccaattgtccgaattggatcgcgatcaactcaagcaacgaaagcttacgccaccacacgagatgaagcagcccgacattttgcttggcatcgatgtctggcacgaattgcaagtccaattcatcgaacgattgccgagcggatttacactttgccgatcaaaaatgggcaaaatactaagcggaacgggacgaatggaaatggggcaagcatcaaatgtcacattcgtcctcgcagtccaagacaaccaaatggcccaagcatcgacaactcaatcaatcgaaatcgaagacaacatcttcacatccgaggatgatctgaaacgagacgatcaactcaacagcttttttggtctccatttgattggaatggatgactcctcaacgccgatcgatcgagatgaagttatggtcaacttcaaaaagaatctcacgttcatcaacaatcgttaccaaattgctctgccttggaacgacaaagtcggaactcttcctaccaattatcatcaagcaaaagcccgactgatcggactgatcaacaaacttcgttcactcaatctgatcaacgaatatcaggccattctcgacgatcaactccaaaaatccgtcatcgaactcgtcgaaatgcccgatcaatcaattggcccggttcattacctaccacaccgagccgtcattcgagccgacaaagcaacaacaaagttgcgaattgttatggatgcttccgccaaaccaaaaagcaatccatccgccccatcgctcaacgaatgcctctacactggtccgctactactcaaggacctgactggcatccttttacgcttccgccgaatggaacgcgtgcttttggccgatatcgaaaaagccttcttgcaacttggcgtccgcgagcaggaccgagacacaactcggttcctttggctgtcaaatccgaaagaggccgaattaaaccctctaaaacgagaagacattttggtctttcgttatagtcgtgtaagcttcggattgaccgtttcgccttttctgcttaatgccacgatccgtgaacacctttcacttttcgacaacgacttggcaaaacgcattgacgagaatctttacgtcgataatattctaatcgaaatgaaagccgacgaacaactcaaatcagtggtcaatgaagccaaatcaatcttcaaagcagccggcatgataatccgagaattttacggcaccgacattgaagggctcaaacaattgccagccgaagacttggccaaagaattggaagagacaaaagttcttggaatcgcttggaagccgaaacacaatcgtatcgcattcaaattgccaattttcgagggaacaatcaccaagcgcacaattctatcacacattgccaaagtgtacgacccgcttggattgatgtcaccagcattgttgtcagccaaacttttccttcaagaagtgcaaaatgccaatagcaaatgggacgaaccattgtcgagccatctcgtcaaaacgtggctcaaaatcgtagaaacttggtcgcacagtggcacaccaatcaatgtcgaatttccgcgattcattccgtccacaacgaaggacgaatttcattgcttttgcgacgctagcaactatggcttgggaattgccatttatcagaaagcagacacgacatacgcaaaatccgaatgcaacttgatcttcgccaagagcctggtcaagccgctaaaattggtcgcccacgattcaacaattcccaaactggaactgcaagcactcacgctatgagttaaagcagtcaacttcattcaacagcaactcaatttcgatgacaagcaagtcattctttggaccgacagccaatgttcggtcgaacgcctcaaagacggcagaaaatccgatcgattcgtgaccaatcgactcaacaaaataagggctgcaaattttcaagttcgacacgtcagaacagactcaaacccggcagacttagcctcaagagggattgaccctcgcagcattcaagcatcgcttctttggagatttggaccgatttggttgtccaaatctgatcaatggcctgagtcaaatgtcatttatcaacccggcgaagaaatcaaagcttacgaagaagtgccgatcgttgaaatcagctgcgcagttcaagaaaagcagaaattcaagccaacaattcaatttgaacgattttcgaattggaaccgactcagagccacagcagcatacgctaatcgattcatcctgcgactgctgagagcaaaagaaggaacaacagcttcctcaaaacattcnnaatcatggacccattgaagcacacgaaactgcacttgncgaagaatggatattgacagaaactcaat

SEQ ID NO: 235 - DNA, 13483 bp, Heterodera glycines
actcggccaaccccatgacgacgatactccggcgacgttcctgctcttggaccgcttcctctaccattttgtgctgcttgaactgcagcaggtcttggttctgctgcagtatgacgaaactattggatgcatatcccgcattacatataactcgaaagtaatggccaaatatagtgaattagatgaaaaaaacctaaagattgccaaaaagccgaaaacgaatttgcacagacttaattgaatgtcattcataagtttaacatgcgaaattggcgacagcagattttcagtgcgtttaataaaatgaaattgaaagaattttaaattcaacttctttgcctgagtttcaatttccgagtcatctcaacaatttcgagtgtttctgcaggattttttcaccaatcgtaattgtttatttttattgttttagcattttcttcgctaaattcaaaatttccattaattgcaaacattttgtattaatcccgacgtaacagtagaacaaacattgattcatccgttttttccaaatatttttgatttctctaacccacactatttctccattttctttctatctgctcacaactaaaattgtcaccataaaaaatcgatatattggtgggagaaaagcctgcagagatgaagagcagaaaagaaggatttctatatccatatttttccatatttcgcgatttatgtccatatttccatattttggcattttggtccatattttatgtccatattttggcatttttcaaaaaaacctctattagaacggcccccagcagctaaattagcctttttgagcccaaaacccgaaaaatttttcaaaaaatcattttttcgccaaaatttctcgagaatattgaataaatttaaattttcttaaaaattaataaattatgtcaaaaataagcaaaaaagcgaaaatttcgcttttgttgttgattttgcgctaaaaaaattaataaattttagcttttatgttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatttcatatgcaatttcaaccaataaatttgaagaaattttgcactcaattttgaaaaatttatgtccatattttgacatttttgccatttatgtccatatttcgcgatttttgccattttatgtccatatttcgcgatttttgccattttatggccatatttcgcgattttatatccatataattacactccctagtgatatgtctgtttacaccaggctactttaattaaattattgtttttttttaattgattgaatttttatgggaatgcgtaaaaatttttagtgaaaattttgtcagcgaggagttcgattaacactttcaatgccatttaaacaaattaaacaactgaagaaggcatttgcgaattagctttgctgtgtgcactgttaccaaaaaatttaaaaattggtagtaaatttgtctggataaatttctttgtctttctttaaaaaactatttcctccaatattcatgttcaaaagaacggcggcaaatttttcccccctctctgaagataaattcgttttattgagatttcataattgctttttaatttaacattcgattattttgaacattggcaaaaatatttgggtgtttattttatttttttaatccgccatcgttcgtgcattaaactgcactagtggaatgtcgtagcgcatgaaaaagatacgagcccgaaatatccacaggatgccaagtgttaatgccactgatgccaaaatggagcaaattgaaagcataaaatgagcgaacatggaggacgaatgggcaaccactaaattggcactcagaacggcttgctgctgggaattgtaaaaatatttattcttttattttccgattaaaaagttttcgagaatttgaattatccacttaatttattacttgttcttcccttcctcctcctcctctgtctcccgattcaacggacaaagtcccatgccggtcattaattatttttcttatgccagccaaaatgccatggattgcatccgcccaacgcttttgttgaaacaattgttgctaataaatttatatgccaaattatttgcttttttttgatgcaatatgttgtaataattctcgttattttttctgtttctcaaatggccaacctccgctgcatacaaatggtttatttcgtcctgcaaaattggcgtggcgaaataaaatgcgacgcggccaaaattaaacaaatcaatgggaagagtcaatagaaaggccttgtggcattcgttgtccaactcccattgatgcaaaagtcggaaaggcgcgtcgacggtgttgttcaacaatttgccataaaatattactttttaaacgaataattaaacaagcaataaaaaaatgtctatgtgtgtcatttggcaccactaaaattaccatcacatttatttcaaaataaagcggcttcttggaaagcgcaacggcaccagtgactcccttctttttacacccattttgaccaccgtcctgaaatttattggaggataaagaaaggaatccaattgattgaatggcatttttggtcttctttcaaatcacaacttttctttaacggtgtgacatcatcactcataacactgacaatgagcatgactttggttacatttttcgtctgttcctggaaagagtcgagcatttccgcgagtttttgtcgctcgtccgcgcttaacacttcttccgggtcgcacacgtaactcttcagaggcattttgcactttgcgaattgcccctcgcgcaacggatttggataatcgttgatcagtgaggaggcggacaaaaattggggacagaaaaatgggaggagaaaaaatggaaaaagcaaaaaggaaaactcagtagcagaagcagagaacatatgtaatttagcaacaataatattatattattataaaaaatatagatcaaaaaaaaagaaaagaaatttatccaacaaaagagacgagcaaataaccaaagcaattaagaaattaataatctaataaataaacgattggtggtcattcgaaaaggagcgcactttagtaaaataaacaaaaaaaatgtaggaattacataaaatgaagcatatttcaatgagaaatttttacttctccaaaatgtcatctttataatgaaaaaacaacagataaaatgagaatttcagaatagtttttttgaaaattcaatcaattgcctaacagtcatttttcttaatgcttctctttttgaattgacgacaaagctgcaaatgagaaatggtattatgtattcaaaacaaaaagcagtccgaaattctcacccatggtcacattgtcaatttgggcaaatattttcccaccaattcaatgacccactctttagtcaacatttcctccacaaatttgtcattttgatttatcaattgtttgaatttgatcttaaataaacgcaacaaaagttcatggtaattttccaattctttcgaaattttccgtccctttatttcttcatccattttgtttgaatttttgctgtctttcgctttgaagaatgaaatttgttttaattccggtgccaaattcaacaaaattttttcctcttcctccgacaattggcttgacacttcatcatcctcagaattgatagaatcacttacattttcttcttaataaatttttatattgttagagaaaacaatttgaatgcaaaattaaggcattctaatgcaaaatttagctgttttattgcccacgtctcatcactgataatttcaaagggaagccttataaagatttacctctttctttttggcttttcaacttctgctgcttgacattatgagctcgctttttccagcccgaaacgaagtgaaaaactttttggaaaatgtaaaataaattggtaaaatgttaataaattagcagtattgcaattagagccaggaattgagaaaaaaaaagcgcgaccaaactaaaatttccgaaaggactcggacacgaacaacagggttaaaccctgtcttaacaagctcctggtccatatgcattttactatgtttccgggctctaattatgacataaagtaatatgtatttattttttcacttttagaaagtagtaatgggtttgatttatgctcttccaaatttgaagtttcgttgttttcacttaaattcctaacaattaaatcttttgcattattttttggtaaattgtccatatcacttggcaccatttcatttgtaaatttggttaacacttcatcaaatctgtcaatttttttcaagaaaatttcatccattctttcgtctaacaatgaaaaatttcgttcagatgcagttaaatgcatccctttaaacaaatcaaaatcggcatttttatgagtttttggcgtccttgacaataattgtcgttgtctttgaactgtgatgggttcgccttcactttttggcactgtactcatttggccatttatttttggcactgttttcatttggccatccgattttgtatttaattttgacgtcgttcgaactctgttcaaacttctctctcggctttggtgtccgtaagaaaatgtgtttgtgttttcattattcggaactttcgagagtattcgtcgcattgcccgcggaggttccgatggtgttctgaccgacgtttttttaatgtttggtgttgaatttttaaatgcaaagatttcatttaaataaagaattaacagagtgattgaatatttattcataattttagaatttcgcagcaaaataataaaatgaagaaacaatgattttattagtattttttgtttgcttttttgctacatcaatctgtcaatactatgtctgtgtaataaaataaaataattggatttccggacgcctaatattttcttaaatattagaaaaacaaattgcacaaaacaatattcttcatttctattcacattgaaaaataccagttatgtaatataaattagtgaataacaagcttccctggtgtgctgattttcagatttgtgatttaattgagtcggacagcctttaattcaataattcttaacggggtaaaccaactcatccacaaacaattaatccatgaaaaaaatgccataatgcgaacgcacaatgcaagaaattgcatggatgagttggaaaggtgtgtggacatttcgccaactgacacttcgccaactgacatctcgccaactaagccaaattcagacgtttcgccgactcacccaaaaaatgacatttcgccaactaagccaaattcagacgtttcgccgactcacccaaaaaatgacatttcgccaactaagccaaattcggacgtttcgccaactaagctaaattcggacgtttcgccaactgacattttgccaaaaacattcatttcgccaaatagccataatattaacatatgagaaaaaaaataaacgaaactgtttctttttcatcaaacatatcattattccctgtcacttccctttttgtgttaaagttttaaaatttcttttctacctaaacaaaaaggattttcagattctagtaagaaatgccaacggtacgtgaaatacttgagagtctgcaaaagccaattaaaaggccccgaattccaacaaatgaagacatcgtactgaatgctgataggactgacgcagaacaacaaatgcgtcgtaacacacagaaaggcgatggcggtgaattagcgagaagaagcaattaccgcacacacaattagccaaatggggatggagaattgtatcccgaatccaaaatccaaacaatttacttttacaattaaagtccgaggcagcaaattaaattcacagcagaaaacaaaaacgaataatatcataaaacaaaaaccgaaagaatgagaagggaatgacgtggctgctggtcagcagcagaaacacaatcgatattacagtaatatagaattggcgggaaatacaaattcaaagcaaagggagatgaaaaattgagaaggaaacaaccaaattaaataagtcaaaaatgggaaataaataaattaattatataagcacatcttcgccctttgaaaagcgatgtccacagagcttgcttggcgaatcgggagtgcaattggcttcacgaaaggcgatggcgaggtcaagatcaacggcgatcagctccaaaacgagaacgactcggaaaggactgcgcgaactgacggcgatacgggtggtgctggtgaacatgccgagctccacgcgaccctgactggttgaactgtccacggcctcttccaattctgcttgtccctccatttggcccctcttcactcttctttttcggttctgactcttctttttcgtcctcctttggcatccctttgatttgggacatgacccaggccctcaaaaccaataagcccttttccgtcattttgccatcatttgacacatggtcggtattgaaaccggagccatagcgccacagttccagcactgatcgtcccgccggcgttgtcgttacaaatttgacattgccttgtgccgtcccaaaatgttccttcattcgtatgatcagttcttcgtattcaatcattttctctttgatgaaaggaggtggcagccaaaacacaggggcatggctaaagcgcttcaacagctgttcaagtcgccccacacgttccagcacattttcgatcgtttcttcacctctgatcgaatctcttccgatcatcacaatgacggccttcacttttgatgataaaattgcgccatcaaaagctctgatcacttcggtgattgtgccttcttcagtgccaatgaattgggattttggccacatttttaacaattgtttggccgatgagtcgcctacgatgactcttggcttctcgacgaacaatggcttgcggtggatcgtcgttgcgcgtactttttctagtacgaagctggccttctttagcacctcgttccatccgagtttttccgattccggcaattcggcaacgacatttggcattggcacttcgatcggagtgtagccagtcttcagcaatttgtcccttgtcactgcgcatctttcgacccacgccgtaaaggcactttcgatgtccttttccgttgggaaattgccgcttttcacttggtcttcgcgtgcgccggagtaagtgatcagttcaaagccaaccggagcactgacgatcagctgtgtcaatttccgaccgccggcgactgatgaaacggcattcgattttagcaagaaattgctaagaagggctttcattggggtgccgatcaccttaaaatcgccacattcatccccattttggatctttttccattttctgatcactttgaggccaagaccggccctttcaagcactgggtcgaggtcggctgctgtcatttgtacgcagtttcggtgttcgatgccgagtccaccgcattgcgtgtcccaaagcaaaggcccgcagctgttttccgtctccatcacttttccaccaactgaatttgcaattgtcctcaattgcccaattaaatgacggcccaagtgttccaatttttgagaattgcccaaatttgtggtttcattttcggtttcccgatctttgatcttttccatggccgcactttttccacacggttcattttccatttcgcgactgatcaaacacacgacacttatcagcgcatttaactgatttttgaaggggtttttaccccggggaagtgtactaatgtttggtacaccttcaggcacttttacaaggcgttctattgggacctttataggctcaaaattcggtttatcgattggtatgactgacgctgtcgaatcagtgagatccaaaattttaaatgggccaaagtgattccaaagaagtttccggtgagctgaacgggtattaactcccggataaatgaccattgctctttcgccgatgcggaatttatttgccgtgacttttggctgttgatcgtactgatttttcatatttttacgagcaatttcggagtttttctgtgcaatttcgcttaattgtacgatattttcacgaaaaagttggatgtaagtgtccacatcaatcgtgtaattcgggtttactggcaaagaaatttctgatgggaaatttggtgttttgccgaaaataagatggtaaggcgagaatttcgtggtctcggacggagtgatgttgtaggcaaagacaacgaatgggagcctctcgtcccaagtccaattagatgccgttgatcgtttcagcatccccaaaattgtttggtttgctctttccgtaattccattcgcctgagggtcgtaacccgatgtaagcgatttctcaatttttaaaactttggtgatttcgttgagcgtttcatttacaaattctttccccctatcgctgtgaagcttcttcggagttccaagaatcaaaatgaaattcttgacgaattcattcgcaattgtgtccgcacttttatttggtattgggactgcgaccaaatatttcgaaaaatgatcgaccgctactaaaatgtatttgtgcgacgaattagcgggcccaatcgatagtatatctatgcacactaattcgaatggttccgatgtttgaacgattttcattggtggttcattagctcggggctttcgcgaatgtgcacaaattcggcattttaaggcaattttgacgcagtctgcatacatattcggccagaagaattgatgcgcgagttgcaaataaatctttttgccactcatgtgtccagcacaaattcctgagtgccgttctctgatcagcgcttctctgaaggtgaatggcacgaagagacgtagttttccgtcggcttcgcacttgtagagaagcccatccaaaattgtgaaatttgggagaaatgccgtaagcctttgcttatttttcggctcctgcggcacaattcttttggacagaaactcataaacgaaatttaattcgctttgcttcgttttttcgatccattccatacgattgttggcttcctccaccgaactttgaatttggcaaatttttatttgcgcaattctcgaaatttcgctttttgccggtggttcggggcattttaaagctggcgaacgagataaaatgtcagcgatcacattctttttccctggttgatattcaacctgtaggataaatcttgagttcaactgcatcagccacttatcgacgcgactgtttccggtctctgttttacttttaaacatatggataagagctcggtggtcggtaaagactctcgttggaagcatcgtgataaattgcgaaaatcttttggctccaaaccgaacagcgagtgcttccaactcggttgggcaatatttgctttcgtaagtgttacactttctcgaagcgaagtaaattggtcgaacattgccattatcatccggttgacagagaatagcggcaattccgattttactggcgtcggtcatcattatgaattgacgggatggttcattttttgctgcttcaaaatttgggaagtgcaaaacggcgttgtccaaaattttgtctttcaaggcgttgattgcctctttttctaatttgccgatggcaaaactagtgtccttcttcagaagcgaatacagcggagctgctatagcaccaaaaccgaaaataaatttacggtaataggccaaaaatccgagcagtgattgaagagccttttttgatgttggaattggtaattccattactggacggactttgttcacatccattttaattccttctgttgttagcacgtgcccgaggaacggtaattcgcttgcagcaaaatggcacttgctgatttttagtttaaggcctgcgtcctgaattctctcaaacacagcttttaagtgttgttggtgcttcttccacgtttcggaagcaattaaaatatcatctatgtagatgaaaacgaagtcgttgataagtccctcaaaaagttgagtcataaatcgttgaaacgttgcgactgcgttgcaaagtccgaacggcaaaacgacaaattcatgtagtccaaattccgtggcaaatgccgttttttcaatcgaatccggtgacattttaatttgccaataaccggaaaggaaatcaagtgtagagaagaattttttacccccgagtgccaatagtgtattgtcgatattaggtaacgggtaagcgtcttttacagtgactgagtttagtcccctgtagtccacacagaatcgaagagtgccatcttttttcggcacaatgacaatcggagatgcccacggggaagatgaagggcggatgataccgcgtccaagatagttttggatcatttcagagactttctctctatatgcataaggcactggtcgcattcttgagcgaactgggaccgaatttcctgtgtcgatgtgatggctagccaaatttgtttgactcagctcttcttcagaaaaagcgaaaatttgttcaaaattgtgcaacaaatccattaaatcgtcctttccttccggtgggatttgtccaattttcaaagcctgttcagcttctccaattttgtttccgttttgacaatgatcgattctgaaaatttttgacggcagaagtgaattgtcggcttcccatgtcgattcgagtgtctcgacattgccaactattgttttgctttcgatttgttccgtcattgaagacaaattcgaaatttgacacacaacttttccgttttcaacttttccaactgattgttccagtttgatttcagttttgtttggcactgggcaaatcagcacgtcttggccgttccattgctttccaacttccatttggacgaatttggaagtccgtggctgcagtattgtgttgaagataattctgactgcattttcatttttggtcgcttcttcaaactttataagttctttgtttggtgcatcgtacagtgaaaaaccgagtgcagttaatgaatttgttccgaataaaatgtcgaacccaaatggggcactggtcacgtaaaaatggataggcacttcgatacagccttttcgaagaattggcattgtaagggtgccaaaacattgaagttcctttccattgacgtcggcaattcggtcctttgtacgggcaaaatttgctttttgcaggtctaagccgttttctctgatcaatttatacaggaatgtagcgccgatcaacgaaatttgtgctcctccgtcgatcattgcttccgttttggccccaaaagtctcaacttttatgaccaaaatcttcccgactcggcccaaacttttcacttcgttttgttcctcattttttcctttgaactcattttcgaaaaattcctcgatttcggacgaaagctgtacgccgcggcaaaaaacttcaggtggtgcctcttcttgcataattatgcaattttgttttaaaaaattttgtgaacgacgttgatcagactcttttgttgaagtctgtggaagtgctcgattttcaggaccatttggccggatctgaaaactgtttgctccagtggcgggcactgcgtggctttggttagccctgtaatcgaaattttgttttcgtcgtcgacagtcacgagaaaagtgcccgggttcgttacaattgtaacaaacaatgttttcacgcggttgaaaactttgtaaaaattttgatttttgctgagtttggaattgctgtccaaattgggaaaagtttcgctgggtaggacgatttctttcgtcaatgttttgacgttcggttgacacattttttgtcgccttttggattgactctgcacgagcagccaatgcgacaaattcgtcaaagcacatgccaggccggcgtgccatttcaagcgataaagacaattccgggtttgacaaagcacgaattaaatgctttgtagcatattcgtcaatcaaattttgagttaggccggggtatgcgcgttggactacgttctgaacccgatcggcaagtgcatccatgctttcgttcggttttctcttcactccattcataagctcatcaaaagcacccatctctctgcaatcagtctcctctaaatgcgcttgcattgctcggcgaattgcatcaaaccggtatggctgatttgccaaagcagcattgaacgcacgctcagctctgcccgaaatttttgattcgagagaggaaatccgtttgttgtccggccatccctctgtcgcagacacgaattttttgaaaaaatagcgcactttatcagcgccttcgttccctttaagctcgggaagacggtcgagaatcagcacgtactccaaattactaagcggggattgtaccggcccttggcaatttgtttgtggaacatttattgggtcgtgacaaaatttgggagcagcatttccgtaaaaacgcatttgttggttattttcaacaaaattgcgttggttttgttgatggggttcacgcgtttcaaactgcggaaaatttcgctgatgaatgtactggtgatgatattcggcattttgttgcggcccgacattcgttggttgctgcgcttgtcgaaaataaagttggtctcttggttcagcgcgttccccggcgttaggctgtgcgacaaaacgaaaatgctgttcctccagcatcaaattgcgttggtggactgccggtggttgattgagcataaaactcggttcaccacgctgataatttgcgaccacgtttggggtcgaagtcatgcccgggtgaaacccaaaatcatccacaatatcaacgcgcactctcccctggtcaatgcttctcataacactaactgcatttcgaacattttctccacccaaattttgttcatggggattttcgttaccaaaaattgagtcaccatggtcatccaaaagagcatcttcgtccaaatcgtttcgattttgttgcgcgtccatatcgttccgtggatttgggatttgcaaaagtcgccggtggattgtgtctggtcctaaaacagatgaaaccgatgaaacgtggctttggcgattttcgttttcgctcaaaggagcatttccgacgtcggagtgctgttgctgaactcgctgctgttcttgcgcaactcctatgccctcgtttcgcaattgtatgccgaggtttaacgctctttgtcgcgttaatggcggacttcgcataaccggcatcattagcaaatgagaatttgttttcccgttttcaattcaatgcttttgacttagttgtcagcttttcctccgctttcaagattcgttttccacgttttacaatttcaacaaatccagcgaattcggcgagatgaagaaagggatttgtttccctctttttaaaattcggtgatcacaaatttctcgtttttcttttagggatttgtttcccaattttacgaattcggcgctttctttccacgtcgta

SEQ ID NO: 236 - DNA, 2684 bp, Heterodera glycines
atgaaaaaatagtattaatatcaatacaaaaacaatattacatatccaagcaaaattatatagtataacatttattgcaaaatatataaatagttaattgttttttccttttaaacctttatcacacttagatatttattttgcatagttagacttagaaatgtggaaaaaatactataacataagaataaaaattaattttaattccaaattcaattaaatggactgaacacgtaataaaccgaaatcgtcattttttgaaaatccatgatcccaaatataattgcctaatagaagaatcaatcaaattataaaattaaaaatgtaaatacatcaaatgactgagttcttttaaaaaagaaataaattttcttttaaaataattaaaaattggcaataaatataaaaaaattggtgtataatcaaaatcctatatattatcaagtatttcctaaaaaatagttttctttcaaccagaatattaatttaaaatgtaaacgtacaacaaagctttatgaaaaaatatatgcaataattaaaaattaaaatgtaaatgaaaaacattaaatttcaaattaaaacattttttacttagaatactttcaactttgaaaacttttaaatttttcaaaaagagtgtttcatttaaatttcaatacaataataaattatttagtataatgtatgaatcttagtatcaattcaacaaacataaaattgttggtcacaatataaatataatgtgaatttgaatatcttaattataaaaagtaaaaaatatgatgcgttttaattatgagaatgataaaatatatacattcgctcataaattaaatacttccaatataaaaaattaataaaatattaacatgatcaacattttcattgaattgataaataagtatgtttaaaatcaagcattttcaaaaaatatttcaatttacatgttcgttatgtaaataaaggtttaaaaaataaatataaatatatataatataatgtttaaaataataaatataaatataaatagttataaagttgtaaatagataatgtaattaacataagggtctgacaatcaaatttacaagcggtttgaattaattaaatataagtaatagtatcaagcgaaccgaatatgaagaagcctcgcttatttaatacatattagaaaatttaaaaaaattatgtggcaataattaaaaatttttgctgacaatgtagaaaaattagtatcgaaaaaacaataaaaaaacttctcctcattaataaaatttgattttattaaagttcaaaaaaatacaaaaatgttagagaaggaagtaattattgattaggtgtatgaccccacgccacttcgccatcttccccctcccattcccctcattcagttgattattgtgcccaccaatttgacctcccaatttattctctgcatttatttattattttattttcttcggcaaataaacttatttaatttgttatcttcggacataacaaattttggcgcagtcagcaatcaactgcacatcaccggcaacaacaattccgagctttatctcgtgttgatattgctcgagagggaaaattagaaagctcgtgttgatttctaattttcccagatcatcaaaaacttttctctccgtgtgagattaaagtctgccgtgtgcagttctcttcaattggccatggacgcgcaacagctacaacaattgcttaatgcactccaacaaatggtcactaatgccgcaccagcaaatttgagcaatgccaatttggcaagctctatcgatgctcgcctttcggcctttcattacaatccggaggtcggcaccacatttgaaagttggttcaaacggtttgggaaattgatcgaggacgacggaagcacactgtaggaggcctcaaaagtgcgacttctcctcggcaaactcggagaggaggagtacagcaaatatcgggacacgatcagcccaacccagccggaccaagtgaattggaatgacaccatttcgcacctcaaacagctttttgccgagacacgttcgctgttcgtccgtcgcttcgaatgctttaaaattcgacagcaacaagggcaagacatctcatcactaattgcgcagatcaacgcatcatgtgaaaatgccgacctgagtctgacaaaggagcagctcaagtgcattattttggtcatcgcactcaacgatgaacaccatgatttgcgacaaaaggcattgaaaatgttggaggactctcagaaaaatggcaccaacatttcgctcaagaaaattgaggaggaattaagggcaattcaagttgtcaaggagagcgccctttcgctggtcaacccaccaattgccacaaacgccattcgcacaaggccacgacaatgggccgacccagcgcaaagacaaagcggcggctccaatcaaaagcaaactccaaatgccaattcaagcggaaagccaacgcgtggtcaaccgacgcatccatgcggatcatgtggcaaatccgaccattggcgctccgactgcacattcaaggacgccacttgcctcaagtgcaacaaaaaaggacacatttcaacaatttgccggcaaaagaaagcaaaggcaccaccgaacagccaccggtcattccacactgtcaaaatcgacgcaaattgcttacatgtcggcacga

SEQ ID NO: 237 - DNA, 2798 bp, Heterodera glycines
acagtatctcttcttttatttactgtatcatttaaataatacaacaaaaataaataataataataaaaatcaaaataataaataacaaaataaataaaaataacaataataaaaataaaacgaagtgtaaagtacaacaatttcttttctcataatcctgtgttttctccgacattctctaatggtgtaacattggtgaccgatgacttttgtaactgtgtacactaatgcttactgtaatcagcggtcctttcccacgctaatgcatttcggatcgcaattgcttatgttattaacgcaaagctttctcaaacattaaacacactctcgaatattcttgtcacactttctcattcataagccgagtccatccaatcaaaggcatcattcatcatttaatttgtcaatagcctttcatctccttcattgactattgtgtcttcaattcaatgctcattgtttaattagtctttcactttcacaaattaatataatgtactcattcatcttctatttattctttatcatcattcagctattccaaatcccaaatcattcccaaatccattccaattgtcttttcctctcattgtttgttgcccacacctatgacctcagggtcaattggtgcgcttggagaaagtggttgggccatggcccaaaatcataatgatgatgaaatggtagcagtgcgggtggtaaataagaatgtattcaatggaaagacttcgggttcagtccgtttcgaggacgttgataaagtcttgggtgagatagtccgcctagaggaaggcataaatcgtgtccttcggcatgtcaatcgcaaagccaaccgtgctttgagcaacattagtctattgtctggtgaagttaatactggatttaggactctcacaactcaaattgagacatgtgctgaaagggttgacacagtagcacaagtcaatcatgccgatcgtcaacggagggattcgtccctggattcaaatcgtagcgatgatattcctgctcaggacaaccaagctgagaatgaagatggtttggatgatggccacaacattaatgatcaaactcttcaatgggatgaaacaccttttcaacgtgtcaacatgctgactgatggtcctccaattccgttggaagtctacagggatgattgtgtcatcacatatgacaggtgggccaaacgttttcgtgaacacatggaagcctatggtcggaagttggatgaaaaagaaaagttggccaggctggtcatttatttggatgggataccaaagcgtttgattgagaagatggaagatgcaaagaaaacgacgattggtatggccttaacgaatcttcgtgctgagctggattcgccgcagagcaagagtttatcaagacaagccctgttagcatgccgccaatctgatggagaatcggtaaaggatttcttaaatcgattccgtgaagtcgaaattatgatgtcagctcaatcaagcggtatgccgtttctgcagaatgaaagagttattcatgccgttgaacaagagtcaatgcagaatccatcaacgccaagcggtaggttccaaactttgactccaaccagacaggatagattctcttccaacaattatgaaccaaaccgaagaagaaatcaaacgccaggccctcaacaacgtttcaggcagaaattcgacaatcgaaaccagcagagccaatatagaaatcaacgcccgccaaatgacaggagatggaataatcgtccggtttgcaattattgtaagaaagttggacatgttgctaatgcttgccgtaccagactagcagactttcaaaacaatcagcggcctcaatcttttaatcaacgtgccaaatcggacagatggtcgacaactccttttgcctctggtgccaatgctgtccatcaggatcaaacattgtcgctgcttcatgaaattgcacgaacaatgaacaaattgaccgtcaatactgatcagcctggacgcagagatgatgtcaacaccattgccacttcgacagagcagtgccatgtcaagaaagtacacatcaaggataagtcagacatcagtaaatcagagcctttacaagtctcgtcatgggaaaaagcgactttgggtcccaaaattcaccctttcattttcattgtggctatattttgtacttgtggccctgtcttttcaaatacagcaatgattccacaaggaccaatgctatgccaaactgaaacccaacccactctttggaaattaccagaaattcctgaatgccctattccaaaagtgacagtgggacacgtcccaatttctcaaatcagggaattgtatattcctaatgctatcgagcacaatactaaagcatgggcgtgtaggaaaatcatcaaaagagcaagaaagttcacttcactttcgggagtgccaatcacggaggctttaagttctgttatgctggacgtctctgttgatgagtgcaagcagatgattgaacacaggtcatgcatttttggcatccttacagaaattgatggtctgtggggaacctcaaacccaattgacctgactccgagattctggtttattggctccttctcttggtatgaggttaacagcaaaaattgttttgcatttgagacagtaatctcatctcattttttcaataatcaaagcatctgtatctgagcaatggactcaagttgctgatgagttgaaaaagaaagttgtgggagattacagactgacttggctgactctcttgaccatattggtattagtgctgattttggacttcaccctccg

SEQ ID NO: 238 - DNA, 12990 bp, Heterodera glycines
  misc_feature (12914)..(12914): n is a, c, g, or t
gaatgttatgttggaaatggacgtcttgcacgtataattcttggtagaaggaagccaaaacaggacattgaagaaacatatcaagtaaatgaatttccactttcagatatggtccaaactcacgaaatattggaagcaagaggagatcataccaattggccgccttcagtatcaagctttcctcctacttttgcctcatctgatcctcaaaacagcagacctatgggaaggctccagacactcaggaattctttaaaaagcagaaaacgctcaaattcatcgccgtctaatgcacaagggagaattgcgggcacatcagctacaacatcaatcatggtgctgacagcatgcatttctttgttaccacaaacggaggcagtggaccaccaagatgaaatgcggaccactcttttggattggtgggttgcactaattcctgcattttgtgcttatttggtattatttgttgctctgtactgcttgaagtaccttttacacaatagaaaggaggccaaggcctcatatctcacttggaatgaagttgtgtcagaagtaaatacacttcatccatatatggcaactgtgcgtgcctttgtcaataataagcctgtttgtagtctcatggacacgggtgctagtgtaacgctcgctcccatttctttggctcaggacttaaattgccatctttaccctactaatgaaagagtcatttcagcctctggtcatttgattgatgtgagggccaaggccctaatgcacattgaagttgcaaattgtaaaatttatacagaagttaaactggtgaatgatgatggagccgccaaacgcaaaaattacaaactcattattggctgtgatgcgatgaagaaaatgccgccggttacatttgacattgcgaatgccaaactacatattctaaatgggtcaacggacataggcgcagaacgagattggctgttctcagacgtcaaagtggtctgcaatgtctccactgacttgcttccaggacattgcaaagtcattgaaggtaaactcctgtcattttgtgacttaaatcaggtgcttgttcatgacttggacagaagattgaaacaacaaaacattggattcattccaactgtttcagtgtcaaacaatggacacataaaattggtattgacaaatccaacatttgctcctgttcggttgtacaaaggtatgcaaatcgcttcggtgaatcaattgcgattgagtgatgaaggtccatggttaactgaacaaactgaccattcagtatgcgctgtagtcaactccgtcggtgaggtagacccctcattttgcatcgacttttcaaaaagctcggccactggtgataatttaacaaaactgaggaaattatgtgatgaattttcggacatattttcaaaatctcagtatgatttaggttcatgccttgtgggtgagcacgacatcgtcaccaaaacagaagagccagtcgcttctaaaccgcgccgaacaccattcagatttcgtgaagaagttaagagtcatctcgataaatggatcaaagcaggcgtgatggtaaagtctgacactccatgggtctcaaacttagttctggtacagaagaaagatggagggttaaggccctgtattgattttcggaagttgaatgaagttacaattccggatcactaccctcttcccagattggaaatgattcttgaaaagataggaaaatgccattggtattcatctttggacttgtcctcaggttatcttcaaattcgtctcacggacagagcaagcagaaaatgtggcatcatcacggaagatgaaatcttccaaatgacacacatgccatttggccttcgcaatgccacaagtgcatttgctcgagtaatggctcatgttcttacaggtcttgaagatacagtgattgcctatgtggatgactttctgatttacacgcggtctcctaatttggatgatcatttgtctgctctcagacaggtatttttgcgccttcggcaatacaatctcaaagtaagtcctaagaaatgtgttcttgcctcatctcaaatggaatttttgggttttgtaataaatgagcatggctacacaccaagcttaggcaaagtggaaataatcaaagaacttccagccccaacgtcggtgaaagaggtgagaagaataattggaatggcctcatttttcagaaagcacattcttggattctcaacactggttgagccactgactagactcaccagaaaagaggtaccatttgtgtgggaggctgaacaacaggatgtctttaacaaaataaaaagcattctttgtgataaaccagtgctaagattcccagattatcagaagccctttcatattttcactgacgcctcaaatgttggacaaggaggtgcgctgatgcagaaggacaatgataaggctccatttcatgctgttgcatactgcagtcgcactctctcaacagccgaacgaaaatggccaacagtccaaattgaattgggttcaataatttttgcattaagacaatttcgaccattcatttatatgggaaatgttgagctgcacactgaccacaagccattggcttatcttcttcagaaagcagacgctcatccaaatttggcaagatggctcattgaacttcagaactacaacataaaaatcgtccatgtggctggaaaacagaactcactggctgatgcactctcacgagctgcacatgagaacttatccgaagaagaggtaaagaatttaagtgaattaaaggatgtagccgaatttcctgcgtgtcttgtactatcatctgagtcacgcttggtcctcgatgagtcaatcaatgcactcacacttcgttccgatgacggtaagtcttatgtaattaatatgaggcatgaacaacaaatcgatattgaagcctctgcattcattgagtttctaaaatcaggagaaattcctgatgggttatctgacttagaaaaagaaaaattcgctgccacggcctcaaaaatgttaattgattctgaattgcttgttcatcaagaaagtgggctaaggcctaggattttcgttcctgtgtctttgagggcacttgtttttgattcgtttcattcatcacctcttggaggaggccacatgaatcttaaaaagacgctaaagaaatgccgaaaatatttttggccaagaatgcatgcagatatagttaattggactcgtacatgcatcacttgtcagctgaggcactctcctgttcctgcttacagagcagagatgaaaatgccaccagtaaacactctctttgcaaaggtgggattggatttagcaggtccattcccagttacaaaaagaggtaacaaacacataatgaacgtggtttgctggttcacgaaatttgttatatcagttccagttccagatgccaaatcaacaacattagtcaatgcctttctaacaaattgctatctcaaatttggtggatgcactgagttgataactgacaatgccactgccttcacatcagaatttttccgtgaattttgtgcgatgctctacatcagcaaacgctatgcaattcctcattggtctcaaggaacgcctccacagaaaggacctttcgtacttttcacaacatattgtcaaagtacatctcaaaagaccaaccggactttgatgaacacttagaagcggcaaccttctgttataacactgctgttcatcaatcaacgggagaaacacctttctttctgatgtatggtagggacccaatattttgcgttgatcaaattttagacccaaggacagcagacccagttgcttttactgatttaacagaattcaaatatcgtctaatcatttctttaagaatggcatgggcggccactgctgaggaaatccgggagtcccaaatgagggctaaggcccaatatgataaacaaaaccgagttctggatatccaagtgggtgacagagttcttttgaagaattatatctctaaagtaggcacatcaaagaaattccacctaccatggagaggaatttttagagtagtgaacattgatggtgtaaaggtaacaataacaagctgtaatgccccgcaagcaaaccctagggttgtgcatatcaaccaattgaagaaatccttcgatggattaggttgttaggaaaagaagagaagtgggtcacggcccaaaattctgagaatgaggtggaaggagaggaaaagaagaaggatgagggcgaagaagctgagttaaatgaggacgttgagaagaagaaaaaggagtgggctacggcccagaactctaagaacaatgaaaaggaagttgagaagagtggagagaaagagtttaaaaaaagtgaaaagaaaatgaagtgggttacggcccaaaatcattctgaaggcttcggaaacggtggttttggagaacaaaccaaaaaagttgttgaagtgcttcttttggatccggagacatcggcgcagataagagaatatgtggtctgccaactccaaagcaaaggagttgtgttggtatacccaaatccttcgggaaaaaacaactttccgtacttcatctttcttccggatgtgtttgatggcaaatttgaacgtccattgttgcctggtgaccgtgtctttgttgaagattacgcttgggtggaaggaaaagagcatttggacaagtcaagatggatttatgccgaacaaattcgctgtcaagcgacggtcacaaaaattgacaacgtcatttatgccaaacaccacaaagaatttgggttgatcactgccaaatcgctcagaggaaataaagaagtcggtgccatttcggtggttgcgtttggaatgaagagggctatggccctgtatgaacgccaatgtatgcctggacttgagctgaagcaagccattgtgtcggatgtgattgaagtgcaattggcgaaagttgctgaaggttggatgatcggttcgagctacattctgcctcagaagacacccgtgaggcaagggacggaatttaatgctggagcacatggcaagataccggctatggccgggctgtttgaaaaaaattggccaaggaagactgagtctggaattccaatcatcttcccgtttgtgtcagaatataccgaagatgagctcgtaatagctgagaaagtcgtcgcagcagctttaacagtcgcagccgaaacggaagaaatgctgagacttcagacgcagttcaaaggagtagttgggcctgtctgggacaacgtcgacacggagcaggaagaatttcctcgcttcttttggctgcgctttgaaacatcggatcggaagcacgtgaaaaagctggttgatcaatggaccatcgattcacctgttgctgcaagaaaggactacgattccgatgcgtttgctcaaggacaagtcctgctgctgaaaagaagtgccgagttcaaaaacgatgacgctttcttcgtggtacgaatcaaaatcaaattgaacgcacatgaagacaacgacagtcaaatgaacaacttccgttcaatgttacacggcgaagaagtgctagtgcaggcgacgggtaccacgtctggttatgccgaacaagccgcgtgctttggattcaactcgccctctagcatcgcaaaacaagaaactccaagagcagaaatgctccgagcattgttgggacggccgttgaaagataaaagtcggtttgctggtgacaaagttgaggttaatatttgtgatgaaacattggactcgccgacatttaaacgccttaatgaagagcagaaggaatcattgttgctgatggaatgtcaggacccattcatcattttgcagcaggctccgccaggcaccggaaaaacgaagacattggcttcggccattgatctgattgcgaataatggtgttgctgaagatgtggtggtggctacggccacgtctaatttgcccgtcacgaaaatggtggaagagaccaaagctcttggtgtgaatgaagagcttatcgcgttcttcagtggtacggcgaggattcggtatgcagagcaaatttctgctctcgaatcagaattgcttcggcacaaattgacggacacattcctcgcgaaagccaaagaagctggtacgggagcggccccattcaagacgtacaaaaagcaagtggtgaagaacccgatgagagcccaagaagcgaaaattgcgtctcgatatctgcaaatggaacgcaaaaagataatgtttgtaacaacaagcatggcgacacgcatccctgaagcgtcagacaacactacgcatttattgattgatgaagccacccaagtgccgttcacatgtgtcgtgaacatggtctgcatgatgccaaatttgaagaaggtattcatcacgggtgatatcagacaactgggtgtgcatctgagtgagcttcctgaagctatttgggcaggcttcggcctggaatcagtgacaacacaattggtgaagtctcctgctgtgccggagactgttcttcggcaatgttatcgctcgcatggtgcgctggtgaactgcatttcctacgcttcgtacgaattgcatggtgaagaagttgttccggtgggagaagtgacacacgcaagaacggctttgactcactcgacaatcaatttgccgattgctgacattccgctggtgctgttacactctgaaggccgaacaagaacggatgaaacctcgttctctgtctcgaatgaagaccacaacagaattgccagagagcttgtctatactctggacgttaatctgccgaaagaagtgaacataatcgtgatatgtctgtatctgtatgagcgggaactgctcgtggatgagtttgagcatgccaaacaacgaggtcggttgagtcgcaacgtcgaagtgcacacggtggattcattccaagcgaaagaagccgacataatcgtgctggtgacgactcgcagcggaaacaccgcagaacaaacgaaaggacgtttgacttcggacttcttcaaggatagccgtcgtgctactgtcgcgttgtccagagcaagagatggaatgttcctcattggagacttcagaaccctccaggaagggccggtgtggcaaagatttctcaccaaagcgcaagaatttgtgcccatcttcaccgatgaatatcttggtctgatggaatgcacgaaaataagaagagtgaatggcatccttgcaaatgttcatggctactcgccaatcgaacgacttgaagagccaaggcgaaaaagagacttccgcaacccgcgagaagagacgacatgggagacgcagccaagaaagatgtgaattagaaggaaggcctagtacatctgtgcaaaggaatccgaatgagaagccattgattggaaggatgagaatgcgaacgtgtcacaagtgtggagaacaaggacacattgcgaagaattgccggcaatgagaaagagtaagtccgtggaaatgaatggttaagaatgagtgtgaggcccggggacggtccctaaggggtattggaggagaatgaccataaagagtgcttaagaaaacgcttttgcagtgggctatggcccaatacgtattttgaggcctcctgcgttgtctttcttttctcaaaatcttatttttgtccactattgtacctaactgtcttcttccgctttattttctattgtaaaataatacatttaacttttcttaatatgaaataatgactagtgagctacggcccaaaagtattaaaaatgacgtcaaatatttcagcaatggaaaatcacttaattcctggaatcccttttcttcttgacggccaaatcgccataaaattcttcactttgcgatatttcactagcaatcatcatccagcaccgtttgagatggatttcgacgactggggagtgagacacatgcactcgtccgagcaaggatatttcgccttgcgtgcggttgagttcggtgaccgacaacagttcgaacatgttcttaatttggcttcggccagagatgtgaagaaccgaggaaaaagggtacgcggctacagttatgggcattggcagacggtcaagagagaacacatgctgcgcgtggttttggaaaaatttcggcagaatgaaccgctgtgtgaagctttgctccggacgggctttgtccgcctcgtggaagccagcactgaccgatattgggccgccggattgctgataactgatgaagctatacgcagttcaaataattggacgggtcggaatgagcttggctgggtgttgatgcacgtcagagaccaacttcgaccattgccgcaacaagtccacctgatccacaagcactacgtcgtttgccaggcggcagcgcctgactacgttgtggcactcgcagctgagccacatgttcagccgtatgctgttcggattaacaacgaaactgtcaatgctgcccgacaactgcaaattggcgatactctggtgataggaagtgtggagtggagagaaggttttgagcagcttggggccgaaggaatgaacgacagaccgtgttgggtacaccaggccagattcaactggcaagctacggcttcggccgtgtacagtgtgtgtatgcaccagtgggttcctgccagagcaaagatccttcgttgtgttcgtggggggccaagacacaaccgaactatctgctcaatacgcatccagttggacggcatcgaatttgtattgacacagcgaaatgtcaatggcaacatcaacttggcacaacagggccaatgggttgacgtgtcggcaattgtggtggcagagcattggcacgcagattggggattcattttgcccccggacgctgtgtttagagggagacaccagattgtgtcggatgggcgtgtcagaatcccggtgtttgtggggtgatgcggggacgaagagaagagagtacgttgactaaaagtgtattaaacgggctagactagaccgcttgagaaatagccattttagtgagctaggttcgagaaacaaatagaaaatgacatgcaggcttcggcctgaaccataaaattgcagaaaaagagtcggcaggccacggcctgaatttaattggaaatgatgagagaaatgtatgactgtcaaatatattacggtatcaaaatttaggagcgcagaaggaagttgtttgggttgcggaggacgccgtagggtccgcgaagtcgaagaatcgtgagcgaaaaaataatcggacaatttatgtacaaataaattttctaatcctttcagctgttctccgttcccatcctcaacaacctcgccctgtcatggaagactacacgaccaacgccgctgatcaccgtctctcgacaacttttcaatcacaatttgcatccacttcaggtggatatttaataagatggaaatattattgatttatttagttgaataattaattaaaaacatcaaaattcaaaattaatggaaccatgggacggttcccggttaaggagggaggtgtaaggcgtaaaagggatcagctaatcggagggaagggccgcccctcccgttcactcccggggcccctccttataagcccgggaattccttcccaggcagttgagtcgcgacgatcagctatatcctattcaattccccatccatcgatctcgtcccccttctccagcccagggagagctcagcgcgcgggctacggcccgggatggacaagaggggatccgtgggaccggcacaactctaactgatttttgcggcaaccaattcctgaatatttttgtcgaaaattcaaaatattctatcaaagcacttttatgtggtatttttaaaatgtaaaaataatttttaaatttctcttaaatgtagcaaatatctttttgagtaaaattaaagaaaaatacttttggccccgagtttggcactttttgccaaacttttgtggaatatttcaattttctaatgacagagaaaaggaatgtatctttttaataaattaaaagagctcggagtcgcgagcgatgccaataggaattaccgatcggaaaattattaaaaatattcgctcgatttgttactgcttttgcaaaaaaaaaaaaaattggccagttttgtggatttttaggccaaaaattggtatttttatgaaattattcaaaaataattgaaatatttatgcataaatacatgctagcaaaaaaggtattaaaggcagttcatttttgacagaacaatccgtggttttggttttaaattcgaaagcaaaacaattggtggatggatgaaggaaatttattcaaaatttgtgatgggatttcttgccaaattgtgccgtgcccttctcttccgctccctttctgtgttccgttcgttcattcgtccatttctttcagctccacaaattcgtactctttctccaattcatcagcaggtggcattttcgtggaagagcgctaaaatagcttgggttttttctttgggaaaaatcaggtgaatccgattgaaaatcctgatatcccaatcacaatctcggtttttttttggtccaagtcaagcctggcccgatgtggattttcccaaaaattctgagctcttgcgattctataaaaaaacaaatacattttacaaaatttcaaaggtttgacatttttaaaacgattgttccagtatttatgattcttcctttcaaactatgaggaggctctatttagggggcgggagaatttggaaatacggtatactcttgaaatttatgcaaaatttaaactctgctgaaagcgaaaattgattttttcaaagacagaaatttaattttttatgccttacagtacaaaaccaccgcccaaaatggaaaatgctagtggatacggtacattctgtgcctgctgttgctgctccaattgttcgagacgagcactcgcagcatcgaaaatttttttcgcatcagccataatccgtttttgtgctttgatctcctcgccaattcgcttaaaaaacaaaacttccgtctcccacgaaataaatttgttttacttccggatgatcaggcactttttgctgtttctttttgtccctttgttgccgatttacgaaccaattgccaactgaaatttttaataaatattttttgttcaagttttagtcaaaacaaattgcattgactcaaaaatgccatttatttagttaattattcattgagtaccagagtccctattcttaaatcccgtttttggcatctcggtctcgcgtcaagtctcaggaaattttcggcctcaactaattaccctgctttgactcattaacgaattgccatgcattgattaattcactaattatcctgcacttatttattaactaatcacccggcactaattaattaacccatcaccctgcatctccgtaaggcctgtctcttgcgccagctgctgctcctttgccgggctcgggtaggcatcagtcaggtaattctccatgagtattttccgctgtaaaattgcattccatcaaatgcatttagtccattaaattttaccgtattatcattaaagcaatgcttttccgggtttgccggaggcaatggatgcttcttgcgcactctgtacttgtccactgggccaagtgggcttaagaattttatttttaaatttaaatttccaaaatctacccccccccctaatttcacctcttcccccacatttgttccgcctgctgataatgcgcatcattccacattttcagcagctcctttccgttttcccatgtgattctttcttccaaaatgagataaagttggtcgaaattgctcttaaaatttacacgaaaatgtgcctaataaaaaatgcccaccgttcgagggggtagaaaaataaagccctcggggggtgtgggggagagtttctattttaggagtacggtaacgtaattgactaccaaattttgaaaatttttctgcttattcctcccactaccgtatgtccccgctttttcttccactaccatatgttcccgcttctcctaataccgtatgtccccgctttttctcccattaccgtatgccccgctttttctcccactaccgtatgccccgctttttctcccactaccgtatgtccccgcttcacccgctaccgtatctcccagctttttctaccactaccgtatgcccacgctttttctcccactaccgtatgttcccgctttttctcccactaccgtatgtccacgctttttctcccactaccgtatgtccccgctttttctcccataccgtatgtccccgctttttctcacattaccgtatgccccactttttctcccattaccgtacgcatgggaaatgttgagctgcacactgaccacaagccattggcttatcttcttcagaaagcagacgctcatccaaatttggcaagatggctcattgaacttcagaactacaacataaaaatcgtccatgtggctggaaaacagaactcactggctgatgcactctcacgagctgcacatgagaacttatccgaagaagaggtaaagaatttaagtgaattaaaggatgtagccgaatttcctgcgtgtcttgtactatcatctgagtcacgcttggtcctcgatgagtcaatcaatgcactcacacttcgttccgatgacggtaagtcttatgtaattaatatgaggcatgaacaacaaatcgatattgaagcctctgcattcattgagtttctaaaatcaggagaaattcctgatgggttatctgacttagaaaaagaaaaattcgctgccacggcctcaaaaatgttaattgattctgaattgcttgttcatcaagaaagtgagctaaggcctaggattttcgttcctgtgtctttgagggcacttgtttttgattcgtttcattcatcacctcttggaggaggccacatgaatcttanaaagacgctaaagaatgccgaaatatttttggcaagatgcatgcagatatagtcaatggactcgtacatgcatcac

SEQ ID NO: 239 - DNA, 1420 bp, Heterodera glycines
  misc_feature (1350)..(1350): n is a, c, g, or t
  misc_feature (1408)..(1408): n is a, c, g, or t
ttatgaaaatttattttccaacgtgggtttttcccccggcattttttaaatttctctagccatacagacaaatattgtaggggaatttgctactcgccccatgaattttcgtttccttatttgttcgggttggagaagaacccaagataattcttgctctactgttcataagcaggaaagcatttcagggccccaaaaatttttagaaaaatgtctcagagttttttctaaagataaaaataacactctcacccgaattctactaccataaaaaatgtaaaaaaaaaaagatgaaaaaaaatttttaaaatttttgagtgcaacaggcgacattcacacttccccgatcttgggaccaactctactttaatcacttaaaagaccagcattgcactttttgaccagtgaaattaaatattaggccttaaaacccaaaaacaaagttttatttatttttgcagtctccattccatattttcagaaaattttttaaattttgttacgatatttcttttatttttcatgaaattgtccgcaaatgtccgtccgcaaatgtcccactgcgctccaaaaagttatcccctcgtatttctccaaaatgctgttcaaattcggatctccgcaagggcgtagcgaagggggcgggggcttaggaggctaaagcccaccgaaaccgaaaaataaataaatgaatctcgaacatttattttctggcacagaagaagcacaaaatacgaacttgtataatgaggaaattggcgagtgtgttcagtaaatgtacaataagtgccgaaaggagtgcctgggggtgaaaggacaaatgccgaattattatcattgttatttttttctacaataagtatgtataatgaatgagcaaattgatcagggtcacatcggcacgtcactcgattgatcatcatcagcgttcagctccgttagaggcgttcagtcattggcgtttatttcgctcctttctgggtgcccaaaaagcctaaatttttttacagtttttaaattttaatttatatatcaaaatatttgtcaacactgatttgaacgtgtgcacttcatcctgaccctgccccccacatcccccgaaatttcaaaaaatgtatcaaaccctaagaaatgtcaagtttttcaaaattatcagagacacaggctgtttagtatattaaaatttttcaattttttccattcgacccttctgtttaggccgagaaacaaaaaaaaattttttttttgaggcttaggtggtattttctctcaccacctacgctcaatctaaaaagaatcatttttcagacactgcaagctgctgctgcccgatcactactccattcggantaagtggtgagcaagttgattttttttgaaaaatatgaggagtgcgtgcgaatctggngacctccctccc

SEQ ID NO: 240 - DNA, 4419 bp, Heterodera glycines
gctcctttccaccacaccccaaccgaaaatttttcaaaaaaaaatcataccttaagcaactgtttgcggtgtttttttgccctttttcagtgccgtgttgatgtagccttgtcggagcagcgcgtaattttccggcgtttggcgcattcgtgcccatctggggctcgtttcggccagctgaatagaaaaaaatttttttttttttgcgttcaaaatttttttgtttaaagggagggatccggctgtagcacgagagacgaggtgctcctgcccatccccgccccctccctcctcgttcgtcgtagggggccggtttaaaagagggggagtcgccggtaaagaggggggggggaagtagcaaaatttaacagattcaccaaaaaatggtgattttttcaatttcgaaaaaaatgcatgcatttttaaggaaaatttcagcaaaaaattctaattcagtgataaaccttcgcggccaatcgcttccagtcatccctgtccgtgccatcgcccacgcatttcgagaagaaaaccaattccgccgtcttgccaccgatgcacatgaggatttggctttgagttgtctgcgtgtgaagctgggcgcttcggtgtattgcaccgagccctcatttccatcagcgtcttttacaatggtaatctgtttaattataataattaatcctcaaataaatccacttttttgaaatcccaatttatggcgccaatggcatgcccaggcggagccgaggccttcgagttttcaaaaaatcgcgtttaattttgaaaaaaattttcagacagtttatgggtttggtaaactctcagaaaaaatatttttttccttcccatttaaaaaaagaaaccttataaatgtgtctatgcattccatcagcttccacaagaaccaaagatgacccagttcatgcagggtggtgcgggctttggtaagtcgccccgttcgttcgcctctttccatgtttgccttttctcgtaccagcgtcttcgtcgttgcgctttttgtcgttcagttagagctggcatggttagtgataatttgttaaaaaataacagaattgtgccgatctgaattcgcaagcaatatggcaagacgattaagcaacaaaacacaaaaacaaatgcttaaagatgcaaaaaaacacttttttgtttgtttgtttttttgcaatttacgacttgggtagaagcgtgacatcaatactcatttttgagtgtcagaaccgtgtccggtaatcccgacactgggtaatttagacactacaatttcgacactgagtattttcgacactgagtaatttcgacactgaactattttcaaaactttcactgttttacttcattttcgacactgagtattttcgaaactgagtaatttcgacacttaagagttttttgaaaaaaaatcatgccaaaatttgaagattggtcaaaaacgaaatataaataaactgcaaatacatagatggcatcggttcgaatttataccttgttttttagacagctgatcaagggctttcgaatgataccaaatttgttcgaattttaccgttttaaagggtcaagggcacctttttcacacaatttttcgagttttaaaccggttcaaaaaccggttttttggcatttccgcaactcgaggcatatttttccgtgcttagctcctcgaggcgaatcgattggtatataatttgaccccttttttcacggggcgttcactacagtttatccggtagaaaaactccaaaataggtattataaaagtcatcgtagacatcccaaaccaagtggaaaatgctttttcgtgcttatctgtgcgtattaagttcgcaaattttatgtatttatctaaatttcccagccctaacaattacctaaatgtattcaaacaaagaagcagcaattaacatgaacatcaattatccgatcaattcccattcctaatgatcaaccaccatttgtcatttcccaataattcgttcattcactttttcttccgctgtccgctgggcccgggtttcattttcagacgatttgttgctttcttttggcccgcttttggtggagacaattgcctaaattcggctaagtgcaattaaaattgattattattatagcaaaagctaatgccatgccactcacccaatcgtatgaaacgaaagctgacattgttcaaattttcgtcctcccattgaattgtcttcccaattgggcatcgcttcaacagccaataatcaatgtcataatcatcatcttcgttctcttcatcatccttttcttctttctccaatgtcagcatttcgttggtccgttcgttcgtcaattcaaatggcgcattctccgccggttcaaagtcttcaagtcgaattatgtagttggcagaagtggtggtgatggcacggagaaatgcctaaacaatggaaaaaatgaaaagcaaatggcaattaatacaaatattttattgaaaatatgggcaaaagtgccggtggtagcgcctctttttcgaaaaaaatttcaagtttttttttctcgtgataaaataattagaccatttttttagaccaaaaatccgaaatcttagaatttgaatttcacacacctttttgaacccgttgatccatttgatatttggtggttctgaagcatcacgacaactcaattgctttggctttctatcttttctcggcgtgttcaaccattttgacagcgcttggccagcagttgcatttggtccatcatcagcgatcacatcgggcaacaaattgccggaatcgattgaattgatgttgtgatcagtgagaattgacggcgaagtgtggcgaatcaactcttcaagatcatgagcatcaaaaaaattcaaattgcgaatggttggcgcaaaaatgggccaaatttcatcagcaattacattccaaattggctggacattcttggctttacgggcgtaaaacaaatacaaatacaaatccaaattggtgcctttgtcaaaaatttgctgattggcacggagaaatgtgatgacggaatagtcaatgtaactgaaagggaatgaatcatttagcattttttgaattttgtttggatttactcgattttaaggttctcaaagcggattttgtcgggcatcgaatggtccggcaacggaaatgtcacaaatttgccatcgatctgcacagacagtttcgcttctggttcattgtcctcgttatgaatgctaatctcattccaaagcgtcaattcgcttttgccgtcgaaatgtttgtccaccaacgcattgaaacggggcgaaagcaatgccaatttgagaccaagttgggcacggtcaaaaaatgggagaatatccatcaaaacatcgttgcacacccaactgaaaatgccaaaaattatttggcctagaaatggaaagaaaattcggcacacattttcctcaaagttcgacaattctttttgatggccacgcggagactttgccgttttccagaagatgacatcactgagcccaacgtttgctgctgttgctttccaccaattgttgcagcagaagaagaaatgaggcgatggtcggcggaggaatgcttttgcttttttttgattggcggtgccatttaaacaaataatttagcctaaaataaataaaacttttgaacaaattagcacaaaaattaagacgtggattatggattgagtaaaaaactattttgcggcatttagctgagcacgcttccaattaattagtcatcataaattatgattgcaaaacaacaaatgacattaactgtcaattttctctgcattttatatcaatttttcacaccggtactcaaatatacgctaatatttttgtataaaaatgccattgtttcttctttcctcctcattcaacattcattcattcattcatccccccccccattttttatccaattttgagtctgttaggtattttattttttataacaaaatttttattgacaagccaaaaatagtttttaaaaaattcacatgccaaaaaaattgttggcaattgacaaaaaccccaaaattcttgaaaattgttgctaaaaaatcgatcgaattcaaaaacttttggagaaaacgtggttttcatgcttttctccagggcttcgatcttaaaattttgaaaatcctcatttccgccataaaaatcctcatttgccactaaaataccccaaaaaaatcttcatttggcatgaaaaatcctcatttttaaaaacatcataaaattacgaacaaagtcagttaactgtcatatttttcgtttgaaacaatcacagcgcctatcagcgccgccggaccccaataattcctattttttcttaaaaaattggcctaaaatcgcaaaattggtaaatttttggtaaaaatctataactactcttatttaaa

SEQ ID NO: 241 - DNA, 2103 bp, Heterodera glycines
tttaaattgctctttttgtggcgcagttttccaaaaaactttttggtgacattgtggggaggggtccggcagtgccgataggcgctgcccgaaaaaaaatttgggattttggagtgcgatttgttaacagattttgtcaaaaaaatgatttgaccccctctatcgatacctgtttatttttttgaataaaattatttaaaggaaattaattaaaatttattgaaaaatgaggatttttcgagaaaaaaagtttaagatttgaagaaaaagtttgaacattttggcaaatatgcctaatttttcaaaaaaaatcatgcttttttgtcactttttttcaaaagatcacaaaaatccgcaaatcctcatttttcaaaaaaatcctcattgaccctctaaaagaccataaaatgaggaaaaatcctcgcatatcgaagccctgctttcctcatcaaaaactaccacaaaaaaggttaaaccctaaaaatcccaacccttcttttgtaaacacctcccattccaatgtttaaaaatttgttttttttttgataccgagccgaacggacccggttttactggatccggtaaaccggtccggcgaattttcgaaatcccctagtatttttttcatacaaaaatttcatttaggcaattcttattattattatttttaatggcaccgcccgtcacaaaaaagcaaaaaatttcctccgccgacaatcgccgcctcatttcttcttctaccgccgcaattggtcatgaaaagcagcagcaattgatgggttcacttgtgacagcatttggcaaacggcgaagtcttcgagtggcaaagaaaaagaatcgaactttgacgaaaatgtgaaaaaaccgaaaaccccaaattttcagttttattcggttttacgcgtccgtcccatgaattcttgggccataacttgtttcttacttaatcatgcttcacattcttggtaccaatcgaaagcttaaagtctcggcaatttataaatgcaagaaaagatcaaatcactggcattaaaaagaaattacaaaactttttcgataaaaaatttttttttattttatttacaggctttaaactttcgtttgataccaaaaatgaaggctatgataagaaactgaggacattggtcattcatggaatgcgtaataccgacaaaaaccgaattcttgtgttaaattaaccgttttaaaaaccgttcaatcatttttccccgcattttttagctggatttgtaacgacgttttgatggacgttctcccattttttgaccgtgcccaacttggtctcaaattggcattgctttcgccccgtttcaatgcgttggtagacaaacatttcggcggcaaaatcgaattgacaatttggagacaaatcagaatttcaaagacacagcaggaccatcagcaggccaaattttctgtgcgcattggtggcaaatttgtgaaatttccgttgcccgaccattcgctgcccagcagaattcgttttaagcaccttcggattgagtaattaaaaaattgactataattaaaagcagctaatgtaaaaagtatcattttccggagcagcttgttgcccccccccctcaaaaaaaaaattcaaaaaaattggaaatttttctataagaaatttctcaagaatttttttttttaatttctaagtttgaaataggcacccccgtttcaggtacattaaccaatccgtgctcgaatttttgcgctcaaacaaacaaatttttgacgatggaagaggcaccaatttgtggttggacgtgtgcaattatgccaaaaacccgctgatttgggattttttggtccgagaaatttggccaatttttgcgcaaaacattcgccagttgaagtttctgaatgctgctgatctggccaaattgcggtgccgaatttcgccgtcaattctcaccgatcacaacatcaattcaatcgattccggctttttgttgcccgatgtgcctaatgttgatcaaaataatcaaccaaaaaaaactgcaactgctggccaagcgttgtccaattggttgcacacgccgaccgccgatggccaacccaagcaatgtttttattcgc

SEQ ID NO: 242 - DNA, 2641 bp, Heterodera glycines
  misc_feature (93)..(95): n is a, c, g, or t
  misc_feature (98)..(99): n is a, c, g, or t
  misc_feature (106)..(106): n is a, c, g, or t
  misc_feature (110)..(112): n is a, c, g, or t
  misc_feature (115)..(115): n is a, c, g, or t
agtttctgaatgctgctgatctggccaaattgcggtgcccttaaaagccgccaagtctcaccgagcacaacaggaaacccctaaaaaaggctnnnggnntggggangggnnnaangttgatcaaaataatcaaccaaaaaaaactgcaactgctggccaagcgttgtccaattggttgcacacgccgaccgccgatggccaacccaagcaattgtttttttattcgcctattaatggcccagaaaaaaaagaatgggtcgacagattcaaagaggtgtgacagggagggagcagcagctcgtccccccccccctcaacgcccccgattttttaaaattttttggaaagttttcaaaatgaaaaatcagtaattcaccatgaaaaaaaattctttttttacttattcaaaaaactcagaggtgtgccaggaagcgcatgtttaagcgagttttggaaaaagattttagaaaaatgaaaaatcggtagtgattcacgatgaaaaaaaatttttgtttgaattttattaaaaaactaagatttttcttgaaaaaattctacattagcgagtcttttttaacatagtgcacattttcataaatattattcaattgattgttgccaatttgtgttggttttcattttcacaaatttgtttagcaatttcgccgtgccaccactgccgtcagctacaaaattcagtttactgcttatgcgccggcgtcaacatcatggtgccatttgaattggtgaacgaaagaacccgggaaaagctgacattgaccaagccagcaaacaaccgatggataattaaacgatgccaaaatggggagacgacgacggcacaatggacggaccaaaattcgaacaacaatttgaacaatgtcagcatttatttgaatggcgcaaattgcatttggtgagtaaaatttgcgtaaaattattaaaaataattcgaattaaaaaatcattatgtgagggcccttcaattaaaatttaattggaaataaaaaatagattttgacatttctttaggccattgttgtccactccggcgacgcgaaaaagcggcagaaaaaggacgtcgaattgcgcggaagtgaaatttaattgagaaatgatcggcttattggggattattgttgtgaatggacaaattgatcgatctgctaatccattgttgatgatgattctttccgacgaaaatattttttattatttgttttcacttttgacattaaatgaatagggctgctcaaatgagggctgaaatccccagaaaattaaccctcgtatttctccaaaatgctgttcaaattcggatctccgcaagggcgtagcgaagggggcgggggcttaggaggctaaagcccaccgaaaccgaaaaataaataaatgaatctcgaacatttattttctggcacagaagaagcacaaaagacgaacttatataatgaggaaattggcgagtgtgttcagtaaatgtacaataagtgccgaaaggagtgcctgggggtgaaaggacaaatgccgaattattatcattgttatttttttctacaatatgtatgtataatgagcaaattgatcagggtcacatcggcacgtcactcgattgatcatcatcgcgttcagttccgttagaggcgttcattccctgcgacgagtcatcagtcgcgagttcatctgtctgttgatgaaatgggggcttcattgaatcaattagtgtattaattgcggctctaaatgcagttcatcggaccatgaaaaagagatttagcaaaaaacaatttggcaaaactttaaagcaccataactttttcaaaaatcactcaaattaaatattcttggtatcattcgatagatgtaagaagcctctgttagtatttgcaaaatttcaaaaaatttcattgcggttcaaaaaaataatgatcaaaaatacttataaaaccagttttttgaagttttctgttcataactttttttaaacataacaaaatttattgaaattttgaacattgatagaggacgcttagatctgtcgaatgataccaagaatgtttaatttggacgcttttagaaaaagttacggtgcattaaattttcaaaaaattttttatggtcctgtgaactgcaatagagccgcagaagcagccaacccacctcatccaatgcttgttgtgcttcatcttcgactatacgaattggcgtcaatgtcagtccgtaccagcggtccatggaacagaacaaagcgcgattgaacatgcagaaaatacgggggaattgctaaatggggggagggaaattggcgatgcgtttagaaaggggacggcacaaaatttcgccgcccgaaatctcgccgagacaaaaatctcgccgcataaatctttaaaagcttttaaagttacaattagaattttatcaataaattttttttgaaaaagtttcaggattttttttttgaaattttatgataaattagttagttttttcgaaataaaaaaaaattccaatttttttctcactttctaagcaaaacacacaccaatatttaggtttttggagtcgctgatcacgaatccggcatccatttcgaccaatttcgaaccccagacccgaactcgagcaaaagatcggaaattca

SEQ ID NO: 243 - DNA, 1277 bp, Heterodera glycines
  misc_feature (6)..(7): n is a, c, g, or t
ctgcannggtcggaaaaaaattgaaaaatatttatggggccctaaactgcatgagccgaattttttttgaaaaaatttttattttttaaatttatccggcgaaattttggggtgcattcgtttggaaattggtggacgacaaatgaatctctctcatcagctcatcacaccttttggatgaaagactccaccacggtttggaagccgagccatttgaacttgacggtcaccaatttgtaagcgcacatgaacggctcgcagttggtctgccactgtcccgtcaacggaccacggcctgtgcacaccgaacggaacgtggacggtatgctgtcttcttgaatgtcctctgcactcagaaactctgtgtcgttggcgatgtcaatgcgtaccatcttcttgcattcattcagcgcttccttcgtcagaccgaacgcctgaaaaattttgaaaaaattgcggacaagacagaccgtttttgtgcgagccgttttcgcgcgggcccgagtttttgaactaaatgtataacttttttcattgtcaaccaaatccaacaatcttggtgtcattcgaaagcccttcacatgttctattagcttgataaaaagcaaaagattttatggtctgcaaaaaagtaattaagaatttttttaattcgactttttgcattttttttttggcaattgtcgaatcgccaagcaattgcatagatacaattctaaacatggtcagctttcgaatgataccaacattgaattggatttggttgacaatgaaaaaagttattgtccaaaaactcgggctcacgcgaaaaataatcgacaatttggtgatggatgatgatgattgatcctctccatcaaacatacgttttttgtgttgccacgatcgctcaaaagcattgtttccatccggatcagaaagttgtccttcatgaagtccgggttggtcagctcctctttccagtacgggaaggcgttccacactttttcatgcacattcattgaaccctttggcaaaagccggcgcagaagagagggcagcttttttctggaaaacgcgagcgaccaattagcattgattacacatttcatggtaacaatactacagccgggtggtggcccccattttttgaatttggcatccatttttctgccaattccgaccccggacccgaattcgaacaaaaagccgaaagttagaaatttagcattttgattcataaaatcggtttaaaacatggaaacaaaacttaagcgccatcaacatgtaataaacga

SEQ ID NO: 244 - DNA, 814 bp, Heterodera glycines
aaagagatttggaagaagaattatgcaaacttgataggcgattatcccttgaagagtataaaaaaatgcttaaggatcttaggaaccgttagtcaaatatcataatggtaattattatttgaaaatggggctttcggctttttgttagaattcgggtccggtgttgtcgaaattggccgaattgaatgatgccggattcgtgttcagaggcgacacctctaaaaacgctagcgaccaattagcagcagcattcattacatttgattacaatccctcgaaaactcacgaattgaaatggtaaattttgtgcgaaaagtgtccggatgtgaatcggccattgcacagattttggccttcaaacggttcgttgtcgcgcaccacttgaatgcgttcttctacatcgccactctcctctaactaaaaagggaaaatgcacataaaccgccgctccatcaaacattgcttcggtaatagttaaaatttgtccacccccagcccattttgaagaaaaaatttgttttaaaaatctgaaaacacatttccgaagggtttcgggttcattgaacagtaaacactaatccggcactcattccgaccaattctgaatcccggactcgaagtcaaacaaaaagtacggtacttttcggttttgtgcctacgcctcaaaatttttaaaaaggtcaacaaggggcgcgctgaagggactttctaccatttccatagcatagcacaaaaccgaaaagtaccaaaagtacaaaactcgaattttgaatggaaacgaactgagtcgtcagtgcttcaataaaagaatcat

SEQ ID NO: 245 - DNA, 5054 bp, Heterodera glycines
gttcgaattcgggtccggtgttgtcgaaatcggccgaatcgaatcgatgccggattcgtgttcagaggcgacacctctaaaaacgctagcgaccaattagcagcagcattcattacatttgattacaatccctcgaaaactcacgaattgaaatcggtaaattttgtgcgaaaagtgtccggatcgtgaatcggccattgcacagattttggccttcaaacggttcgttgtcgcgcaccacttgaatgcgttcttctacatcgccactctcctctaactaaaaagggaaaatgcacataaaccgccatttccatagcatagcacaaaaccgaaaagtacaaaactcgaattttgaatggaaacgaactgagtcgtcagtgcttcaataaaagaatcatttaagaaaaatttgaattttcgaaattttttgttcgaaatcggacacggcgttcagaactggtcgaaatgagtgccggattcgtgatcagcgatccagaaaaccatgggacgcatgttttcatgacttttgaaaacaaaaaaagattttcgcgccgcaacttcatccaacctgtcgcgctccctcctccaagcaaaacgattgggcaatttgatactcttcagtggtcaacggcataacaatgcgactgaatgaaacacaaaagaatgagtgaaccaattaacaacgtaattaattaatgaggtgtcaacagaataatgacggaaaaacaaaaacaacaactcactattctctggtgagcattgttgctgaagtgcagtccaaaaaaagagggaaaatgaacaatgaatgattgtttctgtccgtaaaccatcccttttatactacacactttgcacgtcgtcattgctcagcagcgacaaaaatgaattgtcatacctagtagggatggcattcggaggccccaaaaaatttgggaaatcggaaaccgaaattccgaggcccaaatacttctcggaagtcggaaatctaaattctgactctaaaaatatcggaaatcgtaagtcggaattccgtgccatccctgatacctaccgtatttactcgcgattagagcccccgggggctctattgttcaacccccctccgaaatggggccatatccgcttttccacctactatgatctgcatacactcagtttgaggatataattttaaagatttacgtttcttaattatgaatgaaataagttaaaaaaattttccggttttcgtttcgtttcgtacgaaaatggttattttttcgttttcgtgcagccctgccacggtgctatgtcgttataaaaaaagccatcaaaaaaggcgctaaaaatatgcatacatttaaaaattcataaaaaatttatagaatagaattcatgcgagcttttcagaatatattaagaaggtgtaattttcccggcgccgcctgcctaaaaattgcgaaataatgcgaaaaatggtaaaataggagcgaaaatttgaaaatcagtgcgttttttcaatgaaattaaaataaaatcgatgaaaataacttattgagaaaattaattacaaaggaattaaatttcattcttttttcgaagcaaaaaaataattggggtttctacagaaaattctttttttttcagttttttgttagtttgtattcttaattattttttcatatctttgatgaacctattcaatgttaagattttaatggttaaaaaattgaatgtcaatctttgtgactagtaattttttcgaattttcaattagttatttttgtcgatggcttatagttttagtaaaacttattgataatagtggaatttttatgaatataatatttttgacagcgcggcgcaaaagtccatttttgctgggcggcgcaaatggagcggcgcaaatatccgcggcgcaagtgtctcatcacgttcagaatatattaagaaggtgtaatacacatgtaaataaaatttgatgcgtttcagagcactttctgaaaaaatatttatgaataattttgcaaaaaataaaataaaataacgaacctcccttaataatttttctgcgcctaacaactaaggtactcacttggccgcttcgcggccccccatgaggaaagggacagaaataaaaccgtaatataaaaatttaatattatgatcaatataattaactgaatgatcttctgtcaaatgactcagctgatgaacatcatggaggactacttcaagtaatccataccaaggacggtatgaaattattttttggtttttttcccattttcaaattcctcccaatgtttttcagtgataaattcattaaaaataccatttaaatttgtaaataatgtttgccatatttaatccttccctttggtgttcaggtggagtcccagttgccggagaagacggagtacgtgatcaaatgtgacatgagtgcgctgcaacgcctcctctacaaacacttgcggaagggacgactgctcattgacagcaaacatgtcagtgaacaattacacgactttttcaatttaattgcattttttcatacaaattttttttcatccttggtgacgggggcgtacatttatgtatttccaattatttaccacctctattgtatttatttgatcgaccacttttgatgttatatatttatttgagtaattaaaacgatttaatttatgttttttgtatatatagtattccacgtaaattacgtcattttgcaataaaaatatccaggcattcgaagatttcgcacttcgcagctaaaattgttctttgaatattgaatggtaattaaaatttaaataatttccagtcgctctttctagaacgtgtacaaatagcgaaagatgctaaatcagcggctttttttcttaagctaatttttcagtatcccttgagttttgcgcctgaatttttgatatttcaaataatctcatgtaaaaaaatggatttaaatcaaaatttaaaaaatggctttttgttggcataaaaaggcagttttgtgggctctagtgcactttatgagtccaatcaattgacaatcccgggtttttatacaataactttttccatgttcgaaaatgatttttcattgaaaatctgttaaatatatagccaaaatttcaaaaaaatttcccggcggcgcctatcggcaccgccggatccttaaaatcctcaattttcttaaaaaacttgctcaatttgcaaaaattggtcatttttgaacagaatctaacaatgtaatgtattaaaattttcaatttttttcccggcggcgcctaccggcaccgccggcctccctcctcctccttggtcaccaaaaagttttttcaagaaatacaccgcaaaaaattttgtaaaattaataaagggagtcaaaaatataaagttaataaatgttttgttcgaattaattataaaaaataatttatttaagcaatttgaaaaaattttctgatttttgactcaaaataagatttttttatttcaaatttctcctttataaatttttccatatatttttaatttaataaattgattgccctttaaatttgtgcattaaaaatatttatgttatataaatcattaaaatttagtaaatttaacaacccttgtgctcaaaaatttctatgttcttgaaaattaaaaaatttttatatggaaacctcttattatttagtcaattcttacggttgtttaaacgtagaattaaacatgtactggttatggacttagaccctgaataccggcttagttgggcccgaaatgacaagagacccatctaatactatttaaatttataaattttaaatcttgaacatactgagccttgtaatgatacaaataatacatatatgtaaggcattttatagaatgaatagtaatcagtttagcaaaataagcatgcttaatcgagtgaatattcattaaaaactttctattcgtaacttgatcaaatttactatgcttttaaattagatggttgcaatttatagacaattaaaaataattttattttttaaatccttaatttagtgcccaaacttccgccccccccccattttactcagaggtgatctttcgctttttctattgataaaaatggtttgttgtttttttttgggaaaaaataaaaaaattcaaaaaaaccgaaaccgaaacggtataccgaaaatttttcttcggttttttaaccgaaaccgttcgaccgagaattttttgagtttagaaaaaaaaagttaaacaggatgaataacttaaattcctgaaaactcagaagattcccatctctttcataaatatgtattttaaaaaaccaatgaaatatcatttttttaagctattatgtgaggatttgggattaataatggagttttaaaatagttttgtacgtgaggacattttcccgactcgcaagtgccgccgactgaacataaaatggacaaaagattaattgaattgtcaaacaaattttgtattattgcttgtaaaaagacaaatgataggcatatgaataaaaaaatattcttttgggatttgcgaatgatttcaaaaatggactaaaaaataacaaaaattgagtgagtaacaaattgaaatggaaaataatcataaaatttgagtaaaaaaaaattgaaggcaagtgaacagaaaaagaagagagattcgtagaatttgttgaacaaattatttgaatgagtaaaaagggcaaatgaaataatatttgaaagcatttaaaaatgagtttgaccagcaatttgctggaatgcaaatgattcattttgtgagaggatttcaaagagatttcgttgcatctgttcactggctgaagaagttggaatcacattctgaaaaaataaagtaggtttttactactggaaaactaaaaaaaaattttttttttttttcactaaaaattgacaattttggacaagtttttttaatttagtggaaattaaaacaataagtccgggaaacttgagaatttttaaagaaattttctaaatcattgccaattgtgttttattttcaaattatttgttgttttttgacctgca

SEQ ID NO: 246 - DNA, 2794 bp, Heterodera glycines
attttgtcactatttcgacattttttggaaaattctttaacaaaaatgcaataaaaccaaaaaatacacccctaagaatcgacctaaaaattttttcaaaaaatacacccctaagaatcgacaaaaaaaatttcaaaaagcactcctaagaaatgaaaaaattttctcaaaaaggtaattttgtggcaagaattttaattttaaaaattattttttttatgtacctattttgtttttttgcccttaaaaatcccagccctactcatttgcaatgcaatcagtgaataaaaattatttttgcttaatttttggctgaaaattatgtcactattcgtcactatttcggactttttgtcactatttcttcactattttggcatttttactcactattttagttaactattttgcctatgttttcgcctttattattttcattttttacacatttttaactgtcatttttcccccaatttaagcgcaattcatttcttttccgttttttctacccaataaaatgcacaccacacgcatcgtgatgtcatcaaacttggacaaaaaccttgagaacattcgtcgaattgaccaattcgccagcaaagtgatcggatattccacccacgcggcactgttcaatttcaggttttacatttacatttttgtaaaaaattttctcatattttttgaatggctccgcactttactaaatgagtggaaaattgcggcacaaatgcaaaacttcaataccggataggaaaaaagaaattgcgctttacttttcttgattgattgttacccctaaaaatttttttatcaatttatcgcaaattttcaaaaattccattgccctcactccatgtttttagcaccgagcagaacaaatggctgaagacggaggtggacggcccgctgttcatctacgaacggcttgaccaaccgctgtactcgttggttgtcgtcaatcgccagtcgccccaaaattttgtggagccaatcacggacgggttgaagttgagctatcacccgccttacatttttgtgcatcgcgaagatggtaagaaaaaacaaatttacagcgaaatcctcaaaattgggtgggagggggttggggcaaaaaaatttcaaacattttggatgagggcatcgggggccaggatttcagcccccccccccccccttcggcgactaactttttttcggcgcattttttattggaacagcgggggccagcggtgttgattaaataccgccgggaaattttaaattgatttttcctcaatttttaacagattttgctggtagccaaaaaaaaaattttttttttttgcgcataatttgaccgtattttcgcacgttttcaggctatattcacagtctctgggtgttcggcgaagacgaatgcaaacgagttagtgcatttcattctcggttcatttatgtgcgaaaaatgggtgaccaacgtgcttttcaatgcccaatctttcatttttccccactcattttcagtccccataaccgggcaaaaaaaaaaaaaaaatttttttttgtaaccctatgattttttctgtaactgcccctcaaatttgtttttgacctttagagagtgtaatttttaaattgttataaaacaagcaaacaaataaaatatggccgttccaggctgtttcattaaaaaaaaaatttttttcaaaaaacccaaacaaatttttttttttttgccaggcgtttgacactctgacgaaattgagcatggcgcagaagatgataagtgccggtgccaccaccagcagccccaaaaataacatctccaacaacaacgacaacggtgccgtcgccgctttcgctgccgcaacgccgccgacgaaaattgtcgctgccgccaaaccgtcaacgccgccaccgtcgcagcagcagcagcagcaggcgatccgtgtcagtagcattactgctaccatccgtggtagccacatcaaatcaaacaaggcccaccacgtcggtggcatgacgaccacctgtaagaatttttcggggcggagggaggggtgtggagtaaagttgtgtactccacacgacggttcaaattttctaaaatcaattcttttaaatttcctagtggtaaattgttgggatgcctccgcttgtcactgtgacctcgaaattactgatggccaatgtttgactgtcctttacagaggtattttgtgtaaatataatttcgtcatatataataatataatgtctttttttcagaaggagcagctggttaccgttccgtcttcgctaaacatccgatttttctgaacaaaaaacacggcattttttactttgaaattttgataaaaagtctgcatgagcgactgcttatgggttttacggctaaaaagaaggggattatatgtgaacgggatgcggttttcatgctgtcttcacgcggcacacaacggcgaaacgaaatcgtttcgcagcatgaaaacagtgctttttatgttggcgattttgtctgttgtggcattaatttggcaaccaaccagtttctgtgcaccaaaaatggcgctatcttgggttattaaatttatttaaaaatttttttaaatttaattatcccaaatttgaatttgaaatgatttcttggtaataattaagatggttgcccctattttttggtggaaatttttaaaatttaaaagtcaatcaaaaaagtttatgggtttccggggtcgctggtcacgattctggcatccatttcgctcaatttcgaacccgaattcgaacaaaaagttgaaacttcaaattt

SEQ ID NO: 247 - DNA, 1664 bp, Heterodera glycines
catatttttaaaaattttacgtttcttgatggaaataaattgtaaatgaacaccgttttcatttttcataattttgttatcttttcatatattctccacagagtgcagtctcacttcgttctctcatcagaagttgaatgtttttctttcactgtgtaaccaaagagacattgttgaggcgaattttgggcccaatttcaaatttgatttaaaaagttttccctggaattgattttttttgtcattgttttatgttatttattattttatttatgttttgtttgttatttttgcttaatcttaaatataagctttaacaaatgcgttttttatcatatttaaaccattagtgtaagtaccttaaagcctgtaacagttcaatatttttccggcaaaagtgaaacacatttaaaccagttgtgatttagcccgttttccggcaaggcaaacacacctaaaccagtaattggttcaattttccggaaaaataaacggtgctgggacgttagtcaaaacccatcaaaatgggcgttagtcaaaaaaccatcaaatgaataatttttgacgaaaattattcataatttcgtctaaaatagatcaaattttataatatagatatttttcgatagccctaagtgttttctattatcctgcaaaattagaaaaaaattctttaagtttaaaaaaagttatgacctgagaatttaaaccagtagtggttccttttttccggtaaaagtaaatacatttaaacccatattgcaccatcaaacaagtaacgaaaattaaaaccccaatgtaaattcatttaaacaagtggtggttcaatccttttctgacaaatgtatttagaccaatactgtttaaaattaaaccacggcgtttaatctatttaccgtaaaaagtaaattaaaccaattgtaaaataaatactttaattgcctattttaaactgctaatctgttacccggctttgcttcaacgtggcaactcatttgaacacttttgtcaattttaaagtgaaaagggcattcacaattggtaatagaggtaaattaatgccttaatatatattccctaattaattaattgctcataaggataatccgattacaagcgaatgggcgaaaatgatggccacgaatggaaatcgaaatggcaaaactcattggcgtgccattaaactgcgcacagtgccattagcaacggcaaatggctcagtttttggcaaccaattatcacacttggcattcgtattggagacatcaattgcttcgcagccgttcgaaataaacaataatttttaatctccattaattaccctgggaaaattaaagtattaaaaaaggtattaattaaattacataatcaaattaagctataattttggaggaaaatcaacgtcaattttatttgatgagaatcgaattgccgagacaataaatggtggcaaattttttaattaccgtatattctctaattaaagccctgtctccattaatcccgctgtctccaattatcccccgggggataaatgggattacatatttttaaaaaatcttttttttaataaaaattaattaattctaaatttaaattcatttaaatgtttaataaacatgaaaaaataatacagaaaaatcatttacttcactcaagtccga

SEQ ID NO: 248 - DNA, 3349 bp, Heterodera glycines
tgacaatccctttgattgtccctcccctccttcacacttctcccgttttctcaccggttcgacgtttcgcaccggcgcattttgttcatgcagctaaacaggggaaattaactttataattgatttgtgaagcatgaaaggaccattcgaagtcggaaactggcatgggcagcacggaatcttttggcgctattggacgacgttttgttaaggggagaggcggaggcatttgaaccgagtgccatcgatcacagaaagagactatccaggaaagtaagtgattttgaagataacaaaagttttgtcgccagacataccaaaaccaatttaattaacacgctttgtcaactatcaatgaaagaaaacatttgcgaagcccgggaggaggaaaagagcgagtgccgcttaacgaatccgacggattgacacagcgagagaaagggggggggggaagggaatccaatgttgtggagaagaggatgatgaataaatggtacaaggggagtgaacccaacacctttacggcggcttaacaacggattagacgacaattagccaacagtgaaagccgatgggagggagggacccctttctgtcgagatattgtcatcatcgagcaaacgtggtttgtttgtgtgtccatcttcccaaatttaaaaaacgattaaaaattaatttgaatttcaattcattttcaaattaattgctctttctttttgtgacaaaagcacaataaataaatagtgtgcaagtggattgtgttatcggttttcgccttgaatatcacatttaaagcacaattttcattcattggccgtcaaacaaaattggcacgacagagagggcacgaggacttggaactggactggaaccacttgtactaaaaggggggagagggccaatacaaaagtcaatgggagaaaaacgcaccaaacaatcgccatggaattttttccgacattggcgacaccgaatttttggcaattggtaatttgtggaggaaacggtggacatgcaaatggtgcactcctccacgccctgcaggtgctggtcgatgctccgcttccattgcaaaatcccgtccatcatcactccgttctgaaaatttcggcattgctttttctccgtcgtatttgactcttgaagactgacttgtccgtttaggaaaacgcccaattgaagaagccatttgcgatgcaattctctgttcactatgctccgccccgtctccacttttggcgctttgatcggataattttcaggcaaaagtattgtcaaagtcattgtcgtctcctccagccgataagtgcattcgatctcacgcactttggacagaattcggacctgaaaataacaaccaatttcaaaatgtccgcttttgatgtgccatttgtcagattgaaaaagcggtgcaaaaagtatcccaaaagtcataagcgttaaataaattagaaaaagtaaatgtgataaatgcctatgacctctaaccgcccacgtttcatattttccaaactgcgcaattcacgttgaataagcaaatgactcaaatatttttgggtgtatcttaaataatttaaaaatgtagatttggttaaaaagggtgtgattactcattgactgtgttcgcttccgttttgctgagagtgccgtgccattcgcgaaacaaagcggggatcgtggccaaagtccggaagaagagattactcgtaaaatgttcacgatcgaaaggacggtccaccaatttataatgaaaagggccagtgaaaaggtcgtcgacattagaaacaacgcaaatggcatccgaagaagcaaaaagaaagtaattaattgccggggagggggggaaacctttatgccccggggggtcggagagagaattaaacaaatgggccaacgcattggaaagggttttgacatcgatggcatcgcaaaagcgaacccgggaaaggacgtccaaatctccaaaaaaacgcatcagaacatcccaggaaagcagcaaagggtcgacttcggattctggagaacatttgaaattggcgtggattgtatgcatacggtacttaccgttcagacgggagtaattggcaaactcaaaagagagaagtgccttgaaaagccgtggcagtgccaactgatgcgactgctcctccaaactcttcccaatgtcctccgcgtccccctcgttggcctcggactccaattcatttccgttcaaacttttcttagcaaatgcgccgcgtttggcgttctccgatgagaacatttcaaacaaaaagctgaattgttcaaatggcgaagcttttatttccctttccatttcttattcgaatggacccctttaaaacggtggcagaagcgaattgaatttcaggcaacgaattgaagaacaaaactgaagtcgggagaagtcgggagcgtctctcatcggaataactagaaaatgtaaggccataacaaaaacaaacgaacagcgaaaaaacccctcgaaattttgcaagaacgaaagttcgtcttcgggacagcaatcggtcgcccgttgcaaaaattcaattggaatttcggctttgatgagacggtcaatgtcaatcgattgggtggcattacatagcgttttggtgaaaaattgtggcggcattttgccaatgttggaaaaatgcaaaaaccaatgaaagacgtaatttgctgcggatggaccaaagaattcagcccattccttaattaagggaacatttcaatttacattaattaatcccaattaatgactctggcgatctctctgtagtcctcgttttgtctgttcattctgacaacgttctcataacgaatgaccaaattcagtgcggaatgacccatcagcagccaatgcatcgcaatttcatcgtcacattctttgattctgtcgttcgaagaaaaaaggttttctgtgcaattctgaaatttgtggaaaaggcaaattcgaacaaattctgaagcaaattgcctggaggacagtgattagagcgcaattgacaaagtctcttatcacagcaccgacttcagcaacgaaaggaacaatttgagcacagaatttcaaaataacgcaacagaataaatttcgaaacaaatcgtccctaaaagaaataaattaattaactgaaaggggggggggagacgcactttcgaacagtgaaaagccaatcttcgactcccttccgatgctgctcaatgaaagtggccaaagcaacgaaatgttcagcgcggttttcctccgttaaatttgcacaacgccattcaaattcggccaaccatcgcaaaacgacgcattcttcggaaggttgcgtcggttcatgcggaagcaaatccaacacaa

SEQ ID NO: 249 - DNA, 3451 bp, Heterodera glycines
ttttgacgagataatcaaacacaaaattcactgtgtccggcattctgaccagcaattgcgcttcgttcggtaaaatgcgcatcaaatgttctctttccgagtcggaacacttttcgcaaatgtatgccaatgccaattccaaaatgcgtttcactcgaccgaattccgattccaatcgctgcaagttgtggaaaatcgtacagaatgcgcagaaaagcgactcgtggccgagcaaatcgcaaaagtcggacagaacgaagtcaacggaatggaggcacatccaaacgttgtccatctttggtgggaaaatgaaaaaggcaattcgttttcaattgccactcactttaattcgctccgcaagggaattgtgtcggttttcggttttcgccagaatttggcacaaaatgttgatcaatcggactgtttcaaagtcaaactcaatcgaatctccgaccatttgaatacgaactgtgacaatggccaaaagatggtcgaatttggacgggtctgttcccgaagaaagaatggcttcagctgatttgacgagcagagaattggaaatggccgaagagtttgggcagacgagcagtttaaggccgaacttcccattttcttgcaaaacgtccaaaagtttggtgagaaaagcgtcgctttttgggagctgaaaaggaaaatgaacaaaacgaaaagcaaagcatttgaagaaaaagcaaatgaccagagacaaaaggtgctgctccaactccgagaacaattcgagcgcaaaagcacttttgccgggggacagtttgagctggagccacgcgacaaagtctgccaattttgcgtattcggacacaggaaaatcactcaaaacaaaatccataaattttgttacctaaaaagaaaacagtcgatgacatggaaaggcggacacaaaacaaacaaacaaaactgttaccctcaagaaaaactgcgtcagaaattccgactcgtcctcatcactttcgcagtcagtgccaaacaaaagtttaacgagagaaaatttgcatatttcgacgaaggcgcaactccaagaagaaatttgaatggttgtaaaagcgctaaaaagaaacgaaactctctgaaaagtttggatgaaagacaaacccatcgaaaaaggaatcggtcactgaaaacgcaaatttcacttgtttttggcgatcggaaggcccaattcggtcaaaaataacggagaaaagtggcaacaaagcattggccaacaattcccagtgactaaaatggacattttgtttttgttttgcttggcttcgcccacccttccttctttcggaccaaagacaacactttgggcacaatcgctttgtccaaggaaaagtgttcgaagagtgcgtcttcctgggccaatctcataaaacattcgaacgcattttggaaaagcgaagagtccgacaaattcaaattgttgaacagaacagacacaaatttgcctctgatgagcaaattgggatcattttgtgcaattttagttgcgagccgataaagggacactttcacctaattaaaggcgttttagggattctttgttaaacatttgtttacgctatttcccaaggccatcaaagggttcagtgactcggaatttgtgaaagtgtcgccgacagtcgccaaaagggacggcaaattcgaagagtgcgcagagagcgaatcgatgcaattgaaagactgggcgatcagtcggtcccttctctgctcgttactttcctcttcagtcaatctgaacgggtcgagcaacgaaatcgacccaaggcaaaacaaagaaacggacagttggggtgataagacaagccgatgcctccgatttgcgacactcagagaaagcgaaagcgcatcgtccgcaaagttggcgaacaccaattcctttttttcggccgcaaaacattcgttaagcaaagaaaaggccgactttacgacttggttggaatggtcagcagtcgaaaacagcagaaaagggagtgtcttaaaggacagacgaaaaaataaaacgacgggggaggggaagcaccaacaaaataagaggaggaaacacccaaaaaacgaaaggcttgtcgattggcttattctgtgccactcactcactcgcctgtttcaggcagttgctgggcgcctccttcttcagtctccaaatgtattgggccaaaagtttgttactcgccgaccgaattgtgctgttcgcatcggtgacgagtctttggtaaattggggcaaagtattcaaagctcaacttcagctggtctaaaggcacattcttcagcagttcagcaaattccttcaccgccttaactgttttcttattaactcaatgccaatcatttttcgtcgattgccttttctcgggtaagagtgtcgcgttttgtcagtttcttcagcaaaatacgaaattcgggtgccaaatcggcacattcattcgctgtcatttcgcccaaatccaacaatcccaaagcggaagtttcaagtccaatgaacggaatgccactcccagtggcttgcaaaagctgagtcgccttcgaactactcgcagcctaaagcatttaatcacatggaaaacagcgaaaagagggaaaggggaaaattaacataaactgattgtgccaagatttgttctcctctacggtaaattttcatttggcgaacctgggaattgtccttccgtctttggtgtttgcccatagtaaagaaatctttggcgcaaaaatgtaacaaaaacgctaaaatactaagaaaatgcaagcatattttatataagattcgataccactgaaaattacagaccaaaaaaaaagaagcaaaattcagaattattctgagatcgaggcgcggagagtgagtggggcttcggttgtgacatttcgccgaaatgtcggataaaaaagggagcagtatggcataccatgtataaaagggaaatacagatttcttttgtagcgaaagtaggccaaatcagtaaatatggtgacatcgacagtacctgaagaggcaaaggtggaagatgagtggtgagaaatcgttgacttctttatgcatcaatttttggggcgggtcttaggggtgtatttctcgtttttattggcatttttgttaaaaagttcatcagaatagggcaccgcattttctctagttatcagcccgggggcatcatttttcgatctcctcagaaaggggaggataattagagacgggggtattatcggcgacggggcgacagttagagaaactatggtaaatattttcttccaaattttctggctctagaaacaaaaatctagagaataggcactactaagtcgaaaagtagcctaacaacatactattccccaaacgaaaaacaaaacaagtgaatcaattacccttacatttacgatttacccaaattctgcgaacctgaaaatgttaaaattaaactatttggcga

SEQ ID NO: 250 - DNA, 1513 bp, Heterodera glycines
  misc_feature (1376)..(1376): n is a, c, g, or t
ccgaaaagaaaataacaccgctccctttttttaccgctgaaaaaaccctattgtaaatattcacaaaataagcacctgtcctccgtgccctccactttcagtgctgggttcttcccagttgttgagcattcccccaacgaagtgtatcccatgtcgtagagatggcagtacgggatggacatgtccctaaggaacttccaaacttcggtgtaagtccagtccaacaaagggcaaacctttaaaaatggaaagaggagttaacagaaacgtcggttcaaagaaaccgaccctcaagaaactgggccaaccctgatctgtccattcgcatttactcttcatgaagcgccctctcggatctgtcgctctcgatcccatcaaaacagcctcaatgttcggtcgaacgactttcaactcagccaatcctttcttcaaagcgcctttcagctcgagcaaatccaacgagtagctaaacaacgacaaatgagttttttatgtaagctaataatgagtagcaaaagtactttggggaaatattccgaacaaatgcaattaattcgcaaaactcatcgccttctacgaaaaacccttcgattcgcttttctttcccgaattttttagtaacacaaatgcggaaaagatgcaaaagaagcgtgcaatctttgcctccattgaatgaaatcgccaattgatccaaagagctgagggggagggggaggatgtttagattgagatgcactcacccatatttgtccaaaatttcgtcaattgttgcgatggcattgaaaagcttgacagaaaattccttggtttgagtcgcgcaataaatgtccaatttatggacacaatcctcccacggttcgggatcgtaattcaccacccactctttgaatgaattggaaattacttttaatttatctggaaaattacctgaaaattcatttgccaattcttcataagccaaattgcctaattccttcgaaatgctttcaatgcttagacgagttttaaaataactgacggaaaggtaaataaagctgcgacacaaagctttcaagtttacttgttttccatggtcggatacgacccaattgagacgttttgatgtttggcagccaattgcgacagtttttgttgtaaatgaatttcactcttttttaagtataaattgttcgtaaacatttccaaaagtgacgaagggaataggtagtcctaaaattaaaaaatagtattaaaaggcgagaaatttcttgcatctcatttctatctccgagtctgtcttttttatctttagttggcttctttctccatccctcaaagcgaatttacttatttgaaacattacgcgaaaaataaacagcaatttgattatctattancaattcacttttatttggattaaatttggcgttaattcttctgctcgttaccttcaagtgacgaaattttgctcacaaagtgtggaacaccgggcatgcattacatttcgtattgtataaaagaaaatagtcaaatc

SEQ ID NO: 251 - DNA, 2585 bp, Heterodera glycines
  misc_feature (2439)..(2439): n is a, c, g, or t
ttgagcaaaaatatattgactattcgccgcaaatcttcgctgggcaacaaccgatcgccaaatgcttcagccaatgcctcaaatgttcggtcgtcgtgggtaggcccgactccaccgatggtgaagcttaatcaaaattccatgaaaaacaaaggaatgctgctaacacaatgtcaaattccacgcaaaagtttcgaacttctttggcaacctccgttatgctatcccccaaaatagaaacctgggtaaagaggtattttgacaaataattattatgcttctgcctacctttttaacccaaactcctttctcaaataattgtttgcacaagaattgagaatttgtgtctcgcgtcgtcccttttaaaagttcatctccaatagctgaatttgctcttatgaaaaggcccacattcagaaattattaccaattattcctgcagtgattcttcgttgctctcctcctattgcattgtttttagttccaaaaagtgccataatatcgttatgtgtactaacattaaatgatttaaaaattatccgctctaaattcatacggattggcataatcttaatttgacaaacaaaaatatgtaacagctgaactaaggcgctaatttagaaatgacttttaaatatattttagtaaaatattgaatttgaattaattatagaaaaaaagctttttattttcaaatgaacgtggtgccaaatccccgcttcccccccccctgccttcgcctcctctccaatgcttcgttcttccgtttcactttcttccatgttcgtcctcctcggcattttcggttgtgccatttgtgtcctttttacttctcactgtccaaataggtgctaggacgaaaaaaggaaagaggacacaccatcccaaaaaacgagatgtgtaccaataaatagagagtgcagagaaaaaaacatctctttttttggcgtactatttctttatctctgctaatagagaaaaactgaatttacttcggcacatataactttttttctactcatacaatttacaccaaattttgcatgtcgatagagaaaaaaattctgcatcgaatgttctataagattttacgatttttctatcccatttttgcatgagaccgttatgaaaatttaaaagtcttcgaacttttttacataacgtaaaattgcttagcatttgcatagaaaaatcttctccttatcaagagctttcgaatgataccaagtttgtctaatttggttgcaaaaaagcttcaaaaataattcccaaaaatcgtcattttttaatatttttgacaaaaataaattaaaatattcatgttgcacaacggactcgaacctccaccctttgccctttactatcttacaaaaaaccatttcgccacatatgcaaatcttttttggtacaggagctcgttctgggatggtgtgaggatgaggatttatacatattttttaaaatatgcttactgcagcttttttaaaatttgataattttaaataataattttttataactgtaattattaattagtacataacacgctatttaaatttgtttattttattttaatcattttgaaaattaatttaaaattttaaacagatattttcgcaattttttggtgaaaaacgataagcggcacttgatgaatttgatgagattttttgaactcgccaatttatgcaacttatttaaatttaggttttttttattattattttttgcattttattaaaggtttttttttagcctacgtttaaaaaaagtttggtgttttggtcttttaattctttttttattaatattaattagagaccggcgcaggaccggatcctgcgcaggattttgcaggatcccagtccgcaatcctgcatattttggaaaatacaggatttgcaggatttcaggattaatcctgcgggatcctgtcctgtaaaaaattttgaattccaatctgcaacaggacccgcaaatttgatttttatgcaggattcagcaggatcctgcattgattttttgaaaatttttaaaaatagaatgccaaatattcagaaactttcttttttcaaaaatttttttcttaataaaaatttttcgtttaaaaacttatccttattcgaaaaaagtttttacaattgaattttttatgtgttttgctacctaaaaagcgttaataaaatttttttttactattttcatgcctattttaggatttttctgcctttttaagtgcctatttcgcgatttgtgcctaaaaatcccatccctatacataatggattatggcttttttgcaaagaaatttaaataaaaattattttactttaatttaagctattattatgagccacccaatttgaatacttttttatactttgaaagacttttttattaatacagaattttttgaaatttcctaaaatccgcattccntgcgcaggatccctgcagattttaaatgcaggatttgcaggattaatcctgccggatcctgtcctgtaaaaaattttgaattccaatcctgcaacaggatccgcaaatttgaaatttccggtctctaattatcaatgaaatttttt

SEQ ID NO: 252 - DNA, 2685 bp, Heterodera glycines
aaaaaaacgttattaatttttcatcttcatcattttttagtttaaaaaatatatttgaatacttttttatactttgaaagacttttttattaatacagaattttttgaaatttcctaaaatccgcaatcctgcgcaggatcctgcagattttaaatgcaggattaatcctgccggatcctgtcctgtaaaaaattttgaattccaatcctgcaacaggacccgcaaatttgatttttatgcaggattcagcaggatcctgcattgattttttgaaaatttaaaaaaaaagaatgccaaatattcagaaactttcttttttcaaaaatttttttctaataaaaatttttcgtttaaaaacttatccttattcgaaaaaagtttatacaattgaattttttatgtgttttgctacctaaaaagcgttaataaaaaatttttttttactattttcgtgcctattttaggatttttctgcctttttaagtgcctatttcgcgattttttgtgcctaaaaatcccatccctatacataatggattatgacttttttgcaaagaaatttaaataaaaattattttactttaatttaagctattattatgagccacccaatttggcaaatcggtctttttaaacgcattaaagaagaatcagtcgattgcttggagtgtaagcaaaaaaaacgttattaatttttcatcttcatcattttttggtttaaaaatatatttgaatacttttttatactttgtaagacttttttattaatacagaatgtaaaaaattttaaattccaatcctgcaacaggatccgcaaatttgaaaattccggtctctaatattaatctcctttttaggttatgttatagtttgagctcaaatatctttttgggcaggaattgttgatcatagatttagaaggtcacgtaatttctcgcgcaactcactgtaaatatattatttctaaaaaaatgtcagattcgtgctaattgtaagagccaaaaattacgctagaaaaactgccgttgttccttccccgtcctcctccaaatcgccaggtccatttcgaattcggtgttcccctttttctctgcccgaactcgccgtgtctccctacgcacactctctccacctctttccctcctttttccactgtctctcttcattatcggtatttgtcgccacttttcttcttcccattcatttggccattgacttctgtttttatttttgagttgattctttctttctcccaatgaagatggtacattttgacataagtgatcactcaaagggctttcgttgctcgaccgatttgaggcaatgaagaaattatgctaaaaaaagtgtgccattggccattcactgcgatgatttactttttcttttccgtggcattttctgagacggcgaacgcacaagagcgcattcattgaataaagaaaaaagagaaaaagcgcggccatcgcagacagaagcaaaaaaaagtccattgaatgtatcttcaaattttgatttcgaaatggaaaatttaaatttattgcctgaaaatacccaacgaaaagaacggtggcaaaaagcaaacaaacggtcgcctgagggaagaattaattaatggacacaattaaaacaaattctgagtaacagtgccattgctacacagattgccaagtcaattctgtgccgacttctgctcctttactcccttttgaatgaacggcaatttttgttaggaccgaaaagcaaataaaggccgaaaaagggcagcgcaagaaaagcgatgagaaaaatccaattgtaactgattttatggagagagatcacctgaggggagagaaaagtgatcggaaattggaggaacggaccaggaaaagagaagtgataagctgaagcatcttcagcagggagcaaagaaagcaatcggaaaaagcatgggacaattgagtcgaaagcatcgctaattggcagggggaaaagattaaacgaagtaattaacggacagagggcaaaattgtcaaaaatgtggcggatggaaaagcaaagaatttcgataattcatattcaaaagccaaatattcaaaattatttctaaaacaaatatttgtttttataatattcaaaaagaaaaagttatattttagcgaattttgaagcaattaaaagtcttttcttatcagtgttatcaattaagtgtttgttgttttgctctcattcgtcactttgttcctaattagtgagttaaaatatgtaagtctaataaatgtgaagtaaattaatgttttttaaaatgcctaagtgctcaattatacggcttcccagatcctcggatcatcatgccccacgaatcacttatccgtggattgaaatccgtatgcataaagatcggattcggtgatccgtggatcaacaatccatggattttttcgcggagtatggacataaatttttccaaattaagaagaaaattctcaagaaaatgatattttggaaaattttagggtctttagggataaaaaggccaatttttgttggtttttgggcggttctaataaaggcttttggaaaaatttattatggcatttagaacaaacaatatacaaatatggaccaatcccgagttttcgtggcttttaattatttccaccccagccccggaaaaaaagaatggattttccataaaattt

SEQ ID NO: 253 - DNA, 8076 bp, Heterodera glycines
tatatgcattttctattgccactttttcagttggagatttgagtgtaaatataaaggcataaatttgagagaaacttcattcatcaaattctcacaccacttcatattatctgcactattacatctacctaatttgtaaaactaatttgtattttcaatcttttctaatcctaaaatttcatcgttttgaagcatatacattgtacattcctgtacatacctgtacataatacctccataatctctccctcctccaactcttcgatatttcattactccatcggacggacatgcgcgaactgttgttcaagaccgccaaccaggaacagcacactttcactcttgaggtcgaggagaacgaaacggtgaaatgcaatttccgacggtgcttaaccaattttcccttcttttcccccttcagatcgctcaaatcaagcaaaaaattgaggacagattcggcctcgcgttcgaagcagatgagcaagtgctgttttacaatggaagagagctggacgacgcgctgacggtggacaatctcaacattgaagcgccgaatttcattgtcgtcttcgtgatggtgaggctcacgctgcttttcccattcattccgtcatcaattcaatttgtttctttttcagaatgatttggctggtgctgatgaaggtgagatgttggtgcagcctatgcacatgaacggtcatccggcggcggcgcaagcgggctatgtgaacgaccacgctgcacaccatcaccaccaccatcatcatcaacaccaccagcagcagaatgggatgctcatcgatcacaacgtgtggcagcagattcttgctcccgtacaacaacagattcagctgacggcgcaggattacccggccatccgtcgagtgggaacaacaaaaacatttaaattcaaatttatgattttccctcatttcagctcatggcgctgggctttccgcgaaatttgtgcatcgaaggtggggggggggggggtggacagttggaatttcaattgtttaattttcaaattcccttctttttcagcttacattgtcagcgaccgtaatgaagtgggaaactgaattttgctatttcaattaaatgtctgaatgcctatttttaaggagcttgctgccgagtacattcttgaacggatggcggaggggaacgggccgtgaccgcgttagaagagaaaagaaaatgaggagaggacattgatatatcgaatactgtattatattgtatgtattgtatatatgtatattctatatttcatatgtacatattgtatgtatttacttacgcaacatttaataaaatttaaagaagcgaaatttggtgaaattaagtttccaggcaacaaatttgtttgtctagcaacagggcttccgttttttcaaaataaggacaaacgaggttaaaactaagattttgaccccaaaaataagattttttgaaaaacggcttcttacaattgtagaaacagtaaaaaagggataccaactgaaaaatttcaaaatcagcatttgggggagtgcattttgtaacagattaattctctcttccgtaataggtaagaaactgcatttatgtattgttctcaaaaaatggaattcgaatttctgatctcaaattatgttttgcttcagatttaaaattcatttattttattaagattcttattattgtttttcttatccaatggattggattcattgtaaggcgtttcgaatttaaagcctgctgctttggttttactgctggttcgctccctccccctgtaggtaacaaatgcgttgcagttggtaatcgtggtggttcatattggttcacatcctgtggccacattgtttgtatcaattgcatgaaacagggcatgtttttgtaaattaaatgtccgcttattaatcagttacttaattcgttaattattcaggaggaccatcgcccgggcataaaggctcctgcattatctgtcaaaaaccggcatcaatgtaagtgtaagtaagcaacagcaaatgctttataactcgtgtcagcacaccgtcacagaatggaaatcaaccgctcaatgaagccagaaatcttgacactgttcaagccacaaaaggaagtgttggtggagaatacgcagcgaatcaaatcggcgatggatttgcagaacaaccatcggcaaatgctgattaggaaactgaccgaaaaggtttctacttctagcactgtgtcgcgttgagaacgatgaatcataaaagtgcctttgttttagtacgacagggcagccaaatttgcgagaggagcgcaagcggatattgcgaaacgggacaaacgggagaaggcgttgctggcggagagggaccaactgaagatggagttggacacggccaacgaccaaatccaacgattggaacaaatgtattccgaatttacgtaataaacatggggaaaaaaacaacattttcaggctgaaagaacgtgagaatgaaattctacgcctacggaagagtccgaatcgacgccacagcccacagcacaggaaaagtgagacgaacgggcaattttaagatctaatgagcgaccaatttcaactgttttagggaatatctacccgagtttgaacggcaacactcccatcacttcgttgtcctttctcgggtgcggtgcgatgagtacgcccaacgacgaagtatcatagaaagaacataaacaaataattgatataagcgaaaagtggattaggagagcactatgaacctctattttggccatgttgagtgtgaacgccaaaaacggcaaatttgttgggaaatcaaaactcatgttttagtatacagaggaattgggcatattattcgccattattatacaaattgatgattccatgcgtttagcccggcggcatgaacttcaacatggccacagcaacaccggcgaattttggcattcgaaacgaaaacaatgacgcggagcagaacatcgaagcgttgttccggacgcaaaatgtgcaggaggagacgccacttgcgggtcccgcgttctgtcctacgacgccttaccttttcgcaatggcgggaggcaacagcgaaaagtgagggacaaaagaaaaaagcaatttcagacaaatcaaacaaatttaggcgcacgggagtaacgccgaagtacttctgaactggtcgaatgtaataagtatattgtgcttcttttgttcgatatttgtgaaattcattcatattcaccggcgttgtataacatatacacatttggtatattaataaaatagcatatcttttgcctctatttatcttttcaacattcctattttttaattaaaatttttagtcgaaaatatctacaaaataggaacaaaaaaagagaaaataggaccaaagtctctaatttagagctgtaattatcaggaaagaatcgaccttattaaatttttcaccaaaaatgaatattttctctagtttttgactccaaaaattttattattttttgaaagtcaattttttttaaagggctaccgtatttctattccttttttaccaattaaaatcagacttgttcttgacaatatttggtattttaaggctacaccctaatttgggcttctctgtctattcgccctattttttctgctggaacgggaaaacgcgggattcccaacgggatttccttgcttcagttttaaggccattttgtatttgaaagtctaagggcaattggaattggaaataagaggcaaataactttcgaaattgaaaaaaagaattctcgacatcttagattaagctaaaacataaattaggattttaagtcacaccgttaggtacactgtgtaacattagaatagggacaccctattttttgggagtttgaccacttcccatgagccgatcgagttgaaattttaattgtacgtagcaattctgaaaatatcaagattatgaaagtgagaaaccgaaatgacgacggaaaaatatttaacgaattttttttccaaattggggtaagcattagaatagggacactttggaaaactaagaaaaatctcaacaactactaaaaagaaactaataaaacaagctaaataagaaagaacaaatcttttttcacatttctgtttattttgcgtacagaaatatgtcttttggggagagttatgttgaattttctaagttttcaggagaaattaagggccaaaaggcttaaatcgcctctaacatttgcccaaccgaatcaaactaacagcaatcattctgttttatgattaatagggctgtgaatttaatttgatcagtcactctcaggatggatgataagtgatcgatgtgtggtgctctgatcagaaaaaaacaaataatcaatgtgttttggtcagtaatcgggatcgaaagaaatcctgatcaatctgatcagagatgaacattgctcttgggaaggggtaacttgaaccttcagaggcgcaaccgaaatgagattattacagatcggaaatgatttggaattggtcaatattgattatggattacagatcagcggaagaataaatcgacataacaaaatccaaccggaaaaatctctaaattttgtggcattggggttaacggcacacattcgatgatcgcctccaattgttccatgccctgaaaattgtcagaaactcaaaaaccggcaaaatgccattgttccccaatgccaccttttgttccctgtcgattgccttcctcaaaatcagctgtttgctaaacgtatttaggcgcacaaactcgcggcccttcacaatgttcaacttcattgtcggcttcggcccgccactgcgcccaatgataggcaaagtgcccaaaatggcacctgcacaaaagtggggaaagaatgccattggatttgaccaaattggctaaacaaaaatttaaaacttttttggatgtacggaaaaacggattgaaactaaccattgggaaattgacattgcaaggccatcaaaaatttctgaaatcgcatttcaaattttttcgaggcccattatgggcgaaatttctgaaaatttgagaaaaaatgcaattttttttgtcttcatttcgaacattttgaagacaaacaaaaaacataaatattaaaaagcattgaaattcgaatcgaatggacttggagaaatctttcttggcattctccaccattgacatgtaaatggcacttcgatcgcgctcgagcagacaaacgggctgagcagcatgttcatcgtcttgatgaccaaaattgtggcgacagacccgattgatcaattccatccgctgtttttgcttcttgggaatgtgatcggcgccatttgagcgccagggactcatccgacgacgcactaatttgcccaaatgaagacgaaacgaaaattggtgttttgtttttgccaaatttttggcattaattttttattttcttgcattcgcactccatgggaaatcaaatttcatccttggatctactttatttaattccgtcttgttgtctgtagtttttcttgcataaattgtagagtcatcgttttgtttggtcgtcttattagaatttgtttaattaaaattattcaaaggccctagctacatacttcgggaacctatttcgtatgtatatattatggccaaaataaatcgtttaggtttacaaagttactatgctaagcgaataaacaaaactcaaacattaaaaaaaagttgaaaggaacaatattcactttaggtatttacaattcaatgaatccttttgacaggtgaaagcgatagcttccaaaataaagaatattggccaaaaattaattatactctgaaattgtatgctggggaaggaaaagcccattgaagcagaatggccacgaacttttacctacccaaatagcatttaatgtttaattattttacttatttcttttttttttgcgcagcactttgtcattatttattgtgtgccactttttcgtcggctttagttttaaaaaatggagcagggcggttttgaggtaaattcactcagggtatttgatgggcggggagttctgctgatttctttgccctttaactttgtgaatggcattcccatgacccattggcatgcatttattgaacaaagagtggcaaatcccttcccatacggcaaggcggggtcattcattttcatcccaaacactccaaaatggggaaaaatctgaaaaaaattcctgttgaattgctttttgaaactacaaaaagtcttcgatttgacatccgctgggccactgttcgggtgtccgcctcatttgaccactgtgttattaagtgccaatcagattggctcttaaaggaaattgggcgtctaatgattttgcatcgaaaagtagtaacggctggagggaacatatccaattctaattaatgacaattacaggctttccaatttattaaggttgagttcgtggcggaagagaaagcgcgtctgttccaagtcgtttctcagctgaacagcgaacgccgttctattgtccatcgtgccattgcgtcccattttgcggttgacgaacagtatggggcgaaactggtcaaagacggtgccactgaccaccagcaattttgcgagaagattaatgctatgattggcaatttggttgatcccaccgacgcagcaaaagttgcagtcgcaggagactgtatgttggcgagcacagaaaattttgaactttttatagcatagcaatccctcaagaaatcacaaaagtgacactttcttattttggttttcgagctcatcaattaaaatctgacgtccattttgtttgaggattggtttcatcaattttaacagtactaattactacatttatcactcagttttgcaccaacaagtccagtgtgcgtacggatctctagcggatatgaatcagatctcgaacctgaaggcgcacatttctgaacttcgtgctcagaacttgacccaacaggcgcaaattggtgcacagcaggttcagattgatggccttcatgcccaagttggtaatcagcagaatcgccttcaggctcaagttgttgctcaacagaatctgatcggtggccagcacaatcagatcggtgctcagcagaatctgatcggtggtcagcacaaacagatcggtggccttcatgttcaagttgctgctcagcagaatatgatcggtggccttcatgctcaagttgctgatcagcagaatcgtatcggtggccttcatgctcaagttgctgatcagcagaatctgatcggtggccagcacaatcagatcggtgacctgcaggctcgaaatactgctcttctggctcaggtttctgatcatctgtcactttttgatacccctgctcagaattcttccctgaggaagaggaagttggtttcggacgttgaaaagctgccgagtcagacgtcgagtggaccatcgaaattggccatcggagtttcggagacgaccgtcggaccttcgacgtcgatcgttggagcttcggagacgaccgttgaaccttcgaagtcggccgatgatttgtcgcagacgggcgaatcattgccgtctaaggattgagtgtcgatgaatgtggctcgtcaagatgaaaatgatctgacggttgaaaaacgaatcttatttttgccggcatttatttaaagttgttgattgttgacatcgttaaacttatcgcatcagcaaaaaaatgtttgggtttggtgccgatttttggtcggagtgataaaattgcaactggacaacccaaatactgaaatacaaatatttcaaggttaatcaccggaagattcgctttttgctctattgcagttcacacgaccataagaaaaaggcgaccataaatttttttttttttgcaactttaatgcaacaactttttcaagaagaacccaaatcaaacattcttagtatcattcgatagccctaagaatactcttagcctacaaaatttcaaaaaaattcgttgagtttcaaaaaatttatggccaaaattgtttagaaaatcagcttttttgaatttcttgccataaattttttgaaacccaatgaaattttttgaaataatc

SEQ ID NO: 254 - DNA, 5007 bp, Heterodera glycines
ccaatttggtatggagcggccgttccccccctcctgtcgtttcccatccaaaaaaatttataattttttaaaatttttcgatttcagcgatttttagaaacattttgaaaaattcggggtttggggaacgacgagaggaataaagtgcaaaagtttttatggggcttaaaaggggacgctgaagggatctgggcaccaatgctcaatattgggtattccaaagtgccgagaaccccacccattcatttttatcttaaataagggctccgatttgtcactccaatcgcctgaaaaagcactcacaaatttgccatgcgccttttgcccagccaaaggctaagagtggcacaatttgtcagcagcaacagaaagcagaggaggccaaggcaaagtgccgtatcggggggcgtcaacgacggcggccaaactgtgccgagcgatggcggtggcacacccgaacgcgtcgatcggcggacaatgcacagcgcaaagtctcgacctccggctgaattctcggctaatgccaccaattcggtggccggcgggaggcgaaaaagttcggcggactttgtggggagaaggcgcagcacaccatcaatgggatggatgtggaacaaactgctgattgggggaaggaaaatggcaaattgtcatcataaatgttgtggtaaataaacgcatggcgtgccaaaaaaagccggagacttggcaagtgcccaatttaccgtacttactgaaatagaacccctccctgaattatagccccccccccctccctttgagaaggggtgaaaataccagtaagtacggtagaataatttctgtagttttttgtggtgtgccgtaaatgccatattggctattaattaaagaagcgaaacatgagcaccgaaattgtactggaatgtctctatggatttaaagaataaattaaaatctttataaacaaaaataattttgaaaatcggtgcccaatttccgggattatttagctaatttgtaaaaagcgcactcatttccgcttaacaacgcataagtgatcagctgatccgcttcttctcgtgccgtgccatttccccgtgtccccgcgttttttgctttgatccgtccaatctcaaccgattgttctcgtccattctctcccaccgttggcagttcaaatccgtaaaattgcttttcaaatgcgaaattttgtcctctgatcggatcaaaaactgtcagacggatatccagtgatcggatggtcggaggccgttttgggcatgtcaatttgatagaaatatttgctaaaaagttggaaaacattgattgctctgatcattaaaaccatcgagcaaacgcaatacatctgtttaatctttttgtctatcctaatttaggctttgctttttatgagatttgtcaacaggtgtggcttattctgatcatgttttgtcctcacagcaggtaaatgaaatcactcacttactgaccattcgccagagcgatcagatatcaatatcattttagtgatcattaaaaaataatcatccaaaagctaaggcttaagactaatcagtgaccaaagtttagagtatgaacaggtcaatctagtgaacgaatttagatttaaaacataactttcagcaagaaatgcttgattaaattatggacatgatcggtcctctgctgagcataacttttgaacccaatttcactgatttgatcaaataaaataaactctaaacgatcgttaacgaatgactcaccggcgtattggccaattgccatccgtttggccaatctcagccatttcgtcctctgatcgatgaaaaaaggcaatttgttccgcttctgctgctgcccgttcggcatcactatttccaatgccattgcttctcctctctccgctgattccgtgccgcatttttcgtcgtccaccaatcgcattaatttggtgccaatggccgtgttttgcgacaactgatcgacggaataattttattggaatttatatcaatgcttcatccatgtaaattccataaaaacccaccctcaaaatgatcagttcgctgcttttgccctccccttttgcttcttcgtccccctccgtcggaggttggaccagcaaaaaggcggtggaattgcgctccgatcggtttgcttgtcgcgcctattttcaaatttcaaagtgatcatctctgattttttggaatcggaatttatgatcctgagaatattttaacagaaattttgttgagcagggcattttctgccgacattttggctttcacctgtacgatcagattcgccggcaccagcttttcggccagcagtttgacctcaccggtagctgatcaattgcgtagttcaccgcgtgttcttaattacaacaatatgtggactaattgatcgctctgatcaaggatcagttttttgttttcgcgtttcttccaacctccggaaagtgagtaaatgattggctcatcaaatgagcggtcggcatcccacgctctgatcggtgacggctcaatggccaagctgaagccctgaaagattggcattatgccaattttttgggattgttggcattgtgcaacaattttgaaacaggtcatttaatcctctcccaattttactctgtgttcactgcttttgtacatctgtgcctcgaaggtcgggttcagatcgtccacgtcgatcactgtcacgtccaatcgtgcgaaagtgcgcagtttgggtgtgccctggtcctccgcctcgataaacaccgtaaaatttggcattttttcaaaatcgatccgtccggcaacaaaaagttcgggtcgcaacgggtccgggatgtgcagaagcaaagcggcacagtcgtcatcagaatcggtgtaaaacacttcaaacggatgccgatcatcggaggagccttggccggaaaccttttggtgttgacaaatgcattgaaaagccgccaatttttagaaattctgagccgaggctatcaaaaaattttcttggggcaggtcaaagtccacaggccacttttcctcaacctgggtttttcctgggtgggattttccttggtttttgttcaggaaacccaggtccaggctttcaaaatatcgaactctagaaattatagtgaaaactgctgataattcccctcgcaaaagtgtttttgtcagggtttctacggtaaaagtaaatggttccaccaccgtaccatgcgccagctaccctaccgtatgctcctcatctgattgcgaacattccctcgcctgctgcttttgctcctctgctgctgctgtttctgctgctgctggcggtgatgagcgcacaattcggtaacgaatgcgactatttgaccccggttggtccgcgtcggtggcccggaagtccaatcggatcggcgtgccctcgggcaactcttcggcgatttgcacggcgaagcggcgggcgctgaattggggcgcgttgtcgttcagatcagtgacggtgatgaagacgctgatgttcagctgaatttgaagggaaaatttgatcagtcactctcaggatggatgataagtgatcaatgtgtggtgctctgatcagaaaaaaacaaataatcggaaatgatttggaattggtcaatattgattatggattacagatcagcgcaagaataaatcgacataacaaaatccaaccggaaaaatctctaaattttgtggcactggggttaacggcacacattcgatgatcgcctccaatgatcaaaatttgcattttctctggcggaaccactaaaaaatgactcaaaaaccgcgaaaaaattatataaatttttggataaaaatagtgtgccaaattttgatatttctaatattgaaaattttggaaggggttattctggttcgaattttgcatgtttctcaagttacagtcatttgggtcgtttttcattctgagtccaagtagaagtaaaaagcggggaaaccgcccatttttgaaggaaattaattatgtttaagcaattgtccgcgtccgacaattcgccgaaagcttccgcttctgttcagggctctgttcagggtcaaaagagtcgcggagaggagggacgaaaagacgagacgaaactttaccaggcacttcgtctttttatggaatttcctttcataattattttctatttcaggcagcgaacacaaaacgaagaagaacaagaaatagagaaaaagactctacgctggcattaactacgctaacaaataaataggcctatacatacatttatgttcacttttggacattttggtcttatttatgtttcattaatttatacattttttttgttttattttttgattttgccaaatgaagaataaagtagagttgagcggtactcggtaattttttccaattttgcgaaggggtctccggccatgtaaattaatgtaaatcaatgaccttttttgctttcaacaccgcttttttcgcggcacgtttttctcaagacttttggggaacaaggagggccggcggtgccgataggcgccgccgtgaaaaattttgtattttttaatgcgatttgttaacagaatttgtaaaaaaagaccaattgattaatttttgggtttttaggatgcttaaaatgaaagaaaaaaagttggaatattttttttaattaaaatttcaattaaaataatggtaaagaaaatatgaagaatattctatcccagtggggaattgaacccaagccgagaaataataaaatcagaaggtttagccacttgaccacttatgcatatgaacaaatgctttaaatgaaaataaataatttaatttttttttctcaaaaaatttctccttcttcaccattccctactcttttctcacccagacccccattcttaccagtgcaaatttttaccggcggtaccggtactagacaaaccggtaccgatactttgatttttgaaaaaaccggtaccggtaccggtaccaaataaccggtaattaccggtcggtaccggtaccgctcaaccctaattt

SEQ ID NO: 255 - DNA, 1385 bp, Heterodera glycines
tgaggacgactggggaacggctccaaaataaaggcccgtctaaaaaggggatttttgaaaagataaaaaaagaaataaacaaaccgtttcaattaactcgcgaagtgcttgcaccatacgctgagttgacggaaaaagttcggcattgagtgtttgaaggccagtccacgcaagagtttcaataacacttgggtaaagttcgcggagacggatgagcaacgcatttgaaccctaaatcgcgtgtttgaaatcacttccaattcggctgttgttgcttttccaacacttactgatccgtcgatagacgcataagcgtcctcctgaattttttatgtttagaaaaatagtaaatttagggaacggtcaaattcatgcctctttaaccagttcctgtaatgcggcaacaaaggcattgcaatttttgtccgtttttgccagggcggtaaatgtgcgccaagggatttcttccttgcagagtttgtgcagatcgattaactcgtaacggcgctgaaaaaagtaaaatggcaataagggtcaattcccattttttgcattgtgtaacatactaatttaaatatatttttccatctttcgatatggggcctcaaaaattccatgagtagccaggaagaagtcagaattctcgaacaattttggttaggatatatgtaaaaagtcatttcgtccaaaagttcaggcggcaaatatttcatattattatttgttgtggtaggaatttgggcaatttttcgtgtttcggtgaggggacaattttaatgggactgactttagaatgggttcgcaaactttaaaatatgtaggtaatctttttcaggtactcatgcactttgtatccacatttttttttttcgcatttttcaatttttttttacttttttattgtcacaattgctttaaatatcaaataaaggagatttatgtgcttattggatacaattccgcgatttgggtccacaaattaaaaaaaatgtccggtcctccaaattgcctacgccacaaaaaatcggaaatgtatgtggaaaaaagtgatctttgcgtgccaaatctcgttttgtgttgctgcttgaacttctgccacgtcgattcaattgtattcgtatgttgaccagagacaggatccttgaaattctccgagtgaaaaaattgaaaaatgcgaaaaaaaaaatgtggatacaaagtgcatgagtaccctttttcatttttgggtattttaaagagacataatgccaaaagattagcaatgaaaattgctcaagtggttttttaaaatttaaattcaacttacttggtcggctgacatgaatggagttaggtatttggataaaaaatgatttatgactcttaaaatcgttttgttagttaaa

SEQ ID NO: 256 - DNA, 5387 bp, Heterodera glycines
  misc_feature (34)..(34): n is a, c, g, or t
  misc_feature (36)..(36): n is a, c, g, or t
  misc_feature (59)..(60): n is a, c, g, or t
  misc_feature (65)..(65): n is a, c, g, or t
  misc_feature (97)..(97): n is a, c, g, or t
gaatttgggctaaaatttgaaaattcatatctgncntaaggttgaccaattttgataanntaagncattaaaaatggagaaaaatcaggagaatttnatgggatttatttgggttttctaacataaatatgaaaaaaattattccagaaattctggaaaaattcggattttcagaaaaaaatttataactcgcttctgaaaagatattcaggaaaagtaaaatgctacaaaaatccgcaatttttagctctattttataaattttatttcacatttttatcacttttttgaaaaatgttataaaaataaaagtgattttgggattccagaccaaaggggggtgaccaggatttttgagtgaaaaatttttttaaccaaaaatctttcaaaaacatgtcattagggctattttatgacgctgatcacgaatacgtgatcagattttacttttaacatcgataagacctcagaatccctgtgtgattggggattctgaggcatcattttgagggcggagggggcaggttcggatccggacggtgtaaattattttcgttatatttatggttatttttaatgtttttaattcatttagaagagtgtttttttcttaataaaaataaaattttttaatttaaattaaattgtttttttgtgaaaaatgttttaaattaaaataataatttatttacttttattaaagaactctgtattttttaaattagaatttgtaaaattaatttcaatttaaataaatattcaatccttgtacatttcaaactttctttttaattaataaaaggaataatttattttattttttaaaatttattaattacattcaatattaaatcttactttttaataaacgatttccttaattatttaattttaaaaccatgattgtaccctttttaaccattattgtaccattccaacaattattgtaccttttcgacagtggttgtacctcatctaatcactgttgtacctcttctaatcactgttttacctcttctaatcacttttgttcaaattttaatcactgttgcacctcttctaatcactattgtacctcttccaacaccttttccaacaaatcaccaaatttaaaaaacgggcgcgaagcgcctgtacaaccagaacaaaatttgaaaaacgggcgcgaagcgcccgtcgagcccaacaaaatttaaaaaacgggcgcgaataattttaaaaattttttaaaataatttaaacgttttttttgttaataataaaaaatttatttatgttttaaattaatttttttgtgttgaaataaaaaaaaacaagaaaattcattagatttatttttaagcaaaattagatttaaaaaacactgttgtaccacttcccgtggttgtacctctttccccgtggttgtacctcttctaatcacaattgtacctcttcaaatccctgttgtacctcttctaatcacttttgtacctcttctaacaattttgtacctcttcaaatccctgttgtgcctttcccttccgtggttgcacctcttttaatcactgttgtacctcttctaatcattgttgtacctcttctaatcattgttgtacctcttctaatcactgttttacctcttctaatcactattgttcaaattttaatcactgttgtacctcttctaatcactattgtacctcttccaacaccttttccaacaaatcaccaaatttaaaaaacgggcgcgaagcgcctgtacaaccacaacaaaatttgaaaaacgggcgcgaagcgcccgtccaaggccaataaaatttgagaaaccggcgctaagcgcccgccctatgccgacaaaaactacaaacggacgggaagcgcccgtatgtaatttttattatttttaattttattatatatttttttaattcagctttacagtaatgccgaaacaagtgtcgaaatgttgctggcaattaacagatgcatggaattattaagaccagagttggcatttgccatttttagtggtcaaatttttatcaatatttttattagacgattagaataattaattaataataaagaatatttttaaggcaataaattacggtatttatttgcgctgccaatttgttatggctttgcaatggccatgttcacaaaacccgttctgtttagtggtgtttatttgtcgtggttttataacccatatgttggctatacggacgattttggagaaattgtaagaaaaattaattatgtaattaataaattttaacaattacagtactccaacacgatagcttctgcacataattacatcgttattattggtctatccagcatttatttgttgtttcctgtaattctttgttggcaaacctacacaatgtcatcaggcggccaccaaacacatcagtcatcttgggcagaaaaaatggcaataaacaaatatattttaatgactataatgaggttttttgtttaagcaaaaatgcaaaatttttgaaaaagctaattatcttttcaatcatttattataaatattcagatttttatccaagtgattatcataagtttgttcaattcaattgcctccgtaatttacatctcaatgcaatttgtcagaatcagcaaaatttacatcatcgttggcacttacgcatgggttttttcgagtggttagcatatttatttttaaaaataaaaataatttttgcaaaaggttgccctcccgtggtgtatttgctgctgaacaaacgaattcggaatgattgtgccaacttttgccgtgccattttacgttttttgcgcaatgacaataattcggtgtcaaacggaccaattgccatggcatggatggcaccaaattatgtcagaaacaatgccaacaacagaaacaataacaacaataatgtgcaacagcaatgctgactttttaccgattaaaaaatcaccaatttttgtgttactgtatatttttagtgtatattttttttgatgccatctttttacgtccttttattccttggaaataaattttgagtcacttttttggtggaaaattagaattatgtttgcttggaactcgttgttcccggtttttgggcaaaatgccgagactgggaattatcaaaaaacggaaatgcaggttaaaatcaaattgtacggatgtgagggattcaatgcggacaaaattccacttgaacaacggacaagctgatcggcaaccgccggaaccaatgttcccaaaaagttttttgaaaaaagcataccgcaaaaaagtgcacatgcggtgaaatgaggaaactgatgaacagaaacaaaataataatgaaaaaatactacaatcatttttcattgcatattataatttttttgtatccttgaatttaatgaaactttcacgttacgtccttgtaaattattatacccgtccttggaaagtccttaaccctaagttgaggcaaggttaatgaatttaaatttccccatggcgcccaatcggcggcgcccaatcgtaccggcgcccaaacggcggcgcccaatcggcgtcgcccaatcggcggcgcccaactgacccggtccgcggcagtgccgataggcgccgccgggaaaatttttggaattttaaattaaatgaccaaatgttggttgccttttgaagttttgaggggtcggcggtgccgacaggcgctgccgggaaaaatttcaaaatttaaatgtaatttgttaaaaaaatttgtcaaaaatgaccaaaatttgggatttttaacacattttttaagaaattggagttttggggggctgtcggtgccagcaggcgccgccgggaaactttttttggaatttttaatgaatcttgttacaacatatcgccctttttatacttttatcagagacctcaaaattcaggacaaatctgaaaaatcaggacacttgggagccctggctataactgattggtgagggaaaagggaaaaatgaagaaaagaaaaggggcagagggataaatgaatagggatgcgacttttagtgacgaaaaatcccaaaatagtaaaatagtgaaatgccaaaatagtgacaaaaagtccgaaatagtgacgaatagtgacataattttcagccaaaaattgagcaaaaataatttttattcactgattgcagttgcaaatgagtaggactgggatttttaagacaaaaaaaccaaatagttacctaaaaaaatttttaaaattaaatttttttgccaagaaagtaaatttttgagaaaattttttttcattgcataggagtatattttgaaaaattttagcttgattcttaggggtgtattttttgaaatttttttaggtagattcttaagggtgtataaaatgaatgcatcattactaaaaatgaggtgacaaatttaatggatgtaacggaacgaccgctcggcgtagaatgttgagaataaacggagaaaatcgatgcaccaagaaaatggcaaaagatgcagaaactacaattaatgtatatatatatatatatgaaaaaaatagatttttctacgacaaaaaaatgtttaaattttttgaaaatccaaaaaaaaatgccaaatttagcagattttcaagaattttatcggttttcaaacaattcagagaatttttcagccctggtacatccctgctgtcccatgatgaaagttcatccaacagactttgttgcctcatcccgaccaatttaatcatggaaattttcaaaaaaaaatttttttttttttgttttccggtgccagtataatgcacaacattcttgagctatttaatttttttttgtaaataaatcagggtatgaatttgtccttgtgtgccattggggaaaaaaagaaagaaaatattccataataaaaaacaattttatttaaaaaattacaaggaaataaataagggacagttaagcaaatgttggaaaaaatctaaaaatgtacaccttatgagaattggattttcgtgtgagaaaaaaaaagaagttcttatcataagtttgttccacacaattaccgccgtaatttatgtctcaatgcaatttgtcagaatcagtaaaatttacatcatcgttggcacttatgcatgggtttttgccaatggtttgtaggatttcttttaaaaaataattgaaaacttatttatttgtttttatttaaacagattcatattctttaaggttgtcatggtgtatttgttgctgaacaaacgaattcgaaatgattgtgccaactttggccgtgccattttccgttttttgcgcaatgacaataatccggtgtccaattggccaattgccatggcatggatgaaccaaattatgccgaaaacaatgccaacaacagaaacaataacaatgtgccacagcaa

SEQ ID NO: 257 - DNA, 8864 bp, Heterodera glycines
agcacaatacgatgatggtcatgctagacatcgtgaaacagcgtcggagggcacggaggacgagtacgaccacgttccgaaggaaagtccaattgctgaatcggtcgacacggatccatgcttcattcttttgaacgataggcacgatagccgcgatttcagctccgttttggatgtcatcattggcaggcttaacttccatggtgatgggccaacgatcttcgggatggatgagccaacttgggccgctccaccagagtggatgggaggtgagttcaatcacagtgcatccgcgtgaggcgacatcggctggattttgctctgtcgatatgtagaggaagcgaacgaggtcaacggcacggatttcttttagccgattctccacaaaacgaggttgctgctcagaagatgacacctaaccaaggactggtttggagtcacaccaaatgaatttgtggcgaatggcaagtccgagctgtttttcggcaaattgaagcatccgaatgccaatcagcattcccatgagctccatgcgcggaagtgagatttgatccctttggtttcattcggctcttggcaaaaatgagatgggccgtgattgcgtccccatgttgtgcccgaatgagatgcatgctccgtaggcatctttgcttgcgtcgacaaaggcatgtagctgatgcgaggccgcttccaacgggatgactcggcgcgggacacggaccttttgctggttccaagttgcggcaattgtgttccatttttgaactatgtcagtcggaagaggaacatcccagtcgagcttggtttcccaaagtgattggaaaaacattttggcatcgtgaagtgccgggcacactagtccgagagggtcaaaaacagaggcgagctgttgtagaacagttcgacaagtaacgcagcgactttcggtgtccatggacggaaagtcgatgtacagtttgtccggtttcaactcccagtgaaggcggagcactttaggcacttctttctcgagttgatcttccttcggaattcggcccatgacttcgtctgagttacagatgaattcgcgaatgttcatttgacaggcgcggaacatagtcttgctgctcatgtacttgttcagcgcttctgagatggcacccttgaccatcggtagatgaccacgttatccggcaacggtggtttacggacgtcgttaacccagagcattttgcagaattttcggtcgcgttccagcaggctgagtgaattgaaggccttttccaagtcacgccatagcgcaatcccagccaggcgaaagcgcatgagaattccagcgagttctggcataattacgggccctctgaacatgcatttgttgagagagttttgcccttttggatgaatgttgaagacggttgagaattgaagacaatcggcgatgggccatggcaaaatttgaaggcaggtccggcggaaaattcttccatggccatcccacgctgtatcttccgttggccaggcgcgtagttgtctggtcgaagatttgttgggccgtctcatcatcattttcgagggggtcatctctgatgccaatgttttgaaggtcccagaattgccgtagcgagtcaagatcagagatggattcgtttctctgagtcccactgacagctgaattggtcatcttgtcttcattggcagaaacatggacggtgacgggcatgacggacagtggatgatcggcagttggacgagacggaatttcatcgcgcccgcagattcagtggaaccgattgaagtttgaacgttgaacagttgcggagacactctttggacgccgttaaaaaacttccagaagtctgccattccaacgagaatgtccggttcctcgtccacaggtactaacattccctggaggaatgtggcacggcgcactgatggcacgatccagtccgttcgatgggcaaccaacgtctcgtagccaccgtcctctcgttggacgcacaacacgtgttgtggcgctttcatctggatgggctgccgagtgtcgataggattcacctcgagctcatcgtcttgcagtttcggaaggctcagttgccgtatgagggacgaatggagagacaattgccatgattgtagtgacaattgtcggctcagaaattgggtcagcatcattggcaacagcggatgacaccaatgacctcgagttgcgctcagttccgaaagtctgtttgttcctgggcgagcgctttgattgctttggacgagcagaagatgtccctttggcactagggcagattgccgaatgatgccgttctttacacgtgcggcatactaacattgatcggcactctctcagctgatgtcctttccgtaggcagataaggcatcggttctgctgcaaaaggcatctttttcgagtctctgcatctgtcactttgttgcactccgagtcgcaatgctggccagggcagaacagacaggaaggaactcgcttgtcatcagaatttctgactgactgagcaacggaaaaaactcgcgcattttcatgccgttctggtcgctgaggtcgatttggccttgcttcgtgccgaaatcgtgtttgtctgtcggcatttgttccgcgcagacaccgttcaacctcttctctgactccgagaacttcggcgagtccagctctgagctgaggagtaccccatgggatgcctgccgcacgttccatttgacgagttccagtggacggcagtttgctgtggatgatttggtacatgaatgggctgtcatccggcatgttgaggttcgaaagttggcggcacacacgttccaaagtctcgagaagtgttgcagtgatccaacgctatcgtcaccgaccgaagattgatcagttcggactgagtgcctcggcaattttccgtggatccccgaagagtcgcctcagtgcggcgatggcatggacgtaattttcttctccacggtaggctgtaacggcgcgagcagcctcaccacgtaagcacccgtggaggtaattgtttgtcgacgggctcgagggtggcacgatcgacagcactctcaaaactttgccaaaaggaaggccattccatcggttcgcccgaaaaaatgggaagactaagctgcggaagccgagcagtggcatgaggagcagctgccggcggcattggcatattaagagcattggcgaccggtactggaggtggctgataagcatgattcgcagcagccggctgctgaatattggcaccagcagcagcattgatcgccacaggtatggctggcacttgtgcaatggcttggttcacagcagctgctggctgctgtcctcccgctggcatgacttggttaggtggatttgcgagctctgctgctatgtgagccagcagctctcgcgcatcctctaaccaatccgtcagatgacggtcgtctctcacaaagttggcaaatagcgcttcctccgcctctcgtgccgggccttggagtgtgttcatgattgtaccccatgcatccagttcgacttccatccttgacaggattcggatgatgtggtctcgttcctgctcagggagtcgactgattgggcatccggatcgtcttcatccagcaagttctcggctgaggtgatgtgctggcgaagacggataagtgcagccatccggcatcgtgcagaagacattatgaatcgctaacggcaccacttgtcgcacaaaggggatggacaacgaccgggaggggggatgaccacgagggggcaacgaaagggctaagaagggcggcgggcggagagacgaatgggcggaaaacacgggggaccagccaaagagtgggggaataatgagcgagtagacggttagagaagtgcgctttattccaatgcagaacagtgaagtcaatggaaatggtgaagtgaagaacaggagaagtgagaagcatttaaataggagaagaaatgtggggaacaaagaccgaaatgatgattaatacaaaaaaatggacagaatttaagaaacatttaacatataattctcaacagaaggaaattaatcaccggccaaaggccaatccaaccacattatttgtcctttttcattcttaaatctgctgaactccttccccaaaattcgcctttgtcatggtactgccgaccctcaatttctgtatgatgtacgccctcagtgatcgcttggattccgatcggggaagggaagtggattggcatgttagaagatcaagggaccatcgaattggacttgctgcctccgaatgcagtcggcgatatctaccatttacagtttgttttagataggtattactgtctaaatgaccccgggaggctggcgattataaattcactgggccatcgacagattaaaaatagtaaaaactttgctttttggtgggtgtacgttcggaggaccaaaatgtgatcttcgcagggctttctcggtgtgattttttttgttatatcgtcgtgacaaatggggtcggggtcacttcgccgcggccatctcgccgcggccatctcgccgcgagaaactcgccgcgtggccaactcgccgcggcgctatctcgccgccgcccaactcgccgcggccaactcgccgcgccttgttttttggctatctcgccgccagattttttcattgaaaggttacctcattattttgatataaaattaaaaaatgcattaatttatttcataagaatcattaaaataacaaacactggtccataacacaatttgattcttttcgactttattcgaattcaggctggtgttataaataggttgaaatggagtgctcagtagagaccggaaatttcaaatttgcggatcccgctgcgggattggaactcaaaattctttgcgggacgggatcccgcgggattaatcccgcatttaaaaaaaaatgtgggattgcggactgggatcccgcaaaatcccgcgcgggatcccgtcccgcgccggtctctagtgctcagcgcctcaaaatacccaaagaaacttgttaaagaattcccagaaaaaaaaaattcgggaccaatgaccgacatgattgctctttaaatttgtggaaaatatagaggaatatatcgttctgcaatttttccttcctgcgttaactttcaatttgaagcatattaaattggagagaaactttgctgaaatataacacattgaatacaattaactgttaaagaatttttgcttttaatgcatttttttaacgaaaaatctggcggcgagatagccaaaaaacaaggcgcggcgagttggccgcggcgagttggccccgcggcgagaaagcgcgcggcgagttggcccggcggcgagtttctcgcggcgagatggccgcggcgagttggccgcggcgagttgggcggttccctgacaaatgtatgttttatcaatgtctatattttgtatgaatggaaacaatcagaaatgaaaattacaaaaaaaaactccgatctttttcaaacaacccttaaaaacgcgatttttttatgaaacgacctaatagaaatgttccattgacggacgataaatgaatccgaaaagattgtgccaactttggctgtgccattttccgttttttgcgcaatggcaacaataattcggtgtcgaatgggccaactgccctggcatggatgacaccaaattatgtcagaaacaatgccaacaacagaaacaataacaacaataatgtgcaacagctatgctgactttttaccgattaaaaatcaccaagacagacattgtgaacggatgcattttaaccacacttttttcgtttttgaggttttatataaccggagcatttgggatgggtatgaaataattgtttaatatttatttattatttttgaaattaaagctttgtgggtttgcggaaacaagtgacgaaatgttgctggcaattaacagttgcatggatgttgagatcggaacgattgtgccaactattgccatgccatttttcgctttttgtggaacaatgccaaaaacagaaacaataacaaaaccatgtgcaacggcaaagatgaacaaatcagcagtaaatactctcttccagatttttgccgattttaatggaaataaaacggaaaaattcccaatttttccaatattggcaatttttatttttcgttggaaaaatttatttgcatattcttacttttacgcggatttttttttttaataaattaagaaccgcattgactttttaaatttttaaaaattcgagatattttttataattgttatttcaatttttatatgataattttgtttaatgaattaaaagttttaccactttcttcatgtttgctttaaattattttctcgcgcttcattcacttttttttgccattaaaatttgtgtccttttaattgggtatgtaacacgcgtttttgtgacgataattgctgttgtgtaatccaaactatgatatttctttttcttaaacaaaaaaattattatgattcataatttttatgttccctaaaaataataataattttttattttttaataaataaaaaaaattcatcccgatggaattgttgctgtttcgtcatgacgaatttgacaaattgtacggctgtgagggatttaatgcggacaaaatcccacttgaagaaagaacaaacattgtgaacggatgcattttgatcacactttttttcgtttttgaggtcttaaagagaatatattaagaattaatatctatttttttaaattaattagttaattttaaattaattaatagttaatttatttatattaattaatttaaaattaatttttttaaaataataaaaaaagcaaaaataagaaaaaaaaagaaaataataaaaaatcaaaaaaatatcattaaaaaatctaaacgcaatcgtggaaaaaaacctacgaataaaaatattttcagggggtgattgaattagggctgctctagagtaaaaatttgttatattcggatagcgagaccaaaagtaaagaaaattctcgaaacttaaaatatgaaaaattaagctactttacattccgtgtatggtatcaatttacaaaaacatgaaaaacaatgcctgctacaaattgatgttctttattggcatattggacatggtcattttttaattgaataaatgcaataatatttatcattccaatttaattgctttgtctgcttcatgaattctcatattttattaattatgtatttgtattttttaattaaatttccatagtcggccttgttcatgaatgcgttggaaacgggaattcttggcattattggtgccgtttattgtgactatccattgctgatttatacaaccggagcattgggagcaggtatgtaatttttattatttctaattttattatatatttttttaattcagctttgtggtatgccgaaacaagtgtcgaaatgttgctggcaattaacagatgcatggaattattaagaccagagttggcatttgccatttttagtggtcaaatttttatcaatatttttattagacaattagaataattaattaataataaagaatatttttaaggcaataaattacggtatttttttgcgctgccaatttgttatggctttgtagtggccatgttcacaaaacccgttctgttcagtggtgtttatttgtcgtggtttttcaacccatacattggctatacggacgattttggagaaattgtaagaaaaattaattatgtaattaataaattttaacaattacagtactccaacacgatagcttctgcacataattacatcgttatttttggtctatccagcatttatttgttgtttcctgtaattctttgttggcaaacctacacaatgtcatcaggcggccaccaaacacatcagtcatcttgggcagaaaaaatggcaataaacaaatatattttaatgactataatgaggttttttgtttaagcaaaaatgcaaaatttttgaaaaagctaattatcttttcaatcatttattataaatattcagatttttatccaagtgattatcataagtttgttcaattcaattgcctccgtaatttacatctcaatgcaatttgtcagaatcagcaaaatttacatcatcgttggcacttacgcatggctttttacgagcggttagcatatttactttaaaaaataaaaataatttttgcaaaaggttgccctcccgtggtgtatttgctgctgaacaaacgaattcggaacgattgtgccaacttttgccgtgccattttccgttttttgcgcaatgacaataattcggtgtcaaatggaccaattgccatggcatggatggcaccaaattatgtcgggaacaatgccaacaacagaattgggccacagcactgaatggttacgggtgaaaaataaaaagagcgaatatttttaaactaaaacccatattaaatttatttatgcggatccgaacccagacaactggtatagtgcagggatgggccaaattgaaaaataaaaagcgaaatgcgaaaagcgaaatttgcgaaactgaaaaatgcgaaatgaaaaaaaaagcgaaatgcgaaaagccaaaatatgcgaaaagcgaaatgcgaaaagcgaaattttttctacaactttttaatagttaaaatcataaagcaaaaatcattttttaaaattttattctaaatttaaaaatcaataaaacgcttttttgaggcgcgctttttccaaaaaaactttttgggaagaagggggcaggcggcgccggcatgtaccgccgcgatagatagtgaaaatttgattaaaatttgttgacagattttcactaaaaaatgatcaaattttgatatttttatcattttt

SEQ ID NO: 258 - DNA, 2324 bp, Heterodera glycines
attaaattttgagttttagcttaaaaatattcgctctatttctttttgtcccatttgccattcattgctgtggaaaagattccaaaaatttctccgccacgcctaccgacatgattcaacaatttaatgagtttgatgtaaaactatttgctttttgaaataaattgaatgtaatataaattgaagttatcaatacaagaaaaagtcaatttcactggtgatcaatcattaccgtactgttccggctggtgttcgttgctgtggcccaattattctgttattggaattgttcacggcataatttggtgtcatccatgccatggcaattggcccattcgacaccgaatttttgttgcaattgcgcaaaaacggaaaatggcacggccaaagttggcacaatcatttcgaattcgtttgttcagcagcaaatacaccacgggaggacaaccttttaaaaaacattaaataaaaaatatattttattttaacttaaataaataaacaaaccattgctaaaaacccatgcgtaagtgccaacgatgatgtaaattttactgattctgacatattgcattgagaagtaaattatgactgtaattgaatgtatcaaacttatgataatcacttgtagaaatgtctgaatatttattttaaaacatttaaaattatttgaatttaatgttttttaattataaatagggttaggattttaatgataaataatgaaaaaattaaaattaatgtgtttttaacagcaaatatttgctattttttgcgtccacgatggctgaaatgtttgctgattttctgtcattttgtacattttccaacttagaaatgcagaaaacaacaaataaactgtggataggccaaaaatgacgatgcaattattcacattatccatggtgttgtaatactataattttaaaaattaactaaaattaattaaaatttgcacaatttgtccaaaatcgtccgtatagccaacgtatgggttgaaaaaccacgacaaataaacaccactgaacagaattggcttagtgaacatggcaaacttttaaaaaattttacaataaaatatattgcatacctcctcccaaaattccgcttgaataaatcagcaatggatagtcacaataaacggcaatgttctggattttagggaatttatccctgaggaattggtcccacaaaaactttcggctggtcttcatcgttgtggcatattattattattattcctgttgacattgttcacggcataatttggtgccgtccatgccatggcaattggcccatttgacaccgaattgttgttgcaattgcgcaaaaaacggaaaatggcacggccaaagttggcacaatcgttccgaattcgtttgttcagcagcaaatacaccacgggagggcaaccttttgcaaaaattatttttgtattttttaaatatagagaatataccatttaataaatatgaaattcattatttaattaatttacgcattttcaagcaccaaaaaattactaaaaattcctcaaattttttcaattccaaacataacccacatattagaaattaaaataatttgatatctttgtttatacagtatgaaactaatgatttaatttaaagatagcaaaatttcaattaaaaatcctacaaaatttatttacaaagttgtcaaattcatggcttaaatttttgacttaccatgcgaaaaaagccatgcataagtgccaacgatgatgtaggttttactgattcttacaagttgcattgagacgtaaattacgcaggcaattgaattaaacaaacttatgacgatcacttggagaaacgtctgaatattatttaaaataaatgatattaaaaaactgtaattaatttatttcctaaaatagttttggaaaattaagaaaatttaaataattttttttttgccattttttgtgtccacgatggctgaaaagtatgatggcttgatgccattgtgtaggtttgccaactgagaactgcagaaaaaacaatataaattgtggacaagccaaaaatgacgacagagtcttgtacggtatgcatcgtattgtggtactgtaattcatttttaaatatatgtattaataatctttgcacaattattccaaaatcgtccgtatagccaacgtatgggttaaaaaaccacgacaaataaatcccattgaacagaacgggttttgtgaacatgacaactgcaaaaccataacaaattggcagagcaaataaacatcgcaatttattgccttaaaatatttaaaataattaatttgttaaaataaacataatatt

SEQ ID NO: 259 - DNA, 1323 bp, Heterodera glycines
  misc_feature (102)..(102): n is a, c, g, or t
  misc_feature (107)..(107): n is a, c, g, or t
tgatttggatatctgtttattattttactacgtttttttattgcgagtttgctcaacaattttaaaattaaaggtgtgaatttgtagttttatggctgcttntaatntattaaactgattattcggcagcctcagaaattcatgtgatgtttttatataattataattaatttaatttaaaaataataattaaaataaaacgtggttaaataacgtgttatttaagaataacaaaatatttattaaatagaaaaccttattatttttatttatttcattttgcatcatttattttttcattttcctttagtttttagaggcaataaagttattattagggctgccaattctatgtaaatacatatttttttcctggcttctccttgctctaaatagcaggaaaaacactttcttttttgtgtttgcgaacaaaaatcgggacttttatttacatattttggatttttttcatatatattttcatttatttacatattttgagtattttttacggaaatttttggaaatcctcaaaaaaaaaatccaaaatttctgcaaatatttttgtacatattttcatttttttacatattttgaaaatttataaagaaaaaataagtttgaaaatgttgcctaaaaataccaaaaaagtaatttttatgtcattttatggctatttcatattttacggggattttctttcccaaaaaataccattaaaaaatttttatttacatatttggggttttttgtacatacctattttgtgatttttcttacatatttatgtacatatttggaccactttttgtacatatttttggcagcccttgttattattacactaaaaactctcaattcatttcacctgctgctgtatttatatgattgtttgtctaaagtttatttttttaatagtatttttgtatttatttttatttattattttataattatgctcaaaattataatttctttaaaaactttttaatttaaatttttagtttattaaataaatgattattatggaatttagggttaaatgattttttttttcttctgcttactcataatggcctcaaaattattttaaaagtatctaaaacgcatatttatttttaataattgaatattgacaaggttttcgtaaatttgctgtggtttaatagcgcttttataaaattgtattaaaattataaatgataaatccctctgacaaatgtattcattgtttaatatttatgtttatttaaagtcttctgatacagtcatggtcataagtgctgccccatgatgctttgaaagaaatacttgcgtattaaa

SEQ ID NO: 260 - DNA, 12604 bp, Heterodera glycines
ttgtcattttccaatttcaacagataagtagcataccatcgtatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcatttcaaagcatgatgggacaacacttatgaccatgactgtatctgatttactgcgatgttttgagcagattttattttattaaaagattattagtcaatttaaaaattaattattattcttttgcttttttttactctgaaagtttcatttgtttttccttaatttatttaattttctttttcaaatttatgcaaccatttctcgagaatatttgcaatttatttataacgaatccgagcattggaaatgatgataaattaatttattgcaaattaaaaattatttggacgaattttttgctggaatttttaaatgaaaatgaatgggggagaagggacgacggggcaatgggagaaggggcaattaacggacaaaaagcacaaaagtcaattaaaatgaatgcggaatgaccgcccaaatgaattttttgaaatttaattttgcagatggcgtaaataaaatggacgaaaaagcagtgaaaagagaacagaagcagagaagaaaaagcgaggatagaagagagggtgaaaagaaaaagagcgaagagagagtgtgggaacagagaaataagcaaatcctcccggggataaactcaattttttaaatttggacaaaaatagaaaaatggggaaaagcggaagaagagggtgattttctcggaatttttggtggtcaagataatttcaattatcagaaagcagcccaaatcctccgtgggaaaaggattggattttcgggattttaaattcaccgagcagaattgcagaaacttcgcgccggaaatttaccattttttattaaacttttaaaattcgtatcgccagacccaaaatctcaataatttttcatttaaatagactcaaaatttaataattttttgataaaatctattaaggttcgttaccctctttctctttctgatagtttttggtgaaatcattaaaaaacccttaatttgaagcatttttgtttaaataaataaactgtaaatttccctagaaaagaaaagaaatataatttaataactagccagatgaaaaaaatcaacaaaatctatttgaaatttaataaaaatatcacaaataaattctcagtctgtccattttaaattaataatgtaaaaagaattgtttaattgattgggtttattttttattcatttcttgaaaaaatatcaagttttgaaaatgtttaaatagttcgaatcttttttgattcagattatcattttcgtaattttccaatcatatcccgcatataaattatttatttttaatttgttttatttcaattgtcaccttcataattatttcgccatatttattattttgttaaacaatgctaattttagaagcttatccaaatattcattgtttcttgctgttttttatgggttggggactgaatttaatcacaattttaacaattaaaatcataaaatattgtcatttttggactaaatttgttcgcaaagtgcactgaaaatttcaaaattttccccggcggcgttgactcaaaaacgcgcaaaaaaactaacgaattttttgttttgtgcgttttgaaatgataaatattttaccaaattgaatcaaaataaaaaaaacaaaaattagttaagaatagagtcaaaacaatttttaaacaaaagcgaataggaaaattttttgaaaaaagtctcgagtctcgggttttttgggtctcgagtctcgggaaatttttggtctcgagcttgtcaacaacattttttaaatttctcgagctataccgacaagtcttgtctggggatttgctatcagctcctcaacttttctatcccagagaatcggggaagaaacctagataaatcttgctctagggttcagcgaggatagcattccgaggccccaaaaattttcggaatggaaatcgagaccaaaaatcccgggaatcggatgccaaaatcggaattcgtgaagctggtgttcagcacttaaattatcttgttattttgaaattataaaataaattttgttcgcaattaagcatgtcgcaaactctttccttatatctgaaattagaggagacgtattatggggccaaattttccatcttgttttagaaaaaaatttttaatgtttttttaagaaaaatttttattttttccaaaattgtatgcaaatgtccgtccgcaaatgtcccactgcgttccatgtctatgaaaattgtttcaattttagaaaaaataataaaatattaattcagattttgttattaaaattattagtttttttaatattctctttaatttataatcaaaatagtttttaagcttttaaaagtcaattcaaattactgtgtgcttttttaaaaagtgccattcttattaattttcggaataatattttattttttttttcgctgtttcgtactttcaaattcaacgtctgattttattaattgaattatctattaccaagttatttttcattaaaacatgctttacttttttattttttactatttttttaattacttggtatttacattcaaaaaaaaattaataaaaaagacagcatatgtattttaaaaagtataaattttgcatttttgtacaaatatatttgcaaattttttcacttgaaggcaaattcgttttgtaatagtgttacaatttttggccccaagatacgatttttaaggcttggtgttcttgatgttcatcagatctttttatatcgctaaaattttttggatatttttactttaattttttatttttacgttaattttttgttctttagtatttttgtttgtcacttttttattctttttctcatgattcccctcttcttattcttcttagtcctcttcatttcttaattttcttatttattttggtttttacattatataaattaattattcaattaattaatgtgcaattttcaaatatttattaattagtttctttttattaaaataacgaattattttgagaaattaataattattttgcttttttaaaacattttcactgatttatgcgttaataataatccgatgcgaagcttctaaccaaaataatttttaggttttttatctgaaacgcaaaataaaacattggtaaaaaaccaaaaatactaatatatttatagaaataaattgaaaatgatgacaattaatttattgtaaattaaaaattaaaaagaaaaggtacttttcggttttgggcttacacctcaaaagccgattttaaccattattattcccatagcataaattaacggagcggtaaaggtcctccactcccaattttgcgcataaatttatgcccccaaaatagggcgcatattaaaatgccttcagcgcgccctttgttgacaatttttaaaattttgagctgtaggcccaaaaccgaaaagtaccaaagaaaatacctcttgtaaacaaaaaatttcggattttctaatattttaatttgtgaaattccttttcaaaagggcgttctgaatttttctgaaaaatcgcaaaattccatatttatggaaatacaatcctcccgattttctttattttaagctttatcccactaacattgtccaaccctgaagtgagtttttaatttccaaaaatttgcataaatttcccgggcttaaaaagaaaaatttaaaaaaatttcaaatttctgaaacgcacaggtgttttcaaacaattctccaacatagtaaaacatatacataattttgatcaaaaatgcttaaactatttacaatccaagttaatctccttaaacatcattagccctatgctcattttattcagcatcttttcggctacttttcaagttaaaattttcaaatatgcattatttgaattcatagctgtttccagcagaagtaatgaccgaccaattcattcaattaaataaaatatattttaatcaaaatatttatattatattgattttttttattatttagcattatatatttaattatttgatatggcaaaatgaccaaaagaaataattttgattttttattggctagcaaaatggtaaaatgagacttcttttgagaaatttcttgtttttgagcaggtttgtttcagtttatagaagaaaatatttttggcctgggatattttgaaatatgtatatatttggcttctggaccagtcagccgaggacaactcacaaatcagctgacagataattccgctgatggacaactcagccgtacaataaaaattacaaaataaatcctaagcttaagcctaggtccaagcaagcctaagcctatgactcgcctaaagcttaggtaagcctaggcctagcctaagcgattgtacgagttgccttttgtaaattctcgtaaagctgagttgtccatcagccgaattatccaatctgctgagttatcctgacacgatatatttttcataattggcgtttttttagcaaatataaatccgttcaaatataaatccgttccttggatataacaataaaaaaagatgttgaattgctttggtttattttttccaattttttttattatttcattattatttttaattattcatttgaatttttgtatatataatcgaatcttgttttccaattttagaatatttattttctttaaaaattgcttgttttctgaatgtcgagttaataatttatttatttatcctatagaaacattgttgcgacttttgtgtttccatctaatcattttatttttcgtcatagtttattttatgtgtaattattagagaccgagatttccaaaaatgccgggccgggccgggctggtttttccaggagtaaccgggttccggtcccggcctctcaaaacccggtcaactcgaaacccggtcaacccggcttttcaaattgccgggcccgggaccgggttggtaaaaattttaattttcacatatatttcaactccaaaattgaccaaaaagcgggtcaagtgttaaatttctgcactatttcacttcgggcgtaaataaatgacatcttcaattataaacctagaatttttcaaaaaaaaatcttagaaaatttttctatgagaatttcaagaattaaaaattaaaattttatagcgatttttctaatttttgtaatgaataataaaaatattttcatttcattttaaagcagggctcagatcgaaaaattttcaaaatcaggacatctggcccaaaaaattaaaagccaaacgactttttttgcttttaaaaacgcttttttgtggcgcgttttttaaagaattttggggacaggagggtgcggcggcgcagataggcgccgccgggaaacaatttgtaattattaatgcgatttgttaacagattttgcccaaaaaattactaaatttagcaaatttttcaagaaaattaaggatttttaaggtccggtttaattatttttcttactttttaaagaaatgttaaaaatttggaaaaaattaaaccagaaaattaaaaaaaacatttataaacattatgccaaagagattttcaaggaaagagaacaaagtttgattaaatcataacccggtaaaacccggtcaaaaatgccgggttccgggtcgggttgcactttcaaaaaatcatagaaaaagtaattaaatttttcatttttcactgatttaaaataatttgaaaaattcttaagtatttatgaatccgtttataaatgtaaaatttttaacctatttttaacaaaaaaagagaaatggttagaacatttttggagaagaaataagcaatcgaatagaattaaaatcgttgcgattgaccaatcattaagcattagccaatttgggccccgccccgttccttttttcgtgtcccccgtccctggccaacattcattctgttcgggagagggattggcttagccaatcccccaatctctctccctcctcccactaattatcccgagaccgaactgggagtcccttccccatcccacatttattcatcatttactcatcatatatattgtattgtgcgcacattactgaaataaagagcatattcaaatgccgccgctgggatttttggggagggacccgtcgcctatttcacgattttgcacaaaaagaacaaaattttcgcctttgagaaaaatttttaaaaagagtttttttagaaaaataaataaatataaaacaaatttatggaaacatttttaaaaatattcgaaaataacagatttaatatttcttttaaattacttaaaaattaaaattattacggaaataattattttctttattttaaatttaagcttttttctttttttattatcatatggtatatttaatatgtataattaattaagtttttgttttttaaaattatattttgtaaataattaatgaatgcacctttttaattcttatttttattattttgttcatactttattaacaaaaataaatctactttatttgttaaggattaattgtaaaattagatttaattgggttaaacatgtcctcttttattcaggtaactcacgtaagaaatgctgaaatcgataccatctagttcaatctctatgaaatttcaattttataaaaaaattaaaatatttattattttaaatttgttactaaaattattaaatgtaaaaaatattattttttatttatgtcatatgtaaattgtatttaattcattttattatattttggaatatctccgattatttcaatatgtatttcataaacaaatatattaagtcatttatttatatttattatgttattagttaaatttaactttgagaaaaaccgtggccttccctagtattttggtttttagtgtttaaattaaatttgtataaaaaataattgaattcagtttggccggattttggtccatctttttcttcaaattattattgaaacaattattttcttattattttttttttgtgcttatgtgaggatagttaataatgtatataattaatttaagtttttactttctaaattatatttgtaaataataatgaatgcacctttttaattcttatttttatattgctcatacattattaatagggttgtaaattatatagattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgcctttttagtccatattttggccattttttggaaattttcacaagaaaaatgaaaaaaaaacgaaaaatacacccctaaagattgattttttggaaatttttaaaaattacaccccacaaaacacgaaaaatttgagttttcatcgtcattttggcattttcaataaatattttcgtcatttttttgcgaacatttcttttttttaatgagaattttttcgaaatttggcaaacttggaggtgtttttgatacaacgaacaataataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctggagaaacaattcagtgaggaggtccttccgttgtcaaattctcctatttctaaaaagccgaagggattgcttgatttttttgatcatacgctgtcagcatcgtcagtagtcgagacaaactcacgtaaaaaaaccaatttttttcatttaaattttgagttatagaagagcgaaatgcaatgagcgaaattaatgcttattgttctaccggcacaattccgaccaattctgatcctttagagttttggaaggaaagagccaatgaatttccgggtattttaatgtggttaatttattaaccggttctaaggttttacacattatttagctttggcagaagaagcaaacaaatttctttgcattccggcgacgagcgttgcaagtgagcagttgttttcaacagcgtgcgacacatacgactaccgtcgccgccgcttgcgtccaagaaaggccgaaattctgatttttttgaatcgaaatcttccaaaaattcaatataaatattaaaaacattttactgttaataaaaatggtttattgctttttggtaaaataaataaacaaatttaaaaaaaccgaaaaatcgaaataaaccgaaaatttttctttggttttttcgatttcggttttttaaccgaaaccgttcgaccgaccctcttgtccggtctctagttttaattttaacgagagaattaattagataatgttaaaataattcaaatattattgtattaaaataaattgtctttcaaatgttgttttttggcttttttatagtaataaatttaaattataatacatttttcaaaataaataagttaatacattgttgatatttattatgctattaattaggttattttgttagtaataattattttccatttttgtcttttctaatttttttttattaaatatattatcacacttttaatttattaattaaatctattagctattgatcacttgatcagttgaagtaactggacatttgtgccgtgttacccttttaagaaattgtttaaattaaatttcattgtcatattattatatattaattctaaactattagcaataattcatttttaatatatttttaattattaatgcaaataaattaaaaattcaaaagagatcattttagatgttttcattttacttcattgaagatttgttaaaaaatttcaacaaagtgcttaattttcactttattaaaatttaaatattatttatttattttttataatttagaatatcgacattatttatttattttaaactcatgtattttccccgtctaccccctcggctcattcgccggctgccattttaagtaatatttgatattaaatttatttttatgaaagattttgttttaataacttttttattaattttcataaaatatttttattttaatataattagatttcacatattatttaaatagtgtgttttggtttttttctgcaaatattattttttagaaaatttcttttattttgctatttaatgatgtaaattaacatttattccatttgaaaatatttataataaaaataattattttctgtaagtatcttttatatttattttttggcaatgattaattttgcaaatttcattttttagtctcgtaattaatcaattttctgaatatttatcgtttttttaattttttgatttgaactactattttcattagccttcttttcggtaattgttcaatattgacaaattcttgatgtattttctagaattttcccaaaaatttcatattattaatattttaaagaatttaattttctttgatattaggtttgtccatctttaatttttatttgttgtataaattcaattttttaattatgtttggtattaaataattaaattttaaattgtgtttttttatatatttttttttattatggtttgttttaaataatttatattaattatagttttgtgatttagtcactcgtccttcgcatcggagtatttaccggagtgagtgggttattttaggatgtttagcatttattggtctgtcttgtcttgtgaaattgtaattatgaattttcttcgtttgattataagtagggtcgcaacttttagtgacgaaaaatcccgaaatagttaactaaaatagtgagtaaaaatgccaaaatagtgaagaaatagtgtcaaaaagtccgaaatagtgacataattttcagccaaaaattaagcaaaaataatttttattcactgattgcattgcaaatgagtagggctgggatttttaagggcaaaaaaacaaaataggtacataaaaaaataatttttaaaattaaaattcttgccacgaaaatacctttttgagaaaatttcatttcttaggagtgctttttgaaattttttttgtcgattcttaggggtgtattttttttttttttttttttaggtcgattcttaggggtgtattttttggttttattgcatttttgttaaagaattttccaaaaaatgtcgaaatagtgaaaaaatagtgacaaaacgccaaaatagtgatttttaactattttagtgacgaagtcgccaaaatagtgatttctagtgacgaaaagtgacgtccaaatgaaaaaattttaacgcagaaatgcgttttttgagctcctttcttcaaaacaattgagcaaaaaaaaagttttttcactaaaagttgcgaccctaattataagttattatttcttcaaatcgttttttcatgtttattttactaaaataggggtaataatttttatatctttttaatacgaagttcagaactttcataagagaaggaggagaacatatatcttttgttattttctcatactttttcaatttaaaaacaggttaaaccataaaatattttatgcttaatttcgagaatttaaatataatatttataaataaaattaataaatctctgactgttaaaatttgacgagaattatggccgtgcgtttttccaattaatgatattgtttaatgaatttttattttattttttcttctgtaatgtctttctttattaaaaatataatctgcgactgatgggattatttcaaattttagttcaattttgttattaaaattccacttttattattaataaaaagtttcccaaatatttagcaatttgattatttaaaataataattattattttgttaatttatgttttttattttagaaatcgaaatcagaacagcgggctcaaaaaatgggaacaggtaactctcgttcaatattccaaaattgatcgagtaaagttcaatgatgaaatttaattaaaatatttagatttgttattctttttaacctttgtaatatgtaaattaatttatttcattttaaataaaactttttggtttggggtcattaattctgcgccgcaaatgtcatttagacttggcgccgcaagtgtcggcgccgcaaatgtcggccaatccaaattaattccattgtcttgttcttttgcagcacctcataattgtttttaatttacttttttatattgaaaaatttatgtttgattagttttgcaaatttaactttttatattgttaatttatttttatcatttggaattaaatctaagcgttttaaagtttttttaaaaaaaagaaatttttttagcaaaaaaataaaataaatataatacaaatttgaggaaatattcttataaaatattgaaaaataataagtattttaaagttttcaaactatttgtaaattaaaatgattacggaaattattttttatttaaaatttaaacttttttctttttttattgtcttatgggatattaataatgtactttttcaaaaaattttcatatcactaatcgagaagcgtctagaaaattgatgggactcagaaaataatttcggcttcatcgcattaggaccttttaaagagatagaaattttttaacaatattctatcgtgcaaatttccctatttgtaaaattcgagaagcgtctacaaaattgatgggactcagaaaataatttcggcttcatcgcattaggaccttttaaagagatagaaattttttaacaatattctatcgtgcaaatttccctatttgtaaaattcgagaagcgtctacaaaattgatgggactcagaaaataatttttattttgatttacatttaaactttctttctattatttacatttttgtttttgatgtccgaatgaaaaaaatttgaaaaaatatattttggtgttttgcccaaaatttattaccaaaaatgcaataaaaacgaaagatacacctctaagaatcggccccaaaaatttcagaaaatacccctactaagaatcaacctaacattttcaaaaatatatccctaagaaatgaaaaattttctcaaaattattaataaatgtattttattttttatgtattcattataaaattaatttaattgagttatatgtgttttttattcagtaacccacgtactttccaaccacaacggctaaacttacgcagaaatttttaattatttcctctaatgataattatttatttttattaatttatttatttttattaaaatatttattgtttaaaggactaaaatctcactgaaacattaattgtttccgaattatttgccacattaaatattaaaaattcgaatatttattattttattttttgctaataggtgcccattattcatc

SEQ ID NO: 261 - DNA, 2201 bp, Heterodera glycines
  misc_feature (97)..(97): n is a, c, g, or t
  misc_feature (109)..(109): n is a, c, g, or t
  misc_feature (216)..(216): n is a, c, g, or t
  misc_feature (233)..(233): n is a, c, g, or t
  misc_feature (2151)..(2151): n is a, c, g, or t
gcagcacctcataattgttttaatttactttttatatgaaaaaaatttatgttgatttagttttgcaaatttaacttttttatattgttaatttatntttatcattggnaattaaatctaagcgttttaaagttttttaaaaaaaaagaaatttttttagcaaaaaaataaaataaatataatacaaatttgaggaaatattcttataaaatatgnaaaaataataagtattntaaagttttcaaactatttgtaaattaaaatgattacggaaattattttttatttaaaatttaaacttttttctttttttattgtcttatgggatattaataatgtactttttcaaaaaattttcatatcactaatcgagaagcgtctagaaaattgatgggactcagaaaataatttcggcttcatcgcattaggaccttttaaagagatagaaattttttaacaatattctatcgtgcaaatttccctatttgtaaaattcgagaagcgtctacaaaattgatgggactcagaaaataatttttattttgatttacatttaaactttctttctattatttacatttttgtttttgatgtccgaatgaaaaaaatttgaaaaaatatattttggtgttttgcccaaaatttattgccaaaaatgcaataaaaacgaaagatacacctctaagaatcggccccaaaaatttcagaaaatacccctactaagaatcaacctaacattttcaaaaatatatccctaagaaatgaaaaattttctcaaaattattaataaatgtattttattttttatgtattcattataaaattaatttaattgatttttaattatttcctctaatgataattatttatttttattaatttatttatttttattaaaatatttattgtttaaaggactaaaatctcactgaaacattaattgtttccaattatttgccacattaaatattaaaaattcgaatatttattattttttattttattttttgctaataggtgccattattcatcaatcgttttaaaactttattttctttcttcattttgtaacgagtttatttatttttatttaatttcttcactaaatttggaattgttgcctttgccaattatttttccattattttcattgttacaatttttgtgaaatttactttacttggcgtcgacgccggaaaattttggaaattttggctcaatttgttaacagatttttttttattaaaaaaatagcaattttggcaaaaaaaaatataaaacaaatttttgaaatataaaattgaatgcactttttaattcttatttttattatttgctgatattttattaataaaaattaattaatttatttataatgtattaattatataataaattattggattaaatatatgctctttttttattcagaggcaactcacgtaagagattgcgaaatcaatattatctaattccatgttccttacggacatttgcggacaatttcgggaaaaaaataaaaaattcataaaaaaaattattttttttctaaaaaaacgaatggaaactgcaagactaaacaaaaatttgtttttgttttttgggctttggaaggcctcaatatctcatttttatatttctaaaattaatttcgcaggtcaaagtgaggttctagtttcttaaatgatgagttttattggtctccaaataactattttttggattttatgaagatttacttcccaaagagtatttgtcaacaacattttttaaatttctcgagctataccgacaagtcttgtctggggatttgctatcagctcctcaacttttctatcccagagaatcggggaagaaacctagataaatcttgctctagggttcagcgaggatagcattccgaggccccaaaaattttcggaatggaaatcgagaccaaaaatcccgggaatcggatgccaaaatcggaattcgtgaagctggtgttcagcacttaaattatcttgttattttgaaattataaaataaattttgttcgcaattaagcatgtcgcaaactctttccttatatctgaaattagaggagacgtattatggggccaaattttccatcttgttttagaaaaaaatttttaatgtttttttaagaanaatttttatttttttcaaaattgtatgcaaatgtccgtccgcaaatgtcc

SEQ ID NO: 262 - DNA, 3466 bp, Heterodera glycines
ttttaaaagaaaacccaaagtaaatcgaattagaatcccccccaggaaagttaaaaagaccattgatttatttaatcacttctagtttaattttattcaaaatgatttttgcttgtgatgaagtgacaaatttagtcgctggaacaaatgactgtgcagtaactcaagaaggaaaaattgaatgttcttatgaccaaacaacccaactctctattacacctgaacacttaacctgcttaaaactcgacaatacaaaaactaacaccactatggaaacactacaaattacaatagaaactttaacaataatttgcaccgaaaaatctgattattttacgagaggttacgaattatcttcgacatcacaaaaaagatgctcaggcgctgggaaatgtaccggccaaacttgtcaatcagtaaaaatgtcagaccggaatcccgaagtgaatgatcacgctaataatcaaccaggctattcatactgtgtaccatcgtgcggaggatggcattgtcaatgtttcctcgcaactgatggatgtctattttacagaacttatgccgaatcagttggtgacgaaattttcgaagttgttaactgtccatcttggaccattcaggcgacaattaaattgtctatcaatccagaattaacctattctgttgacttgaaacccggaattttaacacacattggtgacgagtctaatagttctatatctgtcacactgacttcgacttcaattccaccgacgccgttatttggttcgacatttattatagttcgcgaagaattaaaagcagcaatagttgcgaacggaaatttactcaaaaatatattacggtgtaaaaacaaagaagaagcgcaaagttttagttgcacttttccaccagaagcatgtcaatgccacggaggtgattccgttgtacattgtgaatgtgaaaaaagtccacttaccgaaatatttgctaggcaagagaaccttttacccattaaaacacagggaagttacgtatacttcgattcccaaattaaagctaaaatacagcaaacaacttctcttcaaatgcaagtcacacttaaaggacataaggttaaagctatttatgataaaaatatttgtaatattgttacaatatcattggaaggatgttattcctgtactagtggtgctaattggactctatcatgcaaaacatgtcccgatggtaagactgaaattattttgaaagctaatctggaatacatacaccaacaagatacaaaaatcattcccactaacaatactaatgaaaaccccactattggaatttcatttgaccaagtaactgatatattaaattttatctattcccttattaaagccaattttttcaatatatttattattatcatattcatactcattatgattttcctaattccatgtctactacctattctatatagaattatgtgtcgttgccttcctctttcgcgcgggagtgtcgcgacaacgcgaaatcctaagataaaacccaaaataaaaaagaggaaaaataaaaaacaatagaaaataaaatggggaaaaataaaacataaataataaaaaatatttttacatttattttggaaaaataatattataaaaaactatcgaaaatataattacataaaaatgaaaaaaaccttttgaaatgaataacggaaaattgtttgaaaaggaaaagtgcatttcctcaggaatgaaaggaacgaaaattaattaatattaaattgcgaattctgttaaggattgttcgtaaacaaattattaataattaatatattaaagaaattggaattgtaaagggaaaacggaaaagcaaacaattaatgggaaaatggcaaatccaaacggataacacacaaaaacatattttaattaaaatgagaaattgtagcgtactttggtgcaaaaaaaatcgtatttaaaggggtggacttttccggaaatttcagattcgagacaaacggttccctccgaagtttcccggcacccgcccaccgcctttcactgcacccggccttcgctgctctctgtctgtgcgagtgccctccctgtccgcgcctgctcgagtgccctccctttcctttgccattgtgtggccccttttggaccagccgttgcccgaatgcccttccttttcccatcgccgtttcgccgttctgaccccttttgattttgccacattttccatttgtgatttatttactgtcaccgtttttgtgcccccttttccccgttcacattatcatgtttgtcccccatttttcgtttccctcaccgtcccgattgggacggtttaattacccaagtttgaggtcgacacaataaacatactcttattaaaattgtgcccaacttggtctatttgcctggacgaacaccggcacgactcatcgctctccgatcggtcccgaccccctacgttcccccgaccggctactctgcgcgcctcgcccatttcatccccttcccgtccccttcaccccgcagagttcgacgcaaattttttgtcgccacgacaaaaagtggtgccacgacccgggaccgtgcctttcccgctgtgcccatttgtcctgccgtgcgtcccgctgtgctcgttcgccctgttgtgcctgtccactccgctgtgcccatttgtcctgccgtgcctgccgctctgcccgtttgtcctgctgtgcccattcgtcttactgtgctgcctgtccggtctgcacctgattgccacgtcaaaacgtcaaattcaccgttgcgcaactgctcgtcatccggaagtataagggtcaccaagcccatacaaaatcaagggttgacaaacccaatttaaaaaaaaaacacacacacacacacacacggatcaccaaacccaatcaaaaaaccgaaaaaggacaccataaaaagccaaacataattaaaagtcataataaaccctacagcaaacccatcactaatttaaataattaagtggacagagcgactcctaattcaattactccgacgaccaaagccaacacgaaaaagaaacaagtggcgaaaagcactacactgactgaacttataaaattaaaaacacaaacggaatacaaattaacgaaacttcgcccaaaacatacggagaatatattgaaagaattttatgaaaaaaaggagcaaataattaacaaaaacaaataaaattctgtgatcaaatttttaaatttgtgataacaattattaattctgtgatcattaaattttaataaaaattatttaaccagtgataaaacaattaaaattcgactcgatactgattatccactaaataaccataaaagggtacttagttaattattttgaatttttaaaatacaaactatgtccggtacgcttcgtagcaaaatacccctccttaatcgcgtattaaaaagggaaatagaaacgatcaaaacaaaattgaggaaaac

SEQ ID NO: 263 - DNA, 8270 bp, Heterodera glycines
attgtgtggccccttttggaccagccgttgcccgaatctcttccttttcccatcgccgttctgaccccttttgattttgccacttttttccatttgtgatttatttactgtcaccgtttttgtgcccccttttccccgttcacattatcatgtttgtcccccatttttcgtttccctcaccgtcccgattgggacggtttaattacccaagtttgaggtcgacacaataaacatactcttattaaaattgtgcccaacttggtctatttgcctggacgaaaaccggcacgactcatcgctctccgatcggtcccgaccccctacattcccccgaacggctactctgcgcgcctcgcccatttcatccccttcacgtccccttcaccccgcagagttcgacgcaaatttcttgtcgccacgacaagaattggtgccacgacccgggaccgtgcctttcccgctgtgcccatttgtcctgccgtgcgtcccgctgtgctcgttcgccctgttgtgcctgtccactccgctgtgcccatttgtcctgccgtgcctgccgctctgcccgtttgtcctgctgtgcccattcgtcttactgtgctgcctgtccggtctgcacctgattgccacgtcaaaacgtcaaattcaccgttgcaactgctcgtcatccggaagtataagggtcaccaagcacatacaaaatcaagggttgacaaacccaatttaaaaaaaaaacacacacacacacacacggatcaccaaacccaatcaaaaaaccgaaaaaggacaccataaaaagccaaacataattaaaagtcataataaaccctacagcaaacccatcactaatttaaataattaagtggacagagcgactcctaattcaattactccgacgaccaaagccaacacgaaaaagaaacaagtggcgaaaagcactacactgactgaacttataaaattaaaaacacaaacggaatacaaattaacgaaacttcgcccaaaacatacggagaatatattgaaagaattttatgaaaaaaaggagcaaataattaacaaaaacaaataaaattctgtgatcaaatttttaaatttgtgataacaattattaattctgtgatcattaaattttaataaaaattatttaaccagtgataaaacaattaaaattcgactcgatagtgattatccactaaataaccataaaagggtacttagttaattattttgaatttttaaaatacaaactatgtccggtacgcttcgtagcaaaatacccctccttaatcgcgtattaaaaagggaaatagaaacgatcaaaacaaaaattgaggaaaacaaattcgaatatgatcaaaataatcccggagaatgcatgcggatattcaataaaacaaaggaaattatccaaaaaatagagccaaattttgaaaaattaaaagccttaaataaaaggtggcaaaatttaatgagaaaaatgaacaaggaagaatggaataatgaatggaaagttcaaaaaatctttcgtgaaaaacacgactaccttaaaaccattaaagaaatagatgaaattctcgatacattaaaagacgtaaatttggaggtaaaaaggagattaaaattacttaaagcaaaatcatcttcagactcagacccggaagatgaatcaaatgattatgaacatgaaaatgaagacgaagtagaagaacaagaagaagaaaaggaatatgaaagtgacaatgaagacgaatcgccagaactttctttgaatgaccaaatacaccatgatcgtataccatttgtcaattaccgatcaagaataaagcttccaccccaaacgcttacgcattttaatggcaaattctcccaatggcccagtttctgggatgatttcaaatcctcagtggacaatgacccaaatttagaaaatatacaaaaactcaaataccttcgagggctcttacatgatgaaccgtacagaatagtgtcaccgtatcctcttacgaataaaaattacactatcgtaataaaattactaaaatcaaggtacggaaacccccaattaatcagagaaaatcttcatagcgaattacgcaacctcaaaagacccactgaatccacaattgattaagacgatttattttgttaattgaccgaatcattttacaaatgaaatcccaaggggaagacataaatcaccctcaaatcaaacaatcaatcgaaacgaaactcccctataacattagacttaaattgaaggaaaaattcaaaatctattcaacaaaagaaataatggaatttttgaatgatcatacccaagcacgtgaagacatagaaagaatggaagaatcgaatcgccaaatccggaatttcccctctaatagaccaccccaaaacggagtacagagacaattctatccaaatttcccacacaatcaaatgaaaccaaacccatggaatcaacagaacacatcttcctctccttttccatatacttctgcatttacaacgaattcaaacccagtacgcctggcacagtttaaatcaaatccaacacaaactagaacacaaaataaaatattttgtcgcttttgcgaaagagaaaaccatgcaagtaaagaatgcaaaatttattcaactcccgaaaaacgaaatgaacgtgtacgtgaactcaaactttgcctaaattgtctaaacaagggacatatggtcaatgattgcaaatccacttatttatgttttaattgtaaatacaaacataatactctcctctgcacccgtaaacaaactcagtacaaaacgaaggaacaaaaaaccagagtgaatatggctcaaaattacgaaaatcgtgaagagacacagacattcatgactatggattatgataaaaatttatataattatgaggaagaagaattacttatgactactgaagtcaatgttatcaatccagacaagcctaaaataaaaaaggaaataattttatttgataatgggtcacaaaaaagttatataaccgaagaatgtgctcaaactcttcaattaagcacaattgaggaaaaattattagcaatttccactttcaatcaaaataagccaaaaatcattaaatcaagactagtcaaagttggcattaaaacactaaaaggtgaaatagagtacttaacactacaaacagtggagaaaattactgatgttacaaaaatggttaataaagaaacagttgatgtattgggagtaaaaattccaatcagtcatgcacgtcctcaaattctaattggaatcgaccattattggcacttcatgttaccaaattcacaaattcaactacttccatcaggattttactcaataaatacaaaattaggaaaaatattatcaggaaaaggaaatattgaggacacaaattgtaattcagtgacagaaaaaagaaaaagggatgaaacgaaccaaatacttcagaaattttgggaattagaaaacattggaattatcgactcaccacatatgacggatgaagatacagcaatgatacactttgataaaaatgttacatttaaaaataacatataccatgttcgatggccttataaaagagagaacccaaatttaccaacaaattttggattatgtttgggaagactaagaaatgtagtcaaacaactaattaaaaacaaaaatttggaaaattacgacaaaatattacaagagcaaatggatactgacgtaaatgaaattgcggaattaaaatcaaataatttgcttcattatcttccacatcatccggtaataaaagagagctcaaatacaaccaaaatacgaccagtttttgatgcgtccgcaaaacttaaaggaaataattcactaaatgatgaaattcaccaaggaccaaaattactaccagatttgtgtggaatgattctccgatttagactcaaaaattacgtattaattggtgacttggaaaaagcatttttacgagttggattaaatgaattagacagagacacaacacgatttttatgggtaaacaaatcgtacttgaatgaaataaaacaaaaatatcgagaaattgaaatgagagacatcgaattgagacgattcacccggataccattcggagttaacgcttcaccatttttattaactgctgtagtcaatctccatctctcaaaaatagatgagatgtttgaaaaattcaagacacttaaagttaacggagaattatgcctaaatgataaagaagaagaatttaaaaatctttgtatagaacttaaacaaaatgcatatgttgataatttcgtaatgatgtgcgacaatgaaaaggaaataaaattcaaacattattggagtaaacagatatttaaactagcatcaatgaatctgagagaatttatctctaatcatgaacaaagtaataaagaaattcaaaagctggaaggatcagagataccaaaagtaacaaaaatgttgggtataaaatggaatgttgactctgatgaacttgatcttcaaataaaaattccactaatgagtaaagacacaacaaaaagacaaattttgacgatgattgccaaaaatttcgatcccatgggatggatttcaccagtaatactgaaatataaactatttttccaaaaactatggcgatcaaacaaagattgggacgataaattagatgatcaagaaattattgaatggaataatatttcaaacacagatataataaccataccacgttcgcctttcacaagtcaatatttaaatcattcaatattacacattttttctgacgcttccgagttggcttatgccacttcagcttatttacatacaaacgaccaagtgaatctactattcgcaaaaacaaggcttactccattgaaaggcctaacaattcccaaactcgaattattggggttattgatagccgcaagagccgccaagtttataaaaacggaatccaaattgaaccttgaaaatacctatatttggtcggactcaaaatgtgtactcagttggttgaaatgtaaaaagaatttaccaatttttataaaaaatagagttgaagagatacaacaaattgccttggaattacacatcacttttcattatgtaaaatcagcagataatccggctgatttggcttcacgaggagcaactatgagtgaattaaaatacaacaaattatggtggaatggaccaaaatggcttaaactggaaaaggaaaattggccacctcacagcttttacagtcctgatcaagaagaggctccatatttagataatacagaggaaataattaacactcaaataaatttaataaaaaacgaatataacggaattatcgaatgggataaattcagttcatggcttaaaataactcgcatttgtcaaactttattaaaattcatatttttcaaattagagaactctaaaaaatttaaagaaaaatttatttactctaaattcgaaaatgcattacaattaaaaatcatggcacaaaaaatgctaattcgaattattcagagggaaatggaaccaaataaagaagaagaaagacagttaagaatttatctcgataatgatatgatactcaaatgtgaaggacaattaaaaaatgcacaaattcaaggtgtcaatcccatttttttaccaagaaaacactatggaactcatttgataatcatggattatcacacacgaaatttacacgcaggtacaatgacaacattatcggaaataagaaaaacttattggataccgaaaggaagaagaattgttgatcaaatacggagacaatgctatcattgtaggagatataatgccaaaccttttcaacaaccacaaatgccaccattacccaaatcacgagttgaaataacggaaccatttcagaacattggactagattatatgggaccaatacaaataaaaaatttcaatgaaaaatgctggataatcttatttacatgcttcacaacacgaggaattcatctcgaattagttacttccttatccgtccagcattttctcaatgcatttagaagatttatatcaagaagaggcacacccaaacatgtatggagtgataatgcagcacaaataaaacttgcatcaaaaattttaccagaagtgttaaaattaagagaaattctcaaagacgaatcaattaaaagttattttttaaatgaaaatataaattggacattctctatagaattagccccttggcaaaacggagcaattgaacgacttaatcagaatgtcaaaacagcaatgagaaaagtaatcggaaaaagatttattgagtttgattcttttcaaactctgacttgtgaaattgaagcgttagtaaactcacgaccaattacatttatatatgatgaaattaactcttatcaaattcttagaccaatcgacttcatacttccacataaaaatttatgtattcctccgattttggaaaatcaggaaactaaagacccaacatattacccaaaaaagacttcatacgaccaaacaattgaattatggaagaaaaccacgaaattattagatgactattggaaaatttggactgatgaatatataccaagtctaagagaacgttataaaatcgaaaacaaaaatccacgaaattgtatgaaatcttttccagaattgaatgaaattgtaataatacatgatcaaactcccagagcaatgtggaaaactggcattgtcaaaaatgtcataactggatcagatggtatcgtaagaggcgctaatatcgaacttccaaataaaacagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatgaatagactgtttcaaaactcgttaacaattatatcattattaacattaatttcattatgttcatcttattcatacgaatgtccaaaggaacctaaaatatggaaaacgagatatacaactctatgtatcgaaaacggttttacaatcagacaaaataaaataacaaaagaattttgctataaacaattggtatgcaaagacaaacatattattaaacgacgcccaccttattgtggtgaaaaatgtaaatgtccagagggattcaaattttgtagttttgcatcttacaataaaatcaaaaatgaatcagttgaaaaaattaattaccaaagcattatttcgttcttcaaaccaaatatctgcgcaccaaataaaactgaaaactgcccaatcatgaaaagaaaattatttaattcaattgttcttcatgacaattcaattcacatagtgaaaacattaaatttacttttttcccaaattgactcaataaacaattttcgttgttttggggagggcaatctgacgattggtactccaatttactgtcgagaacatgactgttttaaaaataattcattcaaacaaatatatggaacgaaattttgcttttacgatccatacgaaaaaatttaccttgttaaatctgatgaagaattaattcaaatcaaagcatggggaactattgaaaaaatattttacttgccaaataatttaaatcaaccattcattgaaaatagacggaataaaagagaagaaaactcttcaatcactgaagaatcaaccattgagtgtttaaaaggaggcattattattaaagcaataaatgatatacaagaattacaaatttccattgaaaattatacaattataaaaaagaaccctcaaaaagaggaaataatttatttacccccaaaacttacatcctttgaatataaacctgtaattaaatttataagtaacccagataaatcaaatgagaaacaaatcacatgtcaatcatctcccgtatgtgaattaattaactgtcgattttgtatggattatcttaaaaacccacaatgtgtagaccagattcactgggcattaatgcttgtaattataatgataattttatgttatttcattaagcctccaaattattcgaatactcacacgttttatccattggattttacaatttatttttaattgttttaaaagaaaacccaaagtaaatcgaattagaaatttcagaccaaagttaataagaccattgatttatttaatcacttccagtttaatttttattcaaaatgaatttttgcttgtgatgaactggcaaa

SEQ ID NO: 264 - DNA, 1739 bp, Heterodera glycines
ttttttgaaaaaaaattttaagagacaaaacccaatccaggttttgtttaggagtcagcaattttttttcaagggcgtccattttttttgccattttttcgtataccccgaaaaaagagatagtcgtttttgaaaaaaaattataacgagcaaaacccatccaggtattcgttagggagtcagcaattatttttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaattataacgagcaaaaccatccaggtatcgttagggagtcagcaattattttt

SEQ ID NO: 265 - DNA, 1796 bp, Heterodera glycines
tggatgcttgattcatgatcagcgaccctgaataccattggaaacatattttcatggcttttgaaaattaaaaatttttttctacggggtgtaaactgtacaagtatctccgcttcctcctccgcttcttcaccaatgttggcactttcctggtgccgttattgtgccgtatgctcctcctcccccatgttttgctgttcgtctgcttccttttcgcccttccgctgttttgcgctttcttttccattcagatcaggtcagtaatactgtcgcctatcttttattccgcggcggactggccaagtgtggcttggtccagctgaggcggagttggttaccgctccttttcaccgctctcgtccctttcgtctcagcgccaaagggggacgagaatgggaggggggaagggtgactaatttggactggggtgttggatattgtcagcgacttgctgcttgcttaacggcaccaccgacaagattttggtgaagggcttgtcggaccccttgagctgctccgaacggacgggagctgctcgacaagatttgttgtaaagggtagtgcactttaggcgtccaaggttccgtttctttggccataacttttttctcacttggtcaacttggtcaataactacattcttgatatcaatcgaaagcttaaagtctttagaatattttgtagacctaaattctggaagaaaagcaacagaaacaaaataattcttgaatgtactcgaaaaagctacgttacgagttttctcgttgtaattcttctcttatagccaagtatttgctttttttacatttaaattcctgggactttaagctttagtttgataccaagaatgtaggcattgaccaaataagaaaaacatggccaaaaaactgcacattggatgcctaaagtctacatagagcaattgcttctcttttccttttgttcttgccgcctttgtccaaattttctatttgcatattattattatggcattagcacaattctcgatgtttgtccaactttcgggactatcgatgtcaatttttcctcaggtgaatttgtggctttggactttgcattgggtcaaaaatgagttggcgcggagaagtgagttaaatgatcagcaaaaatgctgatcagtgaatcaaatggcggagaacagatgaaacacattaatgagggaagtgcgcagccagcaaaataaaggcacaaattgttggcattttgttacaaatccatttcgaaaatttggatcaattaattgaacggaaagagtcatttcggcaaacattgcaaggtaattaaggcgcgccaacgattcgtcaactcagccaaaatgcgacgattcgtcaactcagccaaatgtcaacgattcgtcaactcaatgattcgtcaactcgacgattcgtcaacccagccaaaatgtgacgattcgtcaactcagccaaatgtcaacgattcgtcaacccagccaaaatgtgacgattcgtcaactcagccaaatgtcaacgattcgtcaactcagccaaaatgcgacgattcgtcaactcatccaaaaatagttttaaaaagcagtttcaagagcttttaatggcgcttagcacaattatagcattcttttaggctaatttagaaacaagaacacataaaatcacgatccttccgatgaaatattcaatcaaaaacttgcataaacaaattttattaaaccaaaattcaaagaaaaaaacgaatcaaaatgatgattatcagggattgaggttaaaacaaatttcaactgatattatagggtgaat

SEQ ID NO: 266 - DNA, 8650 bp, Heterodera glycines
  misc_feature (119)..(119): n is a, c, g, or t
  misc_feature (139)..(139): n is a, c, g, or t
  misc_feature (189)..(189): n is a, c, g, or t
  misc_feature (432)..(432): n is a, c, g, or t
ttttgcccatcgtatttcaatctcgaccaattagcagaaaatattaaagtgattactaagtctgatgccccgtttccgtaaaagccatttttactttgtttatttggacggccacacancgtctttcatgtcattctantcgaaaataaataaattaaagcttttttagaaggattcacaattattaanaattagcgagtgagagagagaaaatggaagtgccaaccgttggagaggaccacgaggacttggaagaggatgcggtgagatatatcgtattgaaaaaggaagaggggggggggggggagaatttccagatttcgtgatcagaaattagccgcgattcggggtgggatggggaccaaaaacgggatgattttctcgactcggacatcactcgcgatgctcggtctaccctgtttaaagtgccantacataaaatatgccatttcaaaacgaccattattggaaaattttattttttatattttctcgaaattaagactcgaatcagtgccctctacatgggcattgaccacttcctccatccccccccccccgcctcccgccttctctctttcttcctctccctttttcaaattcccttctttctcccatcctcttgctctccctcgattctctaaattaatattcggatttttaaattggatttgtgccgttcggtgactaccaaaggtggcattcccatgacccgaatgagaccgaacaatgtttcattgttcttaatcaacggcacggcagaaaagccgtccactcagaaggacaggtggcgatcactgatcgtcattcactctctcccaaaaaatgaaaatgcttccaaatgaattactttacgaaattgttcacagtcttccgtttgacatccgctgggccacctccgtccgtgtgtcggcttcctttgattattgggtcattaggcgccaatcaatttggctaatcattgagcataagcgtttaatgattttgaaaaaaaaggtctgagacattgactttttgctccatggcttatgcaaaatttgtaaaaaaaactccaataaacaccacgagaaaaaggcacacagattggcatactttttatttggacatttagctaatttatacaaaaattttcaaagtcgtgtgcccggcagtgccgaggcatttgttgttaagaaaatcggtataataattttttcaaattaaggtgggaatgctaattgttgagggccaaaatctgcgcaacctcgtccgccgattgagtccggacaaaatttcttccgttgtgcgtctgttgaccgcccatttcgctgttggacgtgacttcggattgcagttcgtcaacccgaacgcgttcacaccggcgcaactcgccatccgacaaatcaatgcgctcattaacaacattgaccacagtaacggaacagccgtggccaatgcgggtcattgtgagtaaaaacttaaaaattacattttatattaactgtaggatttgaattaaaattattaaataatcaaaatttcatttccattttggaagtttcattttttatattttggttttattccattttaggcctttttatttaaattcatgtttaacattatgtcataatagtatcttttttgatcaaaaattgttggattcgatggaatttgagttttgggaaattttgcatcaaatcttatcttgtttagtctcaaatccggcataaaattaatcaaaacttttttggggcactgtatcattttcatctttttcagtcttacacgagttggtgaatgcatttgagtgaagttcggtcgacggctgctgagcagtgatttggcttttgctttttcctctgttttatgacaggtcactgagtgccgcgagaattgccaatttttcttttcgggaaaaattacatgaattttggaattccattcccaagaattttgacatgacaaaatacctaaattcatttctttgtgcttggaaatattttttctaaaacggctaagccaaaaaacaaagttggcaaaagcacaaaaatttatccgctttttcaaagtcttctttcatcattttttcttctttgtccgattcttcggtcaaaatttgttggatttgttcacttaatcaaatttacatccatttggccgccattccatcactattatttgttgaatttccaaccttttgtcaaacgctgaacatttctaatgccttttccaattttctaatatttttctctgctgatcaaccactcttacagaattttgtcgaatttacaatcattgccaaattttctctcaaattatgccctccttttttcaaatgcttaatacatatgcatttttaaatcatcataaattcccgtttttgttgccattgcttttaattgtaatcctttgtttcaaataaactgcgaattgaatgaactcaaatcagaattttatcaataagaccattttatatggatatgacttaagccgtgcttaaattcaaatcgaaaaatcccattcaagagccaggatttagggtgacccgggaatttcgggataaatcaatcacattttaggctggttccctgtgctgacatttcgtcctcacgtttattgaatccaatgcgatttctttttttttgcataaataattttgtcgctcgccaaatttaacaacaacaaaacaaaaaggaaacggagaacaaataaaacaaaaacaaagtacaaaatgtgaaatgagtgaacagaaaaaaaagtctgagaaaggacaagggacaagggacaaaaacaaaaaaatgtaataaaataaaaaaataataaatagacgaaaaacaaatgaaaacgaaaagaatggacaaatgaaataaaaaatgatgagcgacaacggatgcaaaatgatccaagctgatcagagcaacaacaaaaaaagcggtaacacaaagtgtgatgatggtatgtgtgtggctggggaggggagacggacgaaaaaaccaagacccattccaacaatgcacgaatttgaatttgggatacctttctagaataattgccaaaagtagtttcggcacttttccgtcaactttctcatattttgtagccgttaaattgcggtattccattaatggttttgcatttccaaaattacaattttaaattagcattccgttaccaaaattggtgtgtgctttttgactgactccgttttcgagaaaggtcgaaaggcccatgttttccggattttaatttccggtatggcgggggattaaattccgaatttcgtccgtccccggaaatttggaatgaattttgagaatggttctgtctgtgagtggcgtgcagcggggctcgtcaatgatcacaattggtactgtgtgcccagcctttgcttcaacggttccggaatttgagcgacaaaattgttccaattctcatctcccacttgtgacttgaaggcgtaaataatctgaaaataaaataaaaatgtggaaaaataattatttaatatgacgtttgctatcatttaatttagtgaattttcatcaaaattcgtaaaaaatgcgaattgatacgtttttctccctttccgtcgaaaaatgtttacattttggacgggagacaataattttgcagaaaagattgttaggaaatgcattagaattctttgattttcgcattccaatcttttcattccaaaaactaatttgtttaaattttcaaataaaaaaaattcaaattttttacaaaaactacaataaaatgcccgtctccatgtagttaggctacacattgagacaaattattaaaaattggttggaaactaagaaaaatttgaggtaaactatgctataattgcccaattaggaacactaattggggggggggggggttgggaaaagcggtgctcaccctgccgaacatgaaaacacacgggcaaccacttggttgatctcgggaacacggacggttcgcccgtggtttttcgttgcgaccagttcgccgcccgtagaaaaatgtattcttttggccgctataattatttcacaaaaaatttttgattcattttatttttcgagttaattgttattgatgaaggaaggtgaaactattaggcgaagcgttaaaataattaacgatagtttcttctttatttttggcaaattattgtatcagtaaaattctggcgatggatacataccagggatgtgccgaatcggaatcgtaatcggaatcgcaattaatcggattttgggccataatcggaatcggataatcgtaatcggaatcgcaattaatcggatttttggccataatcggaatcggcgatttaatcggaatcggattttgtctggctcggcacatccctgatacatacggaggaatgattgaaaaaggcgaagccgaccggtttaaatggtgctaggtcattgcgcgaaaatagcaaaaatggcgtttcgcgaaaagtgcaattttaacaaaagagagcgggccttatcagtacgattcttgtgataaaatgatttttaataatttcaaatgtttgttttggtccttaccataaacacaccactgcaaaaaaacaaaccaaattataaaggtttataaaattaagttctttttaatagcaatttataaagaagcagagaaaatttaaaataatttaatttcgcccagccgttaacccgccaccgtacaaaagaaaaactaaataaattggaaacattgaaattttttattattatttattaacattgattatttaaagaattcatttattattatctgaaaatctccgcgttcatagtaaataaagtgaacatttaaataaattaaaaagaatttattgttttaaaaaacaacaaagaatgttaaaattccagtaaaaatgaaaagtaattaaaagtattcaaaaaattgaatgaacaaaaaacataaattattaaacaaatattaaagtttatttatcgagagtctcggacctcgagaaaagtctcgtgttttttcgatttcggtcttcaagactgagacttttttgcatccctaaagattggcttttagtgaaaaaaacaaaaaaataaattatttaattttttttttgtataattctgaaagttttgctttcctaaaattttcttataaatttgaaaaatgaatttttgaggccttgtctaacaaatttgctttttttaattttaattcaattaagtgtacatttattatgttttatcaatccaaaaatccacaaaacaaaaaagttgtaagcctttttcgttcgtaaattggatttttccctttcgcattggtgaaccggggggtgggggggggcgatcagcgttggttgattttttaaaactcgagaaaatttgtttgtgacttttgagtgaatttaaaaaataaagaatttagatcttcggcgataaagagggcaaattctgaaactataatgtaatttgaaaaataggaaaaaatggacgatggctaaaataagcaaaaaaaaaaaaaaatattttataaataaaaattaaatattttttatttcttaaaaatcagtgaattatcgatttgtatattaatgccaacaaaataagaaaaccttttagtaatatttgatgaaataaaattacaatattaaagaatatttttatacaaatacttccattatatgtaaaaatgaattggtggcatttaattttatttattatatttttatttatttttgtaattgactccggcaaaatccgaccgaattttgatgaaatatttggcgacggatgggacaaaaaaaattaaagtgaagaaattatggctctagtgcactttatgagtccaattgagttttatgtgtccaatcaattgacaatccctggtttttatacaataactttgttcatgctcgaacaaaccctatctttttggtatcattcgaaagcacaaagtctaaataatgtaataatacgagaaaacaagagaattctaatatttcaagaaagttacaaaccgaaataatcaactatgcgttatatctcatcgatcttctttatgataatctccgacaaaccaatcgtgaaatctgtaccgtaattcacagacggatacagactcacgatatcgtaaacgctaatttttttcttctcgtccgattttgcaaacaatttcatcggtccggtcctccctcccgcatatgccatcctcggatcaatcggccccttctcatttcctctgtcgtcgaagaagcccctcatttcctcatcctttttcaattccttctcaatttgacacccctaaaaagtagaatttataaattcaaatgtcaaataaacatacccaaacttcttcgacatccaaagtcttccgtagctccactaatctctcctgagtctcatcgttcaattcctgggccgtccttcctccaatcagttccgccgccgggtcataacaattcaaacatccatgtatgtaacatcccatcacttcaatgcacttgtccctagctccttcattcccaataaatccatccaatttgtaattcccaattttaacttctcgtccgttccccgcgtgccgtatctcaattccatcccgctggctccgccactccaaatactttattgccatcacactggcgcgatcacaccgctcatatcccttctccggcacaatcgataactgctccgtcaataaaaacattgccttaaaaatattcatcgcaacccccgcattcgtacaactcctcggtagtgggtcaaatcctttcgtaatgtcgttaatcaatatccttctaaactcaataattgacagcaataaaatctccgtgtcgtttcggcaataatttttcaattcatcatccaaataaaaaggtgtctccttgttttcgttgtacctgaaaaaattatttattgttaattttgtccttcttttcttaccatttttcgaattttataaatttatccttgttcatagatcccggcgaatagtcctccatcggtggcagatgttccaatcgtattccataattttctttcttgttgtaataatatgggaaaaagggcttgtcctcacagtccaaattaaatgtcgccttcagcgactcaagcttcaccggcatcaataaacatgagtctctccaaatcagctttgaatgtttcttcgagttttgcactttaaattcataaattttcaatccattgatgagcggtagcgggttcttcccggtacggcagaggtaattaaaaacaaaatgacctaaaaatttaggatttaaaaatttagattaatttttttcattaccgtcaaaacgtccggcgttatgtgcaaatatgtacgtatcgtaattcgtaaaagcagttaaaatccactccacaaaatccttggtcggctcatgtccctccgcctcgctccaatccttgatcctctcctccccacaaattttgcaattcgtcctgtttttgtcatcacagcattccgtacacgtaactctcaccgaaatataattaataacatgctccttctggtcccccttgtaaatagaatcctgcgaagtctccgaatcctggagttagacttattattgttgattttatttgtagaacttacccaaactacaattctgtagacatctttttcctctttctcctcgatcggcataatataacacccccgcttggggtcatggctcacactacaaagctggcaataagtctcaccgcattcatgtcccttcttcgtgttaaataaatatgtcttgtcacaaatcacacaacgtttccataatttgcaagtctgatgtccctgatgataattataacactcccaattgtaaaagtaacggtgacactttgggcattcaatcttcactccactctccttttcacatggcattccccccactctattgcaataataacatctcgcccggcaatcgaaagtatgtttgacatccttgtcaaaaaagcactcacaatcaatacaaaattttctcccacgattaaaaaaacagacgtaattcttcagaccatcccagtgaccattctccaaaaatatcggtacgaccttctctcgtcccataggggccttccacaaaacacggatcgatttccgcggatccgcagatttttcaaacgccacaacccggtactttccggggtaaatctcatcctgaaaaatttattaattttgcattttttcatttaacccacccaatatttctgaacattcggcaattgctccacaccatagctatattcgttaatatcaattccacaattatgtaaaagctcaatagctgcgtccctctgtctcataatattgttcataaatcgattaaaaatgtttcgatgcacttccaaataaagctttgacgccaccaaagcataaaacaaacaaaatttatccgcatttgtaatccttaataaaattattattatttacatttattttttctttattatttaatttatttttttaaatttatttttttctgttttttttttgctgctttgcttaataaaaataattatttcttttttttctttactttaattattatttaattttttttttgattttttaaattttattttttatttatttaatattttttaattatttattttttgattttttaaaaatgtaatttttatttattttttggctctattaaattattatt

SEQ ID NO: 267 - DNA, 931 bp, Heterodera glycines
ttttccatttcttcagcaaaaattatttctgaacaaaaaaaaaatttttttgaaataatttcttaaagggtattatcttataattgtatttataattgtttaagaaattattttttttatttaatttattaaaaatcacttacccgattgatcggaaatcccattttttggccaatgggacggtgggttggaaggagttcacgcgtttaaaagacattttaaacaagaaattgcagcagaagaattaaagagggtagagagattttaaaagaaaaaagacgtaagtaaatagtaatagatttaattaattcaattaaaaatagagcggagtgaattaaaattagagcgcgaagagagtttaatgaaatccaactatttagttgaatgattttcgatttgggccgggtgtacggattgggcgagaggggaggggtctagtcacgtgactgtctgggtttgccttattttagggggtcatcaatcatttcggtagacagctgtcacattttattcaaaaaccgtgcaaaaatcgtttggatattccttatttcgaaagtcatcaatcatttttttttgacaggtttgcaaaattacgggccatattgcgaaatagttggaacagaaaactaaaaataatggagacatttaaataagaaaccaatcaatcacattttattgacagttgacctaatttaggggagatattgcgaaataatttgaacaaaaagtcacgtgcagattgagaaataatggaagaaaaataaaaaacccatcaatcaatttttagttgacaggtgaactacttttgaaaaagtttttaatttatttattcattctttgattttacttttaaattggatttaaatagtaattttattgtccaattcataatcgaaattatttgctgccaataatcaattaatttggactt

SEQ ID NO: 268 - DNA, 1559 bp, Heterodera glycines
  misc_feature (6)..(6): n is a, c, g, or t
actacnctttttatcacttcacagtgttcttggcgtaataaaaatatattttttagctgaatttattttgcatacataatatatttcatttaatttatcgttatttttctttgtaaagccaacgctgataaaataattattatttaagcctcacctttgttgtgctcaatgaaaataaattagaagcaatgcaattttaagagcataaccgtaaaagtcacaattttatttaaaccgtttgtttttcttttcttccgaaaatttctccattaaggtattcctcctcaaatgtgccccagtttctgaaggaatatgagtataagctatatttttaccgttcaactgtcgtcaaaatattattttaaaaattatcattttattactttaccaatccataaaactactacttttttatcacttcacagtgttcttggcgtaataaaaatatattttttagctgaatttattttgcatacataatatatttcatttaatttatcgttatttttctttgtaaagccaacgctgataaaataattattatttaagcctcacctttgttgtgctcaatgaaaataaattagaagcaatgcaattttaagagcataaccgtaaaagtaacaattttatttaaaccgtttgtttttcttttcttccgaaaatttctccattaaggtattcctcctcaaatgtgccccagtttctgaaggaatatgagtataagctatatttttaccgttcaactgtcgtcaaaatattattttaaaaattatcgttttattactttaccaatccataaaaatactactttttatcacttcacagtgttcttggcgtaataaaaagtcattcgacctctccggtatgttatgttcgaatccctaataatttttatgcggctatcattccctaatcgagttacagactcatgactaaactgtccgttgcctcaaaaacctcggggatgacttaaataagaaattattttggcgacccaaaaaaaaaacaataagaatactcacttttacattttggaaaagaaattttagaaaaagttaaaaacattattagtgaagtgattaaagttaattattattaaattttgtctttccgttggccccaacgactcttcttaactgccacttttgtttagaatttttgaattataaaaatagcgcctacttttagagattttttttagaaaattagacttaccgtattttgaaccccctcccccccccgcccgggttctatttttcaaccccctcgaaaggagggttctaattcaggggggggggggttcaaataccgtaatatacacatattaatcaagcactattttctaaaacatatgttaggagttcagcaaaataacaatggttccagggcttcgatcgctgaacacagatttcaaaaatccagcaaatgctagcgtttccaggccatgactagcaaaaaatttatttaaaaattccttactgtggtgcccaaatttccacatgaaatggccgcactaaaaagcgctgccgattcacaattttctttccccatcacagaac

SEQ ID NO: 269 - DNA, 1301 bp, Heterodera glycines
ctgcatcagtgagcccttgcaacggcgcaagtccaggcactttcggcgccgaacgcgccgctcgcccggcattgtgcacggcgtccatgggccccacaagctgaagtagccttcggactggaaaattttcagccaaatttttggtttcaaagagttaggcccctgtaaaaatttttttgaccccttcaaagcgttcttctggcgatccgtcatccaacgccacaatttcatgctgttgagtggccgccatcaccgtagtcgttggctgtggtggtggcgacagtgtcgagacggaagagccggagccaaaggcgggtacggtatgcaacgacaccgtttccgatgggaatatttcggtggagaaaggctgtgaaaaacattcaaaaacttacttagtgaaaaatttctatgaaaatttctgtgcagcatatcgccggcgtgaaattttaggcataaaaatcaataaattttgtaaaaaaaaatatatgggaaacctaggcgtcaaatcctgacttaattttgcaatttttcggagtgatgcccttgataacataaaaatttcattgtaattgtttttgggcctgatttcagtgaattccagaaaaccctcaaattgtagtcgtaaacgcctccccatcctcggttcgattttttatttctcctaatatgggcatgcttttccaagttacctttattttttggcacaactttttggcattttgactaacccttggcctctgctgtcgctctttgatcagtttcaagtgcaaacgcttcgtcgactcgggccccttccgactgatcagacggatgccggcggtgctgatattattattattgctgttggctgaaaaaaggaaggcgcatttaattttgccaaaaaaaataaaataaaattacaaatttcgaaaaaactttttccattaaaaattaaatatttttcaatattttaataaaaatgttttatttataaaacccaaattttagggaagctctgggcggctttgggcttattcttcttgggggggggggggggggggagtcggtcggagtcatttcgtcgccaaccgcgttaacactcttatttatccacataaaattttgtagaattgataggtgctatgactagggatgggaatttaagtcacgaaaaatctcaaaaaagtcgacttcaaaagtcatgaaaaatctccaaaaagtcacgaaaaagtcataaaaatgccaaaaagtcacaaaaaatgcaaaaaagcactaaataaacccaaaaaaagtcctgaaaaaattagcctaaatgtaattaa

SEQ ID NO: 270 - DNA, 9587 bp, Heterodera glycines
  misc_feature (6)..(6): n is a, c, g, or t
tttcgncaaatttggtcaaaacggacaaagtgtcgacactcaaaacggacaaagtgtctacacacttgctgggacaaagtgtcgacaccgtgttttttgtgcgtgtagggcagtggcaagtgcatgactgtctgttttagaccatttggtcaccacagggacaaagtgtctaccccgtgacagtgggtcgacgcgatgtcatccactggccatttgacaattttcttttattggcttccactggccatttgacaattttcttttattggcttccgctggccattttataatgtttcttttattgtcatccactggccattttcttttcttggcatccgctgaacattagacaattttcttttcttggcaaactgctcacgggtgccacgcatgcccattccaactgctcacggacgccacgcatgcccattcgccaagccttcggattcaaatgctgcacgggcgccacgcatgcccattccaactgagcacgggtgccacgcatgcccattccaactgctcacggacgccacgcatgcccattcgccaagccttcggattcaaatgctgcacgggcgcctcgcatgcccattcgccaagccctcgggttccaactgttcacgggtgccacgcatgcttattcgccaagccctcgggttccaactgttcacgggtgccacgcatgcttattcgccaagccctcgggttccaactgttcacggttgccacgcatgcctattcacaaagccctcgggttccaactgctcacgggtgccacgcatgcccattcgccaagccctcgagttccaactgctcacgggtgccacgcatgcccattcgccaagccctcgggttccaatgctgcacgggtgccacgcatgcccattcaactgagcacgggtgccacgcatgcccattcgccaagccctcgggttccaactgagcacgggtgccacgcatgcccattcgccaagccctcgggttccaactgttcacgagtgccacgcatgcccattccaactgagcacgggtgccacgcatgcccattcgccaagccctcgggttccaactgagcacgggtgacacgcatgcccattcgccaagccttcgggttccaactgttcacgggtgccacacatgcccatttcaactgagcacgggcgccacgcatgcccattcgccaagccctcgggttccaactgagcacgggtgccacgcatgcccattcgccaagccctcgggttctaatgctgcacgggcgccacgcatgcccatttcaactgagcacgggcgccacgcatgcccattcgccaagccctcgggttccaactgctcacgggtgccacgcatgcctattcgccaagtcctcgggttccaatgctgcacgggcgccacgcatgcccattccaactgctcacgggtgccacgcatgcccattcgccaagccctcgggttccaatgctgcacgggtgccacgcatgcccattcaactgagcacgggtgccacgcatgcccattcgccaagccctcgggttccaatgctgcacgggtgccacgcatgcccattcaactgagcacgggtgccacgcgcatgtgccggtagctgctgctgcacgaacatccagacacgcatctttcggtagctgctactgcccagtcaacctggactgtgcacccgttactggctacaactcgaccggctagggtaagcaagtgcacgctccccacgcatgccctcagagcggctagttatctatatataaaaaaatggggggggctctttgcaaatgtggcccgcacattgcgaattctgcacctatcgacccaattctttttgcgttagccaactgatctccccttactccaacttcaccgtgcaaaaaaatttgggaggccctcggcgctgagcaacgctaacctgttttcgctaagtgttgcgcagcgcccggcggcgcacagctagcggctgggcgccgcttggcgaaatgcgtgccatgccgtggggagcattttaaaaaaaaatttggcccgatccgacaacttggcgccgagatatgctaacttttattggcctgtttgcgccatgtgcagccaacttttgcgccgttaatgctagagagtcagaatttttttccccgcgcgtcccccaccctgaaaggcttgaaaaaaaaattgccgtctttcgccgggcgctttgcgccgagatatgctaacctgtttttgctaactttgcgtggcgcccggcgctgaagtttggcgccgcttgacgaaatgcgtgccatcccaaggggagcataatggaaaaaattttggcgccattcgactactttgcgctgagatatgctaacttttgttgcccactttgcgccatagagagccaacttttgggccagcgatgctagagagtcagaatttttttccccgcgcgtcccccaccctgaaaggcttggaaaaaaaattgccgtctttcgccgggcgctttgcgccaagatgtgctaacctgtttttgctaactttgcgtggcgcccagcgctgaagtttggcgccgcttgacgaaatgcgtgccatccgaaggggagcataatggaaaaaattttggcgccattcgactactttgcgctgagatatgctaacttttgttgcccactttgcaccatagagagccaacatttgggccagcgctgctagagagtcagaatttttttccccgcgcgtcccgcaccctgaaaggctgggaaaacaaattgccgtctggcgccgggcgctttgcgctgagttgtgctaacctgtttttgctaacttttcgcgaatggcgcctagcgcctggcgctgcagagtagctgtcttgcggttgcttggcgaaagttgcgccgcgccatggggagcattttaaaaaaaagttcgacccgattcgacaagtctgaagggtcgaaccccctttagcccctggggggtgcaaaatgcaaagtcgctattttcgcgggaagcggtgtttttttagtgtaaaggatgggcgcagacgtaaaaagcacatttttcgcaaatttggtcaaaacggacaaagtgtcgacactcaaaacggacaaagtgtctacacacttgctgggacaaagtgtcgacaccgtgttttttgtgcgtgtagggcagtggcaagtgcatgactgtctgttttagaccatttggtcaccacagtgacaaagtgtctaccccgggacagagggtcgacgcaatgtcatccactggccatttgacaattttcttttattggcttccactggccatttgacaattttcttttattggcttccgctggccattttataatgtttcttttattgtcatccactggccattttcttttcttggcatccgctgaacattagacaattttcttttcttggcaaactgctcacgggtgccacgcatgcccattccaactgctcacggacgccacgcatgcccattcgccaagccttcggattcaaatgctgcacgggcgccacgcatgcccattccaactgagcacgggtgccacgcatgcccattccaactgctcacggacgccacgcatgcccattcgccaagccttcggattcaaatgctgcacgggcgcctcgcatgcccattcgccaagccctcgggttccaactgttcacgggtgccacgcatgcttattcgccaagccctcgggttccaactgttcacgggtgccacgcatgcttattcgccaagccctcgggttccaactgttcacggttgccacgcatgcctattcacaaagccctcgggttccaactgctcacgggtgccacgcatgcccattcgccaagccctcgagttccaactgctcacgggtgccacgcatgcccattcgccaagccctcgggttccaatgctgcacgggtgccacgcatgcccattcaactgagcacgggtgccacgcatgcccattcgccaagccctcggattcaaatgctgcacgggcgccacgcatgcccattccaactgagcacgggtgccacgcatgcccattcgccaagcccttgggttacaatgctgcacgggcgccacgcatgcccattcaactgagcacgggtgccacgcgcatgtgccggtagctgctgctacacgaacatccagacacttacgtgaaaataaggaagcgaaaaatatacgacaccaatgacatgaaaataaggaagcgaataaaatacgaccaatgtcaaagacaaaaccttaaagcactaggcgattggaatatatgaaaaataaagcaaagtcaaagttaaaaccttaaagcactagtcgattggaataaatgaaaaataaagcaaagtcaaagtcaaaaccttaaagcactagtcgattggaataaatgaaaaataaagcaaagtcaaagtcaaaaccttaaagcactaggcaattggaataaatgaaaaataaagcaaagtataagactaaaccttaaagcactaggcgattggaataaatgaaaaataaagcaaagtcaaagtcaaaaccttaaagcactagtcgattggaataaatggaaaaaaacaaagtcaaatacttatcctacctaatttcatggtgacgaggcatttggctacctttaagactcccttaagagagacccttctcttctcatgtgcaagaatattgctttctcgcctgagcgggatttcaatttagaggtgtttaatcataatcctttaggtggtagcttcataccattggtctatcgaccaagcccagctcatgttccctattcattggcttaacattcagagcactgggcagaaatcagacacggtcagcgcccttgcgcttatgctgccatcctttaattgccgtaagcgaataaacccttggctgaaatcatgcatgtctaattgtgtcaggaatgaacacatcgttcagacaggataaaccaaaaaactgacagcgagcgttaccggcgcttatattacagcctttataacagccaaagtttcaaccaaacaattccttacgtcactacatgcctgacaaaatgctcaagccagcacttgcccccgacgggtgcgctcaaaagagcgaaatactcacaaaatccaaaaagtgcaaaatggaaaagtgtaaaacaatagtattaagttaaaacactagtccatttatggaaatattgttacgaatgatgttcgtaggaatctgttacgagtgatgttcgtatcaatgtgttacgagtgatgtccgtaggaatgtgttacgagtgatgtccgtaggaatgtgttacgagtgatgttcgtagcaatgtgttacgagtgatgtccgtaggaatgtgtatcgagtgatgtccgtaggaatgtgtcacgagtgatgttcgtagcattgtgttacgagtgatgtccgtaggaatgtgtatcgagtgatgtccgtaagaatgtgttacgagtgatgtccgtaggaatgtgttacgagtgatgtccgtaggaatggttgttccaatcgactagtgctttaaggttttgactttgactttgctttttattcaattaacttgtggttaactgttttgagtttaattttggttttgaatgtgtggagtgaggccgtctggggcaagcagtacgtgagtactctgactgcagtaggagaaaacgtattgaggaataataggtgtcagaagtccaagcctctggacttactgtagccgttatcagcttatcggtttatcttgcccagcgatgtgttcagttgctgatatcattagccatgcaatgaatttgtgtttaatacggggaaagaagacagtgcatcttttacacttgtatgttagtcacccgagagcctaagactgtgcacggtttttggttcgtttggatggccgtcccgggtaaaagcgtacctgtatttaagatgcacttccgcgattctgttgagcttgacatagttaattaaagagtttgatggatacgcttggtggagcgttagtgcatagaatcaaatggtggtagtagcaaatattatcagcacatcctttgggttttgtgtaggtagcttgcgggttggcgccgccgcaggctatttacgccgagctcattggatgtgtctctatgatgaactagcgtggtactaccaaatgcccgtccgccgcttgctgacgacagacccgttcgattgggtctgtgcgctggtaatgattcatggatttattgctgggttggtagtgaatggtaacggtgaaacgcgttagcgcgtcagtgatttgtttttggaatctgttgaacttgacaagaattttttacagagtttgaaggttacgcttggtggagcgttagtgcatggaatgatttattgacgtttgctttttttcactataaatccgagttctgaaaattagctagactcttgatcagagctattttgtacaaatggaaattgcgtgcgagtttggattatgtatttctggtgttaatgttaaactagcgtggcagcacaaaatgcccgtctgccgcttgcggacgccagaccgttcgagggggtctgtggcgctggggataactgtttttggaatctgttgagcttgacatagttaattaaagagtttgacgaatacgcttggtggagcgttagtgcatagaatcaaatggtggtagtagcaaatattatacgagcgattagccatgcaatgattgcaggtctaagaggtgtcaggagtccaagcctctggactttaaactctgagggtcaagggccggtccccgcctcgggactctaaagatgcaggtggccagccgtgccggtccccgcctcgggactctaaagatgcaggtggttagcaagagccggtccccgcctcgggactctaaagatgcaggtggccagccgtgccggtccccgcctcgggactcaaaagatgcaggtggctagcaagagccggtccccgcctcgggactctaaagatgcaggtggccagccgtgccggtccccgcctcgggactcaaaagatgcaggtggttagcaagagccggtccccgcctcgggactctaaagatgcaggtggctagcaagggccggtccccgcctcaggactcaaaactctgagcacattgtacggtgatggctgctgctggggtgccgcttttggtggtcttagtttctccagcttttggcagctgtcgaaaaaataaacatcagctttgctgttgttaaagaaatttggcgagttaactgacttgtgtaaatgtggcttaaggcacaaatgctgtgcaggaactcagcactatggatcctgtgattgttgtcagagaattgacgtttgctttttttgctcaataaatccgagttctgaaaattagctagactcttgatcagagctattttgctggggataactgtttttggaatctgttgagcttgacatagttaattaaagagtttgatggatacgcttggtggagcgttagtgcatagaatcaaatggtggtagtagcaaatattatcagcacatcctttgggttttgtgtaggtagcttgcgggttggcgccgccgcaggctatttacgccgagctcattggatgtgtctctatgatgaactagcgtggtactaccaaatgcccgtccgccgcttgctgacgacagacccgttcgattgggtctgtgcgctggtaatgattcatggatttattggtgggttggtagtgaatggtaacggtgaaacgcgttagcgcgtcagtgatttgtttttggaatctgttgaacttgacaagaattttttacagagtttgaaggttacgcttggtggagcgttagtgcatggaatgatttattgacgtttgctttttttcactataaatccgagttctgaaaattagctagactcttgatcagagctattttgtacaaatggaaattgcgtgcgagtttggattatgtatttctggtgttaatgttaaactagcgtggcagcacaaaatgcccgtctgccgcttgcggacgccagaccgttcgagggggtctgtggcgctggggataactgtttttggaatctgttgagcttgacatagttaattaaagagtttgatggatacgcttggtggagcgttagtgcatagaatcaaatggtggtagtagcaaatattatcagcacatcctttgggttttgtgtaggtagcttgcgggttggcgccgttgcaggctatttacgccgagctcattggatgtgtctctatgatgaactagcgtggtactaccaaatgcccgtccgccgcttgctgacgacagacccgttcgattgggtctgtgcgctggtaatgattcatggatttattggtgggttggtagtgaatggtaacggtgaaacgcgttagcgcgtcagtgatttgtttttggaatctgttgaacttgacaagaattttttacagagtttgaaggttacgcttggtggagcgttagtgcatggaatgatttattgacgtttgctttttttcactataaatccgagttctgaaaattagctagactcttgatcagagctattttgtacaaatggaaattgcgtgcgagtttggattatgtatttctggtgttaatgttaaactagcgtggcagcacaaaatgcccgtctgccgcttgtggacgccagaccgttcgagggggtctgtggcgctggggataactgtttttggaatctgttgagcgacatttgctttgaaattacacatgaatgaatattggagtagtggttggcgctaagggttcgccgcacgtgaatggaatgatacgagcgattagccatgcaatgattgcaggtctaagaggtgtcaggagtccaagcctctggactttaaactctgaggttggctccaacgacagacccgttcgattgggtctgtgcgctggtgtgtccagggcgggtgggctcggagaaattcctttatatgggttggtaagcgagacttgcttgtcgttgtcactattctgttatggcagatggatggcacgtttatcaaactgttcaaggcaaaagtagacgagtactcactctcctgaccccaatatactgagcctactggagcacctggcgagaaccctaatagggccatttacctgggggttaagcttggaatctggtacagtggattgggtgttgtgacactcggagttggtatactgccctgtgctgcacatgttgaagccaagtggtaaggctgctgtgtggcaatgggagatgccgcctcgattccagtccccgcctcgggactctaaagatgcaggtggccagccgtgccggtccccgcctcgggactcaaaagatgcaggtggccagccgtgccggtccccgcctcgggactcaaaagatgcaggtggctagcaagagccggtcctcgcctcaggactcaaaactctgagcacattgaacggtgatggctgctgctggggtgccgcttttggtggccttagtttctccagcgtttggcagctgtcgaaataataaacatcagctttgctgttgttaaagaaatttggcgagttaactgacttgtgtaaatgtggcttaaggcacaaatgttgtggaggagctcagcactatggatcctgtgat

SEQ ID NO: 271 - DNA, 4542 bp, Heterodera glycines
  misc_feature (4490)..(4490): n is a, c, g, or t
  misc_feature (4532)..(4532): n is a, c, g, or t
cgccaataaatatacctttttaacattaaaaattttgaatcgggagcagtgaggaggggggggggcttgaggacccactgggaccgtccttgaaaccgactgactcgattccgtgggatccgctgcagaaagtccagatccgtcttgtccgacacgccgccatgggccacaaacaattctttgtccacaacagtggccaacgggagcctgggacgacagacatatattagttgcaacaatatgtctgtctgtgttaaatgactaccaagaaaaaatgtcttcaagcaaccgtatgatggcggaggcggagtccttgtactgtaacgtaaagcaagaattactgtaattactgtaaaattaataaacaaataaatttttccatgattgtctaacacatacttttgtctgcaactccttgacgaaaccgtacctaaatcgtaaaaaaattatatggtcccggatatcataaagtcaatacagtaaccagaggcaaaaaaaaaatggaaaatttttgtgaaccctccaaagcaacgaaatttttcattcttgaatatttcgatagccttaaagttctctctctattggactactaaaattacaacaaaaaataataataatttaacatttaaaaattatggtcaaaaaaacttcaaaaaaaacacacacacacacactagtatatcttatatttttggtcataactttatttaaaaaatcaagcgaaatttctgaaaaattttacaggctaacagagagagagagagagagagagagagagggagagagagagagagagagggagagagagagagagagagagagagaaagagagagagagagaaagagagggagagagagagagagagagagagagagagagagggagagagagagagagagagagagagagagagagagaaagagagagagaagagagcacttagatttatcgaaaaaattcaacagcaatttagtagctttttcggaaattttgaataatttttttttgtgcaattttcctattaatattggactgaaaaatgccaccacctcaaattcattatgtggtcttcatggtttccccggttaagcgccaccgctgtcggatgaagcaccataaaagttaggagcacagcaagcacctcgatggactgacctccccggtcttaatttgttgttttaaaaaaagtgaaatatttttatttaaaaatttaatatgtaagcaatttttgaaaaaaagaaatattccaatttaaataatttaaattaattttgataaagatttaaattaaaaaatgaatgtttaatcacaaaatttctagaggcaatcaattgaattaaaatgatttttgttggccaattaataacagtaataatttaaatgtcaaaatggctaattaaaactgaaaaaatgaattatttcacaaaaattcttcttggaaattatttgaatgaaaattataaatttttaatgcttattaaaattttgccttaaatatcattccttaattttatataattcttaaaattcaacaaaaaattattttgcttttaatggaaattttgaaaaaaaactcaccgacaaagtcaccattaaacacgtaactaaaatttaaaaaataaatttaattgtataattaattatatttatgactgtttacggattgtccaatgatgggaaaccattctaaaaaaacgggttttcaatttaaatttttttttggtgcgctaactttgtgcaaaatgatgcacaggtcgtcaaatttgccgtgcaaatcgccgcatatcgtaacctggcccgacatgttggtggacagatgggttacggtaggcatcactttcagcgatttacgcgcctcgtgcagaatggtcagaaggtagcgggcgggcaaaacctgaaggcacacaaaatttaaatttggaaaatggttttttaagaagtaactaactataattttaactaccgaagggtcccactgaatttattcctatgtatagtatctcctcaaatacagtacctatccccaatatagtctctgtcccctcccagaaaataaatgtgtccggacattctgtcaatgaaagataaatcggtcagcaaatttcatttttttcgcaaatttttcaaaaatttttgtagaaaaatattttttaataaaaaattgtcacaataaatttatcattttatagaaaatctttaaataatttttcaaaaaaaaaaatttccattaaatccatataaattctttgatcatttaaatgcccgataagttgtaaaatttgtttaattttcgaattttaattagcaaaaaaattttaaaataaataaaaacattttaaaaatttttggcactttattttgtttgaagtattcaagcattgtttccacatgtgcacttcgcaacggcaaactgatagtcggccctttgtacgatttgtcgacccgaaaatgttcagggtttgcaagttcccacaatttagcgtccttttccgcctcgtcagccgctgaaattttttttataaaatataattaatttaaaaaattttggcacttccattattcaaacggttatattcaaacagaaatttaaaaacaaaggaaaagctagataaatacagtaaatttaatgggctacagtaggttaatgtaaatacactctggtaaacaaattactattctctaaaatagagcagggttacggtaattaacagtgcaaatcctactataaaaaaagaattttaatttttaaactgttatgcgtataaaaatgttattagtgaatgaatgagttatggtagcattcggggatggaattattgtattacagtaaccaacatacgccacaaaaacccaccatcaaaggcgagtcgagcaattgctgaaacacaatggcttttgccaacagttgaatacagttttttgccaactcaaattagagaccggacagttctcattgggcggcatccctttaccgtaatcataacggtagtggccgatcgtagctcggccacagaatcattgccacttccctgtgtaataagtccccgatcggaaactctaatcccccgtccggtctctaaccaatttggcaatgttttttcaaaaattctgatcacatccttgcttctgatcaccccattgatcagtcgtcaaattgggatcttttcccgattgagtctcgggactgagtcccatccggctgggtctcaatcggtccggtctctaatttcaattgccatttgcgcaccaaccgtggcaaatgtcgttgcgcccggttagatcttcacgctccgccattgctgtgatgatttcgttgaagaagttgtacagctagaaaatattattattatttattgttttatttacatttatttaaattcgattttattcaaaaatatttaatcaaaatatattatttaaaaaattgaaaaaaaaaatgttttaaataaaagttttgaaataatatttaaaatattaatattatgcattgtttaaatatttttttaatatgagaaaataattattttttcattaatttttaattaaacaaaatatattttaattttcagccacgaaattttcaaatgattaaataaaatgaaaattgtattaatccttaacaaattaaagccgatttatgcgggaaaaaagtaattttaagaggattaccattttttaatccaaacaataaatataaaaatattaattttagttaaatcccttcttaaataatatcattagtttattacctttaattggtcctgctctcccgcgtattccaaagcggtaaaaatgttccatgttgctaaaataaaataattaattattattgaaaatgtctttgttagaaaatgaaaataaattaaatttaaataaaaattcaattattaaataaaaaacaattaaatttgtttataattattgtagttttttcaataaatattatacacattatttgctaaaaaaacttaaattaaatttcaaaaataattaaatatatttttggttaaaattaaataaataaatttaaataagccataattcaaacctcttcttcgcgcttccaaacgtgccaaacagcgccggtaccatttttgaatgagaatggcagatcggattgctgaaattggtgcgcaaaaaataaaataaaataattattatattgtaattaattagccataaaaaatagtgcgtaattgtgtaggatagggaaaagaaaacagagagaaagcaatggagcagaaatagtgaggcgagacgaaaggcaggaaaagaaagcagagagaaaaaagaaaaggcattcacgagagagcggaaaagtttatagataaaaagaaaaaatgtgagtatgcttctaacttgggataaagcagacaatgaaaagcacagtgaacaaaaaaggcatttcggtgaaagatttttctaatccagaatcccaacttcaatcagcaaactggaccacaccagggatggcattccgaggccccanaaattttcggaaatcggaattccgggggtcaaaaatttttcngaagtcggaa

SEQ ID NO: 272 - DNA, 2399 bp, Heterodera glycines
  misc_feature (64)..(64): n is a, c, g, or t
  misc_feature (2325)..(2325): n is a, c, g, or t
  misc_feature (2334)..(2334): n is a, c, g, or t
  misc_feature (2350)..(2350): n is a, c, g, or t
gtgaggcgcttgactcagacttacacagttccggataaacatggtgcggcgccgcgccgtcgtntagcgccgcgttggaggatgtgcgcgagttgggcgaccgtcgccggcgagcggcgtccgcagcgccggcccgcgtcacgcgtttgccagcgactgggggcaatggcggcaacggacacgtgatcacctatgggagtattattgatcagtaattgattgatttggttgacgatcggaaatttttagacctggaatttgcaaagcataacaacagatacggtaagacaaatcatgggcttgggttacggtaaatttaaattttgaaaatttcatccaaatcatccaattcaaaatccccaatttttaatttgtaaaaaatttcccctctgacgggaaaggttgaaaaaattttcaatcgattaaaagccacatgaatatcctgatcactttttggcgtaatcaaaaatctccgatcactttacaaagagggaaaaaaagtttggcacgtaccttaacatgcacatccggcatttcggcaccgttaacagacgcatgtttgtagttgtggtggttgtgatgatgcacaggtggttgttgctgttgctgttgttttgatgttgatgggccacaacccatgctaattagtgcagcaattaagtaattatgcaattaattaattgattggtgaatttcgttgtttttagcacggctgatgggtattcaattatttaaaaatttatttaaatttaaaaagataaaatttttaatgaataagtttttagagagtgccaaaatttttatggaaaaatgttaaaatatgaacaaatttttagaatgtgctccaatttcttgaaaaaaaaacatttattaagcgtgctcaatttattttaaaaaaacatttaaaatttaattaaaaaaattttttgcattttatttttcgctattttttagtcgtctgtcctcaaaagtgaattgatgagactgatttttgatgatggtgatcagcagcaagaagcttgaagaaaaatagagaggtagaaattgatccaatttcatctctttttgcgtcatttggtcagtgacaaatgctcacggataaaaatatatcagcctcatatatattattggatggaaattatttttaatttaattttttaaaaattttttatgagacgaacccttacaaatttttaattaaattctcaaaatttattaggtcatctcataatttatgtgaaccgcccaaataaaaaattggcataatttttgaattcttacacttttcttggcaaaattattgtctttaaaaggtgtcagctattttttgatcactcgttttcggaaaattcatttcttaaaattttttattgaattttttaccaaggctgttaggctcgaaaaattcccgtaaaacacatgaaaatttataacaaaagatttacactaaagtactcttaaatccgaattaaaatttaggaaaatcggaggtgatgtgtccgattctgccgtcagatttgtcagtgtgatttcaaaaatcaaaatttttgtcaaataaatttatcttaactttttaagggagtgcaaataataatgattctttatccaataattaaataattgaagctatttttatgaaaaattaaatatttattatgaattttctttatttaattacatataattaattaattaataatttggtgccattaaatatcgtcaaaattaaggaaataaattcttctggcaattgaaagcaaaatttaatattaaaaatcgcattagtgcataatagctgttttgtgtttaatggcttcaaaatgttagcccattaacaaaatgtcaaattgaagaaaaatcccattgcttcttattaatgaaaagtggcttaggaaaatgccatggaaaagcaatagtctcagaggatggaagaacattggaaatgccgatgaataaattggaagaatgtgaaaaatcccgcccccgccctaagaagatatataattcaaaaaacagaattttggtcaaaaacctggcaacattccaaatgaaattccgcgaaaatccaaaatttaaatttttatctcggagaatttgagttaacacaaaaattatttgctgaaaattcgagaaaatttttagatggaccgataagatttatcttaaacaaaaccgataagtgaattttgtttttattttatacttttttaaattttgttaaatgaattaaaattcaggaaaattaaaaaaaaagcaaaaattttatatgaaaaagcattgggatttttaagaatttataaaacatgcgcaaaattcttcatttanaggaactanaatttttaggcacttnaatttgcacaaaattgagaccaaaaaaatgaattttaacgataaaattc

SEQ ID NO: 273 - DNA, 7680 bp, Heterodera glycines
caggaaaatttatgatgaagctgatgacaaaaaaacaatcatttggccattacaatttgccaaaaatggcgctaatttaaaatggaaacaaatgcgtaaaatgtgtgctaattgcacatttgtttcccagctttagcgccatggtgaaatttatacaaaaaaaaaacaggttggccaattggtcattgaacaaatttttgttgtttgattttaggcggggaaaaaattttatttatggaaatttgtaatctcaaaaaattatggcttttaaaattttctaaaatgcagagggtgagtcagggccaaaaatgccgcaatgtcctccagggatgtgtgccgacgccctccaattcgacagtctgaaattggaattcagacggcccaaaaaagttcaaaaatcggaaatcggcatgccgacacatctctggtgtgctcatttattaattggtaagattgggttttaattttgaaagatttttacggtttgttcggtaaacaataccagggtcaatggcaactcgtacaacaaaaaaaaaatctaagaattttcaactaaaacttagaattttcagataaaaaatatataaatggattttttagcctagaaaaactttaaaaaaaattctttaaagttttttaccaatttttcagctgactttttttattttcttaaattttttgaaaatttaagtgttttaaaaagtttttctaggctaaaaaatccatttagattttttttaatctaaaaattctaagttttagttgaaaattcttagaaatttttttttgtacgagttgcctgtgtacgagttgccatgacaccacaataccaaacccacaaaaaagtgagcaaatgccaaaaaatgctaaatttattttggaacagaatgggcaattagcaaaaaaatcccattagaccgaacgacagctttttggggccacacctgctaagcaaattgttagttgcccagattcaaaatgatgatgattttgatggcatttgatacagtgtgtcgtgccgtagacacattttcacgtcatattagtggagtacgggtgggattaatttgtgccctccggggaacaaattaaatgcggcaccaaaaaagcatcggagaacatccagctccacaaaaataaatagggaatgaagaaaatgatgatgatgcgataatgatgatgatgatgctgttgatgataaaatggataatgacgaggcatgcaaaaaaaacgaaggaaatccacaaattttggtaattacaaaaaaggttgtacataacaaatatttttgaaaaatattatattcttttaattttaaagttactcttttggaaagtctaacataattggcccccctgattatcgaaaattaattttaaaaatttttctaaaaactcgaggtttacctaaaaatcgcagctttagattaatcttttttgatcatcctttttgggttttttaaatatttttatgcaaaatttggattggattttccctgcatttattcgcgcaaacgatgatgacaatgatgagagagagagagaggataatgaaaatttggcatcatcgccagacaaaggatggcatttttttgtgcggggtgaaagtcattgtcattaaggacggcatttcagaacaaataaattgttacattttgcgtgccgtcgacagacgacgaattgagaaggggggggggattaaatgccaatgtcagttttatggcgatgattcatcgaaaaaattttcggattagcatacagcgaatgaaggtaatccatgttgggttaacgggaattgttcccttaattgtcgagaattcatgtttcgaaaatggcacaaatcagtttgacctatctatttaaattttgaaaagaatcaagaaaattttaaagaataaaaattaaaaaagggcttgtcaaactcaatctgatcaatgaactataagtgattaatccatctggtcaatggaccgtcagatcaatgttatgatcaataattgatcacttctctctcgattggtgactttagagcagcaaaattaattcagtcctcgaaaatccctagccaatttgagcagtgtgatcagcttcaagtttcgaaaggcagtttcaaatgggataagactgatcagatcagtgcattgatcggctgtttccacccgatcagcggcttccacttacaagcgtcgatttccgattgttgtacatggttagctgcaaaatgtccgttttcaacaacagatttgcttgatgaggatgaacacttgtacagccggcgttgaatgcgcgaaatcattgaggaatcttaattcattaattgattattttaattgaatttgagtaattaaaaaaaaaatttaaaaaaacaatacaattagtctattaaaattacaaacaaaaaaattcattttgttgtcagcaaaatttttcaaaagcgaacaaaatacctaaaaattttgccaaaattctttgtcgtatttttcggtgctggtgcatttcctaaaaacggtgctatgtcgttacttaaaaaaccatcattatgatttgatgaaaaattatttataacttagctgaaaaacaacacaatttttatttcttaatatgattcgatagccctaagtgttctctatcagtctacaaaatttcaaaaaaatttcattaagtttcaaaagagttagggccaaagatgctcgaaaaatgctcgaaaaccaaggttttttgagttcctctagccataacttttttgaatcgtaacgaaattttttgaaattttgtagacttatagagaacactaagggctatcgaatgatatcaagaattaaaaattcaattgcttttcagctaagttataaataatttttcatcaaatcataatgatggttttttaagtaacgactccgccccctaaaaaccgatctgtacatttctgtgttcccatgcgcgactgatcaatcgatcgatcggtcgagggagggagagagagagggacgaattgggggagggcgccttagcctaaccctttttaactggtcgaaaatgagtgcgtttttcaggaacgcattgctcagaacgccagaaaggagcagctccgggaccgggctgttcgcttagacgattctctgacggcattggtcaagcaggcccatgacaagctgaatgagtcggctgcgatgcctcagtgctatgagcaactgtgcaatggactggctgaacagattgagcttgccgagcagtttggcgccgagaatggcatcacagttggcgaagaacggattgcgcaggcaaaggaggtgcgcgagcagctggcacagcgatggcaccattgggacgagtttgtccggcttcgagatctgggcaccgcccaactggataaggcgcgtgttgcgattgaccagaccgagcaaaagacatgccgaagcgtagcggaggccgagtcggaccatgacaacctgctggtaagtgtccaggctaattaaaaaggggatttgcaatgcaatcggactgactgatggtttgcaggaggcgcagggttcgcttgcttctttgaatgccaccatcgaccaactgcagcagttggctgacaagcttgatccgctggcgacgactcatgctgaagtgcgattcctggatgtggaattcgaacagctggagaagcatttcggagacgtgcttgaccaaatgcacaacgaaattgagcaggaaaaggcactgatggcggaaactgagcgagccggacgagaaactgacgacatgacggcacagctgccgacgatggcgaacaatttgaaggcattgcagcatgctcagcagacagccatccctgccctggaggcgaaagtcgtcatgctgcaacaacagagcgagaaggagaagccgctcagacagtacgtgctccgctccactgccgctccttctccggatgaactcgcgcagcgcttagcactgagcaaaggccgggcacaggaagcggcccaacagctggtggacacagcagttgtccgggtccaaaatgtgcttttggggacaagccaagctgctgccgaacttccctccgatgaacaaattgatgaatgcgccaaagagctgcaggacaacatcccgcttgaacatccgcacaatgaacagctccgacagcaattggagcagctgagagagaaggtgatgcgcagggatgccatccgatcgcatattgaccagcacttggccaccattggcaaggaattggaagggttcagcgagcagttcatcagcagcagcaccaccaacggcaaaaaggtgccgccctcctccaaaaaggaggccaaaaagaagaagggcaaaggaggcgaacccgagcagcaaaaacgagctgaaaagatggccagcagagaagagcacatcgacgagctgcgaaaagcactgggacgcctggaaagcggcattttgcctgccttgaacacgcttcatgacgaggccgtccagcagggcattcctttacaaccgacagaggaacaccagcatcagctgatgcgagccaatcaaattgtccaaagtttaaaggtgtgcttttgttgaagcattcattgattttcgtccatttccccaatcacttgcaggaggaccttgacaagagtgtggccgagaacgagcgggcgagcgtggtcatcaacgacatacgccttctgaaaagcattgttgatggcacggtggtggaagcagaaaccgcggcggaagaggcgactctccaactgctggacgtggagtccgtagaacagcataagcgagacatggaagaggcagccaaaaagttgggtgaacagctcgccaagatggcggcagatgcacatcaggtcagcaccagtttggagccggaagagcaagcactgatgaagcgggtggaagaggaggctggcaagaagatggacaggctgaactccctcaactcggtgctccagcatcagatggaagtgctccgagactgggcacgcgataaggacaggcttgagcagcacacgtgctcactgattgaccagctgaagagagtgcaggaggagcgggaagaggctggccctgccccagcagaggaagagttggccaagctggatgccctgcagagcgaagtggacgaggccagggatgagatgaagcggatgcagagctggctggtccaaaagctgcccaagtgcgggagggctgcggtcgaactgcaacttcggccggtcgaagagagcttagtgaagctgaacaccgacatggacggcacaatggagcagctgaagaagaacgtgcaaattgaacgccgtctgttggaagagcgcaccgcgcttctcaatgctgccaacgagctggatgagcaagttcagcaagcccatgcgtttgaagagccgcaggagcagatcagcgagctggacaagctgcacaaccaactggagcaagtcgaacagcaaatgcgcactgttgaccaacaatccgagcagtacccaacgccacagaaggcgacaacactgagcgaacaaattgcacatgttgtgcacaagacgaggacaaacattgaagatgcccgtcatcagttggaggtgaggtcatttcgtctgttgatgattggaaatcacccataaacccattgatcacggatctgtacatttctgtgttccttcagtcacacgactgatcaatcgatcgatcggtcgagggagggagagagagagggacgaattgggggagggcgccttagcctaaccctttttaactggtcgaaaatgagtgcgtttttcaggaacgcattgctcagaacgccagaaaggagcagctccgggaccgggctgttcgcttagacgattctctgacggcattggtcaagcaggcccatgacaagctgaatgagtcggctgcgatgcctcagtgctatgagcaactgtgcaatggactggctgaacagattgagcttgccgagcagtttggcgccgagaatggcatcacagttggcgaagaacggattgcgcaggcaaaggaggtgcgcgagcagctggcacagcgatggcaccattgggacgagtttgtccggcttcgagatctgggcaccgcccaactggataagcaccgcaacagtcttgacaatgtccgttccgcgcctttaatctccgaattgaacgatgctcagcttcaactttcctctttaaaagtgcttttcatttttgtgctttttcattttgcattttttaggacaattcgcttcatttttcgcaaattcgtcaacttttgtctgatttggtctctctttccaagtccctttctcctctttccgttgtcgatgatattctccgttttatgtttgtggagctcgaaagtttggaatcagccaatgaggtgtttttaacattttctctttttttcatttgatttttaaaaatttatttagcaaattgtccatcgattcgaagccgaaattgaacatcgaaatgaattggaacaaatgtttgatgggatctcttctaatgtcagtacttctgagaacaattttgatcattttctgcaacttcggaattccgatcgaatgaatgtaatttttattcttttcttttttttttgtccttttaattaatgtttttaacaaataaaaaggacttgctgactgaacttggcgagatcggcgcacaaattgatcagcttgaacagagcatttggcaagggaatgatcagcaacggatttttgtgcaaagtttcgacaagaaacgcctccgaattttgcgagaacgaatcgaacaattggagaaaaacatttggggggctttttccgaactgagtgaagggccgtcgacggaagcggcggaagaacagccgaagtacgacgtggacgcggcggtggaaattctgtcggcgatttacccgggccgagagccactcgaagtgatgagggaacacgggctggacaagttggagttggacatgaacgatgattatggggacggacagacggaaggggaagaaggtgaggacggacaaaagggggaaattggagaattttaactgatcaatcaattcacaccccacaaaaagagacatgcaatttgtgggtgtttaattaggaatgaggagatgaaacgcgcgcgaatgataatgcgtaataaattaattgtcagaaattaattgggtggcggggccaacctcgcccttcactctcgaaatatgaaattaaccgttaaattcattttcttttcgttttaatcaatttaatttatttattgccctttccgcagatgctttcctagccgagctgagtccacaaccctcgcgtccgtcggtgtcctccaaagattcgtccatttcgcccgtccccgacgacccatcgcacgccgcgggggcacagcagcggccaatggcacagcttcaacagcagcagtcgcggtggaggcgagtgctgcgcacggcactgccacttcaggtaaagcggtgggcacagccaatggaaattcaaaaacggaagttcggttttcaggcgatgctcgtccttttgctcggtgccgcttgtttggtgccgcactgcgacgacgaatattgttgccatttgttgaacaacttcgcgcgcagctttgacccgcagttgcatttcgccaacggaacaccgcccttttagcgaacgaagaaaaattattaaatgaatagggatttcatttacacaattctcactcttttttattagaga

SEQ ID NO: 274 - DNA, 2336 bp, Heterodera glycines
tttttaatccattctttctcatacataatcccgatatatcttgttcttttttaaatgagatcgattcctttgagaccggtgaaaattaactgttatatttaacttattccactggatcggtgttttaagaaactagaaaattacataaaagataatagtttataatttaaaatatttactaaattttaaaaaaattgttaatcattttctactcaattttcttggttatttggcgtgagttgaaagtgaaaaacaaacgattaatcagcaaataacacacatccagaaaatgagctcctgtagcaaagattttcatgtgtggcacatgtcagtggtttttgtaggtaagtcaatggaaaagggatggagttttgcaggtccgccataagcagagctgccagctgattttcaaaatcagcatttggccgacaaagaatcagcaatttggaaattttattacaaatgcaaaaaaaaaataaaaatgttcttctgcggcgcacttttaaaaaaaaaaatttgtcaacagggggccggcggcacctgtaggcactgccgggaaaattttttaaaatgtgatcaattttaaaaatcatgggaattttgagggtcgatggtgtcgataggctaaaaatgttaatttttgaagatttacttaaattataaatttggtttatccaaattgtatattaaatattacttcataaattaggcttacaattttttctattggtgtgcaaaagttggttaagatttcatattaacaaagataaagaaagagaacgccaaaatgatttatgtattttcctattttcatttctctctttttcgaacggtgcgtgtaaatgggttcgcttatttgttagttttactggagcgatttgtcatttttcgatttaatatttggctttttcattttgtttgcaatgaatggaataattgccacgttttataaaaagcatttcgcttcgcattttctgtttcccccagttttcgctgcccgaaacagcaaaaggaaagaaaaaagaggaaagggagggagagcaacgaccaaacgcttcgacaattcctccgacaatccctccaccctcccaattccctcatttgtcagcccctgtccaacatcagcccatccattccatccgtcgcgcataacgcagaaggacaggcgagccgatcgcagcgatgacgacgataacgccccaacaaaaaccaattcttaaagcggtgattttagtcggcggcgcccaaaaaggtggcgaccttccctttcattcagtgtccccctcccctttctgcccatccctttcattctccacggcgactggttgcttttcgtagagtcacttccttccattcaattcattgatcaaaatgtggatagccgggtcggctctggtggcactttattcaatatttctgttgttgcctgtgttaattctggcgtttgtgatccaaaagtgtccactgagactttaaaacagaaaaaccattaattgctgatcatttaatccctaattgccccgaaggtatacaaataattgcaaacaactgttatagactttgcacattagcttgcacttctgttaaggcactcgttttcggcccctctctctccaacttccgaagccattgttccccgttgccggtgtcccactgattgagcatcacatttcgcagctttgcgaagttaatgcatttatcgttatgattttttcattttttccttttcagcagttggaaaacctccacgaaatttttattgttggattttacccggccgaacaatttgcgaactttatttctgattgtgagaaaaagtatcgacgcgtgccaatccgatacattcaagagaactgtccgttgggcactgccggtggccttttgcagtacaaagacattctaatcgacgtacggatttgtgttttaacttttaataatctaccatctgatttgaatcattgttgttttaagagaaaacctccggatgcactctttgttctgaatgcggatgcttgcggagaattccctttccttgaaatggtgcaggagttgaaccaaaagacggaggcgaaatgcttgattttgaccactgaggcgacacgggagcagtcggtcaactacggatcggtagcaattcaaatttggttattccgaacccgacaaaaatggtaccatcgaaagctcaccaagagacaaaccgatgtaatggggggggggaagtcgatcagacaaacgcccatttgaacactcattgactcccatcataaaacactaaactcatcgagagctatcagttaatacaatatttgtaagggatttgtccacggataaaaaca

SEQ ID NO: 275 - DNA, 778 bp, Heterodera glycines
gagagagactgagaggagcaattaggaccaatttggaagtgaattgccatgccaaacagtcgcagtaatgcgctgcaacgcgtcggtggcgtgatgtcccccccctccctcattttgcagatttccaaaagattcccgttcccaataatcgaaagtgctttttgctttcttttccccccccccccccccttttgcgtccttatgttttgtgtgttttttttattattttcccttttaattgccttagaagacaaaaaccaaatatttgtcactgctggaatcatacataattaactgtgtaattaattgctttgcctaattgcttgtggtccatccgatggttaattataattatggtgcctcatttggtccatcgaattcttcccaacaaatctcattattaaaaaatttctaacaaattcctcctcttccgttcattcatttccaattccgtccattccttcgccaaattttgttttcctccaaaattgcataaacaaaaacaaattatctcaaatctcatgcatagtcaaattctttgcatttttaccatttggttatccttttttggatgaatggcgcaccgccgccggcggaagaggcggagagagtggggagggaatagagagagagagcgacagagagaggagcagtggcggagggggaggaggaggtggatacacaaaagcgccaattaccaatggcaattcgtcattatcgaggccaaagaatgattcacgcttttgacctaatgcagcggattctatcaaaatttttt

SEQ ID NO: 276 - DNA, 1519 bp, Heterodera glycines
  misc_feature (55)..(55): n is a, c, g, or t
gattgatctgcgacgtgtgcatttcattaagaacgagcactatccgccaagcggncacggagcgcctttcaacggcaacgccgcgggcaagccattggcatttcctttggcaattcctttggcattttgttcgttttcgttttaggcacgtgccagctccctccaagcattatctcctaattttaacattatcggccttctccgaacgggccttgagcaatcggtgccaccaaatgcgcgtgagtgtgccaaaggcattcatttcgccgctttttaatcctttttagacattttatgcactggccgtttgtttatctcagaccactcgtgcccgagactacaaaaatgtgattatttccgagtttgacagcagagaagagcttatccaggtgagttccaagagagggactctgttgggaaaggggaaatgtcccttttgttcccacgggcattgacctttgtccattgcttttcctttaggccatcatttgctcctgcttcatccccttttactgtggactgagtgcgccctgttaccgtggcgagcagtacatcgacgggggcttctcggacaatcagccggccgggcaaattcgaccacggcaccatcacagtcagtccgttcagcggcgagtctgacatttgccccagcgatgacgacagtgccaggtcagacagactgccgtgccatttggttgccccccggcgatcgcttgctttagcatgttcggcttcgacttttacggcacgcccattcaattcaccactcagaatttgttccgaatggtcgtcactctttttccgccttcgcccgaaatttgctcccgaatttgtcgccagcagggctttgaggacactcttcgttttctgaccaaaaattgtaatatttttcaaaatgtttcctcctccaatgactttgccaaggcatggctccgtgtgtgaaatgtttgacggtccaatcgaatgtcatcccagtgacacagcatcagcagcagcaaaaggaggaggaaaagccgatcagaagcagagcaattcgggagaacaaatggcagacggaggaggaaaagcggtggcgaaagacggcgtcagtgagcagaatgagcaatttgtgagaaggggaaaagcaaatgatcaacaaaagtcaattagggacaatttgcaagggaaaggcaacggcgaaatgtaattcaaaattatcgcttaattaccccccacaatcaggcggaatgagtgcaatcgctgctttgaacatgtcgaccgtgccggtccgccccgtttctcctcagttccgttgccgaacaccattcttaaatgtgagactaattgaacacggggcgaaaaatggacaaatttaaattgggccaattaatgtataattattattaattactttttattttagcgctttccgaaatggaagaacgaaattgcacttggatgaattatttgcgtcgccaacgcatcttccgctggtggtaccgtcttctgatccccgttattttgccctgtgaaatggtgc

SEQ ID NO: 277 - DNA, 1324 bp, Heterodera glycines
ttcattggctattgaatttttgttttgttttgccactttttctcatcaacgttaaccgtcagttctctcattaaggccgtaaagcttttgcgattagtgctccttgtgttcattcgttcttcggcacataaaatgccttaggcaagatgactaattatgggaggggcggggggagggaggggggaagtgacgacggaacaaaacgaagaagcagacgaatgggacattcgagaagaagcagatggacggaagcaaaaagccaaaaggacaaggaaatttgaacaaaaaaactgaagaaatttttaaaatgggagagaaatgatcagaaattatccaatttttaacaaaatatcttaactgctttataaatattatactgactgtttaaaatttctcaaaaactttattttgggtaatcgtaccgatgttagcctcctttttgaaaaaaaatttttatgcgtttttgaggtttctgatcaggaattgacattttttcaaaaagatacgaaattgctctgaaaatcggcaataatgaagaataaggcaaattgtttgcatagtcaacaaaaagggatttgcgcttacaaattagaccttttctctctaatggcatttggcatttgctggcacattttcataataaacaattattaatttgtgttcccacagcggatgcaattgtcggtacttacctatacagtttaggccacatgaattttttttgttaaaagacacaaaaaatgtaaggggtttttggggttgctgatcagtgatcacgaatatgacatccatttcgaccaatttccatttatgaaaaacggaaatttaaatgaaattagaccaatattttttaaaattatttctcatcagtgaaaaaatgaacagtgacgaaagagagagaaaaagaaagagagagagagagaagagaaaaagaaggagagagagaaagatgggaaaagagagagagagagagaagagaaaaagaaggagagagagaaagatgggaaaaaagagagagaaggagagggggagagagagagagaaaggagaaaaagaaggagagagagaaagatgggaaaagagagagagagagagaagagaaaaagaaggagagagagaaagatgggaaaaaagagagagagagaaagaaggagagagaggaaaaaaagaaggagagagagaaagatgggaaaagagagagagagagagaagagaaaaagaaggagagagagaaagatgggaaaaaagagagagagagagagaagagagagagaggagaaaaagaaggagagagagaaagatgggaaaagagagagagagagaa

SEQ ID NO: 278 - DNA, 1809 bp, Heterodera glycines
tttcgaccaatttccatttatgaaaaacggaaatttttccttaattagaccaatattttttaaaattatttctcatcagtgaaaaaatgaacagtgacgaaagagagagaaaaagaaagagagagagagagggagagagagagagagaggagaaaaagaaggagagagagaaagatgggaaaaaagagagagagagagaagagagagagagggagagggggagagagagagagaaaggagaaaaagaaggagagagagaaagatgggaaaagagagagagagagagagaagagaaaaagaaggagagagagaaagatgggaaaaaagagagagagagagaagagagagagaggagaaaaagaaggagagagagaaagatgggaaaagagagagagagagaagagaaaaagaaggagagagagaaagatgggaaaagagagagagagagagaagagaaaaagaaggagagagagaaagatgggaaaaaagagagagaaagagaagacaactgtagtccaattagacggacataaatgaaaaagtgccaacggcaacacaaacaaatagcaaaagcatcccttcccttccctttccctttctttatttttactccgctgcttttcctccgcccgttattttatttctctgtttgaccgtccgccgtttgtctgcggctgttaacgaatttatcggaaaatcacaagtcaaaccccgtgaattttcgtttttagtttcttctgtaaactgtgaaatgcgttggtaattactaatttattttattttttgctaattttccttggcacttttttttgctcctttttcgctttcacttccccccccccccaattcctttctcattttcatcgctttgtttgttcattttgcacattctcccactcattaaatgcattttttggtattaatttgtttggaattcctttctaaatttttcgtcccctcccattttttgctgatgtcatcaaaaaatgggtaaatttgtcaaattatttaccttttaaaaagcgaataatttttttatttctcaattttttcgttcaaaaaaaccgcagaccgaaaaaaacaaaacaaaaaaagcaaacattggaaaacaaaagttgtttctcttctttcttccttccttccattcttccgcctttttcccattgattttccataatttttcggtttttcattggcaaattcttaaaatattccgttacatatttattgtttttgcgtttgcttttgttttttctgttttctattttagtcaccctttcattcctttttcccttttttccattctttcctttgccttttcttctctccctttttatttaaataattattaatatttttatatatgttttatttttattttcggttctttctttaattgaccaaattgcgcaattaatctttcttttttctctgtgttcgttgtttatttattttaggaaatgtcccccttttccgtcctctttttgctaatttccaattcgtcccctttaactaagaattccaccgggaaatttaaatttcccttttccttttttataaaaatattgcaattttccgaaaatcattactttcctttatacttttttctttaattagttgttttcgtatgtttttctaagaagagaaatgtttttttaagcgccgaagggaacaaataacattctctttccgcagatcgccgttcttcggatgatttgttttaggggaggaatgaatggaaaaagcgggggacagagagagacggagagggaaaatgggagagggagggaggggaaggaaggatacgga

SEQ ID NO: 279 - DNA, 1229 bp, Heterodera glycines
ttaagcacttttaaaaattttaattttttttttgaaagggggggggggataaactttactattaccgttggcccggtaaaatccgccgggacctcgggctctaatttgttgaaaattttatttttatttttttcaaggtcctattacattgctttttccccattcagatggaacgtgccaagcgctacattgtcgaccaggagaacagaacggagaaggacgcacgtcgcacactgctcaaattggctgaaatgttcgagtcgcccattcccacaacatcgaatgtggcccgtttacgcaaacagtttgacgacgacgacaacgatgctgatgacaattagagaccggacactgcttcaatcgattaatcggggaaagatcgtcgatttttctgtatttttcttaagactaatttacataaaatgtatttttaaataaattaactttgcaatttattagtgggaaaaattctgtgtaaaaaattaacatctctgcttttcttggtcgagtttgctgaaaaatgctagggtttggagtttgcggatcccgctgcgggatttttaataaaaaaaacttttgctggacagtatcccacgggattaatcccgcaagtccacttttaattttgcggcgcgcggaactgcagtatgttactaagcaaaagcatcccttcccttcccttcccttcccttcccttccctttctttatttttactccgctgcttttcctccgcccgttattttatttctctgtttgaccgtccgccgtttgtctgcggctgttaacgaataaatttgtcaaattatttaccttttaaaaagcgaataatttttttatttctcaattttttcgttcaaaaaaaccgcagaccgaaaaaaacaaaacaaaaaaagcaaacattggaaaacaaaagttgtttctcttctttcttccttccttccttccattcttccgcctttttcccattgattttcccataatttttcgctttttcattggcaaattcttaaaatattccgttacatatttattgtttttgcttttgttttttctgttttctattttagtcaccctttcattcctttttcccttttttccattctttcctttgccttttcttctctccctttttatttaaataattattaatatttttatatatgttttatttttattttcggttctttctttaattgaccaaattgcgcaattaatctttcttttttct

SEQ ID NO: 280 - DNA, 4994 bp, Heterodera glycines
gggatgaatctcagcttaaaacatcgggcagacgagactctcgagggttgctcatcggatcagtgcactctcacgcccctttcctttcatcggccgttctcttcagcacaatttccattctatttatttcctttttattatcgtacttcttctgcacgccgacatttttttttttgatggacggatctttcgaccgaaaacattgcctaaggcgcaacgaatcggcggcagaaaatgcaaatgcgacgcaacggagaagccccggggggaggaagggaagccgagcattggacggtgggcaaattaagggaaatgattaaatgtgttgttttcgtataaatctcacaaaattggggagggaaaggaatttggggattattatttatctgctgtttactgagggggccgtgaatccacgcactctccggcggacaacgcacacacaaacaaaaacacccccccccccccctgcgcacgccccaatttgaaattggagcaattgccgggggcatcgaaaggcgacaacgccccgggcaattttcaaaagcattacagaaagcgaattccgcgctgcgatcaaacacattctcgagacgggtgacatagaaggggaggacgcgaaaggaacgaaggaatacgaacagagacagcagcggaaggaggaggaggagggggagacggactcctccgcatcgtccatgtccagtcacaccgaaacgatgaaaagcagcaggtccaaaactgactgatcgctgctatttgttggcactttccccaccgttggtgccatcctttagcattgattctggcactaatcatttgccatgttaaaactgacaccaatgaatccgattttcgctgattacccatttgctttgcagcaacggctccgattggcctttctgctccgatcggatgaaaatgatgcagaagctggccaaactgaacctgaacgaggcgggccccgcccctccgagcccgtgctcagtgaagacaccgcttgagggcgtatcgacggaggacactttgcaaagactgaggccgaaggaggaccaagcggaacaaagccccacggggacactcgcgacacggacaccgaaggactttttcttcataaaagtgctcggcgaggggtcattttcgacggtgggagaagcaaaagtgggaagtgaagactaagaagagaccgttaaaggtgtattttgcgaaagaagtgaccacgggggacgaatatgcgataaaagtgctgctgaaaagcgaaatccgacgggaggcaaaagtgcgctatgttctccgcgagaaggacattatggccgcgctcacttacgtccacgggggtcacccttttgtcattcgcctttattgcacctttcaagacaacgaccgactttgtgagttgggaggggcaccaattctgatcagtggatcatttcgatcattttggattgacattgatcacaattccctcggcctcgggctgattgtctttttttgcacagactttgccttggcatatgccaaacatggcgagctgttggattggctgcgccggctcggctcattcgacgaagctggcacccttttctacgcttccgaaatcctttgtgctttggaatttctgcaccggtgcaaagtgatccatcgcgatttgaagccggagaacattttggtgggcgccgattggcacattatgctctctgactttggcactgcgaaaataatcgatgagcaaacggacacaatgggtaaggaaggcaccaacaaatattttcccctttttctcgagaacccatcactattaataatttagcttgttcctcctcgtccgcctatgtttctcccatcgaacgtctccccccgggcgaagtgccgggcattgtcccgtcggtggcagtcaaaccgaccaaacgaagcgtgcggagttcctttgtcggcacggcccattacatcaggtgtccgtgtttgttagcttttcctacgctttcttcgtttgtttttcagcccggaagtgctcaagtcggaggatgttgggcccgagtgcgactattgggccctgggcgcgatcattttccaaatgatttctggccagccgtaagtcatttattggctaatcggcagccaatggcccattaacattttgaaggcctttccgcgcggtcaatgagtacaaaatcctgaagaagatcctcagcctggacttccacttcccggatggctttcccgaggtcgcccgtcacctcgtcagccgactgctcgtttataagcccagcgaacgcctcggcagctcccaaaagggaggcattgaagcactgatgaggcactccttttttaaggtaggcaatggacaatgaatgacgaaatcactcaatccgttgtttataaaggacgtcgaatggtcgtctctgttcacccggaaaccgcccgaattgaagccgtacctcccggcaagcagcggagagccggaattctatggggagtacagtccgcagccggcttatgggccaatggactttgagcccggactgaacgaagcggcgttataccggctgatgggcctcggcagtttgggcggaggcggctctgacgaattcagcgaaatcgaattcaatcgggaaggtcggagaaaggagacgggcgggaggggcatatagaacttccatttgaatcaggcatttctcgagattcgccctcctccccttcccaaaagtttattccgttgccccgggcgtcgtttgtttatttggcaataaaaagcagcaaaaacacactgactgtgaaaaatgggcttcattccctctcttattgatcattttgactgctcattctcaagtcagtcttcttttttgcggctttcggtggaaaaaatgcttttggttcgtccaattccaatcgaaatccaagctgcccaattgaagaccgacttggcattgtgccaattcaatcgcacaaatggccaaattccgctcgaattcccatttatttcggccaatttggtcttttttttaactgtgccaaattattttttaacgttgtatatttcaaaaatgttcagacattcgtctcgacgatgcttcttcctccccgtccgttagcttatccgtcgccccatcggttgaacaaagcgaacagaggcgccaaaatcgactggaaaaacaacggagagagaacaaataccaccgatttgtggaggacaatttgatactgaagtcgggactaatcgacaaaaagaagggacttttcgcacggcggagaatggtaaagaaaagaggaaaagccaaaaaagaataagggaaaagcctaagaataggggaaaagccaagagaaataaaattaacgatgagaaagcagccaaaccgatttatcattgagacattttgaatcaaatgacatcattgccattgactcatcccaatgttcgtcaatttcagtttctgctaacagaagggccgcgtttgtattacgtggaccccgtcacaatgcatttgaaaggcgaagtgcccttctcggagcaaatgcgcaccgaagcaaagaatttccgcacatttttcgttcatacggtaatttggttaaagtttcgcatttttaaaaaatatttaagccaaaaagaacgtattatttatttgaccccgaacggcacgccaaagattggtgcgatgcgatcgattgggcacgggagaaatatttgcgcagggatcagcagcaatttcagcagccgaaatgctggtccaaaaaagcgttgtcgttggaaatgccattgaattcccaacggcaaaacgcaagtgcaacgacggaactttcgaggaataattcgagccgaccgaacagttcatcggaagaaaggctaacagcagcagagagcgggacgaagaccggcggaaagggactgatcagaaggaacagagtgaagagttagtgcataaaacagcacggaatgatcagccaaaggggtgagagagtgagattcactatgaggactgatcagaagagggtggacagagaaggcagaggagagggactgaccaacatgaggagagggagaggagaaaggaagagacagtggactgatcaaataaggagagagagtgagaggaggagaaaatcgccgcctgagaaaaaccaaaaaacatgctcaatctcaaccaatgttttatttgaagaatttttaatttattgaatgaaaaaagaatttacgggaagttggattagctacacatataaaaaattcaatgttgacgaagactcgaaaaaggcgctttttgtgggatgggccatttgggcctaaccgtaaaacatcttctcggaaggcttccgggattcctgatcaacggattcggtattgaatcgattagttccccaccgagcaattaaaatggtaatcctttcgaattgtgttcctgttaaaataaaaaaatttcctttctaataaaaagggtaaaaaataggccatctcggatctgagctcacgttttgaaaatcatttgcaaaatcaatgacattcattttgacaaatctgaagcccaggcgcgcatttgaccaaaagtcaaaacgttgaaacatattattaaaccggtgcagtcagaaaaaatggtaaaaaactcaaaatttttgtctaaaaattctttcggattcataattattgtatatgtacatatgctgagatgaatcgttgatatcgattttggtaccaaaacaattttgatattttcccttgaaatacggtagaaatcagttatttttgagatgtccaattttgacaccctatggtgctctgcggatatgagtcgtttaacaatcatcccaaaggctattcggtagagaattttgtcctctttttgataggcctatttaaattttccagaaaaaaatttcccaaccctctagaaattttcccgatttttagtgtattttagggtgtccagatcaccatgaaggagtgatctgatcatgttggtccaaaagatttttttgaaacatcaaaagttagcttaaaagga

SEQ ID NO: 281 - DNA, 642 bp, Heterodera glycines
agagttatcgggacagtttgggtatttgttagtgcactaaatgacgtttcttttgcaaactatacaattgttcgaatgttattcgagctttttctccgaccaaacagacccgaaattttaccaccccccccccctccctacacaaccatttcacttgaaacacaaaggagcatttccatgattttttctatgaatatttttaactctaaaaacgggattttcagtaacaaaattataggaaaagtaaatgattttatcaatccatcggctaatgaccgaattttaaacatttcgaatcggcattcattcgtcgttttctgttacatcgatttaccagtcatccttcccttttccctccccttccttttactctcagccttctctcacatcgattttcccttgtttcacgcttcttccgtccttttttcgtttctttacctcttccttttcattcatttacattttcattctttgcttgtccaagtccttttgtttcttacttttttgaattaaaagattttcattttttgggaaaaagcggtgggtcgaaagaagtgtaagtagtttttctggggtccatgactattcgccgacgccggttcgccgacagacgattcgccgataaaatgtgggacagaatgt

SEQ ID NO: 282 - DNA, 855 bp, Heterodera glycines
agccgaccgaacagttcattcggaagaaaggctaacagcagctgagagcgggacgaagaccggcggaaagggactgatcagaaggaacagagtgaagagttagtgcataaaacagcacggaatgatcagccaaaggggtgagagagtgaagattcagtatgaggactgatcagaagagggtggacagagaaggcagaggagagggactgaccaacatgaggagagagggagaggagaaaggaagagacagtggactgatcaaataaggagagagagtgagaggaggagaaaaatcgccgcctgagaaaaaccaaaaaacatgctcaatctcaaccaatgttttatttgaagaatttttaatttattgaatgaaaaaagaatttacgggaagttggattagctacacatataaaaaattcaatgttgacgaagactcgaaaaaggcgctttttgtgggatgggccatgtccggaacacagcgttatatgctgcctgattatatggatgaatatatgtggcgccaattttatggcaaaaagacgcttgcggcgttcgaaaatatctttgaccaaattgctgaataaattgtggacttggctaaaaaagaattaaaattattgaaattttcactagggtcaaaaaaattttcctcgggtcagattttcttgaaattttgcctaggctagttttttgaccccatctatcgaattctcttttgttatttgaaagtttcttttttaactcgagatcggctcttcagtttttacaagggaaaatctcggcaaaatttttaaattagtggggttttttggcgttttgtccttaggcaatttttgtcaaaatgatgatatatgc

SEQ ID NO: 283 - DNA, 1734 bp, Heterodera glycines
  misc_feature (1676)..(1681): n is a, c, g, or t
  misc_feature (1695)..(1695): n is a, c, g, or t
  misc_feature (1706)..(1708): n is a, c, g, or t
aaaaatgttttttttttgccgtttttgcccaattcctttgttggaaggacacaatctgtgataattattgttaaataagctgttaattttacttctttttttgtcttattttcatttgatagtttaatgatattccgtcggtccatcggcgggcgaatgcattgtcagcatcaagcacaaaaaattcaatctaattaggtatgcaacatatcggctgattgtcagcactgagagtgggcatgaaagcatagtatgctaatatgatgattgtgagataaatatgggtataagcgtcagcgaaagaatgttaattgattcgttttttcagatagtttggtatgtaagtctataatatttaaagacattgtgtaactctatatatagatgaatcgtctgtcggcgaaaccgtttgtcggcgaatcgtccgtcggcgaaccttcctgctcccgtttttctctataaattttaagcgtaaaaactaatgcattttgtttgcacatatgacaatgagttctgttactaattacttttgtcagatgtccttccttcttgtttacttggtctcagatttgttatcgttaattattcggtacatatttttattttttagactaaccatcctttcattgactctgtctttttcatcttaatacgaaatggactctcccgctggtgctcagccgtcgaacccaaacgctcaacaacaaggtggagcccgaccatcgaacaaacgactccagcaaacgcaggcacaagtggatgaagttgtcggcataatgaaggtggttacagtttttcgagtaagtcagtcaactaattggtctatttgcaggtgaacgttgagaaagtgttggagcgtgaccagaagctgtcccaattggatgatcgtgctgatgctcttcaagttgttgtgaactctttgactcgttaaattcatttttaggaaggtgcgtcgcaattcgagaaatctgccgcgacgctgaagcgcaaatattggtggaagaacataaaggcaagccttgttttcggctctttttccataattgaattttgtttagatgatcgtgatcatgtgcgcaattgtcatcctgctgatcatcatcatcgtcatttgggctggaaaatgaacgacgtgtgctgcggtcggatgctcgagaatttccaagtcttcgtgaattgaaaagatccatttacaaacaaaacccgcgaatctaatttaaccagagttcttgaccaacaattcctaagtctgtttctcatctcctgtttgtgtaccacccaaaaatccgagtacatacgacacttacttcggtcccttcccacattcctaattttcaaaactgtagagtacgcttggaatgcgatggattgacacattttatgtgatgtggataaactgaatatgtaatttctgtttctttttaaattggttgcattgacactttcctcccatactttttctgttatttattagtattaaaataaaatttaagaatggctgttgccgttgataatacggcgctctttcgtgctcgggcaacgattttgaataaaaaaacggaagagtcatttagggacaaagaaaaaggtccgtaagtaaagccaatttatgagaactccttttgtgtggtttacgctattttctgggcccattactaaacatttcctgctagaannnnnnaaggcatttccatnctttagttgcnnncattggacgactgaaaagaccttcgt

SEQ ID NO: 284 - DNA, 3344 bp, Heterodera glycines
cattccgatctctgggactcaacccaccagcatttcaatctctgagactcaatctccggcattccaaacactgggactcaacccaccaactttcaatgacattccaatctctgggactcaatctccggcattccaaacaatgggactcaaatctccggcattccaaacactgggattcaacccaccaactttcaatgacattccaatcgctgggactcaacccaccagcatttcaatctctgagactcaatctccggcattccaaacactgggactcaacccaccaactttcaatgacattccaatctctgggactcaatctccggcattccaaacaatgggactcaaatctccggcattccaaacactgggattcaacccaccaactttcaatgacattccaatcgctgggactcaacccaccagcatttcaatctctcggactcaatctccggcattccaaacactgggactcaacccaccaacatttcaatcaatgggactcaacccaacagcattctaatcactgggactcaacccaccagtcggactcataacaaacgaaaatatcactgtatctctctctatatgccagtgatcactgatcagctgacaaataattaggtattaagaaaataacgtaagcataaaacgggaaaaagcgtatggtttgaaaggcaccgacgcataaaaaagaaagaatttatttgataaaagctcgaatgacacattatgcatattttacaggattatgaatgcatatgaaattgaaatcacaaattaaaatgcaagagatttagataaaaagttaaggcaagaaaaaaagaaatgaactcgttatgatgggattggatgggggagatttgtgttaatgatttagagataacgaagcaaaatggacaggaagttctgaactcgtcgatttaaatggcaatctttcaatttcctttccaatttttttggtgtttttctcttttgttccttccgtccgtccgtctcatttcttcttcttcagtttgatgttggagatgcgttcgcccacgtcgttgaagaaattgcccacgtcgtccaccactttgtccaatccgtgcttcttggccagtcggcccaccttctctttgaccatctcccacaagtgtttgacgtactcgcgcaactcgcgactgcgtcggttcgccacgcattcgaagtcgcaatccttcgaaattcgaatggctttttgtggccaaatctgtcctcgaaattacctcatttggctgtgtgtccgtcggcagtttggcccggtcggcctccaattgttcgggagtctttccgcaatcgctcatcaccatcaatgtccggtaatggtcgagcgtggaacagtcgaatgttcattcccttcgacgtcaacggccttaacggaaaaactgcggagttctgatggaatattaccaattaaaattgaaactgtcatcaaatttaataataaaataaaatttaaaggaaagccttcaggtcgggcagtttctcgagcagtacttcttcgctgggcagcacatcgatgttattgcgggtgagcgcgagcacagtgaaaccgcggagacgcgacgggggcaattggacaaagtgccgatcgggacgattgtgacaatggatggcctaataagggagagaggaatttggaaagggaaagccaaaacaaggaaatgaacggatggatggtaattaattgacataattaaggtgagagtgtaattgattattaattaatcctatataataaagttgagtgtttgttgtgagtgtccggtgtttgaatttgtgtggcgttttgtttgagttttgcgttaaaatgaatttgaaaaaagtagagcgagggaaaggtgggaaaatagtgcactgtctgattgtctgtctacgcgggcagcggcgggtgagaggggcatacagagaacagacgcgtgctgctgtgcagcagcacgcgtctgttggacgcgtgcgtgtgtgtgggagagggagggagtgggaaaaaaagagagtaaattgcaatggaaaagaaaagagagtaaaaagtcggtcactcattggcgccgttttgccgagaaaatttcgcttttatatttttcaatttcatgttgtggttatcgaacgcatgagaaatgcattgacaaagtgcggcgcgtttgtccgagtttggccctggcgagaacggaattctctctccaattcgatttgtgccccgagaaatcgctgcttgaacaaaattatcagtgcgccgaatgtttttcgcccatcggattcggtaataattattttttggcacgttccttgagatacgttttgggattataaattttcaaatgccgcattttgtcaaaattttgttgaatttttccgttttgatttaagacgacgactctgaaaaactgcctcggatttgcgatttcaccggccttttctgttgtcggcgctgtcattggaacgacgaaatgattgttcctgcgagaattgtcaagaattgggacttcgaggcgtgcaattttgctgggttttgtaagaaattgaaatttgctcattaagaaaagagccgtgtgccgagcgacaaaacaaatgttaaccaccgcaatgaaacggccactgataaacttcgaaaaggagaacccgacactgttcaaatttgtacacaaattggacaaaatccaaaagatgcggacaaatattatgctgatgaagtgctattttgtatatgcaaggtaaaaaagggggaaaataaaaaaatatggaaagaaaaagttatggctttttcagttgcaaatttattttcattttttcgctttcagtttgcccgcaaaatgcgtattctccagcatttgagtcgtttccaacactttgtggagaatgacacaatgttcaccatggacgaccttctccaactcgccaatggccgcttattggcggacatcgaagcaattgtcaggattttcactgcccatatcaccgaagagtgcgaaatatgtcggggaaatgctttcttcttcagcgcatctatccgttcagcgaaaacgcggccatttgcaagagttgctgtgctgtctgtctatcaccgctcgtgctttgaccgtgccagcaaacggtgtccgcgatgtttacgcagaaaggcgagaagaaaagcgggatggaagagaatgagggggacgaggaggaagaagaggacggacaacaaccgcaggacatcaaacttttttatttttgcataaatcgggtcacaatagtcaaaataaaaagaatttattaaaggaaagtaaataaattttgaaaaggttcgtacacaaatcaacgtgttgtacccgtcgcaacttttgctg

SEQ ID NO: 285 - DNA, 2593 bp, Heterodera glycines
ttttaaaaattaaaaaaaattcatttcccaccttttccaccgaagacgatgacggcacatccggcagttggagttggcacacatgctccgtcagctcaaatgccacattttccaagcattgcagtagattctgacatttatcttgtttaatttccattattttattttattaatacaaaaaatgataatttttaaaatgcatataaaaaaaataatttcataaaaatttaccagcgaggtgggggggggtatggttaccgtatcaaaaattttgtaaagaaaaatcacctcgatgccattcaatgcaggcggttggccattgacagctgccggcttgacgtgttcagcgctaaaaatgcaataatcagaaattgtttttttaaattaattttttgctctaatttaattttgttttttaaaaagaaagttaaagcaagccctccgttttaataatattttaatttaattgttaattttgaatattctctacctgttcagtggtggttgttgaggacggcgaaggaccggcaggcgactgattggacatgttgggcggcgttcagcagcagcttggacctataaagtcatcatagacaacccaaaccaagcggaaaacgctctttttttgtgcttaaaatgagtgtaattctccctacccccaaaaaaattttaaaaaagataaagaaaaaatggcttaaaagcaaaatcaaatatcacatttgaatccaataccttagggaagtcgaaaattttttcaagataatcggcagagaaaagcgaagaggccggtgaaggtgaagaacatcgaagaccgtcctttcttttataggctcttcggtccatgtgggcggtgcagggggcggttccgatgaggcggcaaaatgggatatatgcgggattaaggggattttcagggaatgggaaattggcccgatgggaaaaatttgaattggaaaggctgggaaaagggcttatgagagaaaaagggataaaaaattttgaatttaagcctggagaggaaaaaggaatttttaagaaaaatttatgatgatcaacgatgttatttttaattcatagtgttgtgaatcgatctttccaatttgcaaaaaaaaaaaagttaaaccctttcaatatttctttaattgcttactaattaaaattggtcacgcaagtgatcatcataactattaacattttcttttgaattctcatgtttttacaaacatttttccgtctatatatgattttataattttgagaaatttttcaaataattacaaaatattgaagcacaaatctatctgaccatgttcacttctaattgatcttaattgctcccagaggaaataaatgatcagtcgatttaatttgatccttttattacaccgaccaaactaataatgagcagaatattattatctaatttttttatcgctataaagatccttaattttatcggaacctagtgtacatttggaaaaatccattctaaaaatctgaaatttttcatttcgaaattatggttctgtttaaatagctctaggcaatatcaataaatcataattatgattataatctcacaacacctgctgctgttgctctctctctgctgtctgttcattcaaaaatcgttcaatacccacacacttttctcgagcacacacttttgacattttaaaatgaaccaacaaacaaacaaaaacaggaccgaccgacctcctcctcttaaatcatttttctctttcatcattaattacctaattagcgcgctaaatacaaatagtccaaaaatttttggtaaaaattataccaataaataataaaatatgtcccgtaatttgtcgacaaatgcacttcgtttcgttgttgttctcccagttatcgatgccaacattgctgcagcggcacaccaactacggcagcgacgacatttgcacattttgccaaaactccaaaaaatcggtatttgtgtgtgtgcattttttaaccggatcatctgacattcacataattgagcatgatcagataaaccaattaaggctaattaagaaatcctgctgaaaatcgtgctttggctaaaccattctccccctccctcccgtcccgcattattaattttttgagattattatctcatccatttaccattttaaaactgtcttcactttcttaaaacataaatttaaattattttcttttaaaattaaaaagcctacatacatttaaagaaaatttttattaaaaaaaaatatttccattttcctttcttaattttcccactctcataattcaacactattttatttattttatcaaattaaagaaaattttcataataaaaaattatttccattttcctttcattttttctttcactttctttctttcttttcctacatttttcatgcattctaaacgcatatgctcattctttttcccgctctctcccattcatgcactattttcttggatttcctctttcccgtttccaatttttcctttccactctcttttatttaaacgttattttttatatcttttctagccaaactaatgattttttcatttttaattatttttgcaacatttccca

SEQ ID NO: 286 - DNA, 7926 bp, Heterodera glycines
cgcaaacccgctgaccatgaagaagcggactgcaggcggttatttgctgcgtcaacacttcccgcggcttctccaattcccggcaacagaaatggcgtcacatggccttggtcaactggtccgcgccgatgggatggaactttaccgattgatgaatccgcatcacaaaggagatgttggttatttaatgattattgaaacaactcaacaccctggttcctactattttaatttttcaatcgaataagtttttttttcgtaattgaataaacaatcaagttataaaacatttttatttatttaatattttgttaaatacaactaatgcgtacatatcaggacttgtacaattgctaagtgtagtgagaaattgctcaaatgaatatcccacggacatatggtaaatgaaaacaatgcaatgggcaccacaagtagacaataaagaggattggtaggggtaagaattcttcctcagtccctccgggaatttacacaaaaaagttgacgtaacagcggctgggattggctgagcaaggctgtcaaaatagaacactggtgcatccaatccctttgcataaatagcgcaccaatgagagcccttcttatggtgggggtcccggttcacaacgagcgctgcggagtactgtagtgtggagggaggtggcaattggtcactggcgtagcagccccgaaatgctcgctctgtccgacaattttcgttcaaaatctttgttatttgcacgctgtccattcttcaaccaaaaaattgaacagagttggtgtagcacaagactgatgataagcattaaatagagagtgaagagggcccagcaaatagcttgatgaaaaatgctgctttcctcaggctgctccttacacatttggataagcggtggaagaacagcagaaacatgctcatcaattaacttgtcgctttttggatgggtgtttatgttcgaggtagttgttaatgggacagttgttgtactgagaatggtgttggtggtacgtttgaataaagacagtctccttaaatattcagagtatgaatagtgtggttcatattgttgtcgagacaaagtcaaattttttaggtaagcagagtaggtattttccggttgttgttgttgtcgcaatgttgatgaaacaacgggaagagaaactcggagaaagaacaaaatttgggcaaatttttttgaatacatttttattttattggaacaaagagaaatgacaaacggactttaaatagtggtgtctgtgcttattgatcgatttttgtctaacatcaccagtgagtcacattctcccatcaccaccagcattattcctccgtcgggcactgggtggttaaatttgatgctgacggcagtggtcccattctttatcagatcaaatagtgccgcttgatcatccccactgttggtcaaattgaacacgtaaatgcaatgcgttttcccatattgggcaaaagttatcccgttgctctccgaagaatttgcgaatcccaccgcttcgttcatgtcattgaatggtcgaacatatttaccgttagggtagtccaagtcatagggtgcttgtgggtacgagcgcccattagcaacaatggaaatttcgcgcacattaaatggttgaaaattgaatggactgcgccgaattgagccgacataatcagcattcgccaccagacccattgtcacacgacgggggatttggtccatgaacaggttggctgtaaactcataccgaccctgactgatgaacattgacttcatcattgtcttccgcactgcataacgggcaggtttcacctccagcttccgcgcaatgtccagcgccaacccatccatcagagacacctttttcacatataatttcagtccaacaacttcaaagcggtaccggggcgcacccgtggccggcgcaattaacacaaactcattgtcattgggcagaatttcaatgtccaattcacaaaaattgatcagatacagtggttggttgaataggtctgtgtcaattttggcgatgaattgagctacaccgctaccagcaaacaaatcacgtcgcgctatgcatccgtttcccgtctcaagcacatcacccgtatcccgataatagcctgcggcgttcagatgagagtcctttgctgtcgttgaataggagagctcatgcgagaaatatgttttgtaagccattaaagcgttggcattgaaaatttcgcgcccattgatactcatttttatgttacggatgaaagtttgaccgatcatttgaattggcgcaatgtgtgcatcgtcaacagtgagatcaacaagttgtccatttgcgttttccttgcgaatgcggaactcagtgagcaaataacatttagagaggtcaatgtaattttgactggaatgaagtttaaagtggtacggtgtgtcagtcagagggttgctgggcagaagctcgaacacttttgatgacgaaacgctcacatttgtagggggaattcggaaaaagtccaaagcattggtgattgagttcacagaatcgttgtcaattttatgaaacgccattatttaatatagtccaaaggcgtcggatcgaatacgcttttttgcctgttttacaataggtcgtccaattagcgtctgatgaccaggcagatgtgctttctttctttttatacccctttttccgcttccaaactgttttggtaatcctcctttgtcgagtacggtgtcgatccctttctttccctcactgacaagtgcctctttaaacggtatcccctcattcccgactcgttccagcacgcgttgtccagtgctcagtgcctccgatcctactgtagtgccaacgcggcgaagaattggtagaaaaaagcgccacagtccacgaaacacatccccaacgcccgccccgcgttgaataccgtagccccgttggaaggggttggacccccgaaagtagtcgaaatcgtccttttctaatccgctaccgtactgcacatactcgtcatactgtgctatgctcgggtcaaatacaatatgaaccatttattattaattataaatgaaatgtaaaatgaatggaatcaaaaatttatcactttcttaaatatcaacacgaccatcgttgttccataggcgaacggcaccaatcgtcctttgtccattgtgcgcagctcaatttcaatctcgtttatctcccttggcagcactcgcgcaaatattggcgaatcgtaaattttctcgttatactcattaggaatggcaccgctgatagacacaactcggagcaaagagctcaatgaattgccgatgatcatgttctcggtcaatccttttgagtagacagcaaaacttgagatgccgccacgcatatccaccggatactttgagagttcatttgaccctacgtgttgagggttttcgaaaccaagaacatagcccaattgcggcgaaaacgacaaatgactgatcacctcctcattgaacaccgctttgaaacgttctgcgtcatcgtgatatggtattgagactgagttgggcacatatcctagagggtcaatttgaacgctgaggatattttctggtaaatttaagtctgctaactttagagcagctgaggttggcgcgggtgacggctgcgttaaagcagctgcgattggagcgggtgaaggctgctgatgttcggtttctccataacggggtggagaccctgacgatggaaatttagcagaaagcgaaattggagctagcggtttagttggcagttgcggttttcgttgaggaggtgccgagctttttagttgcgctggaggcgccgtaattgtggttgttttaacagacggactcgtgacttgtggttttgcaggcgttgttgcctttgcggttaatttttctgctttattttcttcctcttcaaaacgtggtggagagcctgacggcggtgatggcggcgattgagcgctaggcctcgatttagcgggaagggaagttgaagctgtcagcttagctgtagtactggatgctgttgattttggagacggtgccgaactttttagttgcgccggcggtgccgaaattgttggtttaactgatgggctctgaacttttgttattggtggcgttattgtctttggcggttgagggacaggtgttgctgacttcggaggtggaggaactggtgttgtagacttcggaggtggaggaactggtgttgtagacttaggggctactgtttgtggtggtggcggttgggtttttgatggtgttgttgttgttgttgttgttgttgttgttgtcggggcaggtgttgtcgctattcttggttttggaggcggagggtttgatggttttgtttgtggctgaactgccgatggcttttgcggttgagaagtagtcgttaacggtttttgcggttgtggtgcgggcgatagatgctttgcgggtggctgagaggtcagtgttgttgttgttgttgttggttttgtagttggagccgatggtgttgtgattgacggcttaataggacttggagttgctgctggtggcggagacttggttttgggtgtgacaggagcaattccaatatcttttgtttgcgcttcttcttcttcaatacgaggcggtgattcttcaagcaacccttcatcatcatcaatttctttgggtgtgacaggagctattccagtgtcttttgtttgcgattcttcttcttcttcatcaaaacgaggcggtgactcctcaagcatcccttcgtcatcagcatcatcattttcgttatacaatgggggagattcaagccgttttccgctctcgtcaaacactggcggtgactcagctcttttctctctcttcaacggtggtggcgagccgagaggctttgtccgattccgattcgcttccacctcactgggaagtggcaacaattttgcaccactacgattccgcaatgtgacggccaaaaagtctctcagctgttcaaccctactatgcgatgccctgggcaccggcactctgatcactcgttgtctgtcctcgtcggaggcgctacggtcggtgaagtgaatgtcaatccactgctcatccaatgtgccaatggttgaccatgagtaggggtaactgatactgtgcagtccgcacacccacgagccattaaaatgtaaaggttttgggaggcggacacgaaatttgttgggctgattgtccgggtaatcacttacattgctaggcaaaaacacaaagaaactgttcgacatgattgtttatctgcacaaataatgaaaaatgtgatcgcttttatacaagctgagattcctgaatccattcccgattgggatatcctatgaatttcacaagcatctccgttgttccgtctgtcagttttctcttcctgtacaccttctcgatacggtagcttgtctctgcgtcctttcttacgcgtgccagctcctgttcataaaagctgcccttgaatttctctccatgctcatcccgcaatttgtaccgaattgggcgcaccgctttcaacacctcatcaatctcaaggatttcgtccccgtaatttggcaaataccctttctcaaattgtcccttctctctactcatgcgcacaaattcatcattgtgaaaacgtggtggtcttttacgtccgctcaatcgtggttgtcggtggtacattcgcttccacactttctgagcatttgaaaagtcaacgtcaatggggcgcatcccgtgaacacgagatggagaactgttaatcccgtccacaattttctgtactgtatccagccagttcagcgtctccttttccgcaaaataccgatacaatcgctgcttaacattacgaatggcccgctcagcaaccgacgccttgacggacgaatgaacgggctcatgcttctcaatttcctgctcctcaaagaattccttcatcaatctgttcttgaattcggtgcccttgtctgagaaaatgcgatgcgggaccatgggcatttgatcgatgagttgcttgaatgcctccaacatctcctcggctcgcttattttttagtggaacaacaaacaggcgtttggataggacatcaaccgcaacgagcaggtagcggtgaccccgattgtgacgcgaaagagcttgaaaatcggccaaatccacctggacatcggtcatgaatcccgctgctacagttttggcccttggaaagcgcacccgccgggggcgcatcagagtgtaggtgcggtgcccctccaaataatgctgcacatcccttttccgtaaatgttttagctttttttcgcgcttccttccacagtgcggtaactccggcgaacgctgccggggaggatggattattgtacagcttgtcaagagtggtgttgattaactccattttttcggacggaattccttcttgattttcggcgccgtcttggtggttgtgctctttgacggtctctttggaggagccgtccatgaatacaaaattgggtcctgtctaagccgctcttccaatagggccgctccaggtggtttaatggtggggcggcccgctctcctgtcaattatatacctgatggccattcgcaaattgctatgcgccaacggcttgccatttgctgtgttaattgtattgccccggacacccatacgatccgcataacggttgcatttgatgtacagtcgttcaatccgctgagtcatggtcagctgatttgacggaatggcaaacagttcacgttgttgttgctgttgttcatcactctgcgcagatgttgatggacccggctcgggcgagtactgtactcttaccctcctcggttgcctaactcgttttcgtatgcgcacctcatcatcattctcaccattcacggggtggcggcgtttggtccccctcctaggcggaggaacatagggcatttcttcgacgacagcagcaggagggggttgctgttgcggtggcgtttcattaatttttggctcttttttcgggatctgatatggcacgggtctctttgtcgattgcggctcatatttgggttcaattttgggtgtcggcggggggaagtatccggcttgccttgatgtggatgggcgagaatctagctgctcaaattttggtccacttttcgatttaggtgctggtgtgggatgatcggcttgttttggtgtcgacggtttaagttccagttttggcttttgttctatcttgacagaaggacgctgtggaggtggaggtggaggaggtcttggttcaatttttgctttagcacgcggcattggtgtgggtcgtggaggcgaagggcgaaagatcctatgttttttgtgtcttaaattgttttcacctgcctcatccttttttaattttcttctggtggcaatcctatgctgtgcggtgtccatctcctcaatttcgtccgcgttgtctggcagcacaggtaaatcgccatagtattgtgatggcgctggcagagcgaacccactctccaacatataatcatcatcattatcactttccggtaaaggagcggcagctgcttcagcaagaagatcacgtacaaccggccgccgtcgttgtatatcgtatcgccttttctgccattgctccagacgaccacctctccgataaggcgctgctctactcggtctgggaggacgtttaggatgaggtggaggactccctggtggagaaggagcgggaattggaggaattggtgggggccgaggacgtctcccgggtggcggaggtggagggggaggacttggtccacgccaagggcgtctcccaggcggaggtggtggtggtggtggtggtggtggtggtggtggtggagcgggaggtctgggtggagcatccacaacttcaccattttcatcttcaccacctcttctcatcagcacacttatccctttggtgagctcaactttggtcggtctg

SEQ ID NO: 287 - DNA, 6384 bp, Heterodera glycines
cgtccatgaatacaaaattgggtcctgtctaagccgctcttccatagggccgctccaggtggtttaatggtggggcggcccgctctcctgtcaattatatacctgatggccattcgcaaattgctatgcgccaacggcttgccatttgctgtgttaattgtattgccccggacacccatacgatccgcataacggttgcatttgatgtacatccgttcaatccgctgagtcatggtcagctgatttgacggaatggcaaacagttcacgttgttgttgttgctgttgttcatcactctgcgcagatgttgatggacccggctcgggcgagtactgtactcttaccctcctcggttgcctaactcgttttcgtatgcgcacctcatcattctcaccattcacggggtgccggcgtttggtccccctcctaggcggaggaacatagggcatttcttcgacgacagcagcaggaggggcttgctgttgcggtggcgtttcattaatttttggctcttttttcgggatctgatatggcacgggtctctttgtcgattgcggctcatatttgggttcaattttgggtgtcggcggggggaagtatccggcttgccttgatgtggatgggcgagaatctagctgctcaaattttggtccacttttcgatttaggtgctggtgtgggatgatcggcttgttttggtgtcgacggtttaagttccagttttggcttttgttctatcttgacagaaggacgctgtggaggtggaggtggaggaggtcttggttcaatttttgctttagcacgcgccattggtgtgggtcgtggaggcgaagggcgaaagatcctatgttttttgtgtcttaaattgttttcacctgcctcatccttttttaattttcttctggtggcaatcctatgctgtgcggtgtccatctcctcaatttcgtccgcgttgtctggcagcacaggtaaatcgccatagtattgtgatggcgctggcagagcgaacccactctccaacatataatcatcatcattatcactttccggtaaaggagcggcagctgcttcagcaagaagatcacgtacaaccggccgccgtcgttgtatatcgtatcgccttttctgccattgctccagacgaccacctctccgataaggcgctgctctactcggtctgggaggacgtttaggatgaggtggaggactccctggtggagaaggagcgggaattggaggaattggtgggggccgaggacgtctcccgggtggcggaggtggagggggaggacttggtccacgccaagggcgtctcccaggcggaggtggtggtggtggtggtggtggagcgggaggtctgggtggagcatccacaacttcaccattttcatcttcaccacctcttctcatcagcacacttatccctttggtgagctcaactttggtcggtctgtcggtaagctccctcctcattttcaaatagcgtctaagctgttggttgtagtggacattttttgtagacgggtgggttcgttcggccctggcacggtccaaatcgtatcgaacagcatcaaggttaatgtctcccgtgtccgacatggaggtgagaccacgataaatttcttgaggaacaagtaaaaatttattcgccatattttacaaaatgagtgagtgtacacaaaacaaaatggttgcggggtatttatgcatttttggtcacaaaggactttgccacttcaattagaacgggtgtcaatagggcagcgaacaatccgccaaatcctgcgcctttctgaacaagcacacgcctggcgccccgctcacttctcgctctgctcattcggcgtacagtatccacatggggcattagtctctttttttgtcgggttgtcagttgaaagcgcgaagcgacgagattcaaacaaatttccaccagcgcaaggagttgttcagtgctagcttttcctatcagtttcttgcattttttcccggatttcgtcttggccaaagcacaaagccatccgcgattttctttaatcagttctccaatctttacttgttgattatgtcgctccatttttgggaataaacacaaccgttccttcgtcttcaccctcctgctcgtccttaaatatgttggttcgaagccgcaatgatgggtctgatgcagcgtgcatatcaatcagcaaatagccatagggacgagcggtcgctttgcggtaagcatcaagaaaaaagtcgagctgacgcggaaaaagttggacaccaatgttgcgaatggacaacagggaattaggggcccgcatcagcaccagatactgagcggacaggcgggccacttttattttccgttcaaacaaattttgagtgacgaacaccaccgcaaattggtggtgatgtgactttttggtgaacaaatcggacaaatatttctcgtcgatggacagcatcaggtcgtcgagaatgagcaagaggggttttgggagacgtttgagcaattcttcagatgggactcccgcatacacatctactcccgccttttgaagcgccggcaccgctgagttcatttcaccaaaacaatagagcattgagacgggctttggtgtgattaattggtccgagtccgcaataaattttaacaaaaactcagttttccccgatgaggaggggcccgaaatgattaggccaaacggtagtttgaaacaaatatctttattggtaaatgattgtgtattaagcatttttggggggacaaaatgatttacatgtttgcggttgaagctttaatactatcaaagaactcgtcaagcgttttgtcaatgtcgccaaggtcctccttgttttgttcatcttctcgtctgggctcttcctgtacattctcttcctccacagggctatttgtcactttggtgtcaaacgattccgctaaaaggaggttgccgagtacattgattgcggttttggccttcttccaacgagcaccgtcctgcatggcatcggccattagcccggcttccactaagtcaagtgctacctttgctttgcgcttcaggtcctgatcggtttgcgtttcttgggttgagaaggtggtagtagtagtgatgcacgtgtctgagggcaggtcaccgtagggcacattgaacactcgggccttatttttcacgcgaaagaaacaatggcccggcaggtcatagacaacgtcaaaagggacgaattggggtttgctgatccggctgcaccacaaggtgatcccctctttggtcaccattgtgtccacctccacttcggtagctttgcatgcgcggcagcggccgcactcctcgaacggtataaatcgcggggtggacagacgaggcccgctcacggttatgccgcttgttgtcaccgtaatgtctgcctgcccaaggatttggttgacgagcgcctttttgtcggaaatattgattgccatttttatttgggagaaaaattttcgagaatgaaatggaagacggcggaattaacagctgcttatatacacccggctggacatcaattgagccccccccctccaatttaaaacgtcaaattacgcaaaaggaattgagtaaagattgggtgggatgggcactcaatactgagtcccgtgcgacaattcaaatcgatgatgacaccccctcccatccccttctcgttcaagtttaatgttcatcttttattagaacagagagaaaaaagcggaaccgcatgaaactcaaatcaaagcgatcactttatttggacaagctgatcacaaattttatccagaattttcttccatttctggacattttcacacggcatacgacgctctttggcgaattccaacacctcctggcaaacgtcacgcgccaccatcggtgtgaaccagttcaaaatctgagaatggcaaagtgaaaaaaaaaagatgctacgattaaaaattaaaatttacattgtcgtcgggcgattcgaaaatgtcataccaggcggacaattcataaagctccatgtcaggagacggtgagcgacggtcggtagagttcatggttacagaaaatggattggtctaaaaagtaattaaagtacacggttgagacatttgaataaatatttgcgaaatatttataaataacaaaataaaatttaattattgaatgaatgaatgaatgaatgaatgagtccctgacaatttacctatttatactcaattttgcatcaaaacaaattaaagattcctgatgacccaattcgaccatctggcgaattctcgccttgtgtccgccgacattatagggggaaattaattaattatgcaattcggatggaaaaattcaaatttctcattaatttaactccaatatattttagggagattttatatttgaatttcccatatggttttttttttaattaatcataaattttaaatttatttttatacctacaatttatcctgattatttaagaaaaatatagatggatatataaaaaatgtatataaatggatatattaaaaaaatatatggatatatttttaaaaaataaattgatcaatcggttatttttatgaatttctaaaattcgctctcatcgtcccactcatcctcctcctcttcaccattctgattgctcggcacgtttgccggagtgtcatacacatgatcaaggcccgtattcgcctgaaattataaaaattgggtaaaaatttttttttaatataaattaaattgcctcataaaattggtcctcctcctcgcgcaccgaactgcgagccgacacatacaacgggcgcgtcttgaactgctgctggtgttgtttctgtcccgtgttcgcctgaaattttaaaaattgggaaaaaattttacaaattaaattgcctcattaaattgttcctcctgctcgcgcaacggactgcgacgggccggcacgtacaatggactcggtttgaactgctgctgctgttgtttctgccgctgtcggcttcgaatttgcttgccttaacacacacaaatttttcattatatgattgtgcaaaaaataaatatgaagacttacggcgttctgcctgttccttttgacgacgcttcaactctcgcctcaaagagagaaaacgggccaacttgatcaaatgttggctgagctttaaaaaaaggaaaaattttattgagattatgattttatataattaaaaatgcctgagtcatgaagagaaggaagacaaagacagtacaaacgatgaccaaaaggaggagaagggcatttgacgggtagcttacggtagtcgccacctcagcgcagttcagcgccttccgcactccatcattgacagttgctagcggctcgttgttgggctggggacagtcggttgtcgttgcagttgtttggggcgcgcgctggaggtagtccgtgaagttcgagatgtccggatgcacacaaacaattggctttttgtaattgcctgctctataacaatgaaggccaaaatcgcaggaattacagaggaatcggttccactgcaacattattatttttaaaatgaatagggcaattggctagggaaaccccctccccacggggtccctttacctttcaaaaactttgtcacacagtttggcccaacaacaaataacaaaaatgttttctacaaattattacccatgcatccttctcttcttttatcatttgcatacccttcccccccccgccaaaaatctattaataaacggtccccggttgatcacggcagagattagtgggtcaccgtgtcccctttttctcatctcctttccgcgagcaacacggcgcggcgacaaacaaataacacatttccgataccccccccccggcactcttatctcacatcccctgtctcttttctcttgttgcttcttctctctgtctctcactttatctctcatccaccaccaccaccaccacagcactgctgcatactccccccccccaccaatgatcacccaaaaaaaaaacaaacttttaaaatttggcacccccaaaacttttttttttcacccccacaaaatgcgcgaaaatttccctctaaaattaggcttcacccccccccccccgaaatttaaaatcaaaaaaaaatgcgcgaaaatttcactcaaaaacttcgccccataggcattaattaagtaccccccccccataggctcgctccccactaattaatcaccccccccccccccataggattcccgcactcccccccccccccataggattcccgcactaattaatcacccataggcttaggctcgcgcactaattaatcaccccccataggtaattaatcacgcggcaaacatcaaagaccaaaagccatcaatcaccaccgcgacaatgactggtaagtaactactat

SEQ ID NO: 288 - DNA, 5240 bp, Heterodera glycines
ctgccggactcctctttgcactcgacataacaatgtccatgccctttgaaagggtatttgagtgcatatttgatgttcgctttgttaccgtatgcgaataacacgttgtggtgtactcggtaacgcagcaaaatgtatgggttgtacggcacgacttgcgagttgtcgtatattaagccgttcacctcaatttgggcaccaccgtcggttgggctaggccggtaatacaatgcgggcctgtccgggtgtagtattgtacatttcgagtacggggctgggaagccctttttacaccgcccaaagttggggtcacgtggaccacaccaactatcactgcatctgtgcagttgcatatgcattagttcgcggacttcgcgatgcatttgcgctatgggtgagtcatcgtctttgcacggcaaaggtggaatatgagcccatatgtattcctggatgacttctgggactgcgtccaggtcagtctgggctacaatgtgtgcgtgtgggccaccacgcccttggaactccattgactcgcctgagccaaggattgttccgaagaaactcttttcatagagctcctggtggaaaacagcaattttgctggaccacacacgcatccacatgtcgaaacggtcagtgaacatttgaccatttttgtaaatgttttccttgaactctggccactcacggttattcgtgaatgtgatgaagagccgcgccttttttgcgtcatggcaacgcgcaaaaatggtgttgcagtcttcatacatttttttccaatactgaagagaatttacatttctctcagaaaggcgaacaacgctaccaatgtcatcgacagtcttttgtcgtgcattggggttttgccgagcttgctgcttattgtattggttcaccaaataatgcagcagattttttggagtacttatgcgcaggtccatgtctggacggcgcaaaaaggttgcaatttgccagtcaattttggacgcttggtctaagatccagcgctgtccaagaccaccgccacatgaaagaatgtggtggtattgccactccaaattttcatcccttatggcgagataatacttgcagtaatctcgcagggagacaaattttttcgatttgtcatagcgactggtcactgactgcatcgatgcttcagacccagacgatgcaattgactcggtatcgcaaatgtcatcatctgacattgcttgattgtcaaacatatcatcagacatgtcgcttttccgctttctttgtgcgggtttggcatatggaatgccaattttatatccatcgtcgcccttaggcttaatcaatggataggttaagctatcagtccatggactgagaggggcaatttcgttcagctgcccttgcttgttttccacccatatcccttttggtgccggggcaccgttgggatccgcatgaatcgcgaacatcccttcacccgttgagggggtgattatctggtggggatgcaacttcgggtctttcatagcacccggagcagagcgctcatccaacaaagtcattctgaagaaccgaagctcttcagtcctttgttgttttaacaactcatggagctgttcacgagcctgcttataagcagaagcagctggatgattttcttggatcatttgctccaaaatttcaagggtctcatcattaagctgatgaccttgcacaaactcttcatcgtttgtgattttctctcccgtaaaggtgggattttttcgccgctgctccatggcttcgactggatccagaatgtacagctgaccaaagccaggaatctgtgttgtgccagcctgcatgctgcttatgcggcgatggaattccccgttgagaattacagccatcgggccgccagcagggcatggcttatttccagccgaaacactcgcgaattggagcaagttgttgtaacgcgacatattgcgaataaattcttttccctcgcgggattgtttttcccccacaattagctcttgaagctcttttgggtgaggattgagttttggcaacacaactcttccctgacgacagcaaaggctgctgtcctcatgcgggaaaagtagcgctccacaataagagcattttttttcgccaagcttaccagaatctgtgtattctggataatgctttgctgctgcagcagcacagcaccaacccttgtggacaaggtagcaacgctgcgtaaatgcagtgacttgctcaacagcatttgttgatgaacgacgtcttggtgcggctgaaggagaacggctaatcgaagatgattgccgtctgcctatgcgcgatgatcgcctcggaggcgtcttcggcctgacgaagattgcatcgtcagcctgcgcaattggctcttgcacgacgcaaaaatccgacaccaaaccaagcgtgtcagcttggttttcacctgccacttgggcttgggtggaaacggcattaactgcctgcccactcgtctgaggttcgatgatcgttatgtcatcatgctcatcaatttccattggctcagcggtcttggatttcgactgcgcttcatctgtatgtcgatagacaattgggcaaggagttggcaccccttcccttggatgatatggcacattatcagagccatacagctcgttaatgtgccataaaatacgcttcttttcataattgatggataagtctggcagaacaaacgtgcgattgttcattagccaggattcggcatacaggcacacaaagtacccgcagctatttccatcgtgttggaccgtcagatttatggcattaacaataccggtcaacactgttgacggcaaaacatcagaaatgatatttttaattttatccgtcacttgaaaatccaatctgccataaggggtaggcaaagaatcggcaaaatgagtaccgcactgaacatcatggacaatgagagtccagtgtcccgggaaatgtattggcaaaagaatgacttctgccgtaacattagggtcatacccaaatgtcatttttttatattggatgacccggtctatgcccatttgccacaccattggatcaacaacgaccacttttcgttgtgatatgcttgccaagtatgccaaatattcgacaataaagccatcatttagaaactgtgtcagatcattccagcacgtttcaatgaatcttgggccagagcgtctctcatcgcattcgtaaagcccaatacgagatgtggcgaagttaatttgcactgtgctgaaatttattttttcaggcacatttggtaaaatcgccacatttgtgattgcttctgagccgtggtcaattgaagagccttcgctcattgaaccaactgtttggcccctgcctggtcctcgagtttttttggccggccgcccaccacggcttttttgcgttgaaacaggcgttgaagcaattgcttcaatagcagacaggggtcgatcaacatcttcgaccttcaattttttactgcttggcggcgactcaacattttgagtggccgatgtgttttgtgtgccaactgatgacgcactattttgcgatgtcataactgactccgctctggcttttgagggtctgcccctttttttacttccaatggaagaagccggtgtgcttaattgcaaagcacttatgttcggggtattaaagacccggagcgaatccgcccgattcctatctactgaattcagtgggttgccctcagaagggcaatttgggataggcaagctccctgggctgacagattgctccgtccaccgcaggtgctcttctctctctctcatctcttctctctttctcttcttctccttttctcgctttgatggcatctacaaaaacaaagtcagcgtgaaaattcaagtgtgacaaaagtatcgaggaaatttaaccaataaatgcacacaaacaacatatttattcaaatatagaaaattgtgtgaattattgatgcagttcagcaatgacgtcacacgtgaagccgctgccaaaatcaatcagcctggtcactcacctatccaatattgttgaccacaattccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcttgcttggttcaccacaatcccaatggctagtgtaggaatcctacgctaggtcattagtcagcgtaggaatcctacgctaggtttttcaaaaatgatccgaggaagcgattttccactcccttttatagactttgagctcgagtatgataactacattagcctagtgtaggaaaggctagtgtaggaatcctacgctaggtcattagtcagcgtaggattcctacgctaggtttttcaaaaatgatccgggaagcgatttttcactcccttttatagactttgaaggtttattttttttatataatcaacacaagtagaaacagtacaaatgcagaatctacactctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtcgtgtagtgagtctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacaactacactctacactatagaacactctacactatagcacctgtaaaagtgactgcggatgtgcaatttcgctgcgcttatatagacttttggagagtagtgtagagtgtagtgtagtgagtctctacactatagaacacaactacactctacactatagaacactcta

SEQ ID NO: 289 - DNA, 3983 bp, Heterodera glycines
gcgcttatatagactttctggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcaccagtaaaagtgactgctttattcaggttgccaattaactaaaatagtcttaaaaagtttttgattgccgccccgccaacgaagacctgcaactgctgctcgccctcggatggaatatcagaggtattttgaacttgctcgtcttcgttacgcttttaaaaaagagttgaaattaataatgaatttgtgttaaggtattcatagacggcggtgtacgcagtttcaacttttgtggttattatactaaacaaaacgtaacaaaaatttatttgtggtgcacgaaaatcttcaaggacatcatcatagcatataataaaccggtaaaaaatttctcaaaatcaacgttaagatcataaaaaattctaactaaaattcatattgaaaatatatttcccactttcaagtacatctttcttcttgttcgtcccgcgcttttcatcaacttctttcttactaacctcctgcttaattcctttaaccttggattcaccacgactttgagtgtttttctaaattattcgtttattaacttagttcaaacagactaaagatttaattagtatttttttacatactcgagtgcgtttgttgccaagcttattttttggctgctgattctccatctgtttcacatcaacaactttcccatcaatggtatgaggtccacccgaaattattgcggcagtcttaggtataaaatagtttatctttataattcataaatacctgggtacacacgaaggtcacgaagccaaaacagcgcgaatgtttgttcttgacatgtcgtacaaccttgcaattttccaccttaccaaatttcgaaaaataagcactcaaagaagcgtctgtggtatcaatagataaactaaatacaaaaaaataaggaagataaagtatcataaggcaaacccgccaacgaagattttgtggtcttttccattaacggaactgctgctgccaggggctacagacaattggacatcggttggctggttgccctcggatggaatttgtttagaagacatgttgttgttgtgggtgttgtccatcagactgtgctgccctcggatggaatagaaatataattttgctgtcaacgaaatattttgctaaacatataaaaaaatgtagcatcaacacaatgtcttgtaattatcctacactggatactctacgctagtgcatttgaactacattagcctagtgtaggaaaggctagtgtaggaatcctacgctagttcattagtcagcgtaggattcctacgctaggtttttcaaaaatgatccgaggaagcgattttccactcccttttatagactttgagctcgagtatgataactacattagcctagtgtaggaaaggctagtgtaggaatcctacgctatatcattagtcagcgtaggattcctacgctaggtttttcaaaaatgatccgggaagcgatttttcactcccttttatagactttgaaggtttattttttttatataatcaacacaagtagaaacagtacaaatgcagaatctacactctacactatagaacactctacactatagcacctgtaaaagtgactgcggatgtgcaatttcgctgcgcttatatagacttttggagagtagtgtagagtgtagtgtagtgagtctctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctacaatctacactatagaacactctacactatagcacctgtaaaagtgactgcggatgtgcaatttcgctgcgcttatatagacttttggagagtagtgtagagtgtagtgtagtgagtctctacactatagaacacacctacactctacactatagaacactctacactatagcacttgtaaaagtgacagcggatgtgcaatttcgctgcgcttatatagacttctggagagtagtgtagagtgtagtgtagtgagtctctacactatagaacacacctacactctacaatatagaacactctacactatagcacctgtaaaagtgactgcggatgtgcaatttcgctgcgcttatatagacttttggagagtagtgtagagtgtagtgtagtgagttaataatgaatttgtgttaaggtattcatagacggcggtgtacgcagtttcaacttttgtggttattataataaacaaaacgtaacaaaaatttatttgtgctgcacgaaaatcttcaaggacatcatcatagcacataataaaccggtaaaaaatttctcaaaatcaacgttaagatcataaaaaattctaactaaaattcatattgaaaatatatttcccactttcaaatacatcttttcttcttgttcgtcccgcgcttttcatcaacttctttcttactaacctcctgcttaattcctttaaccttggattgaccacgactttgagtgtttttctaaattattcgtttattaacttagttcaaacagactaaagatttaattagtatttttttacatactcgagtgcgtttgttgccaagcttattttttggctgctgattctccatctgcttcacatcaacaactttcccatcaatggtatgaggtccacccgaaattattgcggcagtcttaggtataaagtagtttatctttataattcataaatacctgggtacacacgaaggtcacgaagccaaaacagcgcgaatgtttgttcttgacatgtcgtacaaccttgcaattttccaccttaccaaatttcgaaaaataagcactcaaagaagcgtctgtggtatcaatcgataaactaaatacaaaaaaataaggaagataaagtatcataaggcaaacccgccaacgaagattttgtggtcttttccattaacggaactgccgctgccaggggctacagacaattggacatcggttggctggttgccctcggatggaatttgtttagaagacatgttgttgttgtgggtgttgtccatctgactgtgctgccctcggatggaatagaatatgatttcgctgtcaaggaaatattttgctaaacatataaaaaaaggtagcatcaacacaatgtcttgtagatatcctacactggatacgctacgctagtgcatttgctacgctagctttcgaaaaaatggtagcggactgacggtttcgctggccttttatagacttttctgtgggagtagtgtagagaaactacactggatactctacgctagtgcagttgctacgctagctttcgaaaaaatgggagcggactgacgttttcgctgcccttttatagacttttctgtgggagtagtgtagagaaactacactggatacgctacgctagtgcatttgctacgctagctttcgaaaagggagtagtgtactgagtgtagagaaactacactatatactctacgctagtgcatttgctacgctagctttcgaaagggagtagtgtagagtgtagagaaactacactggatactctacgctagtgcatttgctacgctagctttcgaa

SEQ ID NO: 290 - DNA, 3862 bp, Heterodera glycines
  misc_feature (3768)..(3768): n is a, c, g, or t
ctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacaactacactctacactatagaacactctacactatagcacctgtaaaagtgactgcggatgtgcaatttcgctgcgcttatatagacttttggagagtagtgtaaagtgtagtgtagtgagcctctacactatagaacacacctacactctacactatagaacactctacactatagcacctgtaaaagtgacagcggatgtgcaatttcgctgcgcttatatagacttttggagagtagtgtagagtgtagtgtagtgagtctctacactatagaacacacctacactctacactatagaacactctacactataacacctgtaaaagtgactgcggatgtgcaatttcgctgcgcttatatagacttttggagagtagtgtagagtgtagtgtagtgagtctctacactatagaacacaactacactctacactatagaacactctacactatagcacctgtaaaagtgactgcggatgtgcaatttcgctgcgcttatatagacttttggagagtagtgtaaagtgtagtgtagtgagtctctacactatagaacacacctacactctacactatagaacactctacactatagcacctgtaaaagtgactgctttattcaggttgccaattaactaaaacactggatactctacgctagtgcatttgaactacattagcctagtgtaggaaaggctagtgtaggaatcctacgctaggtcattagtcagcgtaggattcctacgctagttttcaaaaatgatccgaggaagcgattttccactcccttttatagactttgagctcgagtatgataactacattagcctagtgtaggaaaggctagtgtaggaatactacgctatgtcattagtcagcgtaggaagcatggggtgttaaaagctacactatacgataagaatggctttcgcacagaaaatttctccctttatataggctaatcaaaagcatagaaaataatgataaaatgcaaagaaaaataatgtacaccgcccggattcgaacttcccccccccccctcagaatgatgcctcagaatccccaagatgctagtgtagcatcgctacattaggttattaagctagtgtagcatcttaggttattaagctagtgtatcatcactacattaggttattagctagtgtagcatggggtgttaaaagctacactatacgataagaatgactttctcacagaaaatttctccctttgaaaaagggtagtgccaagtattactaaactgaatattaaaattgtaagcgaatcatatttatccgctgtgattcagagaatagtgtgatttataaaacaaagtcaataaaaaagctttttttcaggtagccgatttaaaattaaagctaacgctttgggctgccacactccgaatcacgctcccaaagatccattccttcgggcctggggacactgcatcttttcaaatcatcactctttatgtactgctctagagaactgaaaaccatattttgaagctatagtcgccaataattaaagagccaatcatttttaatataaatataaatcttctcacatttcatcagggtcaacaaattccagaagtgtgtcagaactgaacaaaaaatttccttggctgaattgaattctgttttgatgctttgaatagacatgaacgtgttcgttttgatggtcaggcgtcgttttaatcccaatagattgacgactacgttttggagcgctgcagccttccattgtagtataattttcaaaatgtagtttgtttgacacattcggcaattcagggaacataactaaaaactttaaatctctgcttattaacaatatggttacgatttcgtgtgacaagtgcgaccattctattcacagttgagttaacaatttgttcgtcggttaaagtgattaatgtcgatttatcacttcctggtgctgtcttcggcatcattttattcaggttgccaattaactaaaatagtctttaaaagtttttgaaaggaaccccgccaacgaagacctgcaactgctgctcgccctcggatggaatcttagatggatgtagttgtttattctggccatctgattgaatataaatgggtttttcagttaaatgtttgatctccaatttctgtttgtttgacaaattcggcaattcagggaacataactaaaaactttaaatctctttgcttattaacaatatagttacgctttcgtgtgacaagtgcgaccattctattcacagttgagttaacaatttgttcgtcggttaaaatgattaatgtcgatttatcacttccgggtgcagtcttcggcatcattttattcaggttgccaattaactaaaatagtcttaaaaagtttttgaaagccgccccgccaacgaagacctgcaactgctgctcgcatttcgaaaaataagcactcaaagaagcgtctgtggtatcaatagataaactaaatacaaaaaaataaggaagataaagtatcataaggcaaacccgccaacgaagattttgtggtcttttccattaacggaactgctgctgccaggggctacagacaattggacatcggttggctggttgccctcggatggaatttgtttagaagacatgttgttgttgtgggtgttgtccatctgactgtgctgccctcggatggaatagaaatatgatttcgctgtcaacgaaatattttgctaaacatataaaaaaattagcacctgtaaaagtgactgcggatgtgcaatttcgctgtgcttatatagactttttgagagtagtgtagagtgtagtgtagtgagtctctacactatagaacacacctacactctacactatagaacactctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacttgtaaaagtgacagcggatgtgcaatttcgctgcgcttatatagacttttggagagtagtgtagagtgtagtgtagtgagtctctacactatagaacacacctacactctacactatagaacactctacactatagcacctgtaaaagtgactgcggatgtgcaatttcgctgcgcttatatagacttttggagagtagtgtagagtgtagtgtagtgagtctctacactatagaacacacctccactctacactataccaaacttctaaaaataagcactcaaagaagcgtctgtggtatcaatttcgctgcgctatatatagacttatgggagagtagtgtaaagtgtagtgtagtgagtctctacactatagaacacacctacactctacactatagaacactctacactatagcacctgtaanagtgactgcggatgtgcgatttcgctgcgcttatatagacttttggagagtagtgtagagtgtcatgtagtgagtctctacactatagaacaca

SEQ ID NO: 291 - DNA, 1566 bp, Heterodera glycines
agagtagtgtagagtgtcgtgtagtgagtctctacactttagaacacacctacactctacactatagaacactctacactatagcacttgtaaaagtgacagcggatgtgcaatttcgctgcgcttatatagacttttggagagtagtgtagagtgtagtgtagtgagtctctacactatagaacacaactacactctacactatagaacactctacactatagcacctgtaaaagtgactgcggatgtgcaatttcgctgcgcttatatagacttttggagagtagtgtagagtgtagtgtagtgagtctctacactatagaacacaactacactctacactatagaacactctacactatagcacctgtaaaagtgactgcggatgtgcaatttcgctgcgcttatatagacttttggagagtagtgtaaagtgtagtgtagtgagtctctacactatagaacacacctacactctacactatagaacactctacactatagcacctgtaaaagtgactgctttattcaggttgccaattaactaaaacactggatactctacgctagtgcatttgaactacattagcctagtgtaggaaaggctagtgtaggaatcctacgctaggtcattagtcagcgtaggattcctacgctagtttttcaaaaatgatccgaggaagcgattttccactcccttttatagactttgagctcgagtatgataactacattagcctagtgtaggaaaggctagtgtaggaatcctacgctatgtcattagtcagcgtaggattcctacgctaggtttttcaaaaatgatccgaggaagcgattttccactccatttatagactttgagcttaatgataaaatgcaaagaaaaataattgacaccgcccggatccgaacttcccacccccccccccctcaaaatgatgcccagaatccccaatcacacggggattctgaggtctaaacaatgtcaaaagtaaaatctgattacgtattcatgatcagcggcccaaataacccataaagacatgtttttggaagattttgggtgaaaaaaattttccacttaaaaaccatgtgctcccccctttggtcccgaatcccaaaatcacttttatttttgtatcttttttaaaaaaaatgataaaaacttgaaataaaatttatcctatagagaaaaaaattgcggatttttgtagtattttacttttcacgagtgacttttcagaaccgagttctgaatttttttctgaaatttcgaatttttccagatattctggaatatcttttttatttttagagatagaaattccaaataaatcctataaaattctcctgaattttctctatttttaaagcattattatagttaaatcgatgaaaccatcactgagttatgaattttccaatattatacaaaatcctgagggccaaaaatttcccaaaaaataaagaatttttaaaaaaattccaaaaaatctgaaacaaaaaacaaatatcatattcctgctcaacacctcaaataccccaaaaaaaaaatttttcaccccc

SEQ ID NO: 292 - DNA, 1021 bp, Heterodera glycines
aaacaaagtcggacattgagtatggcaaatatatacgacgccaactttatccaccagtttcacaataaaaaatgtgcaagtgagcaaataccaagcctatttcgaatagaatcatcataatgttaataagaaacattaaaacaaaggttaagaatttaataataaatgcataacattatttgttaaaacaattaatagtttgttataaacttttgaaaaacaatattattttcaaatttatttttaatttatttacatcttttaatgtaaattgaggaattcgatggtggcaaatattcgctggcagctattggcatgccgcttttgggctttttatcccatttttccgcttgttaatggttaataaaaattcagaaaagagagcaaaaatgtttaatggaaaaatggagaaaatgggggacgaaaataattgattaaaaattcaagtataaaaatttcattattttaatttttccacataacaaaattagcaaattttattttttcagtgaattttctttttcttccttatccataatggctttcaggtaaatagttcttaaaatattgatattggtttgcattataattataaaaaaataaagcaaacgccaagaaaccaaaatcggaaattagaaaaagacaatctaaaaacaataattgtaacatgctttaataaagtgggaaataaaataaaatttataataattaataaaataagttaaaaagcaaagaagaaaaaagttcggcaataccaatgagttcttgaggggttataatgggcttacaaatattattaaaaaaagtccagaaagaaaaaatgaattaaatgaatgaaattatgcccttcgggaagataaacaaaaaaggccaaaaacgaaagaaaatagcaaaaatgggaaaataaattatttaagaaaattaaaattgctaaaaaacaaacacatgaacatacgatataatttgaacttattgtaggtccttccggaagacaaagtacaaaaattgtcattgcataatt

SEQ ID NO: 293 - DNA, 657 bp, Heterodera glycines
aaaatgctcgaaaaccaaggttcccctgagttcatctagccctaacatttttgaaacttgatgatagtttctgaaattttgtaaacttgtagagcatacttagggctatcgaatgatatgaaaaaataaaaatttggttgcttttaagctaagttataaataattttacataaaatcataatgatggttttttaaataacggctccgacattttgctcctgcacaattaaatcgtctcactttgtctgttaattaattatattattaattggcaggtaagaaggatgaaaatcttagaattttacccgaaaatttcggaagtcgaattacgctcaaaatttttttattataatttttttctattgaaccaataaaaaagataaaaaagttagaaaaagttaaaaatccgctttttaaatttttttatgtcataaatttttggtcagagtacattcaatcgttaagtttcaaaaaagttatgacctgagaaactcaaaaaaccaagttttttttttgaaccttttcgtcataactttcttgaaacttaacgaaattttttgaaagtttgcttaataataaaaaacactaagagctatcgaatgatatcatgaattaaaaatctggttgcttttaggcgaagttatatgaaaatttggt

SEQ ID NO: 294 - DNA, 2573 bp, Heterodera glycines
aggtctccaatggttgtcgcatacaatacatatgtaaaacattttgaaaatcacacatatataaaattaaaaatgaaattactttgaacttttaaaaaacaaattttttattttgtttgaaatgccatttttgcccctaattttttgaattgtccgctgctgccgatttgtcgtcgactttttgctcctcctcattttctggcaccacctccgttgctggcactttcacaattgacttcatcgacggtttggatgccaccatttccgtgccgccgccgtccgtctcgtccaccgagttgaaacggtccaacattggcctggaaaaacagaggtgcccgaaattaccaaaaaaaaaaaaacaacaacagccatttgagtcctgagacactaaaagggcactgcagtcttggttgtaatcgcctcaagggatagcttaacccccctccccctcccgaaatgcaaaattttgaaaatttcaagaaagacgggcaaattaatattttgaaaatttgggttagcaaatttcaaaaaattttaaagaaagttacaaaaaattaactatttctggaagaaaaaaaaacggataaaaattcctgatttttttgcccggcgctgaaaatttttacaataaaaattacactggcgacagaaagagacccaaattgctgatcagtgagtgatcaatttggcccagcggaaatgccaacgatcacataatggcctaattaatcgtgccacgaaattaactatcatttgttatctacctgtctgtgacgcgggactgttccgccggcgctttggtccgtccgttacggtattggccaccgacgccgtttcggtgctgcgccggcggcgacattggcgcggtgccgacacgcaacgagctttcctggctgctgttcgcctccgggatgggcgtcggccagcgcttgtttacggcgccgccgccaccgttggcgtcggtcgccgcgctggcggcgcgtcgttgcgcggcgcgtttgcgcatgtgttggacaacggagtcgaacaggatcagaaaggcgggcaggaacaccagaccgtgcaggttgcacaacaccacgcacagaacctgagggcaaaaaaaaaaatttttttttttttttggcacgccgtagggctgtgcaagagtttggcgtttccgagtcgagaattttctcgtggtttggattctcggcctatatttttagttcattcaaaatcaaaattctcgagtcacgtaatctagcggaacgcgagacttttctcgagtcgagaccgagactctctgacagcactaatgtatgttttaaactaattttctcggctttattagggtgggtgggtgggcgccagtctaggtgctcgtgttaagttctagttcctggctcgtgattcgggacaacaaaattttgtaaaagtctaacccgtactaacccctcaatatttggtcctgtcaatcaaacctaccatagtcctcacaaatacagtagccatgtgcagatggacaagcagaagtgaggacacacacagcgaggtggaaagagcagcctataagcaaaacaatacaactaatttacacgattagtccatcaattaattaattaattacagtttcaaataattaattatgtaattagtccatcaattaattaattattttggctggagcaatttcaataaaaatttacctggagggcaggaaaagccaccgaggacaaacaattcacctggaataaatttggtaatttttagttttttaaaaaaataaatttttgtaatatgttgaaaaaaaattttccaaggcataggtggacggacgaatctccaatcaatttgcattttttaaattacactaaaaattcactaataaatttttaaaaatgtatattaattttttaaaattttcatgccgtgtcaggtcagcgccagagcactttcattttcccaaaaaaaatttttttttatactccaatcattattgttggaacagatcattcatttcgtacaaaaatttaaaaaaaaattttttttctaatttaaaaatatttataagaaaatttcaaggaaagaatttttttttaaattttttttagcgttacaaaattttatgacgaatatataagtttttcaaatatcgctttatatattttttttattgaaattttcttataaaaaattttcaattttttttttggaaaatttctacactgactgaccagtttcgcctgtggctgatcaacgccatgcgctgccgcctggtaataatggtaggacacgtgggccggaatgtccacactgaagccaattgagatggtcatggcagcctgaaaatgccaaccaattaaatttcgttaatgttagcgtaattgtagctaattaggcgtcaaaaccaggggtgcgatcgaaaaattttcaaaataagaacatcaaggccaaaaaataagatttttgggtccaaaataaggacattttgcaaaattgctttaaatcgcttgtataacactttattcaattaatatgcatagcatcaacttttgtatttttcgccggggcggagccgttatttaaaaaac

SEQ ID NO: 295 - DNA, 5328 bp, Heterodera glycines
tcggtattttgaattgaagcgaccagaacaccggggggtgatcagaatgtagaaatagagaacctggaggaatgaactgggattgatcataaaattgggaaaccaatgattgatcaggcaggaccttgggaatgaattgaatcgtgttgaggcggaaagtgataagtaggctcggggacgggataataatttgggggataagggggccatgaaacagtttgcactagattaaaatgaaatcagttcaataaattgattatgggtggaaaattgatggtgaaagtgataaaaatttaggcaaaatgatcaagcgatcaaacaccacttaccaatgtgccaatgactgattgcagtgtgtcggttggcatgttgtcgatcagatccaagaagattgagtcgtcatagtaaactgatgcattgaaattttccgatctgccaaaatgccattggcacgatgatcagtgtttccgatcacttttaagggccctcacttggcatatttgtccacaatggcacgccattggttcagcatgtggccacgttcggtccatattttgagctgatcaccatggtagccagtggtgaagaagaagcgctcaaggcgtcccctgaagcaaaaaatgagcacattgatcagtttttaaatgatctgatcagttttaaaatgatctgatcagtttttaaatgatccaggatcagactgagtatcgtataggaatgcttaaatgattgaataattttctttcaggtgacatggtcattataaaatcagcagacgatcagactaagtccaagcatttcagataacaaaattaaacaataattgaagtgatcggatcagagataagattctcagatatgctagaccaaaggatttggttagattaaatgatcagaaatcagaaggaatataaagaagcgtgattagcagattagcagggttgttgcaaaacgaaaataaaatgcaaaatacaaaaaaacgaaacgccctaaaaacacgaaaatacgaagcgcgaaacacaactttgttttactgaaaaattcaaaaagtttttgaatcattctcaaaatttaatcaatcaaaaaaatttaggatttttggccctcgggatagatgaaatttttgtaaataaatttttactttctcccagattggttgaaaagaaacgagaatcgattgatcaggattagatcccttgatcagtcgaatgccgttaagagtgagaatttccgagattactcgaatccaagacttgctttatacagaactctcgaaaagcattattagaaaagcttacgtgtcgttgtccagtcggatgtacgccttccactcctcggactcgggccaacgcagaaacgcgcgcaagtcctcctcgcggtacggtccgtttggcgtttgtgtggtcagtgccattgccgtctcgccgccaccgactgctgaggttgtgctttccacgccggcatcgagcgcagccagttcagactccagatcatctgaaaagatagatgatcaagtaaaattagcattgatcaatgatgtagagaccctcctgctgatggttgtaccccaaaattttgccgccaaattttttttaatttaaaagttagaaatttttcaagaaaacaatcttaaataaattttaaaaaaaaagtcaaaagaaaaattgaaaattcgaatattttgaaattttatgatgaattactaatttttccaaaatttttgcacaaaacatgaaaatttgttcaaaattttgtttgaaattttataaaaaaattcgacggtttttcttgttttctacgattttttcttcctgaaattttgttataaaaaaagttctaagatttttttttcttgaattttctttaaaaaattatcaaaggtttttttccttgaaaatttctaagttttaaattttttttaatttcgacgacgaaattttgtccaattccatcctgataaactgcattccccccccccccgtcacgaattaaaaatcgaaatttgaccctttcttggatccagcgcatttattttagtttattttttttttgttcgaccaattccaaaccctaaaatccggattcgatcaaacattccgaatttcgcatttatgttctaaaaaattgattaaatcaagtataaataaattaagcaaaatattgcaaactattactaataaagcatcaaaaatagattggaacaaaattccgaaattcgtagaatttcggaatttttgttcgaattagggttcggcattcgaaatggccaaaatgaatgccaaattgggcccactaaattataagcatcggattttttactgaaaaggtcaattttttttaatttcggaaaaataaacctaattaaattttaaaaatattaatatttatttttaagcccatagagtgagtagtgccatctgaacttagactttttcttccaaaattcacaaaaatttcaaaattttcaagacaatagctctctataggttggaaaattcatagaaattttcaaagttggagactgaattggtggcgctgagatggcatccaccgcttggcctgacaaatggccaaaaaaatttctcccattttttcaattttcaccaccttcgtcccgcaattcataggcgataaagtcgcgcacaaaatatttggtcccaattgggccccacgagccattgatcgcttccatttcggccacaaatttgttcattttggccaaccgttcggggtcactgaggttgcccgggttgaacaccaaaacggtggaactcttcacgggggaagggggaacaattaataaaaataattactgtgaaaagcacaaattgctgcattagcaattgaccagcaatcatattaattagcaaataattcatcaagcaaaaatttcaattaattagcataaatcacttcgtgtttaatcattatcagaatgttaaatacctatttgatttaactaaatagggcatttataatttaattgaactaattgcataattagcacttaaacaataatataattaattagcaagcaagtaaactctctcataacattcaataattttaatttaattatcattaaatcgctgcatgttgaattaaaacaacactataaaatgttaaatatttttaatttactaaattggggcatttgtctaaatgaattaccatgaaatgcggcacttggtaaccaacacgcaattcgtcaacctgaaaatgccaaaaatttggtaaattttaacatttgttcgggcctgatcaccttaagaagtggcgaatcgctggtgaacagttgttggatggacagtttgacctccatttgagtgactccctgaatttatatggaaattctaacaaaatttttgatttttcgaaaatttttcaaaaattttacattttttcagcgttgaaatattcaaaattgagaatttcctatttaatcggttatatgtctttactcatgggctcagttctcgtgaattaaccagcaattttattttttggctatgacaataaagcacaaaatgtttaattgcatttctttaaaatttcctctaaaaattgaattttaaattcttttaatataattaatttgatttttaaaaagttagaaatttttggatttttgggattttctttatttatttattttcttattttttaagaagtaaacttttgaaaaattaaattcttttttagattttaaaaatctgctcccgcgtagctaatctcacagttaagttcatttagttaattaattacccaaccaaaattaattaattactcaattaattgccgcccccacttacccaaatggacatgcccaaatagacaaagtaaagtacaacgatcagcattgcaactaatgaatgaataaataaacaatttacagtaatgcggttactgtaaaaaaagtaccgaatttgttggccacaatgctcacatatgtttggattgattcactgatgtaatgcttagtgtgctcgtggaatttgctgtgctggcgctggaaaaacgacaaaattcaaaaattaactaatgaaaatttttaagcgtttttttttttgaaaaaaatttgtataattttctataaatttgaaaatataccaaattttcaaggggtcaaatcggaaatgaacaaaaaaaaactaactctcaaacaaaaaccttaaacttttcactttctccatggacccaaaatcaaaaaatttcattttaatttttttcactggaataataataataataaataaaaaaaattgttttagaaaaaattttcacgccattttttctatatatttttcaaaaagctggattttcttaaaaaagtttaagggtatatagaattaaagcattgaaatctaatgaaatgttttttttcttagatccgccacttttaagaaaattttaattatttttgggttttcgcaactaaaattccaacctctgttgacaaaaagaaattttaaatgccaagactctttgatcaaagataagcaattttgatcaattgaatagtgcccaaaaacatggtacggtaaacatggtacagtacattcggccctgtaccgtaccgtcagtccatgcttcacgctcgatttgcccagttccatgccggcaccgcccgtttcgacggcacgccgaatgctctcctgcagctcgcgccgttcccgtcgctccgtggcaatttcgtagcggccaaccagcgacattaaaccggcataaaaggtcatctgggagcagttcaatgaaaaattttaaaatttttttgcatttgaattaaattatcaaaaaaaaaatttttcaaaaaaattaaatatttttttttgtaatttttctaccgtttcatttttgattaccgtacctggtagatgaacgcgacgaacatggacaccatgttgcccaggcaaagtgcgccaagctccggcgacgacgtgtaccaaccgcagccgtccgcgaaaatgttggtcagcgtggagatgagcacggctggcccaatttcggacaacacctgttgaaaggggaagaaagtctttgttttttgaagcggctttagagagacgggagacaattttcactaattagtgcactaattaatgaggaattgcagctaattagtggtagagaccggatgggatcaggatccgctggattttttcgggatcccgacctcgggacccgtccggattgtttttccaaaatcttcggaatgaaaaaatataatttccaaataataggacatcctattaattaatatgctcatttgtttggtgacattcgcttagaaggtgcactaatttataaatatttgagtgaaacaaaatg

SEQ ID NO: 296 - DNA, 2308 bp, Heterodera glycines
  misc_feature (115)..(115): n is a, c, g, or t
  misc_feature (125)..(125): n is a, c, g, or t
ctgcgagatacggtagtccacttgattgttgtacggctcggctgccggcgacagtgttggatcactgcttgccattcgtggatcatcaaataggacgagtccaccccgatggacnaacaccaggnatggggatcaggcacaggatggaggcgaaacggaagccgaacatgaacatgaagccgagcgccgtggcactaattttgtacaatgaaaatttggcacaaaattttacatggaaaattttttttgtgtttttgaaaaagaagaaattttttttgttaatttgatctatttattttaaattttccagaattatgggcttttgaggctttccaaatttttttttactgatcactgatcagatgtggataaaaaattgaattcctcaaaaaaactttagcgccgttatcccaaggcaattgattttcacctggacatgaacggcagcacacaggcggcaatcgccagaaagatctgtagaatacagtgtgtttatataagtgaacaattacagtttgtggcttttgctaacctctaactgtggctaatcaattgatcagcccaattatgttagctgactaattgaaaaatatctgatcagctaaagcgatcaattctcaagtgagatcagatttagtttagccaaattgaaattaccaaattatctgatcagctacagcgatcagtctgaattgagctacggtttggctagccagctgatcaatctttgaccatatatctctgaccacttaaatatgttgtcgagcgccaagtgatcagtctctgatcaactagaacacgtaggtccaaacatgatcaaatttcgttgtatcgctaagaatcatttctgtaaatctgcggctaatcaacagatcaattctcaaatgaacttaattttggctattgtctgctagcccaactgatcagacgatgaataatcaatcaaaacctacgccatcacctttggcgcactgtgctggtgcatgtacagggcacgcatgtacacacagaacaccgagcagatcaccatcaccgcaaagccaatggacatgtacgggatgatggagaggccggcgcggatctgacgaataagtacagcttgatcaacttgactacaaacactgaccatttcatcctcaatgaccgacttggacagcacgtacatggcaatacgatccgatttgtattccctggaaatgcaaaaaaaattgcttgttgattggtcaataatggcatggcacggttcgattaggttcggcaccgtgcggatttacaatttataaaattttgacccccctcaccccccccccccctcccgcctcttttacagccgcccctcttcgacgacgaacgaggggggggggggggacgtgcgccggcgtaccccttgctcatgtatttgtctgatcacttttctgatcaatcggtgccaaattttgatcggcttcttcgtcctctgatcattttctgatcaatcactgcccaattttttttcttcccaccgttggaatgtgttgcgcatggccaactcgtactgcttgaccatggccaccgtccagttctgctggtgttccgcctcgaaccggagcatgatcattttcacctcgcgcatgttggtcacgtgctgttgccaattttgttggtcgtcccccgctacgagtgccaaatttgtcgcgccggacgtcaaattgccgccgtcctcggcacgtccattagctgccccttcgtccagcatcacttcgtcaaggatgccaccgccaccgcttccggtggtgccgttttcggcgtcgctggactgtgccgcgttgagcaaagcggcggtcaaattgaactggcgctgatcggacgggccgatgccggcggtggttgactcgttgaaaaatttgatgccaaaaaaggtttgctggaagtcattgggatatgagcggtttttcaaaaaatttctcagcagaacttccgcccttcgaaaattctttaaaaatttttaaaatatatttttttaaataaacagtaaaatatttttataaagaagactaataaaaaaaaattagcaatttttttttgttaaaatttatgaaaaacttagtaatttatcataaaattttcaaagagcctagaaaatttcaaaaattttaatgtttataaccccttcggcatagtcggacccttcaatttgcaaaacctaaacacaaattcttcggctcttaactctggttaatcagtgtacaggatctaatcagatagatactgattagttcagatataaaatgattctttcaacataaagcaattttatgggtgataagct

SEQ ID NO: 297 - DNA, 3180 bp, Heterodera glycines
cccaatctgatcagtgatcacctttagtgtttcgttcatatatccttcgcgcagcattgatccgtcatcttttgcgatcaaaaaaatgtacacactgatgccgggcccatcgcgtgagaaaaaatcctttaattatgcaattaaaatttgtttgattgatattgtaaataaaggctttaatggcattaattaagtatgtactcaattcaattatttaatttatgcattaattaattaatcaatcaatcaatcacaacaaacatttaagttatttttataaaaagcctaaaaaggacaatgaaaaataatttaaaattcattttttctcaaattttccaaaaaattgcaaaacatgggctaaaaaaccaaaaatgccgaaaaacaaatacattcccaactaattagtcaattatggtgtctgattggccattaattgtttgctcaagcgtttgacggcacaaaattaaacattttccatttaattagataaattcgtcaacactaatttggccactaattactttgtcccaagccttttctggtgtcacaaatttgaagcatggtaatttgttcttgttgtactgtatgtacagtatacctgaaagcgactgtattcaatgcgtgcccgtgcgtttggcggtgcgtatccctggatgtcattttgttgtctgggaaaaaaggcaatatttgattaattagcattttaataaatttgccattctttttcgacccgagatttttttttgttttccccgaatccggttttcccagacattttgccgtgaaaaaatttcgccaaatttttgaaacgttttggaagaggtaccaataagaaaaaccgaaaatttcagcgcaaaaaaagttttctgttaattaaatgtgccatacggagtgagcatgacaacgataaagccgatcagactggtgattaagcacagcagcattgcctaaatgataaaaaaaaatatatatgcaaattggcaaaatgccaaggcctcttaatcagttttggcattgtgccaaataaacatatgaataggcataataccaaacgcataacactttcaggtttaggcgatgtgccaaggcctattgatcagtagggctgggaattttatgtaacaaaaatcgcaaaatatgtaaataaaatatgtataaaaaatgcggaaaatatgatgaaatatgtacaaaaacctccaaatatgtaataaaatatgtaaatacaattttttaaattgtgattttttggaaaaaaattcttcataaaaagtgaaatagacacaaaatgccataaaaatgactaagataggcttagaatcacattttagtatacttaaaaataatttttggtttctgttttttgaataaaaagaaaatgatttttaaaggtatatttttcaaaaaaaaatttctaaatttcattaaaatataaattgcccatgccaaggcctacaatttatacattttgacaaaatgccacaatcccctaccttccagtcgtgtttggccacaaaacggccccatcgccggaacattcggatgataaacagcacaaagcgtggccccacattgccggtttgttccatttgcaagtccattgaacgctgaaaatggtagtcaaaattcttaatcacccttcaatttaaagtaattatcactgtagtcgagaatctcgaactacaaagaaaaaaaaattgtcgcgctacacaaactaacagtaattaagtgatcaaagttttgtttaattgtagcctttttggctaaagagtttgtaatttcttttgaacagttcatcattcaattgaacaaaaagtttgtaataagttgatcagacaattaatcattcaattattattaaaaatacattcgagaactctggccttttctgatcattaaagatgttcgatttttaccaaaccattagaggcccgagaatcttggcatagatcaaaattgattgattgctttgattgattgagtaattaagccgacaattggaccaaatccatgaccaaggcaaccccgattttaactttgggccgagactctcgactttgccatctcattaccagccgatgatctcggtgactaatcccctatactaatttggtgctgtacgtacgtacgtttttaaagcgacttttttaagtgccgccaactgacctggccaactaaaatggatgagcgtcgccgttccggaaagccgccgccgagcatggagccttgtcgggcaagcgttgaccggcgttggcgcattgtcactgctgtgccgttttcggagggtgacgcgggtcgaacccgatcggttgtcgacatttttaccggttttatgccgtacaaattttaaaacaaaatgccaaaaatgttgttgatcaacaatcttaagcatggaaaattttgatgaatgcaattttaatatgtaaaagttttcaaaaattcagtggtgttcgagacagttggctttgcatagacaaatttctcgaatttttcggggtttaagcctttttgccttggtatactgtactttccgggattctcgaatttcagactttgtttctctctatggcaaaaagtggtagagacatggaaccttttgcattctgtagcaaaattttgtgctgttctttccatccataacattcgtttccgcgaaaattttttcagtcccctaggaaattttttctggtacacctacccatgtaaaaaatattgtaggatgcttatgcattcattactagcacgtgatttgggcgcagttcataaaattctgatcactcccgatcaccttgatggagtgatctgatgcaccaatatgttttgagcggaaattgggcggaatttttaaaaaaattcaaaatttgagaggagggggggggggaattaattcaccgaaagaatgcgcaacaaaataatatggttggcgtggcgcctttccgtttcaaatcaatgtgaaattttggggacgagaaaagtgcggaatgtgggggggggggtagctatagctattaacgactgtcacatgatcagatgggacaatttgatcagccagccgatcgggggagggcggaacactctttcggatcagttgttgacaataaaatgacatttttccgatcagcagcagagcgggagggggaggttttgtctcaaattgtaaacaaccctataaatcatcctcat

SEQ ID NO: 298 - DNA, 2466 bp, Heterodera glycines
gagttcgatcagtgatcaatattatagcccagggatgcttcaggaggcccgcccaaaaatttttcaggttttattttatattatttcacagtatgatgaaaaaattgagatgatatttacattcagtctaatactttaaattttaaataaataaattgtttgactgataggaatgtgaatttaatgatctctaaaatgtctcgaaaatataaaaatgaattgtttttactatttcttaaatgcttttttttcttatcaacaacaattaaacttttgtttttaatctgtgttaaataactgatcaagcttagtaatcggttttctcgaattttaaaactttcttgattgattggccattaaagtcgtttttgatcggtaattaggctgatggaccaaagttatatgatgacaaccaatcaaaacatttttattaactaaacagtcttaaagaaataaaagtgttttggagaatgattgaaatttctgatcagtgaagtgatcaattaaagaattgttttgaactgaaaccgcttggcgttcattgtttgaaatttaaaaatttatactgtttaaactgatcagaccttaagtaagctttgcttccaaatcttaaaaaattttgaacttataagtgatcagataaagagacaacttaatgtaaaaaattttaaaatttctcataatttgtgaaaaaaaatcaggcttttattcataattaacattaaagttaaaagacattaaaaaaattttcatcaatatataaggtaaaattttataagaatttttcatcaactgatcagacttcttgatcaaattaacgctcaaaaaagcgcgtgtaaaattttgattcttgatcacaattaggcaaacaaaattcaaaaattaggaaaattgaattgatcaggcttttcaatcaaataaataaatcactttgtgtgtgtgtgtgtgtgatcaatggtcagaaaaagggagtgagtgaagaagctgattttgcgcttttgcaaaacggaatcaaccaggagcagatgagtgttgggggtggaaatgatgagatgtttctgtgcgtgtgggtgggatggacttttcggaggtgaaggacacctaaaggcgggggacgaaggatgcccccggggcacactaattgatttgttccgctaattgatcatcaatttgccctccaggcgcaacctaatgtttcaacaaaacgccggcgccgccaccctcccaaaagtgtgcccaccgacggcggcgcggcgccgtgcgattgaacaacgggcgagcgccttccataaaaaaaatggtggaacatttttgaattaaaaaagttcgattgtttttggcgttatgtccctcgcaaaatttaaaataaacaattctggcaatccataagatgccgaagggtttataaaaaaaaatttgtcgttcggcacgttaaaatcgtacattttccaagcatacaaaattgtcataacctttttttttgatttcaataatcaaaacaaaaattattgagcatcatttggtagcgctaagtttttccaatagcctgaaaaatcttaaaaaattctaggttttgaaaaaaaaagttagacagaaaaacaattgttgaacagctttttttataagtgcaaaaatatcttgaaaataacgaatagagaaaataatattattttaattgacaattgtaaatcaatcaagatcaatttagttcatcatgactgttaagttgggtttagggttgtccaaaaaaaatttcgaaaaatccaccccctcctctgaccctacaaataaatgacacaagaaaaacgtgactggaacgggcagttcgggactgaattggctcccataggaaagtgatcggaactaaactctttgtcatctcgagatcattcctcctccatttccggtctcgagggcgcacagtgaaattttcttttcaaatcgcattttaaatttggcggcggcggcggacgctggcgcaaagttcagttccaaagttccgcgacagtttttaagttcgcgcgcggggatttggccctcaaaaaaaacgccacaaatggtgggggcacattaattaatttgggacttttcacaaatggttttgcggttgtgtcccatgcgcgcgcgcgagcgacccccgccaaacaaagacaaaacgcacacaaaatggtggggggggggcggcgggagggggtaggacaccggcttccctataggctgtactttaattctgcgtaggatttttgctccccataaatgtttgagtaccccaaacggacacttgaaaaaatcgatttttttgtttcataaatatttttttcagaaagtcatgcacacccgtccgatctggcaagttaagcaacgattgctgactagccaaaaggttcggtgccgtgatgaaacgaaccagcactgcttaccccgcggcacccggcacggtcccccgaaggaatggatttaattaaa

SEQ ID NO: 299 - DNA, 281 bp, Heterodera glycines
agatggctcaaaaaaattttcgaaaatctgagtcgttcgtttttatttgttttttgcataattaattcataaatatttttttcagaaaatgctctgaaacgcaccaaattttatttacatgctagtgggcgagaaagtgacaacgacccccgtacccctacccccgcccttaggggagggggcgggtgagagaaagtgacaaggacacccgcttgaccacggcctcctgctgcgggactcaaaagacagttccatgccgccacttccgtcccagtcaatat

SEQ ID NO: 300 - DNA, 1866 bp, Heterodera glycines
aggtccggtgcccaatattgtccagtggccaatgttcctttgcccagtcgtccagtgaaaaattttccggtgcccaattgtctagggtttccaaagttttggtgctcaattgtccagttgccaattgtccagtgtccaattttggtgctcattttgtcccactatacccgtgttgaatttgttgggtcggggccacgtctgctgccaaccgaccggcggtcgccctcctattcctgccagccgtctctccgtcgatgaggaaggcaggggccgagttgaaggggacaaaacaggttgtgccccctggcgcccctcagggaaggccacagaaatgatgcatcggtgagggggggggggaaagttgtggtgattggcggtggtggcccgatcagttttattattgaagacactttccccccattccccggcggggacggaccggggaaaatggggacagacaaaatcaaaaatcgacgaccttcacaaatgggctcataagacagttagaaaagttggaaacaaagaatagaattgagcgcggcgcagaaaacacacagtgttgttgaacattgagtgaattaaatatgcccccaggggcaagaaattttaaaaaagcagaaatcaaagctttaggcctggaattttgaaaaatccaagaggtgaacagcagatggggttcgaaaatttcgaaaattcatgcctttggaattgttgaaaatgttctattcgaagtgattgtaatggaaaaatttttttaatatttttaataaaattttcgattattttaaaagatttatctttaaataaattcaaattatagattctttgatttttttaaatttaaatattatttgttatttaaaaaaatttatttaaatttaaaatttttaatatattttataaataaaataaatattttaatatttatatttaaataaattcgaaattgtatattcaagtttaaattatcgagagatcttttttaaactttttttatttaattattgtttttcttattttaaaaacttattccatgtctaaaattttttggcaatttttaaaaatgtgacaaatattttaatttttaataaattcttttttatttatctacctaattaattttggttgttttctcatttttttacaaattttaagtattgaaagtgagtgttttgtttacaactattttttttcaattgtttggttgaatgaatcattattaagaaattttaaattgaatcacacaacaaaataaataaataaaattaattgccatcattaaaaaaatgataaagtaattaaaagtggcgggaaaccctcgcgtcacgccaaacatttcgccaaagagttgtaacacgaggcggcgctcccacgacaaataaaggcattggcgcattgtttggcgaagtgtagttgtttaaattttaaattagtaattaatggtaaaaaacgcagcgccaaaattcgggtgtcaaaaattgccgaaggcatagggaggcccaaaagagtaattgggtaaaaacccaaatttgctgcagggtgcagaaattttttgccaaattgttcttttattggagccaaatttaaatcgtgaaaaacatcaaaacaatattcaaaaaacgcgataattcgccactttttcttaacttaatgtggcaaattaaaacaacaaaaaaaagttacatttggcgaattagtgtcacagaaaaaatttcattgcccaaacacgacgccaattgtacgggaaataaatgctgtcgaaacgccaaaaaatggtttaaaatattgcctaaggcaaaaaaaaaaaacgaaaacgtatggaaaaagcttttttttaatttaacgtgacaaaagaaaatattataa

SEQ ID NO: 301 - DNA, 1293 bp, Heterodera glycines
agaccgagaccaaaaaacccgagacttttctcgagtcgagaccgagagtctcaaacagcactaatgaacttaacggcgtgtttctgaattgagacttacgaatcacctgcgaccacccgtactgagtgctgcagaatactatactagcacccccccccctcgcttgaaaatgcacggctaacataacatctgaattcgatgcagctgggctacgattaccttcattctgtacgaagcttaacgaggagcagtttctattgtcagagctgcctcaatttctacgtgcatattgattttttgaaacgatggttgaagaagctccgtgacatttcgccaactcagccaaaaacattcatttcgcggtttacctcagttggaccgtcacgtttgggtcggcacggttgggtcccagcctattttccactataactttctacaatttttttctttttcatccaaatccaacattattggtatcattcgaaagcttttaatgtatttagaaactttttctaagctattgcttcgcgattagacaaataccaaaaaagttatacgttaaaattgcgaaaaactcgaaatttgtaagtttcttcttaataaaattttttccaggctttaaaatctatccgctttttgtaaagctaatagagtatgtgaagagctttcgaatgataccaacaatgttgaatttggatgccaaagaaaaaagctatcatggaaaagcatcctggggcccaaccgtgccggcccaaccgtgccggcccaaccgtgacggcccaactgagcgagtccgggcgaaggcatgtatgtatgagagaattggcacaagtttgctttatgacgaaaaatactccattaaaaaatcatttatatgggaattcattttttttttatttaaaaatttataaaaatttaaatatctggaaacagtgccaaattttggcattatgagtagttacatgttttgaaaaaatcgaagaaagatgctgctttgaaaacgggagaagaatttgcttaattgatgaaaaaaacgaaaaaacattaaaaaaacgattctgcctcaattagaaactatttaaaatttaattaaattagacagtcttaattaaattaaattttaaacgggcagaaaattggcattccgttccctatttaatttaaaatttgcaacaaaaattgccaaccggcagtagcaaagcgcgatcagtccgaccacaacagtagtggagaggagaaagatcagcacgaacggttgttgaatggtggcgatcagactgtccaacattttgt

SEQ ID NO: 302 - DNA, 1809 bp, Heterodera glycines
cgatttgtcccatacaaaagggcacacggcgcctatcaattcactttgttggcatcccttcgtcaaaagcgaatttttgagttgttcggacgacgggtcagtgaattatcgcgacaaattctttgtttttccgcttaattggtgccatttttcagttccttacgaatttgggacacaaacgattttaaagtgatcacaaaatgcataaacactcagcggaaattgataaagacgaaaaatgcgacggggaaacgggcgattccgacgacgtgttgctactcgtgggacgggaaaatgatagcggcgggttgtgacgacggatccatccaaatttggaacaatgcgaagatatttgtgcgtttttcctatgaatttgtccattaattattgccaacccaaaaaagggattcttttgtctgttcggtcggccctttgtccaccgtttgttcccttttcaggtaaacaccgccttcctgaaccgttcggcccattccgggcccgtcactcggttggaattttccccggatggtcaacgcatcgtttcccgctcccgtaactaacacattcctgtccctcattttcatatttttggtgctttagttgacgacacgctcaaactgtggagtttgaaggacttcaaaaagccgtttcgcatggccaacggattggacaccgttttccctcagtaaatttttccatttctcttttcccccgcgttttgcctttccaaggaccgactgcggttacagtccccacgccgagtttatttatacgacgacaaatgcgaaggacaaaggcggcggagagagaggcgctttgctctttttcgacgcggaatcattggaattactctataaaattgagtacccaaaacaggtccaatttggtgccttgcatttgccattgattggctcatttgttcgttttcgacgagtgtttttccagggatgcatccgtgccttttggcacccgaaaataaaccaaattttggtcggtctgagcgatgggacgagcaaaatttactacgacccgtccatcagtctgcgcggggccctccaatgcgtcagcaaaccgatgaaacggtcgcgcgagtcggagatggtccgcgaggaattggtcctctcccgtacggactcgcaaaataaatttggaagatttcgattgctttttctcttaagcattgactctcgaaatgttccaaccgcgcggcgaagacggcgaggaaaaggaagtgacggagtggcgcattcggaaattcttgcggatgcaaagcaaacagaagcggccccaatttcggcaacccgccgcaatgccaatgtccgggccaagtgcgtccttttccctcaacgaccaatggcttttgctgttgcaattgttggtttgaaggtgctggtggacgcattcggcaaaccggggggacgctgcactcgtacatagccaaggaaatggggatgagccggaacaaggagttcatgcagcacgaggacatccgctcttcgatcctccggcacgctgacgaggcaattttgggagggaaaatcgaagcgaaaagtccatcaaaaacaggcagagaaaaacccgcaattcgtggccatggcgtacaaacggacgcagccaaaccccgtgttccaagaaactgccgaggagaacgaagagggcgaggaggagcccgtgtacaaagtgccgaaattaggatgagagggcattgaatgttggcactttttgcaattgctcccccccccccccgccgttcgtcctcttccaatgcttccactttttcatctgattctgccgctccctttgcctttt

SEQ ID NO: 303 - DNA, 1760 bp, Heterodera glycines
tcacgtccttttttctttgttcgttgtcttggttacggcttttcataaaataaatggaatgaatgcctccaaaagtgaatgtgcacatttttatgatgtaaccaaaaggaacgcacggcacaaacgaagagagtacaaattattaaagattgcaattaaattaaattatggggacgaagtgggaatttgaccgaatttgaatgggaattgggcgggggaattgaaattcgattgttcacacgaaaagcggactgacggaatttgccaccgaccgtttaaaaagggtttccttcgttcactctttgtgccgagggtggcgccgacaaaggaaagaaagaaaccttccgctgcttaatgtgtgtttagcatttcgaattcatttgggcaaagcgtccgtcgccctttgattggccaattgtccgacgcttttctcctcggcccactcaacgcattcatcctttaataaatccatccatctttctctccgtctcttttcatccgccgcgttacttttgccgattattccctgtggaattaattttcggattaccccccccccctcccctcgattatttcccccccccctcaattcgttttaattgtctttttcttcgcatttcgcccatttcatcgaacggcattttcagtgaatgctcatttatgaaatggacaatctgctcacacttcgcccgttcctcttcgttttctttgtaatttgttcttcgcccgcctttttgtcggcttgcgacgaatccaacggaacgccaatcgaaagggtaacgaattgaaaattcaaatgaacacagtgccataaattataaatcatctcgccaaataaccgctgaacccattcagcccgtctcagcgccatactccgaccagcagcaaatcgtattggacaacccaaaggcaaattcaagaaaagtgcgggaagcggggggcactgacactgcggggaatgcaacggcagacgcggggagtgtcggcaatgggacggcggacgaagcgatgagcacgacaatcgactggtaagggaagcggggggggggggagcagtgccatggcataaatgtgcggttgcctttgaggtggagcagtttggccactcagtcgcctctcatcgtccaaagggactccgccaatgcttccgtttcaaattcctccgcttctgtgccaatcgcttccgccgcctcttctccgaatgcgacttctccaaattcgccggacaattcaactgccaccgccaaaaacagtgccattcagcgccctttccttctgttcactgttctgatcgcttttggggcaatggcggcgacgattttatgagtggcggaacgaactcaacgaaatccgaacggaggacgacataaaagcagagttgtcgtcaaatgcttatttgttgatctatttttagcttttgacaatccgtttatttgcttcatttgtgatttccttccgccgatggcaaattaagtctttttccaatgtttttagtctaccttttttctcattgagcatttatttttaactgaaaatgataaacattttttctgtgatttgactccgatcagtcaatttcttcgccatcccttcaaaaaggacccccccccccctcccaatctccgagaatgatttgacaaattgggtcattcgccttcactcaccgctgacgaaacaatggaaaagttttggtacttttctgttttgaaggcacaccgcatttaaaaaaattcaacaaaaagcattcaatattaatagct

SEQ ID NO: 304 - DNA, 2496 bp, Heterodera glycines
ccgagcagctttcctaaaactcagcaaaaagtccaagaataggtgtattaattcaaatgaattaccatcattgtggaattctgccgaagaatcgcgtatttgaaaaatgaattattgtcgaatgagaagttctacagaagaatcgcgtttttttaatggctcaggaaagtaccaaagttttgggtcaaaaattccctgggggcatttatcaaaacaaaagcccacccgccgtcttccttctgctaatgactacccaattagcatttcccccttccctttgtgttttcggttgcttttgttaatgattgattaatttgttgggcctttgcgccgttcgttccgttgcctttgcccttttttgtcctttgaaattgccttttttacgtgtgcttcgttcgtccccagctgtctgttgttttttccttccaatcgatcccttcgcttttcccccatttttcctttggccatccgttcgctcatttttctccttttccgtccgcttaattcacttggccattcatttgtcgtccttccttcgcattatgccgcccgtctcaattgatttcggagagggaaacggcgaaatttgcgccttccaacagcgatttgaggcattaattggacaacttccggcggaatgtgagccaatcgcagcagcacaaaaaatggaaaagcttcgatttgtgcacgcggttatggtaatggcaaattcggacggagaaaggggggagagaataaaggtgaaaaaccaaagaaaaaagaaagtaaaacactcccaacagaaaaggtacaaggcaccgctgctgaacgaatggacggaaaataatgaaagggcaaagggacagcgaaacgcagcacaaacggaggagccgagttggggggacccaattggggaggcggtgaaagtgctgagggagacgaccaaaatgttggagcaaatgctggacgattggaggggcgaggaacggcggggagggcacgcgactttgtggcacagaaaaaaggacggagcgatggcaccgccgtcgcctaacggaacagtcgaaggacgcacagaggcagcagaagcggtggacactgatcaaacagcatggaaaccaacgacagaaaacacgcgtcaccagcagccgcattcactgctgtcctccaaaatcagttttccaagcgaattgcgcaggtaccgaatgacggaggaacggcacgaggaacgaatctgagaaacgaaagaacaatgacgaaaatggcacaaaatcaaacaatcaaacacaagcgtgagacgaaacgccacgaattgtaaaaaaggaatgcataaaagagtaatgcttactgaaatatcaatgtgaaatcgtttgccaaatccaacagatttctttcttttgccattttttattttattatgacagtgggaaatgaattgtcttcaatcgacacttgggatttccgagttagatatgtacaacacttatattcgtgaatcttccgtcagttttccgcccattttgccgtcttttcacttagtacggatgttttgcgcagaatattatttccgggatttgtccgtcctccacagaagttccgttgttgttcccgggcgcgtattggaagtgccaatttatgtccggccgtccgttccgttccaatttgatctttcgcagccctttggtgccgtagtgggactcattcccctgaaaataggatgacacttttaagagagcaatggttggtcgaagggttacagtgagtttggcggaggcgacgtaagtggtgttcgaagagatttcgacgggttcgtcaaagagaacgcgaaaagttgtgggcgaaccatcggagaggaaaaaacactcattggaggctagggatttgcccgaattgaaattcaaaatctgacaaaggcaaaggatggtcaattacagacgaatggggggaggaggggcgacgacctcaatgaggacggtgtattggcacgactccctgttggagccgtagagaccaaagccgaggataaacaccggagtgtcgaccataaacctgaaaaatgttaatcgaaatgcaaaaactgcaaatacaaacaaaaaaagcacttcactcggtcgggcgtgccggtgtatccccaggaggattcaatgcgttggaagcgtttcaccaccaactcgggagtgtacaacccgcgataagtggacgggaaaggcatgggctgtttagggcccaaatggtagtagaggaacacgctgaccatctcggcgtcggtgagcaatttggtcggggctgacaatgagacacaacgccaaatgaaaagcaaaacagacggacgaaccgacgaaagtggcaaagtcggacggactgatcagcggaaaacgaattttggagagggcggagccgaggacgaggcgcaaattgtcgggagtcggctgtaattccttcgcccggcacttttcaaatgcccaacgaagagactgaagaaaacgaaaaacgaattggaaaatcaaaacaaaacaa

SEQ ID NO: 305 - DNA, 1380 bp, Heterodera glycines
aatgtcgtcggtgtataaaaagtgagcaatgcctcgaacgcctcgcgctcgacgtcgacgaggtccaattcctaaacgaacattgcgaatggcatgacaaaggttgaggagtcccacgcgaatgccattggcacagtcggaagagtcgccgaaacggaacatcgcctcgaacaccgccgagccaaccgaaagcacaaatttgtgggcggggattctctgagaagggacagccaatcattgccagtgggggagggacaacaaaacctggacggacccatccgaaccacggaaaatgaagaaaatgtcggccaaagtgtcgttcatcagcatgaaagtgagcctttcccgggccgacggaagcgtcgcctgccaaccgagcgccccaatgcccccacggccattcaaatgggcaacattctcaactttgttcactgaaacattacaaaaagtttaaaaaataatctaggcatcgcttactgcgccttttgcagattttattggtcagtcgaacgttggactctttcggcgggcattcgtccgtcttttcctcgtgctgttccggtgtacactttgtttgctccaaaagttgggcatttttagggttggaagtttcctcctcgtctctccgattggcacatcggccactcgtcgaagggaccaccaaattcgatgacaaattacgctccaaattagcaacattctgttctacagagctttgcgaatcggctgccaatgagagggatttaaacatcaaaggcaatcggcggctcacttttggtcaatttgtaaaaattgctggtggaatttgtcatttcccgttctgtgccgtcgtttgttttgtcctcgacttcggaacactttttatcacgtaattgcttttgagaggccatttagaattcgtcaaaagtgcgctttccttctcaaaaagaaccgcaaaatcagacccaaaattattagctgatagacaaatacgcattttatggcattctgttattttaatttaaaggaaaagaatggacaaaattgaatttaacaaaattatctctccaaattaacacattttccaacaatcacagtacaattaatgaaaatgaaaaaatattgcacttttaaatgggaaggaatgttaaaagataaaaataatgaatagaaattaaaaaaactaaaaataagtcttcacaagccaataaaatcattcagagaaagaattgggcaatgagatttaaaaggccacaaaaaataaggaaagaatgaagcgcaatttgccgatgagtgagtcggccttgcatttggagacgtttcaggtgcacagcgcaagggagcagaaacatccaaacgaggccagaaatggagccgatgtaactgaacggtgggggtaaa

SEQ ID NO: 306 - DNA, 1531 bp, Heterodera glycines
gggaggcgaacgaaaaagccaaacccagaacaattcgggcggaaaatgcgggggaagtcgggagaagcgacggtttgaaccatgggagaagcctgtggggggtgatcaatgaaaagcagcaatcatgggggtgaatgatcggtacaaaaaatggagctaaaatggttgaacaaaatttatacaattttgaatttttttaaacattgtgacaaacacaaaactagctgtactttttgttatgagttcgatacccgttgacgttttcttttaaatttatttttttttgaacctataaattggctaattcgaatgaagacctgtttaaaaatggtcaaaatttccaaattttccccctacggcgcctatcggcaccgccgaccccccccccctccccccattttgctgcctacattttttttttttgaaaaaagcgtgccctaaaaaagtgctttgaaaacaatccaagctaaaatagaagatgacaatttttttaaaaattttattatcaaaatttcacaaattttgaaaaagtcccggtcccggccatttcaaaattccgggctctaattttcacatctctaacacaaaaaacatcaaattcgtaaatgctaacaattttggttataaggatacaaaatcactttggacatttagaattaatagagaaattaatagttttagcatttttggtgaaaacagcagtttaggacttgagttataacgtgataaaaatttgaaagtatcacaactttcttctgagatgtcaaattgcttagcaaaaaatttttttagataccaaatttgttcagtttagttgggaatgaaacgagttatggcagatcaaaataaactccattttctgttgaatgagtcgataccgaagaatgaggaactgctgtccattcaggtggagaaaattcatggggaaatggttttgaatttaaagaaaagggatcataaatccatgtttttctgaaggagaggcagcgaattgaactcgaggctcagtcggccaccctcgaggagcagcggacgcacatcgaagtgctcgagaaagccctttccaacgcgcaggagcgactggcggccaaagaacggtcggcggtggacgccgttgcggtggtggacaaatgcagccatttgcagaggttaggcccaatccaaacacactcaccaactcactgattttgccaatgtcagaatgttgcaagaggcactggaggacaaacagcggcaaaaggaggatcacggacgacaggtggcgcagttggagatggagctgacgcaactgcggctccaatttgccaaggactccaacccatccgcaattggaagcatcgggcgaaaaagcggcggttcgatggcaatttcagcagggacagcgacagaaggcggtaccattgtttagtgtaccatagggctcccaagtatactgagtttccaaatttgggttgacagaaaagttccccttggcgccaacaaatccgaattaaacaacatttaggacaaattttgatatataatacaaatt

SEQ ID NO: 307 - DNA, 3623 bp, Heterodera glycines
  misc_feature (3356)..(3357): n is a, c, g, or t
tgtggttatccgccatggtttgaattggcgtggcgttttgtatttgttttgcgttaaaaaatgatttgaaaatgaaaatggttttgatttttcaatttgttttgcaataaacattcttaaaattgtacctatttatttgcttttttatgtatgttcatagtttattaatctgtgactttcgtgtgagacactaatgtgtgtcatgcttttgaaaaaacattagtggtttgttctgtgactttaggttgatactaatgtgtgtcatgcttttgaaaaaacattagtggtttgttctgtgactttagtgtgagacactaatgtgtgtcatgcttttgaaaaaacattagtggtttgttctgtgaatgagaacgaagaaaatgaggacaacggttggacttacaatcaaacacttgacttttattcgattgatcaaattaaatttgcgttaattagcagagggggcagacgaagaacagctgcaaaacatgttggagaactaccaaaaacacgtgatcaggcagaagcaacgccagagcagcagaagaggacagcaaggcacagccggcagaagcgcgagtcatctgcagaagaggttctgaaaggcgagggacaaattctttccctattttcactttttactaaaaaacccattctgattgtgagcatcgtccagtgatttaattttgttgttttttagaatgaacgcctcgcaacaatctcagatgagtcattcccagccgtgtctgctttcgtccagcgttggccaatcgcatcacaaaaatgacgcgattgctggtggaattaacggcttggttggcgtccagacgcagcaacagcaccaggcattaaaactggccaaatgattcgatgcttctacaaaatgtatgcataattaaggtacagttttccgcccaaaaccgacgttttggtgccgctcaacaagacgaacagaacgaagtgctgatccaacgtcgccacgacgacctaattggcattggcaatcaacaacaacaactgaccaagatgaattcggaatgtaatggaaatggcaatgcacattcgaatgagcccataatcagccaactgaaggcccaaaatggttaagttaacgatttaaattttacaatcgaatttcttttttttagaaaaattacggaaaaaaagcgaacgactggaggaggtcagtgcgagtgttttaaggctaaaaaagcaatttgtttcatccatcccaaagtctttatcattcctccgtccttcactttatttccgtctttagctggagagagcgtgcaaaagaattgagcgtgactatgaccaagtgacggcacagcacgaacggcgcgaagaactgcagaaaatggcgattcaaaagttggagcaacagttgcgaatgctttccgcggagaatgagcagttgagggcacaaagtgcccggctcagcgcaatgtttggagttgtcggccaaggcaatgaaagcgaacagcagcagcaaatgcaaatgcaactccattttctgttgaatgagttgataccgaagaatgaggaactgctgatcattcaggtggagaaaattcatggggaaatggttttgaatttaaagaaaggggatcataaatccatgtttttctgaaggagaggcagcgaattgaactcgaggctcagtcggccaccctcgaggagcagcggacgcacatcgaagtgctcgagaaagccctttccaacgcgcaggagcgactggcggccaaagaacggtcggcggtggacgccgttgcggtggtggacaaatgcagccatttgcagaggttaggccccaatccaaacacactcaccaactcactgattatgccaatgtcagaatgttgcaagaggcactggaggacaaacagcggcaaaaggaggatcacggacgacaggtggcgcagttggagatggagctgacgcaactgcggctccaatttgccaaggactccaacccatccgcaattggaagcatcgggcgaaaaagcggcggttcgatggcaatttcagcagggacagcgacagaaggcggtaccattgtttagtgtaccatagggctcccaagtatactgagtttccaaatttgggttgacagaaaagttccccttggcgccaacaaatccgaattaaacaacatttaggacaaattttgatatataatacaaattattcattaaggtattggcgatgaaatgttgaagttgaggaaaacgatcagtctgaaggacgaccgaatttcgcaattggagagcggccttttggagatgcaaaaacggtacagcgacgagctgcaacttcgcgagacggcctcaattggcaatggattcaccggcggaataaaaagtggcgcggggggaggaggacgaatggccgagttggaggctttgtaagcaaaatgccaatgattttctgaatttaaaacccaacaacacacacaaacagagctgtgcgattagaacaggagaagtttgagaaggaacgccgcattcacgaattgttggacgagaaatgccacattcaaatgcaatggaacgaggagcgtcgttctttggactaccgcgtcagactgctcgaaaaggtgggacgatcaaacaagttttggcactcaatttccccattcaggacctgcgacatttcatgggcagtcaaagttcgttggccagttcaagcggcggcggaggcgcatttttcggcgctggtggagttgtctctccgtacagtggttgtgttggcgctgacctcctctaccaacaccacaactcgccttacgcttcgatgcgcgaccaaaaccttcgccaccgttcatccgccgaattacccaccagtgcacgaattgctgcactttatgaggataggtcacacggctgcggcttggatgtgcttgccaggatggaggggttgggccggaagatggcggaacgacgggcgcaaatgaaaacgtcggagaaaagtagctgcgcggaagggccaaaactgccgaacatcgccaggccgaggtcagtctcacagtcaacaccagggcatccgacattgcacatggtgtcagtgtcattttgtttcagtgactttgcgctgtctcacaatcagcagcaatcaatttccgccaccactccctcttctgaactcccgcaacaacaacaacaacagctccacgccggtgcccccccttcccaacatccgtcactttcctcctcctccaccgaccatccgtctcatcagccaacaatgttggtggatttgtccccttcctcagaagaactgttgcaacatccgacaaatgttgtctcgactccgaccgacgactatgggaacgcagtgacaccccaacaacagcagcnncctcaaccgtcattgagcaccacttcttccaccagttcgtccaccaaaaagtagagtagtcgttccccctccggaaaattttgaaaaatcttatcattgcaaaatcgaaaatttagacggtattttgtgagtgctaccgctgtcaaccactcaccagttaataacgtttttctggaccaatactccgagtcttcacgtcgtcgtgtgactggtggcaacaaaatgtgcagcagcacttttgtcgagacgaattcgtttggtggaga

SEQ ID NO: 308 - DNA, 2989 bp, Heterodera glycines
aagcatgataaatttataatcataaattaaatgttgtttgcaagtctttaatttcctcgagaaaatatacagggttataatatatatcttaaggcattgtcctacaaaccggaagtaggcgtaatatttcgcaaaactccgatcggtgtgagcgtcggcctttctcgcagcagtgatgaagacgcaggaatcatctactttgaggcggctttcaaagaaaaaggaaaacacacaaaacaacacctgacagtaacgtcaggaggcggaacttcggacaatttggcgcacgattcaatgcaaattgcgcatacattcgccataaatttcctcaacacaaagggcaacacatcgttcgaaagagcgcatgtacacatgaacatcattagcactagcacggtatgtatttgattacttacaaatgggtggaggtttcccaccacatccgaaatgaaatgccttagaaattttattaaaattttaaaaaagcaaaattttctaaaaattttattttttgtaaaattatttttcttttgagtggggttggtcgtaagcaacgtggggaaacttttgagcaataattgttatccctctcccctccccatctgttataatcatcaccaaacttatagcaaaacataattaatactttagaaggcgtacaatagtgcgggcccttctgggggcgtgggcgcggtgctggcgtactgctcactggcgttgcagaaggcggtgaagcaggacatcacggccacggggcggattaccctttctggccaagttttaaaagttggcggcatcagagagaaaatggcggcagtgaaaaaagcgggttttaaagtggtgataatgccggaggacaaccgcaaagacttcgatgcattgagcgcagaagaaaaaagagacatttcccccaagtggatcaatgattttgatgacgtttttcaattttgttttggtgatgggtaatttattgttttgataaaattattctacaaagcattgaagagcctttggttgataaatcccaaaataatgcaattccatcaaattgcagtgaaggaaatgctgggaaaacggtcgtggaagtaaagggagaggagggtgactcggacacgttgaacagccaccgacagttagtgtacaggaggagttccctgggcaatgccaatgccatcaagtgaccaaagggtgacgaagaagaaccacggccagattcgattgtttttcctcgtttagttaatatatctatccatttttccccttcaccttccattttaaaatgtgccttaattcttttcgccaaactaacatttgtatacgaaattgaagccagaacttgctcgattccctttattgcagtgccgttatgatgtgaacgattaccggtgcatctacgaagagactaaaatttttgttcattacatcattggaaggtttacaccttttgggtctgttcaccaatttcaacaattacacactataattcactgagcctatcaacaaaaaacaaatggttgagaatgaatttgagtgcaataatcaatgccatcactgcgacggcatttcggagaatcctcgtccaatgtttgtccttggaatttcgtctttcttctccatttgtccaaattcgttcctcctccattctctgcttatggtcctaaatttgaattgatttccactaacatttcctttactttacctcctcgaaatcggggaaactgacgatttcggatttcatgtaaaattttgacacagagacaatccgaacatgagcccagtgaccaagcagagactttttgctggcggagacacactcattgctaggggggaggcaggggtcaggcaccaaaatatgctctggaaaagacatactcgttttatttggatgttgtcctgtatcctgacggattttcctaccgtagcatttgttgtgcccaaccaaatggcgcccgtcggatgccctctcacaaattaaaacaaaatgttcctcgccaatccgttcgtcagtgtagcgtcgataagcgtggaaacaccgcgtcatttcggcggtccgacgacgcgccttaaagaggtaagtgcactttcagcaaaatctgaaagaaattaccagaagaaatgcgtgtaaatttaatataagtgccccaagttgttcggtcgtccctttcggtcacctcaattgtgttaatttttttcagccgggccgccggtgtgccgggcctcgggtagaattggttgatgaacacactggggaattggtacttggacagcaattggacactctcagcaaagtcggcatcggtttcagtaggaaaggcacaaatgaaatcagtggcgatgtatacatttggcacactgacaatgaatattttatcattcaattcactagataaattcactttttcagcatataatccataatttggcaaaagtgtggcacgccgtattaggtctttcagccccccccccccactgtctacgcccttgccgtctatatgatttggctccaatttgaatccaatgaaaattaatattgctcttcatcattgttatttagagttaggacatttccgggtatttttgcatagaaaataaatttttacaatttatagagaaatgatttttctcttttcattcaatgggattaaactttatcattatctgtacaaaaaattaacaactccaattttctacatttgtttttggtaattaaaattaattaaatgtattaattaatattaaacatttttattcgtcttttgctcaatgttttgttagcaaataataatttgtttcccatttattcgatggtgctatgtcgttatataaaagccaacaaaaagggcgttatataaaaaccatcaatgaaaattttcaacaaataccataattcttggtatcatccgatagcctatgggttctctattagctcacctatgtttcaaaaatttgggggggttgagcaaagttgtggccaaaagtacacaagcaa

SEQ ID NO: 309 - DNA, 4126 bp, Heterodera glycines
  misc_feature (4114)..(4114): n is a, c, g, or t
ttttatcatttcaatccactagataaatccacttttcagcatataatccatatttggcaaaagtgtggcacgccgtattccctcttcatgtcgcccaacaccgcgtcactgcccgactgcaccgggatatgcaggaaggagtagacacgggggtggcacagaatctccgcaatttcgctcaaatggtccaaaatgtaaggcggattggtcatgccaagtcgcatctgacaaagtgggaagcgagcattgaacaaaaaaacaaaggcatgggatggtaacgacacaatggaattacaaatcagagtcagtagcctatgatgaataatttgaattgggcgttaggttaggtgagcacaaatgggctgaccatgcatccgtcggggatcacttggaccaaagcgcgcaaaaggtccacaattgtgtggccaatgtcgcgtccccatgcgcccaaatcttccgaggtcagccacagctcacgacacccatccacggacaacgctttatgggcctgggcgacaagcgaactgagcgaaaaactgcgaaggtcgccccgggcggcctaaaaagcaaattcaaaggaagcattaaaaacaagcacaagaaagacgggacacaaattgtttttttgattatgactaaggattgttgtacgccgttttacctttgttttgcaatatgtgcaatggttaaggcacccattgtttatggccaaaatttcgatgaattcattccttccttaaccggcagttcattttcgatgtttgccattttctcacttattttcggcattgataagtcaatttgcggcgtattcgcagtcgccgcttttcgcctcgacaacaatcggacgacgttccctttcagtgtttcctccacaacataaacaactcggtggatttgttgaacaccaatcacagaaacaccattaagccacggctcatttggcgacgcctgacaatgagagaaaatggaagggaaagagcgtaagaaaagtgcaaaaaaaaaaactaaaaaaacaacatcaagaaatcacttgggacacacaaccggacacaacgacgcgcttcgagttggacaaagcctcttgaatttggttggccaattgcgtttcggatggagtcttcactgtgcctaaaatccttaaaacagattaagttgctaaaatttaaatctcaacgaacagctgttaagcacccaaatgtcggctaacgttttgtccgcagtcattctgtagcctgcctaaaaggaagttcgggatcgctgacatgagcattgcccgactccaattcgaaaattcttttttaaacatccacaatttttgaaaaatagaattggcccatcccccttagtctgatattccatggcgcccacctgaacgagcagtccggccatgtactctgagtcactgttgttgtgggaacagccccaagtgcggagaaaaactgtgcaatctgaactaaacaaaatcaaacgaatgcatgaagtggacagagatccaaaaggaggacttaccccacgggagaatgcttcggtccgcccggcactcgtccctttggccccttccccctccatccgtcgtcatttcttcgccttcctcagattctctcattttattcctccgcataatgcgcacattgaaaaagcgttttccattttccttctcatcggcagaaattgcctcatcgaactctgttggcagccgaccgattgaatcctcaatgtccatcagaaaagaaaaatgaaatttcagtaacaaaaaataaatactttgatgctttaattcaaccaatttcatttcaatttaattggaggaaaaagattttaattgcattattaaaacaaatcacatccaatgcgcgagagtcaaagagataaaacatttttaaaacgctgacgatgagcatacatttgtggttttttgggcagaaagtgaataaaagcctttaaaatctaaaaaaggttctttttgttctctccgtcatttatgcccaataacaaaaagcaaggaaatgaataaatggacagacaaaatgagagaagaggaggggcttttttgctttgtgtgaatttacgtgaacgacccgcacttccaatggacattttcttctcatgacccatcgatgccgaaagaggaaggcgaaccaaactgaaatttggaggggaatttaaaaaatctttcagaaagcgatgacccttccggggccgcccccgcgaattgccaaatgactgtcaatggcctgcaatgaaagtaaatgggtattaacggagaagtaaaattgtgcggatctggaacaattccggaggtgacggaacgcgaccactttccaatttggaccaaattcgttcgctttcaatgtaaatttcgaaggctcctgtggattggagcatcctaaataatttgatcttgttaatatatctcacaatcagtgaaagtaacaaaatttatttacccttcgatggcattggaaaataaaaaaagcataagtgcagcagacaaacgattgctgagcatccattggaagaaagttggggtttcaagtctcaaggtggggaaaggactccttccggacacaacgcacacaatcagtgcaattttgaccattccgatgacctaagacacaaatcgaatgcgccaaaacatttgttagattaaatttcttctcttaaccactcacctgcgctcccaccgtgcgaagaatgccgggaggatagttttcgccgtggatgtcaattccgggatatttttcgcgtaaaatctgcgcaaactgttcatatgcttggcgataaccacatgagacactaaaagaatgataaataagtttttagacaaagtccaaaacaaaccaaaaagaaaatttcactggcggcatattgatgggcaatttgaacgattccttcgtccccgaaggttctcggattgtgacttcctcgtcctccatttcgaaccccttctgggcctcttttgaatatttatgcgctgggttttcttcgagttcatcgaattgtttaaatgagtcgtcgcaatcgttttatgatcccctttctttaaattcaaaaccatttccccatgaattttctccacctgaatgatcagcagttcctcattcttcggtatcaactcattcaacagaaaatggagttgcatttgcatttgctgctgctgttcgctttcattgccttggccgacaactccaaacattgcgctgagccgggcactttgtgccctcaactgctcattctccgcggaaagcattcgcaactgttgctccaacttttgaatcgccattttctgcagttcttcgcgccgttcgtgctgtgccgtcacttggtcatagtcacgctcaattcttttgcacgctctctccagctaaagacggaaataaagtgaaggacggaggaatgataaagactttgggatggatgaaacaaattgcttttttagccttaaaacactcgcactgacctcctccagtcgttcgctttttttccgtaatttttctaaaaaaaagaaattctattgtaaaatttaaatcgttaacttaaccattttgggccttcagttggctgattatgggctcagacgttggagcagcacttcgttctgttcgtcttgttgagcggcaccaaaacgtcggttttgggcggaaaactgtaccttaattatgcatacattttgtagaagcatcgaatcatttggccagttttaatgcctggtgctgttgctgcgtctggacgccaaccaagccgttaattccaccagcaatcgcgtcatttttgtgatgcgattggccaacgctggacgaaagcagacacggctgggaatgactcatctgagattgttgcgaggcgttcattctaaaaaacaacaaaattaaatcactggacgatgctcacaatcagaatgggttttttagtaaaaagtgaaaatagggaaagaatttttcctcgcctttcagaacctcttctgcagatgactcgcgcttctgccggctgtgccttgctgtcctcttctgctgctctggcgttgcttctgcctgatcaagtgtttttggtagttctccaaccatgttttgcagctgttcttcgtatggcccctctgctaattaacgcaaantttaatttgatc

SEQ ID NO: 310 - DNA, 3169 bp, Heterodera glycines
  misc_feature (34)..(34): n is a, c, g, or t
  misc_feature (157)..(157): n is a, c, g, or t
aaattccgtcacaaaaaagggtcatcaaattacngcaataaataaacaaaatgccaaacaaaaaaattttgtttgaaaagaactattatgcaatctatatataatttttgcctttggtgtcacaagtaaacaaacataatacataaaacgtggtctntcatcacttttctttgttctgtttttatgttatttggtagtaattgcacttttggttttgcttttctcttttgtttaattctattattttttccttaaatatttaatattattatctgtctttcacaattatttaatactatttttctttttataatgttaggaattttttgtcaaattgatgatatatgctattcgaattttttgatactttgaaggataaaagaattcatgttcaaagagagaacatttatttttgatcccaaactacttaatcgatttcttcctttcgtaattatttgttttcttttaacatcattttttttcactatttcacacattttaattatttcatacaccaaaattgatttagattgcttaattgtctaatggttcgacaaaaacaaactttctttaataacaatgatcttccgacaacatcagcagcattgtctcatggaaaagacgggttccaagctcccgttcaaaaaagcggtcaaatgaatagaagggttcaaagctcccttaataaaaagcggttgcatgaaaacaatgacaatgaattgaattttgaattatcaagcaaacgaaaaaacacagttgaacaaattattaatttggatgaagtttcgaatgatttttttaaaaataatgattgcgaagagattaaaaaccagaagaagatcggagagtcagctattcgtaaagaattatcacgaatgagaatgtctgatgaaaaaataaacatcgttcagaaatatgacaggaaccgaaaaatggcacaaaaaaataaacatacctctttatatttaatagctggtgaatttcgtgtaaatgatttgagcagttataatcttggtgaatttgatgttaaatgcattcattgcccagctattcattttcaggaagaaaacaacaaaatcaaaggaacccaagaattttatgactgttgcaactatggtaaaaacagtaatttagaagaaatgatacaagaatacccaatggatttgcgggttttatttcaacctgaaatagaccaaaataattacacacaaattggagagttacacaatgatttcaaaaagaaattaagatatttaaattcctctttttcatgtgcgtctttgggatgtatgcgatttaaatttcctgataaaaatgtgccaattttcaaaatacaaggtagcatttatcattcatataatagtgttgctaggccaaatgaagaagaactaccgacgaatggacagctttattttatagatactgatgaagcgattaattatcgattaagtgcctacaaagaccaattaacgaaactttcaaatgataatactatagctttaatcgcttacattgagagttacctacgcgaaaattatgtttattcccagtcatataaaatgatgaaagaagtatttgaaaaagcagtagaaatttcaaaaaatactgactgtgaaattcctgacattacaatgttatttgatgtaagagaaggaacagatttaaggcgctataatataacgaaatcgaatgaagtttgtgctatcatttttcgtgatgctaatgatgatatacctgctgcaaatattgttgtacatttaaaaggaagtaaaaaaatagaaactattttccctttaagtccaatggtcgaacctatgtgttatccaattttttatccacttaattatcaaggctggcattacaatataaaaaatttagaagggaaaaaaatttcattgtgcgatttcaccaaatataaattatttttcagaagagaagggaaatttttgccgcaccattatagtaataaattgtttcaacaatggttagttgatcaggcggcgcgaattgaatggagccgtttgaattacataaaattacatcaaaaagaattatgtaaaggaacatataatgagatagataattttttgtatgcaaaagctgccgaaatcggtgcgcaagttaaaaagaaagtgattttaccatcaacctttagtggaggaccaagaaatttacatgagagtttcatggacgcaatggcaattgtaaacgaggttggccgacctgatttattcctaacctttacctgtaatcctaaagattttgatatacaaaaatgtttgcttaattcacaacagtcatatgataggcctgatattgtagcgagagttttccatttaaaagccatccaatttttaaaagaaataatagacgggaaaatatttggaaaagtggctggattttgttatacaatcgaattccaaaaaaggggtcttccccacatacatatgttattgacattagatccagaaaataaatggaaaaatacaaatgatattgataggtttatatctgcagaaatacccaatgaagaagaagacaaagatttatataatttagtttctgttctcatgatccatggtccatgtgggcctgattttactgatgcagtttgttggtgtaataaaaagaaaaaatgtagtaaaaaatttccaaaacaatttcgtgaaaaaacagaaataaatgaaaatggttaccctttatataaaaggccaaataatggacaaacagttataaaaaaagattggaaaacaggaaaaacaaaagtaatatcaaaccaagatgtggttccatataacagatatttacttaaacgttttaaagctcacataaatgttgaaaaagttgctgatattaaagcggtgaaatatatttataaatatatatttaaagggtatgatgctgccactgtacgttgtgtcacaactgaaaaaggaagtgtaaaagaattaatatacgatgaagcgggttcatttcttgacgcccgttatcttagcccggttgaagcatgttggaagatttttaagtttcctttacaagaaaagtctcattcagtacaaagattaccagtgcatttagaaaatgagcaagtaatttttttcgatgaaaatgatgaagaagaaacaataattgagaaaaaagacaaaaaaagcaaattgatggcttattt

SEQ ID NO: 311 - DNA, 1005 bp, Heterodera glycines
atggcacgaaacaaaataaaacaaaccaatttatcaccctttttgtcacaatgcactcgacaataagcacttttctgtttcctttaatgctcattaccacactattctcaaaccacaatagcacaaaataaaggtaataaacagtaataataatgaaatgaattataattaaaacaattatatttcaataaaacgaaaaaatgatcaataaatacgaatttagatggcagcagttcaaacttagttcatccaggttttaactttgtttaatcaatgaaaatatattttcgaatattttaatgaatgttcaatattttaggaataatcagtcgagtttcacagcacggactcaaccttttagcaggtattgcacgaaaaacctttctttttatatttcgaaagcaattaattaatgatcgaatatttttaaattaaatttttttaaagattatttgcgcactcgcgtccaacggtttatgcgtttcagtgcttttcagtataattttagtgtcggcgtgccaaataataatgtttgtatttttaatttaatatgataatttaattttaaaaatcaggttgaaattgccattcgttctttggatacagcattctttgactcgggctcgtttaattccaaaattgcagttattgtgccgtcaaaagaactcatttggagtgtgaggcattaattaattatttatatattatttaaatgctttttattgcataaattaaatagggatttcattttagggctccgactttcgtgccagcattaacagtttggtgcagctgaggccgttggacaaacgcgactcaccgacgcctttgttcagtgcgcatgtgccgctgaagttggaaagagttcgggtggaattggttttgggtcccagcgtcaaccaagacggacacttaaggacgggtgggtaattaattagtgtgtaatttatagattcttgaaattttttatttgtttgtcagatgtgcgacagtgtctaattgttt

SEQ ID NO: 312 - DNA, 1338 bp, Heterodera glycines
gcaggtcatgcgaagtagggaacgcgaagtcagcattagtgctagttccactcgcggcaatgtttttggtattttacggcaaggcaagtcgaagaagttaattgactgcaattaagcaatgcccaaatttgaaggaaaaactcggataaatgattttcgattgcccatattgccacagccaatggtgccgagcaattccaagtctgccgcaaaacgaatggtggtgttccaactgtccaattacactctgagcagccttttcttttggatggtctgtcaaggccaaaacaatcgaaacttttccaaattaaggaccaatacaggaaattcgactatgaaatcagcaaaacaacagtgaaggacaaggaaatcgcagcttatttgaagacggagtgcgggccgaaagacatttgtgccggcactttgttcccaggcatggcacttttttcaaagtgtttaccatttaaaattcccttttaaagcattggcacagaattttcccaatgggttggtgagcatcaaaagtcggacattgacttacccgacaattttaattgaacgaaatcgcataaatgtgcaggttgagagtcggattgacgcatttgcaaatgtaatcgaattattaatttaaaattaatgttagaaaatattttagtattccgatcataacagacgctttttgaccgccacaatgcgtgcaaaattacagctgcagaacacaacatttgtgaattatgtattcagtgccgagttgagcattgacacattcgacataacaaatgttgtaagtttaggtcagtttcaaggaaatgatgaaaaattcaaagataattaaattaaataaattgttaattttaacttccaaaaacagtggatgggatcgatgcgggatcaattgaattcctggtaaatgcactcaatgagctgatcattgctgacgacatgcggcataaacttaaagaaggtacacacatgaaatattaaatttaagattataataaataatcaatgcctaatttcggccattaattaattatttaattaattagtcaaatcaatcaattccaattaactattccatttgcaggcgttcgtttgcccgttctgctcgacttcgaacagtttggcccgggtgatgttcacctcgaggacggctccctggtgctcagtgccgacctgtgctttgacgaactgtgcaaaaggacacccgcaaatgaattgggaaaacaatcgcgcgaaaatgggggcaacacaatgtccaacgtggacatggacgcgaattactacgacagtgttaaagggagaatgaattagcaaaaaagaatgacgaaaatggaa

SEQ ID NO: 313 - DNA, 1855 bp, Heterodera glycines
tttttataagctattgctttgcgattagacaattatcattacagttatgcatgaaaattgcgaaaagtcgaaatttttgaagttttttcttaataaaatttttacaggcttgaaaaacttttcgtttttgataaggctaatagagcatgttaagagctttcgaatgataccaagattgttggatttggatgccaaagaaaaaagcttaagtggaaaaacgagctggcgccgaaacgggagcgccgaaacgggagcgccgaaacgggagcgccgaaacgcgtgggtccctccaattacccctccccgcccaatttatcactaaattcaaaaagactatttaaattagaaatgagcagcgaaccatcatcacttataagcattgaattaataacccaagccaattggaccatctcaaaatctgcttaatttgccatgaacaaaaaattcatcaacgcacttttccatcaacaaatgttcaaaaatggtaaggaaattggggaaaaaacgcttaattagggacaattcaattttggcataatcgcgggtataaactcaaaaaaggctacaattgtcgggggcggggttcgctctcaatctgtgcccgatttgtcgactgtcggtccctttcaagcagttcttcttccgttccgccacttcgctgctttgactgccacgcaaacgcacattgatcccgttcctttgtcctttcttcgccaatccgaagatgaaagcgaacagaagacgatgattatgccaaaatggaaggaggagggactgaaaattgagaggaactgctcaaatcgcatttttcaaaccattgccaaagacgtaaaattgttgactaattgatcaacatcatttattaatcaatggctaatgacagaatgacatattaattagtcattcattaattaataatgggaaaaagagtctgtccaatattgtttagattgtcgacgagtgcgggttggacaattccgcccaggactacgctttgtgggtcaaagcattcggctccaacttcagcatgttttttgcacttgaccaaaatcggcatccgatgggctctgttagcattgcactgtatccgcaggtggcacaatggagcatgttctttgtgaaggaccgcttccgtggtcaccggctcggaagtacgctcactcgacggtccatggaattgcccgggagccgacccgttttctgttacggaggtcggaatgcgcatatttttgatcagatttgatataattctttaccttaatccaattaattcactacactgccaatgatctgaccaatcgattaatggttgactgacgctaatttgatttgtttttcagcggccgatatgtggttcaaatacgcggaggactacggactgaatcatttgttggactggcgcctttggtcaatgcacgccaattgcgcggatgtgcgtccagaacggttggactacgactcgagcgtggagctgaaggagtggagcgaagtgtccttcgaccaattgttgagttttgaccgtctgcagacggtgggcgtcgatcggacggcgtatttgcaggcggcgcttcgactgccccaaagcgtcgcaaaggtatggccgcccttttgaagaatttggtgtttaagcattgctaattacattatttgattttgccgtttaggtggccgtgagcaaagagacaaaagaagtcgttggaatgtgccaggcgcgcaaattgctgaaccgccgcattggcatcagtcttttttatgccgacagaccggtcagttagggtggttgatgccctttctctgtctttcgtctcactttttctcttctctctctcgtccctctttcctcttctttatcaat

SEQ ID NO: 314 - DNA, 1964 bp, Heterodera glycines
tctcattttcctctctcgccccctttctcttcctctcttctttatctttgtctctatcttatcttttccctcactctcttcctcttgtatctctctctctctctctacaaattcgatccgccttattcagtccattgcttctgcccttcttcgcgatgtactgcttcaatttgccggccccaatccgtccgcccatttcgaatcgctcctctacaaaaccccgtccaacaacactgagtccctccgcctcttccgtcagctcactcagaatggccaagtcgatcggcaagtgttcaccccgcagttctctcgctatgcactgccttttcctggaaaacgcattttttcgatcagtgatcaacacgtgtctctcgtctgatcaattcttgaggacatatagtggatggaaaaggccaagagattcgacacacacacaaaatgatccatttcattctttttgttcattatttatgcatttgactaaattttactttgaaaatatttacactttttatatatcttaaaattccatttttaattatctatttgaataaacaattgaaccaaactgaatttaaaaaaatcccccttctcgaagccgcgccttggttttgagactcgaaaccaaaatcaagaccatacatacgtgtcgtcacattgacggtcccagggtttcggcttgggtgggggtacccctcacgggcgacgttcgtgtcttttctgtgcttaccaattagcgtgcctttctttttttaattgatttgtacaaattggaaaaataataaacaaataaatgattaagtgaatggattttcaatgattgtccttagaattcaaacgttcaagttgctctctgtcctcgaccgttgattttaattccattttcaattctttgaatttttcggctatttcttccgcatttattctatgaaaatcaattcgccttttgccgtctttgtccttgtgattgtactttacaaaatcgcttttaatttttaagtcaaaatttttcaaatttttacgcatattttctctgctctcataactttgaattccaatcagccaaaaaatacaaaaattgggccttagcaatttaaattccataattaattatttgttttttaattaaatttaccggaatgaaagtgcgttttgcgaaaatgaggactcataaagcgtacatttctcctggtaaatgccattgtacagctgagtctccgttttgccatttcctttttggtcaatgtcaaaaacaatttgcagccgaattcggccggaaacaaatcgacaaaaatattcaccgttctcaatttgttcagatgcgcaatttaccaaaataaatgtcttatactgaaaatacttgattttaatttttttaaattacattaaaaatactaatatgtagggcttccttttttaggcacaaaaaatcgcgaaataggcacctaaaaaggcattaaaaatcgcaaaataggcattaaataggcacaaaaataggcaaaaacatttttttataacgctttttaggtagtaaacacgtaaaaacttaaatatttcaattgtaaatgaaattattaaatagttgaaagttttttttcgaataaagacaatttttaaaccctaaaaatttttattaagaaaaaaaaaattaaatttcgggatcagttttttgaaagttttttttcaattcttaggggtatattttctgaaatttttttgggtcatttcttaggggtgtgtttttcgtttttattgcattttttgttaattttttcaaaaatcctaaaataggcactttaggcacaaaaactctgaaataggcaaaaataggcattataaaagtcatcgtagacaccccaaaccaagcggaaaaggcgtttttcgtgcttatctttgcgtatcaatttcgcaaaattttaggcatttgactaaaaaggaagccctactaatatgtaatctgccga

SEQ ID NO: 315 - DNA, 12142 bp, Heterodera glycines
  misc_feature (3633)..(3633): n is a, c, g, or t
ccattcgacccccccccccccccccgacaaataaaacttttttactaacttagaaagttttttattggggtgttgtataagttctgtcaccccgaccaaaaatttcattcaaaaatttataaaaaatcaaataataactcaaaattaatcaaaatatgcaccattattctcgaccatcttctcccatttttgagattttaaaaatgatctgtcgattaaattcaagatagttagactcaaataaactgatcggtctacttaaaaaagtggccaaattcaaccactgatttcttggccaagaaaaggctaaaggtacaaaacaaattatggttttgtagagcaaagttgggactatctgacaagctgaaaaagagccaccaagaccgacgggttatttttttaaagttgtcctgtctgaaatgggtgctcaaaagtgccaagattcagcacccactttgtacaacattggttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaattcagagatcaaatctgaggccagatttggattctccggacttgatttggccacaaaaactgcttttaataaatttccaactgatcaaagcaaagttttgacccgtacaataaaagtgatcgaatttgtaatttggggacatccattggaaaatttttttaaaaatcaatttgaatggggaagaacgaaaaatggcttttaaccgaagcaaaaatgtctgctctttcctataggacagaaattgatcggctgtcacttgcggttaacggtgcaaaaaattccgattagcatagcataagaagggtgacagaacttatacaacaccccaataaaagtcatcgtagacaccccaaaccaagcggaaaaggcgtttttcgtgagttatctttgcgtatcaatttcgcaaaattttaggcatttgactaaaaaggaagccctactaatatgtaatctgccgataaaaaaattaataaatattcggacaaaacaattgccttttctgtgaacggagtcgcttttgtcaataactcatacaaattttcttcattcataactttaattttgtttaacgcttaaatttccaattttgaaagctttcacttttttatagtaataaaaatttttataaaaataattcgataattttttgcaaataaaaataatggtcaaaaacattaccgattttcatctcacgccgaataactcttgctgcagaatgtgtcaaatgccatgccacattttgttccggaaacattggcgtataaacgggcatttcttgctcatccggcttcctaacaaaaaacaggtcccaattttcattgacatcaaaattttcttccaattttaattttgcgagttgcacaggcacacgaattggcctcaaatttaaaatttcaattataaaacgagaaattcatcaaaatttgttaatttaatttattcagatttaatagaattgcttatgattaaggcatccaattatatggaaatccattttttttcctggactgtgggaggcctgaaacgcacgaaaaacatttttttagcttgttttgaagcttctaggacgtatttacatatgcatattttgcatatttgtgcatatttcgcgatttatgtgcatatttgtgcatattttggcatttcgtgcatattttatatacatattttagcattttttcaataaatcctctattaaaacggccctctattaaagcggccatttgggcctctaatgaccgaaaatttttcaaaaatatcatttttgggtattttctaataaaaaagtcacttttgaaaaaattggaaatttatgccaaaaatagtcagaaaatagaaaattctccattttttaaccaattttcttcaaaataaataaattttacttttattttgtatttttggtttcataaatgattactcatactatatttagctattttcgagattttatgcttaaatttaacaaatttgaagaaatttcaaaattttgctattaaaatttatgtgcatatttttcattttttatgtccatattttgcaatttttggtgcatattttatgcgcatattttacgattttatgtgcatataattggatgccctacttatgatttaattattttacctcaataaatagaaaataaagaatctctcaattaaaaatggtaatgatgcgcttgggtaaagcaaaattacttttgctgccattatggccaacattggcccattcaaaaagccataagcagtcgaataaatgtgattttctaaatttaagttttttaacttataaatatcacttattttgttaccttttgcccatattttcatgaataaaaccaatgcttgaaattttttggcctttttattttgaaatttttccaccttaaatttattttctgacaatggaatggcacaatttgcatgattttcttggaataaatttgccaagtaaaaaatggagcgataacctaaaatatcaaaatttgtattaaaaaaagataaattttcacttgacaatgcccgcagcatatttttgtgcgcaaaatttctctccgatttgaaattgttaatgtatttgccaatttggtcgtcacttagcacaaatggcaaaattcttttggcaggaattgaaacaaatgtcaaatcgaaatcgatgccattcagaagaaatctgatcagaaacactttcccgaacggagttttgatcaagtttttcacgcctttattctgaaaattagtcaataaggatcaatgaaccattaaggatttaatttatcctctaaaattacttgacaaaatttgcaaaacaatgaatcgttttgttccgttgtgcactcatttttcttgcaaaaaacgttttcttcgccgaaaaaattggccaattttatgatttttcccggggcaatacaaatcaaatcgatgtccgaagaaaatgtgcgagtgccaagcaataaagagcccgaaatgtaaagttgggctgcgccattcgacttaatggaatttttgtacatcaattaattatactcattattttggctttaagttgtatgcactaaaaaatgtcatagtatacgcataaaatatgcactaaaatcactaatatgccctaaaaagccgaaaaatgtctaggtatgcactaaaatctgcattaaaaactgccaacattttatttgaaccctcaaaaaatgactaaaattgtgtaaaattcagaattgactttaaaacatcaaaaatggctatggaacgctttttttagacaattacaaaaattttggtatattttaaatttttttattatatgctaaaacaaaattacatttttaatataaattacatttttaatataaattacatttttaatataaattacatttttaatataaattacatttttaatataaattacatttttaatataaattacatttttcttgtgaaaatttccaaaaaatggtgaatatgctctaaaaatgcaaaaatggcaaatattattctcgaaaatccncaaaatatgcttttatatgcactaaaaacctctccaccaaatcaaagaaaaatttaacgtagaaatgctatttttgagcccctttcttcatagcatatgcgcagaaatacaatttctaaccctactcattactcatcctctttttcacattgtgaatttaattgagaatattcgaattcacccattcctcaacgatccgatgaatttggctcaatccgtcccatatcggcccattaatttctgtgccgtcggcggatgaatttttgccaatgttttcaaacagatatttttgcaacttaatttatttgtaatggtaagaaaaaacagtcagaaagtctttttacattttctttcattttatgatcgcctaaaaatgtctgctgggaaatgtaaggaaaagcggggaaaatgtgctcattttgttggtctttgctcaagtgtttacgatataatgagatatctaaacagacaaaattaagaataattagaattaatggtcttagcccctaaggcatcgacgaaatgccaagccaacgaattccgattcaaaaacaaatatattcttttcataatcgaatataaaatattttttcatcacttgcctaattcggtttgttctgccattcttttccattcaaatttcactttttcgaagcgttctgcgccgaaacgttcgcccaataaataaaataatttctcttttttcgttttattctcataatttttccatttttcattaaattcattgtttttcaaaagtgccattgacaaatttttcaaatgaatttgcacttttatttgctttgttatttcgtcgggctcaaattgttttgtgttttgcaaattgtttaaaaacaattgcataaatttggatacttttttctccattttctccaattttggcacttccaatttaccaaattgctccaaaaatgtgtcccattcatttcttaattgtcccatgctcttttgcggattgcccgtgtgattaaatctttccaattcgcccatcgcttttaaacgatgtccaatttcatttaaaaatgccccaacatcgattatccgttgcatttcgatggaaggctttgccacaaattcttcatatttggcataaaggaatgcgtcattataaaaatctgaattaaaatttacaaaatttattagcaattttctgtttaaaaataaattaaattaatacataattatttaatattattattattagggctcgaaattgtatggattaacatttttttttctgcgcatatgctacgaagaaaggcgctcaaaaatagaatttctgcgttaaaattttttgatttggtgaaggtttttagtccatataaatccatattttgggggttttcgggaataaatccatatttcgccattttttcttttttagtccatatttcggccatttttggaaattttcacaagaaaaatgcaaaaaagagaaaaatacacccctaaagattgactttttaaaattttttagaaaatacacaccaaaaaaatattttttcgaaattttggcaaattttttaggtattttgttcgttacctaaaattttcgctgacaacagaatgagattattacataaattttgagatgtatttggttaaaaattgtaaaggaagaatttgattaaaaaaaatttgcattttttagctttaaatcaatttttggtaatttagtgtattttctaagtttgtttaagcaaatattgaatatttttggaatttttgagggtttaaaacacacattttgacagtttttagtccatatttcaggcatttttagtccatattttatgtccatatttggggtttttagtccatataatttcgagccctaattattatattatattttaccgttaatagaatgaattttggccaattcttcggccaaattgtgtttgatcagttttcttctcgcgttatattccgtaatgtcccttcgcttttccacggcttttcctcctaagcttttgccactttctttacaatttttctcatctgaattttgcttttctttcttttccttttgtccaaattggccattttctccttcattttccccatttatttgctttttctccattttctcatttaatttattattttcttcctccttttttgttttctttttctccttttttctccgttttttctcttcttttttcgcctttttgttttcattattttcattttgtcctttttcatttccatttaaaattgtttttttattttcaattgcttcataaaatctttttaaatcattttccgtcagaaagtcgctcattttttgttgattgtttttgtttaattcatctaaacatttaatatttatttaatttttaatttaattttatttttaatttaccttccaacattctctcaagctcctccttctcgcttccatcttcttcctcttttctgttcaacaattccataaattcggcaaaatgtaatttctgaatgatcggaattggctcttcgtacttttttcgttcttcttccgtttgtgcaacaacattttgcgcattgtctgctactttcttgataagtctgctcagtttgccccattctttgtttatttcggtcagatttaacattttatttctgctttcatccacaaatgttttaatcgctaaattcatttggattttaaggcagaaatgccatttgttggatttttaaatgattttagctgattaaaatgccacaaacctggcaatgcgaagctaaaaattcgcattgcgtcttccatttccgctgcgatacaataagcatcgtaaagaagtcggaaatacaggtgcaaatcgtccattaatttttgcacttttgtgcactgattgtgccggtccatctccaaccaattcatccacacgaaaacatcggcaccaaagcgttcggccaatcgcatttccgaagcattgggagcgaattggtcgtcgagcagcaaaaagcgacggtaatggttcagcagatgaagtttatttgtgaaaactaaatttagcagaattattctcaatcatcgcaaaatttattcttattttttcaaatgataaatttctcattttttgaatctttttcaatttaatttaatttttatttatattttctttcatttatttctctgtttgtttacaatttctgttcagcaatttgttccgtatcttcggcatttcccacattcgctgaattgcgttttttccgcccaccaaaagtctcatccgatacaatgcgccgtgcttttctcgcaaaatttgcataaattcgtctttttctttagcattttcaataaatgccgccaaataattgaaatgttccgcccccaacactttcatttgttttcggttaatttcactaatttccatttgaaaacatttgcgggggaattgccaaaattgatgctcatttgtcagctgtttctccaaaaagtcaatgaaatgcatcagaggacagagcatccgaattggggccgactttcccgcaaaaatttcaatcaactaaaataatttgggaatttaaagcgatcagtgcgaaggaattgccaaaatcaaagtgattttagtgattgcctttagcaggacacatgtttccgctttggccacataattgtccctaattatcattgtgaatttgtcaatttccgaattttgttctccgcttttcaataattctttgcctatttcgatgttttttatcactttattttccttgcgacttgaacacagtgagagcagcttaatgaggacagcaattttgtcctcatcttccagcgatgcctcgtcgaaattgttggactcaatcaaatgttttatgtaaaattcgagcagttccttttgcccaatgcctacaaaagtaaaaaaataacagtaaaatgaaaaaaaatatcttaaaaaagcgaaattattatttaattaccgtcgtaatcgataatttttgtgaaatttatgccattcaaagcgacgtgtttcagaaaatcgtggaaatgggtgaacagcacatgcacaactcgcatgtgaatttggccttgggtcgtcggactttttaaatgggaaattatcatttggccaatgcgcggctcttcacactttgtcttcacccaaaggttgttgtcatgtttgatcagctgtacctaaaatgcgccgatttggtcaatattaatttgcttgtgtccattcttctccagtttgaccattttgccacttacggacggatttttaattttttgatgaaaatccgggagaaatgccgaatttttacattccaaatctgatcatatttctatgaaaatatttgaccaaacattcactggtcatctcggtaccgtacccattcccaaccgtaattcaatgggattatggtaaagtttcgctcgccttttcgtttatggcactcagaaagtccgtctctctgccgaacccttctataaatattgcccattcgtcgttctcgcgcagtgttccgttgtccatcagatgcacaatgaaactgatcatttggcacaattgcacttcgctcccatttgccccgcctcccctctcaaaaaagcccatttccgtcgcttcgatgcccaatttaattgccattcgcgtgaatttgggattgtttttgtcctttaataagtcgagcacttcaagcagtctttgcacccacaatttgaattgcaaatgcgccgctttgataagaaacgactgtttgacggtgtcggaaattgtgcagtttttgacgaaaaaaattttgttataggcaaaagtcagcgcactgccctcttccaaatccactaaacaaaacgtcaaattaagctaattgcattttaattgggctaattacggtccgtttcccatgcttttttgccgacttttctttcgcccatttgcgcgccttttgcccctttctgctgttcggtcgtgccattttcttcgtttccgtcacttcgttcttttgacattgatgatttatcacattctaataattcttcgtttcttcccaataaattgcacatcctttctttatcaatttgaatttcttaaaacaaattattaaatcgctttgaaattgcttaaattgggattaaaaattacgcaatcacccattcattccatcccttttcaatttgtccaaaaaataaaccatattttaattgccaattttcaaagcaaaagcttagaattcttttttgaattttctatgtttgaatatttattacgatctatgcattgcttgaaagtgaactttcttttctaaatttcgacttgcctctcaactgattttggaattctttttctgcgcaaagttttttcaaaatttcgacgtggcctttggcaagtgaatgttttagctcaggaaataaattgcttgaattttttaattgtgtaattaggtttccctgcaattgctcaatttctttgaccgaattaattacactaatcgagtccatcgacaattccattgtgcccatattttggtcgatcaattccgtttgaaatgacaaattgtttgggtcgttcaattggtttttgaaactaaaatatttaaaatttgtactaaaaaagactaaacggtatgttgttacatctgataatgtgccaaaatgtccatcataaatttggcacgggtccactcaatttgttcacttttttcgtttaaatattttaaataattcctattttggagtttcttaatttgctcatctgtcagttctgaattaattcacttttataattttttaattagttttatatcaattttaattaattattactttttttttctttttaaactaactgtttcgaagcatttgtgtcaattttgggtatttttgctccatttttgccatcacttccaccgaattcggtgagcactttttgttgtcatttccaattaaattttttgccgaataaaagtcgcacagtttggccaaggctcccttctccgtttccaacgagtttttcaataatttgctaaatgcgttcgtttccccacttaaattggccattaattcgctgtgtgtgtccagcaaattgcttcgaactttgtccaaaatgtcatcacaaattcggcttttgccctttttcgatgcttttttcttcagttttccgcttttgttttcgatgcctttttccttttcgtttttttccccaattttagcggaaaattcgaatattttctcgaaggtttctttctcctcataatgaataaatgtttgggtcatttgcactaattcgcctccatcccaaaagtgaacgattcggcatttttccatttcatttttggaaatttttgcgtccaaaattttgttccaaattttactaaagtaaatgcgaatggacaaccgaaattcggcctgttttgcaatttggcgatccgtagaaagaatcatggcgtattctgtggcatattcttcgtcaaaaattgtatctgaaaaagttaaaattaaatgaaaattaaaattaaatgaaaaataaaaaattataaatatttttagtttatttcttctcaccaatttgcaattcaattggcctcaaaacttctaatatgctcaaataaatgggtccaattaattcttttattttccatttcaattttttgagcaaaacgacactttgtttgtcctcttttatgcgcagaattcgaaattgataggaaaaattagtttcattttcaatttttgtgtcattgaaaaactttgaaaattccctgtaattaaatcaattaaactcaattaatccaatgtttcttgattgtttatttgaatttggttattctgtattaccataatttgtattggccaacttgtccaatttctggcgcttttcccacttcgtttttccggtccaataagaaaaggatggcattgaaatgcaattgtcgcaaatcgtttaaaaaaatatttgtcgcatttttctcatctgtcaatggcacattttggaaaacattttctgcaattttatggcaatcaatttcatttatatcaatctttttgtacaacttgataaaccgttccatttcatcgttttgcatcattttattttccactgaaaaaagaaacaaaaattatgtaattttttaaaattattttttgcttttttatcactagggctaatatttttaggttctaaaaacccccaaaataggcactaaaaatgtaaaataggcactaaaaagtctcaaatttaggggtgtaaaatgacaaatttattcaaaaagctacaaaactaagccaaatcaatattgagataaataatttttaaaatcaaaattttttgtcaaataaaaaaattagattttggcgatcaattttttgagaaaatttttcatttctttgggatgtatttttgaaaatcttagggtcattctaagttgtgtattgttcgtttttattgcattttcctaataattttgggcaaatgccaaaatagttttttttcaaaattttttaggccttttaggctctaaaaataacctataaaattggctctaataactcgaaaagtagcataacacaaccccgcaacaaaaaaaaaacaaacaactttttttcgtgcgttttttatcacaaaccaaaaaatttgcccaaaccgcgccaaaactgccacagaatgcaagtttcatactgggaaattttgctaaaagatgaaattgcgctgaagagttcttcaaaggccttctgttctttttctataattttttgctcattttctgttactttaattgaagtcattatatttttgatatttgcatataaaatacaaaattccaaatttgttttcaaatttttgtccaattgttcatcaattaacattctttccatgctttcagacggcaaatttagcaattttgagtacagatcgtcaaaatgctcaaaaacatcttctaaatatggtgacaaattattgttatttttgaagatcggcaaaaaaagcgatttaagcaaataaaacagtcaaaaatgccaaaaaaaagtgtcaaaaggtgctacagaatgagaatgaattgcgatcctgttcagataaacgtttatcaaaagtacaaaagattccctatcatttcgtcactgagacataatttttaaaaatattgactaattcaataattaattagtttaaaattctctaaaaattattcctgagtaatagtacttactaccggtggttgccccttttttcgaaattttttttgaggttttaaaaaatcgaaaaatgagtttataaggttttcaaggtcgctgataacgaatttgagtgttgtcctaaatcatattgctctgagatatcgatggggattttctgctgctgctttctgttctaattcttcaaaaaattgatgtaaattgttgtcttgatcaacatagagagatttacgcttaagacctttccctctaatgccatttgctggcgctttttcatactcagcaacgaaatattacaatcgctgaaattctttaagcatcccttttaacatatgttttgatgtgatccctaaaagctctgtt

SEQ ID NO: 316 - DNA, 2888 bp, Heterodera glycines
agaaagcaaatggcaattatataaaaattataaacaaaaaaattttcaacatttaactaatattttttaaaaattatgtctcagtgacgaaacgatcagtgacgaagtgatcggccaccgtacaaaattcccaagttttttttttgcattttcttaagaattttaaaacctattcacgaaaaagaatagatgctgcataatttaaggtacaaaaaataaaacaaaactattctaagaaatagattttcaatcttctctaatcatgaattaattttacgaaaaaaggataaaactaatgcggacagaagtcacagatgaataatgccgaaaatttaccaaattccacagggcgcacatttttcagaagcagaataatattaataataataaagtaaaagttgcacaatcgcatttagaatcagtttatatgctgaaaaatttgagaacggaaaaatatcaaatttaaaatgcatttagtgaataattataaataattataattaaattaaattaaatcaaatgaatgaaatggctttttgaatgaatttattaatcctttgctttattggcatatcatattgtaaataactcaactgcgatttttgtttcacataattttggatttcctttcaatcgaaggcatttaatatgaaaaaatgtaaataaaaacctagcaaattaataatgccggcggatgctttcaccttccggcctaacaaataagctgccctaattatcgattcgattgaaatgccaatttattttttgtatttcttagtttgatttggctgatgaaattgcattttattttgaatcactttttattcatttgtaattcctcacattttgttgttttatgtttatttcttcgactgaaggcattcgcgcgtttcgcctgggaaatgcccggacaaattcagaattcccgcgtcgaacattttttccgctttgtctgagtccgttaggcgagaaatgaactcatcgccgatttcgatgtcaatgcggcgaaggcactcctaaagcaattttatttaaaattaattaattaattgctaaatcgttttaaattaattaaattaaaatcacaaaaaaaagaattggactttcgcttcgtcctcgcaattgtggtaaatgctcagtctcaggtcgatgtcgctcacttccgtttccgaaccgttcacctcaaatttgccctcctcatctgtctccgtttcgcccatcaaatcgtcggggtcaactttaaaaaggaacaaaaagcattttttatttctttcttagtttggcaatgcgtgtttccgctgctgatcacaaatcggctgatcactttgctgatcacttacgcgtgtctttgtcccacagtttcactttggcccctttgtatggctttcctccgcacaataatttgcccttggccgccccgttttgcttcgtcccgccaaagtcaatgccaaaaacacaaagtgaaaaagcggcgattaacaacaaaaacagtttatttgcaaacatttgtcttaatgagaataaagaaaattttaaaaaattaataatttctttaattttgcaattttactaaaataaacaaatgaaaaatctctcataaaaaattaaactaatgagggcattctcaaaacacatgtttcttttattcattttaataaattaattcaagtgcctttttctttgatttatttgaaggacacaattaaataataattcaatcaattaatgtggcgatggatgcgcgggaggaggaaaatggaaaataagaatgataggggaagaatggttgttgttgttctaaacgaatgacggaacaggtttaacttttgaacaatggaaaaatataagagaattcaagggactgatgagtgtccgtttttgaataatttaaaaaaactgaaatagaaaaaagttcttcagaaactttttgggaaaattttcgaccatgtttcaaaaaagagtctgtagcgggccggagagtaccgaaacccggcagtgtttgatggagaaagagcacaccttcagactctggcgattttagtgagctatcttgggtctttatagcttgggcctgaattgccttatacgtgacagatgaattcgaaaaattcgacagtttttcgccctgcatgtcggaatccggctctgagatacgcagggattatggcggattcgggaaagctaacataatagcaattctttgctatatgtttaaagactatctaggttaaaattccggactcgagttctgtatttggcatttttgtaccgaaacacccaatttttttgcaactttggtgtcgttctcgctccgcgagtgcggcagtgtttgggtccggctcaagtgaatgccatcgaatgttttgcacgatgaggagtggcgcttgttgtgttaaaattgcttatttttgtgccaaatctcttaacaaatggcataaaactttcaaaaatcatccggcggcgcctgtcgacatcgcctaccaaaattaatttatcattagggcggagaattatattgatataaaatcgcaaaatatggccataaatatggaccaaaagtcgcgaaatatggacataaaatggcaaaaataaggacataaatttttccaaattgagggtataatttcccaaaatttcttcaaattcgctatacgcgaagtaaagctttcaaaaatggctacatattgtattaaaaatcattttagaagaaaaaaaacacgataaaactaaaatttactaatttttagcgcataatcaaccgcaaaagcgaaattttcgcttttttgcttatttttgacataaatttattaatttctaagaaaatttaaatttattcaatattctcgagaaaatttggcgaaaaaatgatttttttttaaattttccgg

SEQ ID NO: 317 - DNA, 1069 bp, Heterodera glycines
  misc_feature (985)..(985): n is a, c, g, or t
ttctgctcctggcaattttcactgtgacgaaacaaaagcatccaccgaatcgaatcgaaaggattgctaaagcactgaatggtgtaaaagttgaaatttcctttgacgcaacaattaattttggccaaaatgggccatcaaattctgacggagtcaaacacgacgaataaaacccaagcagcagcgccgacgacgggatgttcattgaatggggtggaccttcaggcggaggattccaaaggatgtgtgccgaatggcccgacttggcccccatttattgctacggcaaaatcattgagatgccgagcaatttggtcccaattaatcataatggcatcaaaattcattaattcattacgatgttgagagcgaattaaggcggacgcatttattacgacaaacgctcacagccgtccttcttcacattgtctgacaaacaaacccttgctaattgcatttcctaattattacttccccactttagcatggtctacgattatttcttggccacaaatgacaccaaatttctccacgaagtgttgccagtgcttgaaaaggtcagtgcaataactaatcaacgccataattacttcctgataagccaaatccgaattttccttaaggaacttggccatggagcaaaaatcggtcggttgaagtcgaagttggcggaaagcagcgtacattttaccaacgtatggtacgacttgaacattaaaagtggaaagcttcacgaggagtactacggtagtaatggaaaaacccaagggcttcgtaacttgattaatgatacaaaaaacctttccgatcaaaaaatttaaataaaaatcatttacaaaaagcgaggataacatggatagagagtagttcatccatcaataacaacaacccaataaaagaatatacaaagtgcggaaaaagttgtgcaactcgcttttccatggagaatcccagttcaaaataaaaagaaaaccacataggtaancttgataatttcattcaaaaggaacttatttcaaatgttcaattagcctcccatgggctgaggatacattcgtccaaacgcttc

SEQ ID NO: 318 - DNA, 2907 bp, Heterodera glycines
  misc_feature (2896)..(2897): n is a, c, g, or t
caatggaaaagcgacttgcaaacttttgccgcacactctgtaggaaaataggaataaagtgatcaccactgatcaatcttgatttatcatcacaggctttcggtttcggttacggtaacagtgtgaccatgaaatacgagacgctttcgctcaattcattttgcatttataacacaaaattaaaaagaaattgaattgggcgaaaacgaattgattgagcagaactccattagaggttggaaaatagtgttggacgcttcgtaaaagtgccacaattggtcgaccataatgtccgacccagcagaaatttaaattcttggtatcattcgaaaagttctctaggagccttggaactacaagaaactttccttaatttcaacaaaaaccaaattgggtccaacatggagttgacctggattttctggacaaaaatccaggttgccgaaaaaatatctcgatgtcaagttcggactttatgcccatttggcggatttacgaaccgtccctggcaccctgcgtcgccctcacacaattgggaggaatggcgaattcaaaaatcccaaaaatttgtttcggtatttcttccacttttgctcgtccgtttcttcttccatttcgaccttctccttctccgcattttccttcgtatttttgaacattaagctcattttcacctcaaaaagtttccgaattttcacttccgaatttttctgaaaattattttgaaaatatttcaactgtttttcgttcagcaaaattggcttcgtttccaattgggaaaagcctttcaatttgtaactttcagtccgtttgaaattctcgtcaaaataaaacattgaaatgcgaattaaatgttcgatttcgtcaagcacgggttccagcaattcgtcgtattgaaattttggcttaaccgcgggcatttgttgacttacggttttgtcactggctgttcaattttaaaaaagaaaaataatttttttctataaataaatatatatatatatatatatatatatatatatagtgatcattagggagtccaaaaatatgaatataaaatcgcgaaatatggccaaaaatatggacataaaatggcaaaaattgcgaaaatggacataaatggcaaaaatgtcaaaatatggacataaatttttcaaaattgagtgcaaaatttcttcaaatttgttggttgaaattgcatatgagatacatttccaaattttttgactcggtaaggcgctttgacaaagacggctttcgttttgcaattagtcggtcaacattcggaaattggtctcgaattttttcggcaattacgtgcaatcattttaaaagaaaaaaaaacataaaagctaaaatttattaatttttttagcgcaaaatcaacaacaaaagcgaaattttcgcttttttgcttatttttgacataaatttattaatttttaagaaaatttaaatttattcaatattctcgagaaattttggcgaaaaaatgatttttttgaaaaatttttcgggttgtgggctcaaaaaggctaatttagctgctggggccgttctaatagatgtttttttgacaaatgccaaaatatggacatacaatatggaccaaaatgccaaaatatgcaaaatatggatatataaatccttcctacaagcttcaaaccaagctaaaaacatgtttttcgtgcgtttcaggccctcaacagtccaggaaaaaaatatggatttccatataattggactccctagtgatcattattgatttaatctcactgctggtgagaaaatacggtagaggaaaatgcatgagagatcgaaagagagttttactatagtaaaattttctgaaaacttttaattgttaattggtttgtgaaggaacctacctgatttccaattacagtatacaattttcatatgaatttttctattcatcaaataacggaattaatgacttcagaatcagtacaaattatcaccctttatactaggactgagactccgaggtcagaattgggaaaagtcggagttggggtttgacggggtcagcaagtttggggccggggccggggttgaccaaattagtcggtaccggtgcttagagagtattttttctttgtcccataaagccaaactttcccccacgtatttatgtacatggagaaatagaaaaattgaaatgctcgtttgcattttttaacccatttacatcaattttttaatcaaaatattttttgttgagaaaaaattccgaaaatttaattgtatgcgtgcaaaaagcaaattttgtgatttcctattttgatttttctaattaaaagttcagttattcatttcaaagctgttataatttttccacattttcattaaagaaattttaaatatatttcctaataaaaatgttagaagttgtcaacggcaatagaacaaatggccaaaaaactaatattttttattaaatcagaacattgttggcatataatttatttttcggcacttccttccctcccgttaccttcgacgtacactctgaacagatattcgtacacaatgtccaaatgtcggcggaatgtttggcactttgcccggtcctccccctgcacttcctccacaacattggcacagttccaattttgccacaataaatggaccgcgcttagccgtgccgcaaatttttgtgccaaatgttcccgtaattggtcaaatgtcaaatttttcaattcacttctgtactgcaccatttttttcttgatgctttcgtccgttttctcgtaaaatttgtcaaagtttggccgacccttcacaaaggcaaggaatgcttcttcttcaaaccaacacaactgctccactctctcctaaaaaattatttatttatttttatgatttcaacgannatgacctgca

SEQ ID NO: 319 - DNA, 2210 bp, Heterodera glycines
  misc_feature (2086)..(2086): n is a, c, g, or t
  misc_feature (2171)..(2171): n is a, c, g, or t
  misc_feature (2188)..(2188): n is a, c, g, or t
agccctttagtttctatctagttgtgggtaattttccgattaaggaaaaaaagtaagccgaaattcacttttcgcagctctgagacagatagcctagagcttcagccgcaaaagtcggctaaccgctgaaacatcttagaatttaaatagataaaaaatctcctataattcatacttttcaatttttaaaaccggcttttcaagctttacccaaaaatctgagaaaataatgacaaattcattaaaaaaaaattgagatatattaaaacgtttgattgttactttcgcaatgcttatctcctttattttattgactattttaaaaagattgctaatatccgaatataaaaatagcaacttttttaattttaagctatccaattaaactgcgcatttcttttaaattcattgcttttgctttaaactttatgatcatacatatatattacaaatggcataacagtcaaaaaataaatacggataaatataatcggcacttttttaaatacattggctgcttgctttaaattgtccattaattcgttggcattatttccatcgttttgtgccattccactgttttgcccagcactaaattcgtccactcgctgctgctgtttgctgctcagatcagcgacacgtgttcgtcgctgatcgaaaaaatgcgctggccggggaaaggcagagaatggtgcgtgaactgcggagtgagtatatgccgctgcacgggcccattttggatgagttggcggaggatgcgcaaggactcggcgttggtcgacggtgttttgtagagcagcgagtcgaacttggcggacgggtcggggccggcaaattggagcagtacggcacggagaagagaggaggcgaccgactgaaccaattgaacatatgttttagcagagaaaaaagggaaaattgggcaaatgtgcgtatgaactaattagctaattataggtaatgatattgcctaaggcagtaatgcatcattagctattaaggcactttagaggcattattagcacaacaattagataagaaaattgttgaaatttcacacactgaccgatctttcggcattgaacagactgatgccaatccttcggctcatcagatgccgtgcctgacacatgccgataacttcgcccgtctctttggatatggcaacctttgaaggaatttggcattgaaatgatagagagaatttggcatcaatgatggcacaccttcgccacagattcgggaagtcgcagtgcctctcgcaaatacatcgaccggtcgatgcccgccgtctgttgaacgtcgaaattcaacagtgtctggaagggcacttcttgccaatccttcagcaccacactcgagtcgttgtccagccgctcgggtcgcacgtcggcacttttggcgagcagtgaccacagctgccagtccaagaaatggcacatgccgtactcctccgcgtatttggcccacatttcagcaactaaagcgggttctctcaacggaatacaagcaaaaccaaatttgtcgaaatgtaatttttcttaaggagaaaataatagtacgatatgttttcctatttttgactaattatgctcaatctcgagttgaaatgagcggaaaaaaaaccccgagagaagagttttctcaagtcgagacagagagtctcgagcatttgactgtatcagaaaaatttaatacactttaaaatatttgtgaccaaaatatcgaagaaaaacaaaaatctatcgcaatcttaattttttcgatgaagcgccaatcggcaccgccgggcccaaaaattcataaatcttaaacccgagagttttctcgagtcgagaccgagagtctcaagcattgccaattaaaaaataatgcgctgcttccccacctccgtaaccgaaaatgtgtctatccccagccatttccatggctcgtcgagtgagcgcacggcccaattggtgtccccggtagcgttccttcacgtaatacatgctccaatgtgcaatttttgggtacaccgccatgcttgtggacgccatcggcaatcggtcttcgtccagggcgaagaacatgccgaaattgttgngcccaaacgcttttcgccacatggcgtagtcataggcgggagtgtcccagccgaaccgatcgacgatctgatcaaaaatgaaccnaactcagtggactgatncatgctttattttgccacctct

SEQ ID NO: 320 - DNA, 4683 bp, Heterodera glycines
atttaaaatcataaaaaattaaataatatgctattttttgaaatattttaattaaataatatgctattttttggaatattttaattaaataatattttatttttaataagcaattaatgcaatttgtgatgccggcgagtgaaaggaatcttgagaattcgaattttttgttaattgtttatcaagaaacaattaatttcttttatcaaaaattaacataaaataaaaccaacggaagactgtcaaattggaaatgtcttcaaaaaaaacaatttttgtttgacaaacttttaaattgtaataaatattatatgctaaaatggcaaattcaaattaaattaaaagaatctttctgctatattttcaacaattgctgaatcgctttaaattctaattaaattaaataggaaaagggcttttcctcatattatttacaaacgcccaccgccaagctttttgctaattttttaaaatatgtgtaattttttatttttgccgaatttcaattttaaggaaagttaattttgatgagacaattatgaatttgatgtttaattatttaaacagaataaaacaacataaaatacttgcgaattttgaaggttaaaaattaaaatatgtaaataaaaaagcatcctaaaagcatcaaaccaaactgaaaatactatttcgtatttttaggccgaaataagtatacaaaaaatatggaaatcaatccatacaaatccgggcctttctgataacatatttaattcagcagaagaattacttaaataaaaaaagacgtgaaatatagccaaaagaaagagagcatttgttttataagtttaagcttggtaagtaaagtaaacaaaatttcacttttaaccctaaaaaatcaaaaacaatttaaataatatattttttttacgttcgaaattaattactgttgaaaccgacatcttcgaaatctaacatcagatatgtataaaacttattaattttaaaatttgctcaataaaatttgtctccattttgtcgacccatttttcgcatttattttatcaatttgcactagggttcgagccccgtgggcgggggtgaattttcgcgggggcggggttggcgggggtcagagtcgcggatgcgggggcacgataattccgccccgcggggacgggggtatgccatgaattagctcccaaaaaaaaattcttgcaaaaaataagaattttaaataatgtgtttttcataattatttggtttggtcctcataattatcgttttcctcttcgtccaaatcatttgatgggcctcgattcaaaaccttttggcataaattgcattgtactactttcgttgactgtgaaatttttcaaaacaattccaaactttagaagcacaagcgtccatttttgcctgattcgaagaaaaaaatagttgtgattgaaaaatgtgttaaaataaaaaattggaaagcattttaattttgtggcataatgtaatttcaaatttagattaaaatttttgtatcatcagccaactaactatgcatcactctctcggaaaaccaatctttaggggtgtattttcacccccgcgggggcgaaggtcacgggggcgggctgaaccctaatttgcacttgtgattttggccaataaatgaaatatttaaaaaaataaaaaaacaaggtttatctgtagaatgaacttttatcgaaagaaattatacatgagaattgcatttatatgaaagtgcaactttttgttttgaaaggtcctcggcgcgcccaattaaaaatttgggctatttaaatgccccgggagggactgattagccagtcgaagcaatcacaaagccaaaattcacaacaatgagcatcattcgacgacaattcttcgccaccaaactgttctctccccaattggctagcaacaaaatgggtaaaaatgaaaatatttaagggaattaattaaagataattaaaacaaaagcatttaaggaaattaattaaaataattatttaaaaaaaacatttaaggaaattaattaaagataattaattttcatttttggtccaattttaattatttctatccgtcccttcccaagctgtgctcccagtgcgccattgcgtaagcgtcgccacgccaacacaaaatgatgtgccatacaatccgtcgcccaccaccgcgcaaactttggacaccttaggcattggcacgacggtgcagccaccggagccaaaatggcaaaaggccggactccgaattgagctaaactgtgccgacgagcaaatcttccagagcattgtccaagaggtggcaaaataaagcattgatcagtccaactgagttggttcatttttgatcagatcgtcgatcggttcggctgggacaactccgcctatgactacgccatgtggcgaaaagcgtttgggcccaacaatttcggcatgttcttcgccctggacgaagaccgagtgccgatggcgtccacaagcatggcggtgtacccaaaaattgcacattggagcatgtattacgtgaaggaacgctaccggggacaccaattgggccgtgcgctcactcgacgagccatggaaatggctggggacagactcattttcggttacggaggtggggaagcagcgcattattttttaattggcaatgcttgagactctcggtctcgactcgagaaaactctcgggtttaagatttatgaatttttgggcccggcggtgccgattggcgcttcatcgaaaaaattaagatttttgcgatagatttttgtttttcttcgatattttgtcacaaatatttttaaagtatattaaatttttatgatttagtcaaatgctcgagactctctgtctcgacttgagaaaactcttctctcggggcttttttccgctcattacgcctcaaaacaataaaatgatgattgagcataattagtcaaaaataggaaaacatatcgtactattattttctccttaaaaaaaattacatttcgacaaatttggttttgcttgtattccgttgagagaacccgctttagttgctgaaatgtgggccaaatacgcggaggagtacggcatgtgccatttcttggactggcagctgtggtcactgcttgccaaaagtgccgacgtgcgacccgagcggctggacaacgactcgagtgtggtgctgaaggattggcaagaagtgcccttccagacactgttgaatttcgacgttcaacagacggcgggcatcgaccggtcgatgtatttgcgagaggcactgcgacgtggcgaaggtgtgccatcattgatgccaaattctctctatcatttcaatgccaaattccttcaaaggttgccatatccaaagagacgggcgaagttatcggcatgtgtcaggcacggcatctgatgagccgaaggattggcatcagtctgttcaatgccgaaagatcggtcagtgtgtgaaatttcaacaattttcttatctaattgttgtgctaataatgcctctaaagtgccttaatagctaatgatgcattactgccttaggcaatatcattacctataattagctaattagttcatacgcacatttgcccaattttcccttttttctctgctaaaacatatgttcaattggttcagtcggtcgcctcctctcttctccgtgccgtactgctccaatttgccggccccgacccgtccgccaagttcgactcgctgctctacaaaacaccgtcgaccaacgccgagtcctgcgcatcctccgccaactcatccaaaatgggcccgtgcagcggcatatactcactccgcagttcacgcgccattctctgcctttccccggccagcgcattttttcgatcagcgacgaacacgtgtcgctgatctgagcagcaagcagcagcagcgagtggacgaatttagtgctgggcaaaacagtggaatggcacaaaacgatggaaataatgccaacgaattaatggacaatttaaagctagcagccaatgtatttaaaaaagtgccgattatatttatccgtatttattttttgactgttatgccattgtatatatatgtatgatcataaagtttaaagcaaaagcaatgaatttaaaagaaatgcgcagtttaattggatagcttaaaattaaaaaagttgctatttttatattcggatattagcaatctttttaaaatagtcaaaaaaataaaggagataagcattgcgaaagtaacaatcaaacgttttaatatatctcaattttttttttaatgaatttgtcattattttctcagatttttgggtaaagcttgaaaagccggttttaaaaattgaaaagtatgaattataggagattttttatctatttaaattctaagatgtttcagcggttagccgacttttgccgaccgacttttgcggctgaagctctaggctatctgtctcagagctgcgaaaagtgaatttcggcttactttttttccttaatcggaaaattacccacaactagatagaaactaaagggcttagattttgaccaggcctacctcacaataacattaaaaacaaagaatataaaaatgtatttttatatctttttcccaaaattatccaaaatttttgttccaaaaataaagagcaaaattaaaataattaggtactcatttatgtaccaagacaacataa

SEQ ID NO: 321 - DNA, 6710 bp, Heterodera glycines
  misc_feature (6659)..(6659): n is a, c, g, or t
ttgtttttcttcgatattttgtcacaaatatttttacagtatattaaatttttatgatttagtcaaatgctcgagactctctgtctcgacttgagaaaactcttctctcggggcttttttccgctcattacgcctcaaaacaataaaatgatgattgagcataattagtcaaaaataggaaaacatatcgtactattattttctccttaaaaaaaattacatttcgacaaatttggttttgcttgtattccgttgagagaacccgctttagttgctgaaatgtgggccaaatacgcggaggagtacggcatgtgccatttcttggactggcagctgtggtcactgcttgccaaaagtgccgacgtgcgacccgagcggctggacaacgattcgagtgtggtgctgaaggattggcaagaagtgcccttccagaaactgttgaatttcgacgttcaacagacggcgggcatcgaccggtcgatgtatttgcgagaggcactgcgacttcccgaatctgtggcgaaggtgtgccatcattgatgccaaattctctctatcatttcaatgccaaattccttcaaaggttgtcatatccaaagagacgggcgaagttatcggcatgtgtcaggcacggcatctgatgcgccgaaggattggcatcagtctgttctatgccgaaagatcggtcagtgtgtgaaatttcaacaattttcattatctaattgttgtgctaataatgcctcgaaagtgccttaatagctaatgatgcattactgccttaggcaatagcattacctataattagctaattagttcatacgcacatttgcccaattttcccttttttctctgctaaaacatatgttcaattggttcagtcggtcgcctcctctcttctccgtgccgtactgctccaatttgccggccccgacccgtccgccaagttcgactcgctgctctacaaaacaccgtcgaccaacgccgagtccttgcgcatcctccgccaactcatccaaaatgggcccgtgcagcggcatatactcactccgcagttcacgcaccattctctgcctttccccggccagcgcattttttcgatcagcgacgaacacgtgtcgctgatctgagcagcaagcagcagcagcagcagcgagtggacgaatttagtgctgggcaaaacagtggaatggcacaaaacgatggaaataatgccaacgaattaatggacaatttaaagctagcagccaatgtatttaaaaaagtgccgattatatttatccgtatttattttttgactgttatgccattgtatatatatgtatgatcataaagtttaaagcaaaagcaatgaatttaaaagaaatgcgcagtttaattggatagcttaaaattaaaaaagttgctatttttatattcggatattagcaatctttttaaaatagtcaataaaataaaggagataagcattgcgaaagtaacaatcaaacgttttaatatatctcaatttttttttaatgaatttgtcattattttctcagatttttgggtaaagcttgaaaagccggttttaaaaattgaaaagtatgaattataggagattttttatctatttaaattctaagatgtttcagcggttagccgacttttgcggctgaagctctaggctatctgtctcagagctgcgaaaagtgaatttcggcttactttttttccttaatcggaaaattacccacaactagatagaaactaaagggcttagattttgaccaggcctacctcacaataacattaaaaacaaacaaaaaatataaaaatgtatttttatatctttttcccaaaattatccaaaatttttgttccaaaaataaagagcaaaattaaaataattaggtactcatttatgtaccaatgacaacataattcttaaaaattcaggaatttataaaccaatgcattgcacaagttgatctcagatcactccttaagggtgttatgaagtgactaaaatttttggcaccaagtgcaattggaagacgaatttttttggaaaaactttataattttttcatattttcattcgccttatgtaaacattcaaataggatctacctttattaaatttgaattttggaactatcaaattttattgagaaatgcagtcgtctttcttttctttttttcgacagttaagccacaaatgtcggtccgcaaatctcgcactacggattcagcaattttagtttaaaacaatggtagcttgggtcaaactacaaagatcactgttgaaattcgaattatttcgagttgtaatgcatggttagtttgtccctctctctgctgatttgtgagtcacaatgtccgactgacaattggcaaactgcgctgctgctgttgttgttgttgttgatcagctgctgcttgtccttgttggcctcttcgacgtgtcaagttcgatgccgaagcaccaacgaaaacaacgttagaaacggcattttgctgtttggcgagccaaggaaaggctttttggaagcaatgacgatattcagcgctgaactttttaaaattttgggaattggcaagtaaaaatgaggtttttggcgaaagtcgaatcctcccccgcccccgctttcgttttggataacgttacgactagagctcgacattttgaaaaatggcctggacctgaacatggatttcctggacaaaaatccagaaaaatcaaggctcttctagacctctggatccaagcctggccctggattttttgaaatttgttttaaaagcaaacaaatgggaacatttaaaaatatataggtaatttacaataataatctgtttttaaatctatttaatcattttttgaaaacttgaaaaaaaacatcagtcatttgaaataataaattctaaaattttgtccaggaaatccaggttttttcgtgttttgcctggacctggatttttttttcacattagacctggacctggattttctggacaaaaatccaggtccatgaaaaacccaggttgccgaaaaatgtcctggacctggacccaggaaaaattcaggcctgtatccaggtccaggtcgagctctaattatgaccaatcccgaatttcgctgtcatatttttttggtttaaattattacactcctgggcacattttcccacctgaacacatagagaacgggtgtattgctggccgatgcgacgagagtcatctgaacaagcccagcggcaaaactgatgctgtcctccggcgacagcttcaaaagtggcatataaaaggtgctcagtccgttcagagtccagccgaacatgacgaacacaatgatgacagtgagggacttgagaatgtgcatgttgctggtcgaagtgacttagccattaaggaatgaaacaattaataatcaattattatttaatcaattatttaattagttttatttaagaataaatattatttagacaattaacaataattatttaaacaattaattaataaaaatttttattgaagccataaaaattatcatttgggtgatagaaatttcaaaaaaatttcatatcctaatatttcattaaatcaatttaacggtgatggtgattttttcgttagctgcaatgtagaacataaaaggtaactcgcccggtgggaatcgaacccacgaccccagcaatccgtgccgtgctctaaccaactgagctacgggcgttccttttagaggttctctcaggtcctttgtcccactttctcccacactccgttccttctggcatcacagcaatcaaaattttaaggatttcacctaaatttctgttttttaacgaatcaaaatgccatcatcggcgggttgtagttttttaagaaatagaagccgttcaatagtttgacctccaatcggcggaattgatgatgatttaaacaaattcccggacaaaatttaggacatttaagactaattaatcaccccattggctgttggaggtctggtagaattatttattgaaaagatgagggtattgtttttggagcgattgaatttgatgaacaattttgtcagttggtggtaatgaacttaatgcttctggcgttttcggacacgcgcttcatattcctccttgagttgttccttggtcagtgcagggcggacgaacagacgagccaggtttgttgagatcggagtcgagcacgctcacgcttccagcctccgagtgccatgtgtcggtgtaggcatgaccaccttgagcgggcgcggtgttgtgcgctgagggtcgtagcggccgaggcgaaaaacggcggttggctcagcctcaacatcaagatggtccagaattttggtggccactttcctatcctcctgtacacgttccgatggaagagcagcagcgctttccggaaggccaaggaaaaccagtgtgcggtgtcgttcttgttctgtgagtgcaacagtgtttgggtccaggtcctgtgcaggtgccattgaacgtttggcgcgaggcggagtgatgtttgttgcgtttgttcgcttcatgtcgaattagaaaataatattttttgcgatcttaatcggactatcacttaattggacaatttcttgtcgattaaaatttcggtgaagcaaaaccaaatggatttggattcaggaaacgcacccattcagagttttttgaaatcgtggttttttcgggatatattatcaaacaatacccgggttaggatatggaggatggaagcaaaaataacaaagacaagattccgtgttcaattttcgcataaaatatttctaaaaattcgtcattcttggctaattaaaaaaacagaagcctggttccattctcgacatagaatatttttaaaactgcgttatccctggctaattaaaaataaacaaattcccattttaaagaaggcgatgtaggaaataaaattttaattaataattagggctaggatctttgcggatagcatttgatgagagaagcacgaaaatcatcacattttctccaacaattttttgaattataatttttagtagcaacagtgttaactattttgggctttttgttaattgccaactcttttggcttgtgaaattttttaaaaactatttttcaactattcttgtttgagaacaaaaaattttctgatgaaaaatgtatttaaaaaataaaaattcaacctgcgaaccggcctaaaaatctttcaaaaaatacatccccctaagaattgatatcctggccatgatttggcggacaatcgaaaactttttcgcttgaaaatcttgaaattatgtttcatttacaattgtgcaaccgaaatggaaaaagaataaggcaattttggaaacatcacacatttgttggcatttttttcacgttttttggcatttttcagtttttagcaactatttagtcacatatttctcgatttttaggacctaaaaatcctcctttaataaagaatttttatataaatatttttatcttaaagcaagtaggtatatgcatttttgtacattccgatcacttttttcattcatatttttgcctttgttcaataaattgtgctgtgaattcggataaccggtgttgttgtactccttgcctcccatttggcgatgattttccatggccacaatttgttcagcgcttcacgatactcgagacttaaaaagcacaaatttttattaaaaaacaatgactttcactaatttataagtgtaattctgttttctagttgtttttttcatttatccaaaacatttttttctcgccgcttcaaattcttataaatttgttcaccccaaaattttttttattaacccaataatgtgatgaatctgttaaatttggtattttaagaataaatttttttaaaaaaccatgaagtacaataatcatgtatgtgcaattggaatatttttaaattttaaatgacatacatgaaattttttttaaaactttaaatttaaggcaattaaatttctataaataaaataaaaacagaacgccaaaagaacaaatacaaacaataaaaagtagacattttattttacccttgattttatgaaatttttttagcttataactttttcaataatagaccaaataaaaccattttatgctcattttgaagggtaaattctgaagaatatttcttaattagtcaaaagtttaaaaaaattgtttattgacaaaaaaatgaaccattattttatatgttagagacatggaaatagtgcgtcaaaatgagagaaaaagaaaaaactttgccctgggaaaaaattttttcctgtgggtaactttttttgaaattttgcataggcccatattttgaccccctctatcgaatcacagtttattttttagctgtctagtttttaactcgagatcggctcttctaattttacaagggaaaatccccaaaaaatttcaagttttgcaaagttttggcgttctgattactaaataaataataaacttgataatatttattcaaaaataaaaataaccaaaagaaggacatgtgccacttacacttttggcggaaatgaggtgaaatggaaagtagttataaaagataattgaaattttgaatggaaaagcagaaattagaaaagtcagacctccaacaaagggaaaattgttgttttttangggttgtagaagaggaaaaaaatttattatttttttttgagtaaaattttt

SEQ ID NO: 322 - DNA, 3278 bp, Heterodera glycines
gagagagagacacagagagagagagagagagacagagagagagagagagagagagacaaagggactgagagagagacggggagagagagagagagagacaaagagactgagagagagagacagagagagagagagagacaaagttagcacacgttgccgttttgacaattaattggtgacacaagaacaaatatctaaattgaaattttgagtggagaagcagaagtagaaagtcagacctccaacaaagggaattggttttttttatataagggttggagaaaaaatttttgaggaaaatttttaagaaagtttgaactaggtagtttagtaatttttaattttatttgaagaaattgttggaggtctggttgaactatttattgaaaagatgagggtattgttttttgagcgattgaatttggtgaacaattttgtcggttggtggcaatgaaattaatgtttcataacagacgaggattgttttatcgaaaacttccggcggttgggaaatatcgtcgctggcctccttctggttaggtccatcttcgacaacgggagtcggggcatttgtctgtgagcttgccggtgccattggagttggtgtcagttgacgttttcggacgcgctcttcgtatttcttcttgagctgttctttggtcagcgcagggcggacgaacagacgggccatgttctgttgagaaggagtcgagcacgctcgtgcttccatcccccgagtgccacgtgttgatgtgtagctgttggcatgaccaccttgagcggacgaggtgttgttcgctgggggtcgaaccgtccgagtcgaaagacggcggttggttcggcctcaacttcaagatggtccaagattttggtggtggcttccctgtcttcctgaacgcgctccgatgggcgaacggcattgctttccgggagaccaatgaagaccaatgtgcgttggcgttcttgctctgcgagtgcgacagtgtttgggtccaggtccagtgggggtgccatcgaacgttttgcgcgaggcggagtgatgtttgatgcgttggttcgcttcatgtcgaataattagcaagaaataaagagagagggggagagagagagaggggagagagagagaaagagagagagggggaaagtgagagaaagagagagagggggaaagaaagagaaagagagagagggggagagagagagaggggagagagaaagagagaggagatatattcattccgccgttgctaatagcacgacagacacaaacatactcagaagaacgacaatttaggaagcgaatttgatgggctgcggttgggatgcgcgaaatttggtggcgggggaaggagaaggaagaggaggaggaagaggaggaggaggggatgtgtgaagtgaagttggaaattaattggaattgttaactcgttttggggatagggaagagggaggcagtgtgtctctaatttcatccttagcgacgaaaatttaaaattttatgattcatctgtttaaaataattttacgccaaattcataacctttgtgattttaagcctttttattagtcagcattgtttacatttaaatttctgtcagcccgcctatgtaaaattgccgtatttaaaccattgtaaaatcaccatttttttatcgttcaatcgttgaaatcgttcattaataaatatatttgttcgatcaaaattcactaataaagtgtgaaatataattgaagtattgggaaatccaataaaattaatttaatttaaataaaataaatatttaaattaattcttattgactatctgaaaagagagtcaatacagtgcgcggaagagagagttgagtaaaagtagcaaaagaaggggggaggggcaacgaataatttgatgggatttggcgaggacaaaaagacagtgacaaatttatgaggaatggccatagtttggctaatgacagagactgacgactgattgatggcttggctttgacctttttatgtgatcgggtttttgttcatttgtgcgtggatggactccacaaatacgcattgtgatctgatctgatcagcggtgttagctttataagtttatcccattagatgaattgtcatgcgttgacaaaaagcgtcgttctcttcagcagaaaatcaatttctgatcgaattcgcttttccttttcaatgccaattcatgcttcttattgtgcacaagtctttgagcattatcagcagccaaagaagtgactgacaacaaacatttggaaatatttggcgattgaatttgtcgctggtgcggtcgatcattcactgccgtcgctatcatcccaaaggggggggggggggtccgtcgttctgtagcgatgaatattcttcgcctccacagcccaatctgtcgactcatattcaatcattcattgtttgcctcccttttacacattttccccatgcattcattcgtccgtcctttttacccaccgaccattttttggtgatcccatccaaaaatgagaatgaacaatcattgaaagaggatgaatgggtcagggatataacttggctattgtagaaaaaaagtcgagagaagcgaaggactgttgctggggagaagggataaagcgcggcaaaagatgaaagtgggaggggggggggagagataatggcgaaaatgggggaggggcgaaggacgcggatggaaatgcccagcaaacaatcggcagattggacttctcaaacacacgtaaagcacttccaaggcatcgtttgttgttatgcaaatacataacggcgcgttgtttcgcggtttaaaatgcgattttcgagagggcggggggcaattctcatgcttttctcttcctcttttcttcccatcactttccatgagtgtttgttgtttttgttgtcccactcattcgtcgatgactcaacaaacgcagccctaaaagcattggatcggggaaatgcttaacggtctccctcctcgcccgaccatccatccgaaggggaatgcatgtgagctccatcatcgattctgaatttaagccttattaattcgctctaatattaaaaatggacgccaccaaatggcacacttttgtcaaccaagtggccggtgaatttcccattttctgtaattaccgaattcgccttcacggcaatgttaagccacgggcccaatcacaaaggcggcgatttgtggccaagacggaaatatttgggccaaatctgacaatttcaatgagatttcaccgccctttcccttttaatatcttttgattttt

SEQ ID NO: 323 - DNA, 1553 bp, Heterodera glycines
ctttgatgctatttattttttctaactctcttggcccacacccggttttttatctaaatttaatttatgagcccaatactttatttatttatttttttgcataattattttaactaaaccaaattaattacaggaccccttaagatgaacaaaataaacaaatcaatgaagaaggggaaaagtgctgcaataaggcctaataaacaaatcaattaacggaattttcccaatttttgattttaaaggaaaaaggaacgagggttataattaaataatatttattagttaaattattataaaaaggtttaattaattaattaattattattattttattattatttaaataataacaaataattttctttttaaatttactataaattttattctaaaaataataataaatattttattttaaactagcaaacaattaataattatttattttgaatctttttattaataattaattaaatttatttattgtgaattttctcatcaaatttttctatcaggtcaaattaattccaatacccataaaaagggctaaacaaacaatcaattatgaaaggaaaagagtgtgggaagggtgccccataaagaaaacaattaatggaatttttctaattaattaaaaatatttatcaaattgttattttctcaaacaataataataataaattttatttgaaattcacaaataaaaaattataaataaataattaattattataaaattaatttaaaaaattccatggaagggtgcccaataaaaaaagcaattaacgaaattttccttgattatttaattattaagcaacaacaataataatttttatttgaaattcacaaataaataaataaaatttatttttctcattaaaatttattattttttgtaacaattaattacctacatccttacttttgaataatattaaaacaataataatttttcttttaaattcataaataaataaataaataatttatttaagctcaaattaactccggtaccctttaagggggctaaataaaatcaatggaacgaattgggggactgtaaaataaaaattaataaactaaatttaatttaaaattgattaattaattattattctaaaattaataataaaatattcatttactcttataaataattaaaaaaatatttttttcttaataaaatttatttttaatacataatttagtttactgcctcctgtttaacttttgattttaaataaattatcaaaagggaagggagcccaataaacaaataattaacggaattttccaaactttaaagttaaaggaaatggtggaccaaataattaaaataatatttataaattaaattaagtaattaaaaagatttatcaaattattgttatttctgaaataataattatattttttattttaaatttacaaataaattatttatttttctcataaaatcttttttttataacagttttatttatctacatgattacttttgtacgattttattatatatatatattttgaaaaaatttctcattgtt

SEQ ID NO: 324 - DNA, 12624 bp, Heterodera glycines
aaactgtcccagtggtttgcatacggattggctgcgtgatctttgcattatggactcgctgaaggagcacaacgatggataccggtatattcttgtctgtattgatgttcttagtagacagatttatgtcgccgaagctgagtcgaagaagagtgagcatatgattgaagcgtttgaaaaagttttcaaaaaggcacaagtgctgcctaataaaatgtacagcgacagtggcctagaattccaagccaaacgaatgaatgagtactggctttcaaaagatatcattaaacatgtaatgtacagccctcatctacatgcaggtgttgtggagagagcaaatcgcacaattaaggaaagactttaccgttattttagcgaaaaaaacacacacagatgggtagacattattgataaaatagttaaaaacctgaacaattcagtgaaccgtacaacaggaatgcgtcctgttgatgtgaattttcgcaatgcaacagagctgagaaatcgtctatataaagacatggaacaacaaaagcgaatacaaaaattcaaaattggtgatatcgtaagaattaccaaagagaagggagacttctccaaaggatattttccaaattttactgacgaattattcaaaattgttcgggtaaacccgaccaatcctccgtcataccgaatcagtgatttagaaggtgaaaatataaaaggtattttttacgatcaggaactggtaaagactgttgctgctgaacagacaactcatcgagcagaaattttgaaatccagggtgcgaaacggtgttaagcaacattttgttcgttggataggttattcagaaaatcacaataagtggattaaggattcagatctcgttcgttaggcatggacgatttttatattgtactgccatcaaatgttccctttccgggaaatacggcatcccattttaccgtaagacttccacataccttagagctagactcaaactggtccgttgcgctttcctccatcatctatccacactcgttcccttccgtaggggtggatgaggacgactttgtcaacataaaacttctcaatcctgactataaaccagacggtacaggtccgactactgtaactctgaaggtaaaaattccaagcatacagtttcacagcgtagagcatatgcaaaaatcattgaacagcattattcaatcggcctatgatgtaaagtttccaaaagaaaaaagggtaaaaagagcggcggctgcttctgcagacaaagaattggaaccagaaacgcgaccagaaccggataaggaactgacacgtgaagtgccttcatctaaaacattggataaggaactgatacgtgaagcgcctttaccagcaacacatgacattgaactacaacgtggagatgagccaaaaccatcggagaaggaactaggacgggaaacagaaccagcgcaactttctgacaaacaattgggtgaattagaaggtgaaaaactgcaaaaggaacaactgccacccactcccattgttgatcatggtgaaatatctacgatagaccaagagcgcatggacttagccaaacgagtaacggaacaatcgtggaaagagaccgttaaattggctgctaatgcagccgatatcgcggaaaaggctaaaacagccctcaaccgagctgaacaagcccgcaaacgggcacctaatgctccacatgtaaagaaatggttcgacaggctatcaaatatggagaataatttgcgtgaacttgtggaaaagatttcacaagagtcgaaaaaggcggccgaagcaaaacggaaattagatgtacattatgattccaagaacttgaatgaatgccgtaaacatgcagatatgtcaaaacaagctcttaaaaactcgaaaaactacattgctcagcttacacccatgtattttagcacagtacctgaggatcagcttggcgtgaatgagcttgcaaatcgtgtagtgacggcagtgaacaattttttaaatgcagaattaacggttccaaggccggtcaaagaccctcagctctctgccgggcaaccgaaacagcagcaagaaaaacaaatggaaaagctgaagccaaccgtagaaaaggaagttggaagcataatcaagccaccagttccaaaactgtctgatgaaaaagaaacgaaacgcgaacctacaaagccaaccgtagaaaaagaaatggaacgagaaccagtaaaaccaccggaaaaggaattggagcgtgaaagcccaaaaaaagcggacaaagagctggaacatatggtaaaacaacagtccacgcaagaagacaatttgttagaaaaagcaaaaaaggaaatagaccaaacagcacagaatgcagccctaaaagctgaatatattcgcacactagttgccaactcaaaacataatagaggcgttgcagaaggtaggcttaacacatattcaggtgtccctcaattcaacgaatggcttgaccaaattgttgaattagataagaagatagacgaattggcaaaaaaggtaggaaatgaaccgtcaaaggtaataaacgctaagcaacaatttgataaaccttatcgaatgaaaaatttgacagaagcgcgaaagctaatcgaagctgcaaaaaatgcgtttgaagttatactaaactattcactggaaataaaacagttgaataataaaatgcatgaattaaatgacaaattcactgttgcagtcaaagagaaggaggaagaagaagccaaagaaggtgcggcgattaatatacaacaagaaaagaagctagaaaaggaaattcctcaagtcttaaaggaactggagcgggaaaaaagtcagcatgatattaacaccactgctgagaacacggaaaccgaatttccctcctccgaatatgaaattgacgacagctctgagaagcagccggaacgagcggaacaacaggcagaggtatcgtatgtattgaagaaaaaggaaggaaaattggaagaagaaaaaattgaaaccaaggatgataccgccattaatgaatttccatctacagaatatggaatagaagagagtgaaacggaggagacagagaaatggtcaccggatcaagccaaacaaaaaatattgaaaggaaaagaggagccgtttgagcagcccgatggccaaaaagatgaagagacaattttagttatcggtaccgataaaaaaggggaagaatttccatctaaccaatatgagattgaagataattattcatcgtcgtcatcatcatttattgcccaaaacgaaccatcggtaacgaccaaagatgaagaaggattgttaacggtccaaattaaaaaactaccaatgacaggggataatgagcaaaaaacaatacaaatggtaccatcagattttccttcatataatgacgatgatagcagagatactactgtcaatgaattgtcagaagaacagcatgcttctactgttcccgaagattcgaaatcggagccttatgatgtagatgagctcccagatctgcctgatcctcaagcgctttctgccaaggggagaggaggtgataaaaaaggagtaacttctgtgtctgacagggtgaaaatgctcatgggtcatcagaaacagcaaaggaaagcagtagaatttcttttcaatgagataactcaaagattttacattaacataggtagtggagtacaacatgttgatgcgagtagccatcttgcatatgtacttggatttgagaacactcgactgtactataatcatccggccaaatacttaccagatctgtcgggtggtgtaaggcaattgtatgtttatgcaccaaagttggtggaagatacaattattggagaccgtatggctccattgttgcgcgttgtcaacgtgtcaggcacagttcctctggacgtgccagaggttatatataccaatgagttttttaaaccgatacagaacaaacgaatttccgaaatcaaaatcgaaattcaaacagcgtttggacgttacattaaatttaactggggtaattgtgttctaacacttcattttaaacgaaaactattttaaaatgactcatgtctttttcaaccctgactccatcgaatggtcaacatttctagcctcgcagcaagaaggaagaggcgaacagcagtattttgttggtacacgttaccaacgcggaggcggtcttctgcaaaatgtagcccgatttttgatgccagtggcatcaaatctactctccagtgcatcgaaggagggaattgctgcaggaacacgtgttcttggcgatttgtcccaaggtaaagcattgaaagaatctcttgaaacgcatgctaagcaaggtttcgaaaacctggcaggaaaattacaacaatgtgggaaaggtggaaattatggtgccgatggtagaagaggacaacgagtgtcaaaggttaaaaaagctagtggcatcagctccagtgattctattattggcagaattgggactgttaaacgccgacggaacaaaatcatggatcagttaagcttcccttgacaccttgaacgcgaaagtctataaataggtaaagaattttgcaaaatcatacatttaggaactcatcatcatcatatagcagtactaaatattccttattgattaatcatgagtattatcaaaaaaattgacaaagatagtgttgaaggtcttgaaggtagtctatcattgtttaaccttccaccgacaaatgtggctattaataaaacgagcgttcgggagcttttaccattgtccgctctcaaccagacaggaccctatctttttcgtctgttttccgatagtcaatattgtgatcttagcaaaacgtacatgtatctgctcacttcgatagagcgtaagaatgccgccggagaatgggtgccgaccgacgatgcgattgaagaggacaaacatgtaggtgttattcaaaattttggaagcagttttgttcgatcattgaaagtcaacatttctggtgtcgaagtgtttgatagctcaatatactatcactatcgtgcgtacataatgcaggagcttggctattcacatgagattcgcaaagcatttcacgaggctggctgctattatccggatgaaaacagtcaggatagctactcaaacaaaggttttaccagccgagcacagcgattctcaaacggaaaacagtgcgaaacaatggtaaaactcaactttgatttggctcgtcaaaacacacttttgctgaacaatcaggatgttgtgttcacaatccatcggaacagcgatcctttccttctgcttacaccaaaatggaaaaccgttacagatgcggtcaaagatgcacaaggtaatataattacagcagcgcgtgtgacatggcatgataacacagccgaataccgtatccgtctacatgatataagactttacgtacgcactgtagacgtaacttcaagccttaatattgcgattagtagacagttggaaagcacgccggccaaatatgcgcttcgtaaggtagagatgcgttccatcttcttaggcatgggtcgtactgagctgtcacacaacgtgttcacctcaacccttccgcgtcgtctgatttgtgcgtttgtgtcaacggatgcatactcgggcgcccggcatctgtcacccttcaattttgagcacgcgaacgtacggtcaatcagtgccgaagcaaatggtttgacattcccaagcacaccatatctgttatcgtttggcaatcagaaaaaatttgtgcgcgcatttgtggacatgtatgcagggcttggccttgacgattcggacaacaaaacggtgtccatttcaatggcacgatttctcagcggatgggccttttttgtaatcccgatgacatccacactggatgacacgcctggctttgagctgatccggcaaggcacttgcaccgtcaaagtccaatttgagcagcctataaaagcggacggttatgaaatgctcatattaggtgaattcgattcagtcctttccattaacgctgatcgtgtgttgagcactgacggaagtgtatgaaagaaaaataataatgaattcggttcagctgaaaacaattctaaagggcgtgcaggctaccagaactaagtttattggcgtcttcccatcggataaaattccacaaccaaagtggagaagaaaatacccttattgtatgatcataaatacagacaagtcaggaacacggggcgaacattgggttgcctgtttcgttcctaatgcatcaagggttgaatattttgacagtttaggcaaagcgcccaacaaagacttaggcgcgtatttaaacacttttagtgacataaaaatcaataaacatcaaattcaatcgtcaacagcagacacttgtgggcatttttgcatttattttctagtcgcgcgttgctctggcgtcccatattgtgaggtgatgggcactctccatcgtacacgtactatagcagatttgcttgtaaaggggtttgttcgtacacttttacgagtataaaaggcataaaaaatcgacttcattgttaccagccatgagtacattttttctcctattttttgccgttttctgttataacaccagcgcagaaggcgaattgcttacacttgaagtggcggttgatcatcctaattattttgacaacaattaccggactttttctaaagatacaggtggtgatcagctgtttttcggatatgacaaaaataatgcatgtttggtaagaaaaaataacaatagccaatggacaatcagtttgcaaagctataataaactgattctctcttctcctgtaactattcaaagtattcgaccaattgaaccgacggcgtgttttgagtataacggaaagagctatgtgttctttgaggaccgtgaggcggacgagatgcacatttattgtggtcatcagcaaaaaattgtcaggggcttttttgcgaacgccaacagaccaatatttgactatatgacagaacgtttgtacatttctgatagacatgagagtcagatcagtgaaattgatctaagctatcttgagcggttgtggacaaataaaaatcaaacaaattatgcgattataaaagtcaattttgtatgtctgttacccagggataaaaccgatttcgcaattctagacaacaatatatacttgattcgatcagaccttcgcatttataaatatagaattgttgaccgtcaagttgaactaaagtttgtggtcaatagtagtagcgcgaaattcaactttttattatttaaagaataccgcgacgacgccaataataataatatacttcaagcaggctctcaaacgcctcagttaaaattattgttaggggttgcttatacctttgacgtactattgatcataatttgtgcatttgccgtgaaacagatccgccgagcgagcagcagaagtaacacatcttccgaaaatcttggcatgttcgacctagtggaattggcagcgcttaaaaataattccaaagaacttgtgtacacgcccacaacagtagtcaaagagaggagtatttaaggtaactattctggccatcagcgctcatttcgtacactaaaccactatatgcaacgagcaatcaaatattttattgactattacgccataaacgacattactcaactgtatgctctgttaaaattggaaatcgactcacacccgtccaactatttcccaaaccctctgctatcagtctcctgtgttcatattgtgaacaccgagttcgaaaatcaaccggtgatagtggaaggaacgcttgatttgatagacgagctgctcttttcgacatgctaccccaagacgaggcagggagtcggctggtaagtgagggattaatgtcaattatttaatattttttattcaggagcgaacctctgtatgtggaactgacggatctaatggtttgtccgggcgatttgccaatatgtctgtcacacttcggacaacggaaggaacgacgacccagcttgatggtcgacgaactggattggcacgacagcgacgacgacgccgcagacgaagcctggtgaaagtgttatgcgaattcaataaatgtagaccggaatatctcgctgtgacgatcagaagaaggaagaaggaaaatatcgaatttctatgcgatcaaaaaattgaaactgtacacctaagaaagaatttacaagttttccccgaatcatttaccttgtttggtgcaaatcgaatgtacgcctatcgtggtcttctaggagtcacggtagagcagcatttatacgcaagacatcgtgctcgcctaaagtttcctaaccttccatgtattgtacacattggtggcaacggtcatcaaagttattttccaattgaacttttgaaaatatcatcataatcatcattatcaatgtaatattttttttagtaaaaaaatatgcaacaaaatttcattcatatccaaaaggtaaaacatcaagattttcagtgataattcctttttggcaaacaggcaaatatcttttattttgcttccttgtaattatccgactgtcctttgtaggctggatttttttgtagttgaacactgcggcatcattctgttcatcctcttttccatagttgagaactttgtgcacaaatcgttcaaactgtagcgcttgagagttgttgacgtcaaatgtgatgcctcgaatcttctgcacatattttattgctttcgtctgcttatggaccattttcagagcgtattgtttcgctccgccacatgcgaaagtcgcaatgtcataatccgagtattcctcactcatctggcccaaaaactcgccagtctctactggaacaaggttgcgtttgtgccgcacaattacactgtctgtgtcagtgtacagcaactctgcgccaggtgtattgtaacattgttgcatgtagtcaaacagtttcagtctggctcgacttgtcgtccacagactgagcacaatgttgctggatgtatgttcaacagtgaagtttttctttggcttatacatcacccgaatggctgcatctgtgattggaattattgacgagatttccttaatttatataaattattcttatatcccaaaaaaaatacacaataccattctatggtcaaagactagatcgtaaaactcctttggtcttgtcataactttattcgacccaagctgatttctcatgctgaattttcccctgaaaacgattggataacaacaacaacaaaaaaaaacattattttggagcaaaccataagctgttgagcatcaattttgcaatgaatcgcagtcccggattctttttgatgcgaccaaaatccaaatcaaccccgtaaatgcgccgatactcatcgatatactgctgtttttgttctgacgtttccacaccttccggaaatccacttgattccacctgtgcaattaactttgataaaaattttttttggataattcgctaaccttgagccttatgaattgacggacatatcctttgaaaatctgatcactccattctgcgtaatgccaggccctccaaaatcgatcgacaacatagcccagttccaacgctttttcgagttcaatgtgggtgaagttgccagtgaaggccctctgctgatccgaatgggtgcatttgtgagaacagcgcgtcacacatttacggaacaatgctgcgcatcggtgacagcagctgaacagcagtctctcgtcaattttcatcggcagtacaggtactcgcagtccacgcggagggatgacacgaacacggtaaaggccccggtactgtagatgttcaggttttgtccagttgacattcatctcgtctgcgtttggatgaataatggtaggaattccaatcgggtaatcagtgtcgtagttgacccatgggtacagtgagacaatgtcgaatacggatatcttttcatcctctgccggttcagcaaaaagtcgtaacgggccagttcttccgccgcaatatgcaagtctagggtcaagagggccgcgctcattggatatgtcgtcaaaaaatgctttcattctttcatttttcttcagctggtcgtttatttcacattcccagatctcttcgacttgcagacaacgtccatggtcatcatactcacgaagttgacgaagacggtcttgtgtagtatcattcagctcacgacatgtttttccatcaatgagctgctcatcaggtttgaagcatcgctcgcaaccgtgccagtagcagccgagcacttctatgcaccgttgctggctctcaatccatccgtcgagcttgaactgcttccatcgtttttcccgaccgttgcctgcatgttggatttcaataccttcactttttgcgcgccagtccaaatatttgatggcgaggacgcttgctctatcgtttctttcatatcccagttcagggaccattgccaactgttcaggttccatgaattgcgccttgaagatgttcatgcatgcactgtaaaataaacaaatgttaacggagcaatttatttttttaaacctagctatggtacagctaatcggcaccacatcaaatccgtccgtgatctcattcatcaaaatctggcggaattttaccaaagctttgagtagaatttcggtgtcgttcagacagtatgccctaagttcatcgggcaagaaaaacggtgtccttttgttgtcgttgtaccattttttgaacttttcatacttgtcagccttcatagtgcccggctcgtactcgctttcgtccggaaggttttccattctgagcgaatagttctcttttctgttgaatgcgtatgggaagaatggtttgtcgtcgcagtcaaggttgaaagtcttctttaattcagcgagtgcaattggcataatcagacaggagtcacgccaaataagcattgaatgctttctgctatgctggacgcggaattcgaagattttgagcccgttcatcacaacatccggacgtcttgcagttttgcaaagatgattaagggcgaaatggccatcaaatctcgatgcattgtgagcctaggatttttttgtaagacaaattgctcataaatcacttacccatatgtatgtggtgtattcattattccacgccctcagaacccactcaacaaaagcggcaacaggttgatcctcgccatctgcttcactcctgttatttgaaatttacctttaatttaaataataatcatatcccaccattcttttgctcgttccaacgctccatcgttttgacagcaaatctcacaattgtcgtcgtccgtttccgttgattcacagcaatcggtacaagtaacacgggccgaaagaaaattgaccctatgtatacgctggccttcgtcctcaagttgttcaaggcgtgtttcagtatcccagacaatgatacgatagcgttgttcttccggtgatactcgaatttttttgatgaaacagctcctcttttccgcatgataaacctgaagacagtgttgttctttttttatatattttccaaacagcttagtctcactttgcatcgtttacaatagcgtgtgttacatttgtgcttctggccggtatccgatcgataaactctattgcatgatgaacaccgtttatagagtctacatgttgtcccccggtgaccatcgtaacagaatcgcgaaaaaaaataacggttgcattctgtgcataaaatttggacaccgtcttgtttcgggcatggatgttgaggtccgactaaacattttggttatagaaaatattaacattatttttctaacctttagcacattgaggacatctgctcttacaatgcattgtatgtttagcgtcaacagtgtacgtgcactcacactcaatgcaatatttccgaccaagtttgaagaaacaatgaatttttttgattacgtcataatgatcgctggatagaaaaagtgtgacgttaaaacgatgccctcctgggcctttccatattggccgaggtaactcttctggtctgtcttcaaacaaaactaagcggtatgtcccgggaaaaacacgattctgaaatatatttctaacacttaatgattaaaattttgttatacatcatacccagtattgttgaacctgctgaatatgttcaattccataagaagtctggtccttttgaatgcccgacgcattcatcagctcttcaactgcagtttgcattcgaccaatgtttgataccagacgattgaatgcctcgtagtctttgcaaaaatcgtgtctgttcattatgtttgccataaattgaggctgctgctcatctattgggttatgagtaaggcagaaaatatcgcggtcatgataggcacggcctgcaacaagcgcatgaaataaacagtagctatcgttgttgcgtatgcgaattctttgcgattcatcgtatccccaattttggtatggatgtaaacgtggggctgaccctactggaggggtcaaacaggtgacgatgatctccacaggatcgctgagcagcaaagtttttttgtcagcacctccatcgtctccctcgctctgaccaacttgtcaagctcagccatcaccacgtcgacgttgttttggattggagggcgca

SEQ ID NO: 325 - DNA, 502 bp, Heterodera glycines
taaaataacgggaaaatttaataaaccccatggggtctaaagaaatattgtttttgactcatggcaatccaaaattgtcgagtcgtattatccctgaggggctcaattaattggaagatttaaaaaaaaataataataataattaaaaaaaaaaaagaggaatttattaaataattattaaaagaaaaaaaaacatttaaaaatatttaaattgaaaagagtgggaatggaattgaaaatgcaaatcacgtgcacggcaacgtccgatagtcggtcaccgtacaacgacaaagagatggccatctccttcatcgcttgtcccttctttcccccccccccccccgcttctcatttcttccatagcttcgacccccgtgacccatcgcttgcgttcatttccctcccccgcttctcatctcttcgccactccttggcccatctacccctctcagcaaattatgagtgtgaatggccaaagtgacaattacagaacaataaaatg

SEQ ID NO: 326 - DNA, 2158 bp, Heterodera glycines
attgcgacttttgatcagtaccatttttctttcatcaaattgcgcgcaattcttctgaaaaatcgcatcctaccccattcccattgatcaatctcatccccctcatttttcatttatcaatttgctccaatttcctctgatcagtcacacctcccatgttcctttgatcaaattgtcccaatttattctgatcggattttgttttggccatttcttttgttcgacttccccattttcagtgatcaacacacattttttttgatcagtgccattccctcatttctttttgatcatttggcgcacattctcttttgatcagtgccattccctcatttctttttgttcatttggcacacattctctttcgatcagtgccattcccccatttctatttgatcatttggcgcacattctcttttgatcagtgccattcccccatttctttttgatcatttggcacacattctctttttgatcagtgccattccctcatttttttttgatcatttggcacacattctctttcgatcagtgccattcccccatttctttttgatcatttggcacacattctctttttgattagtgccattccctcatttctttttgatcatttggcacacattctcttttgatcatgccattttcccatttctttttgatcatttggcgcacattctcttttgatcagtgccattccctcatttctttttgatcatttggcacacattctcttttgatcatgccattttcccatttctttttgatcatttggcgcacattctcttttgatcaatgccatttcccttttgatcaattggcacacattttcttttgctcagtgccgtttccccccatttcctttgatcaatcctaccctgaggggttcatttattgcctcacatttacatattatgtttgtatgtgcctacatttttattctatttactaaatgttagtacattaatcacattttacaccataatgtcatttcaacaaaaaaaaaaaataataatattcattatacaaattaaatgcaaataaatataataaaataaaataaaatattaataatcaatcaaacttaattcgcgcattagccccacctccatgcaatttaatcgaatagcatacatacattcgggtactaggggttccattcaggctgaatccatgcggttttcttagatcgctcaaatatgctctgcttatccatgccatctatcatctatgattctttcatgcacgcattattcacgcaaacattcattcacgctagccttattcaatcattctttcattcattcacgccacgtgctttcatagaatcatcgcgtttataaattttcatcgcattacttataaatcgtaataaatattataaatcggtgcggaattagcttatcacattcagatcgagaaccaaaaatctcgccttctaagctttccaatcccgaagttttaacaagtgatgctagttcatcgagtgttgagagccctcgcggggaccatttatcgaatcattcgaagcgttgagcattgatagctcaaaagcagctcgcaagccctgaggggtccgctaatgttggggctgaaattgttattgaagggactgaatccaatgaaaaccctgaggggtccggatatgatgaagtgagaaacgagggtagtaacgtcacatttaaagcgatggaagtggcgcttgaccaagtcgacgcagaggcttttgcgaataatgactttgattatgaagaatctgaagcatgtcctccggccaaagatgtgagcaaatcctcgcttcttttatttggtttcgcaagccggagacggctatgtcattgtttgcaagaagtcgcccaagtcgaagcccaaatggggcgttcttcatgaacattgacgacaaactcatcgagtcggctccaggcttccagcgaaagcttcgaagttggcgacttttgtggcagttttcctcgttttgagtggaatcagaagctgcgatatttggctgaacatcgccaagatgccacacagtcctgcaaattttggttcaacgaaaacacgcaactgttgccaaagcaggctgatgccactgggcgtggttcaactcatgtacatgaacatcggacgcaagcagatcaccggggtcgtttactggata

SEQ ID NO: 327 - DNA, 8831 bp, Heterodera glycines
  misc_feature (30)..(30): n is a, c, g, or t
ttaattcgcgcataagccatacgtcatgcnaattcattcaaattacatacatacattcggacatatatgggttgtattcagtatacatttatcatgcggtttcattgattagctcaaatatgctccgcttatccatgccatttatcttacatgattctattatatatggctcctttatgtgcattagtcctgcatgcattcattcaattacgcactcattcattcaattattcactcattcattcattcatttattcattctttcattcattcacgcataacataggcattcatagagctatcaggcattcatagagccatccattcatacattttaattatcataaaatgtcagaaataagcttatctcattcagatgagatccaaaaatataccttctaagctttccaatcccgaagttcctgaccaaatggacgacaacgcattaacgagtgatgctaggtcatcaagtgttgagagccctgcggggaccatctatgaatcattcgaggcgttgagcattgatagctcaaaagtagctgcaagccctgaggggtccgctaatgttggggctgaaattgttattgaagggactgaatccaatgaaaaccctgcggggtccggatatgatgaagtgagaaacgagggtagtagcgtcacgtttaaagcgatggaagtgccccttgaccaggtcgatgcagagggttttgcgaataatggctttgatgatgaggagcctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggcccctggctttcagcgtaaactcgaagttggcgactttgtggcagtgtcctcctttgagtggaatcagaagctgagatatttggctgaacatcgccaagatgccacacagtcctgcaaattttggttcaatgagaattcgcaactgttgccaaagcaggctgatgccactggcgtggctcaactcatgtatatgaacatcggacgtaagcagatcaccggggtcgtttactggataaagaggaaggtccaaagcattccctccagcttcgttcacgcaaacatcgcgtgttgtggtctagcggtttcggcacgcataaatcggcgtcatcttgatggcatcaatccggaagacctcaagctgggctcacttgtgacggtggttgttgccaacattccacaggattcacttgtatcaatgggatacattctgccgaattcttcaccgtacaaactgggaacggaaagaagagccgaaacacctgaatttttcggtgcagttgcgtgcattcgtcctcatctgttggagtggccaaatctgaatgcaaacatgacgcccaaggtttatccatgctccgcggagcttactaaacatcatgttgtggcgatggagcatgttgttggagcagctctccagattgagatggagcgagaggttgacatgatgattgaagcacgctttgaaggaagggctcggaagttcgatggtgctgattgtctgattgtctttggttcgaggtcgaagaaagaagtgaatgagttggccaaggtctgggagccggagtcccaagtgaaggtcttcaaagaattgggtgagaagcattttgctctgggagtggtcaaggatgttgaggtgctccacgcagaatacgaaaagttggaactccacgtcgtcatcttcttgaacaacatccaggaaaggaagaatgtcgacatcgcaagaaaagtggatgagttcatccagggtggcagtgttgtcatacacccggtccctgccactgcggttgaggacagactgttctgtttccgctgcaacgtcccatcaataattgctgatgaagactccccgaggggaaggataatggcagttctgctcggccgtccagccatggaaggcattcgaatggagaagcaaagcgttgacgactcaacggattcgtggatggaagaagaaggaccgctccaccctgcaattcttgctctcaactcgcggcagagagtgactgcacgcctaatgttgggaggaggtctggtgcaacaacaggcgccgccaggcaccggcaaaaccaaagtcgctgcggcgatcattaaggcaatgatggactcaaatcccgggttccggattgtggtgatggcttgtgccaacattccagttgcaaagctggtacaagaggcggaaggcacatgtgctgaaaaggatttggatggagcacgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgcagacgttttgctctttgatgaaagcactcaagctcagtgggcagtggtggttcacttggttgcgcggatgcccaagctcaaggcattgcttttgacgggcgatcgtcatcagctcggagtgcatcttcaagaactacctgacatcttccactcaggctatggattggaaagcgtcatcctacaagccgaggcttcggttgggacgaactacactttcctcacaaagatgtacagaagccatccatttttggcaaagctcatcagctatgcctcatatgagttgcacaatgaacaactcattccagcaagaagtgctgaagaacgctcacttattacgggctcaggctttcttatgccagttcaagaatgtcctgtgggacttatcaatgctttttcatcgttccgtgtggacccaaaaagcgactcgctcacagatgaccatcaaactgaagtggcatcattcttggtacaagcactcctggaacattttggcaacgatttttcgtcaagaatcatcgttttgtgtatgtacacgtaccaaacttcggaaattgaacgaaagctgaagcactgcggtgttcgtgcactcacagttgatgcctatcaggcacaggagtgcgatgtcatcataatagtgacaacaagatcaaaatactccgagatgggatccggaaggacggacaacatgcacttctttgaagacgatcaacgggctactgttgctctttcaagagctcgccacgctgtcttcatcattggagacttggtttcaataagtacaggacaagtgtggaagcgcttcatcgaaatggcgataacaagaacaagtgtagtccgagccgagtatgttttggcacttctgggacgaacactcgtgaggtcgtcgacatgcctatttgattcggccaaaagagaatcggtggaggatgaaggctttcttgaaagttgggcattgaagcatgggttgcgcctggaccgaacgaatgcctttggacaacaacaatcacagcagccgcgagctccctcattccaattccaaaatcgccactttccggcactacaggcgacagggccctcagaccaagccggtccatctggcagcggtggtcaacaaagaggtgcgcctactttggcaccacagtatggaagaggtcagggaagacgtggcccggacaatcaatggatgcactacggcggaaacccgaaacgacagaagggtggcagacgctgaactcatttcacatgaagtcctgcgggtctcacttctcttcctttcaccatcgctacggtatgtctaagtagttcataattcttttaacttaattaattagttaggtaatttacattttaccctttcattaaatattttattttctttcattttttctgcactcacaagtttttttttctcatgtcacccctccttaacttccggcgttcgcactgtttacgctgtgatacaatcagtagggacactttcccaccatattacggtattaatggatttccgctattttttttttctcaaaacaatttttattacactatttcccataacagaattattgtaacactggcacgccagccacgcccattgtcggggccttttaatctaagcactgcacattcattcattcattcttccattcatttgatttactgttttccactttagatactcttgcacaatcccactgctaattctcatctcacatttcctcttattatgttttctttctcaggtgggggtccacctaatcaaagcgctgcggcgtcaagcaatgcacagacagaccctgaggggctctccaatgatttgcctgagttatcagttgttgataaactgatgtttgctggaaagattctaagcacaccagcacgtttgtctgatgtggacaagctccacacggacttagttcggactgaggatggtgtcaatcgtatgacacgtcaccttaacaggaagataaatcaaaccaatagggatttgactgaacttaaggatgatactcaaactctcataactcaagtaaatactctcgcaaatggttataatgcggttcaagtgttgcaaaacccaaaccagtcaccaagagccaataaccctcctgtcttaaattgggcaactccctctccactcaggaacccgaacaatagctttggcaatgctaatacttcggtggttgaagccatcatacctctcggcaataatgaggaagattcccaggatgaagaatttgaattaaatccttcgggattccatcatgttaacatgcttttcgcagaaagcagtccctctttcacgatattctctggaacatctccattagaattcgatcgttgggcaagaaagttcacggacctgcttgactgcaatggcagaaagtgggatgattctgaaaaagtggcacgcctcaaggcatgccttgatggtgaaccaagacgcatttttgataatttacttcctgcccacaaagcaacttcttcggaagccattcaaaaaatcaaggaaaaccttgacactccacaaaataaagaactcatctatcaggcactaagcatgtgtaaacaaagggaaggagaatctgtagatgagtttagtgcacgactgattcctctaattgaggccaccacggcagaccttacaactaatgctagtgaggaggtactctgtcgagcatttttggaaaaattgaatccaaatctcaaatttctcactcgaaccctgagtgggcccgtcagaagggatttccaaatattgagaatgaatgcacgggaagcagaaatgatgcatagagagattcctaaatctattccagcacctcttttcccaatttcggaacaacaaaatccgagattcaacaacaccgagccgccgaaccacccggaaggcaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcacttccagaaatgatagacgatggaataatcaaacccctcaaaatgaccgacgctggaatgctcggccagtttgcaactactgtgggaaggttggtcacctcgcgtttaaatgttttaaacgtcgtgacgaatttacccaaccatctaagaatttgaatttcatcagagcaattgatgaacaaaacagactgataaacgatctatcaactaaagttaatagtttaacttttagaaatgaccaatccgctgaggcggcctctcaaaatataaaaaccattcaaaaagtatctgaatctagtacagacaaaactcattcatcaatgatgaatgatactctcaaagcaccctccaaaataagtaattgggaaaccagtaaaatggttcagccaaaattttttccagtgctaatgggtctgactcttatttcctctctctcttccactttagttaaagattttaatacaattccatccggtccaatgatttgtcaaactcgcgttcaaccaatgacgtggtcccttcccaaatttccacgatgccccaggatgtcaattgacacaaccaaaccactaactaaacaaagacgcaccatctattttcccaattcactcgaattttctaccaaggcctgggcctgtcgcagaatcatcaaaagtattcggaaatatactacaatcagtggtgtttctgtagaacaacatcttgactctgaacaaacattgatgagtcatgatgaatgtttacaaatggcaaacaataagcgctgcagcttagggtatctcaaaaatgactcaggattgtggcacacagataggaaaattgaccagacaccccgtccttggttattaggctctttttcctggaagaaagtccagagtgagaattgctttgcctttgaaactgaagtatattcgcacattggtgccacttcaattataactcctgcgggaaccgctcaagcttgttcttatgacaaaggaaactgtgtcctctctgacaaaactgtcttagtatgggtccctcaaaaggacaaaatgtgtaaatacagtcccatcggagtcatggatggacataatcttggaaatgtatggctttccactttaggcgacttgggtctaaccagctcaattgttagaaatatttcagattgcggtcgaaatattactgtttctgaccaaggaccagcttttacaattaactcacaaagcccacgccataaaaggggtatttttggattagattctgaaggtgtagtcacctcctctcagttagcggcacaactttcttatttacacactaacatatctcgttcagttaacattgcttttgctcaggcatttaactccttttgtgatttaatgcttgacacacaacgttgggtacagtcatcctatctcaatgatcccacaagccttacgaggttcattcaccaaaataacttcttaattgcgaagagagttggagtttctcttctgagaacatggccatgtgtccctctcagtcagtctgactttgaatttcgtccaacccataccaattcatcctgttttgaatttcttccaataatagtcaaattaaatggaaaggaacatattgctttcttgaaccctacgtatttgacagtctctcttcattctaaaacagctccttgcgaggaccagagaaatattttaattcaaatggctgatcgcacaattgaagttgaccaagtagacggaacaatcaacaatgttcatgtccatgaaatcagggaggttgagcttgactttggtaagccaacgcgcattccaaagctctcaccacatgccttccatcatctggtcattcttaatcttaccgatctcgccacacatgcctttgcttcaaacttggtacaagtaagtcaattcacataccgagctgataaaactcattcctctgaaattaaaactacgctctctgatgaatggtcagcactagaagaatctatagttcaaaaagctgtgggaaattattccctggcatggcaaatttggatcaccatttgtcttttattgtgcatggtagatctcctgacacgccttttctttgcatacattggtatcagacttcaagatcccgtagagacattaggtcgaccaatgatcaccactatagctaatctttttggcaggaagaaacaaaatctagactgcgataacaagaaccatcctaattcgccaaccaaaaccattggtcacattacttactcacatcttcgaagcgttgctgcaacgcccataaatgaggctacaggtcagtccatttttcgagatacgctgaatggtaactcatgtaactttattgaggcataccctcaatcatcaaactccaaggagttcaaaaaaatatggtttacaaaagaaactaatttctctgcttggttgaataattatctctcaaaaccagttaatcacgaaattcctctcctacttccgcggaactcaggcgaattagcacaattcctcgatgttgcaacacactttggaaaagaaattccaaatttcaattcaaaaattgtcccattagcagaatctcgggagatgaacatcttaaatgggacaagcaacgagtctctgcttatcaggtcattttggggcatatacacatgctgattcatggtagaacccaaaacattccacaacaacgatttcataggcctcgctctgtaataagagagttaccaatgttcttggtattgtgcatgatattgcttccagcaacccttgctgcaccaattacctcaaaaggtcctcctccgaacttgaaaaactcaacctttgagtcagcaaattttatattagcattaccatccattgtagccataattatattgagtgctttagtgtattcttggagtcgttcttcactcaaaaagaatatacgtcaaaaaaataagaaaaaatatatactaaaatctgctctcttatcagctagcgccaaaaggtcatcagaagggcgaaaaccacttactctgacgactgttcatataaaagtgtcgtgagtaagtgacaaattatatggatgacaacaggggaaaaaacacaaaataccgtatatgctctaattatagcccattctctctattaatcccacagtctccaattatccccaagtctacgaggtgtttgaaaaataatc

SEQ ID NO: 328 - DNA, 5603 bp, Heterodera glycines
  misc_feature (49)..(49): n is a, c, g, or t
  misc_feature (86)..(87): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (114)..(114): n is a, c, g, or t
  misc_feature (116)..(116): n is a, c, g, or t
  misc_feature (120)..(120): n is a, c, g, or t
  misc_feature (124)..(124): n is a, c, g, or t
  misc_feature (152)..(152): n is a, c, g, or t
  misc_feature (159)..(159): n is a, c, g, or t
  misc_feature (161)..(161): n is a, c, g, or t
  misc_feature (163)..(163): n is a, c, g, or t
  misc_feature (165)..(165): n is a, c, g, or t
  misc_feature (169)..(171): n is a, c, g, or t
  misc_feature (180)..(182): n is a, c, g, or t
  misc_feature (185)..(185): n is a, c, g, or t
  misc_feature (197)..(198): n is a, c, g, or t
  misc_feature (219)..(219): n is a, c, g, or t
  misc_feature (226)..(226): n is a, c, g, or t
  misc_feature (237)..(237): n is a, c, g, or t
  misc_feature (249)..(250): n is a, c, g, or t
  misc_feature (256)..(256): n is a, c, g, or t
ctaagtatatgtaaacaaagggaaggagatctctacaggggtttagtgnacgactgattcctttaattgagccctcaaagggagannttanaantaatgntagtgaggaggtantntgtngagnatttttggaaaaattgaatttatatttnaaatttntnantngaannntgagtgggnnngtnagaagggatttnnaaatattgagaatgaatggangggaagnagaaatgatgnatagagagattnntaaatntattccagcacctcttttccaatttcggagcaacaaaatccgagattcaacaacaccgagccgccgaaccacccggaaggcaactttagaacatgggctcccacaggctctaacagagaacccataagtcccagacagaggaacaggaacaactgggataacaatgcccaagcctcaagaggctcttttaacacatccaataatcgtcctcaaaatgacagaagatggaacaatcgctcttccagaaatgatagacgatggaataaccaagcccctcaaaatgaccgacgctggaatgctcggccagtttgcaactactgtggcaaggttggtcacctcgcgtttaaatgctttaaacgtcgtgacgaatttacccaaccatctaagaatttgaatttcatcagagcaattgatgaacaaaatagattgataaatgatctctcgactaaagttaatagtttaaccatcagaaatggccaaaccgctgaggcggcctctcaaaatataaacaccattcaaaaactctctaaatctagtacagacaaaaatccttcatctgtgatgaatgatactctcatagcaccctccaaaataagtaattgggaaaccagtaagatggttcaaccaaaattttttcctgtgctaatgattttgagtcttatttcatctctctcttccactttagtcaaagattttaatacaattccatctagtccaatgatttgtcaaactcgtcttcaaccaatgacatggtcccttcccaaatttccacggtgccccaggatgtcaattgacacaagcaaaccactaaccaaacaaagacgcactatctattttcctaattctcttgaattttctaccaaggcctgggcctgtcgcagaattatcaaaagtattcagaaatatactacaatcagtggtgtttctgtagaacaacatcttgactctgaacaaacattgatgagtcatgatgaatgtttacaaatggcaaacaataagcgctgcagcttagggtatctcaaaaatgactcaggattgtggcacacagataggaaaattgaccagacaccccgtccttggttattaggctctttttcctggaagaaagtccagagtgagaattgctttgcctttgaaactgaagtatattcgcacattggtgccacttcaattataactcctgcgggaaccgctcaagcttgttcatatgacaaaggaaactgtgtcctctctgacaaaactgtcttagtatgggtccctcaaaaggacaaaatgtgtaaatacagtcccatcggagtcatggatggacataatcttggaaatgtatggctttccactttaggcgacttgggtctaaccagctcaattgttagaaatatttcagattgcggtcgaaatattactgtttctgaccaaggaccagcttttacaattaattcacaaagcccacgccataaaaggggtatttttggattagattctgaaggtgtagtcacctcctctcagttagcggcacaactttcttatttacacactaacatatctcgttcagttaacattgcttttgctcaggcatttaactccttttgtgatttaatgcttgacacacaacgttgggtacagtcatcctatctcaatgatcccacaagccttacgaggttcattcaccaaaataacttcttaattgcgaagagagttggagtttctcttctgagaacatggccatgtgtccctctcagtcagtctgactttgaatttcgtccaacccataccaattcatcctgttttgaatttcttccaataatagtcaaattaaatggaaaggaacatattgctttcttaaaccctacgtatttgacagtctctcttcattctaaaacagctccttgcgaggaccagagaaatattttaattcaaatggctgatcgcacaattgaagttgaccaagtagacggaacaatcaacaatgttcatgtccatgaaatcagggaggttgagcttgactttggtaagccaacgcgcattccaaagctctcaccacatgccttccatcatctggtcattcttaatcttaccgatctcgccacacatgcctttgcttcaaacttggtacaagtaagtcaactcacatatagagctgatagaactcattcctctgaaattaaaactacgctctctgatgaatggtcagcactagaagaatctatagttcaaaaagctgtgggaaattattccctggcatggcaaattgggatcaccatttgtcttttattgtgcatggtagatctcctgacacgccttttctttgcatacattggtatcagacttcaagatcccatagagacattaggtcgaccaatgatcaccactatagctaatcttcttggcaggaagaaacaaaatctagactgcgataacaagtaccatcctaattcgccaaccaaaaccattggtcacattacttcctcacatcttcgaagcgttgctgcaacgcccataaatgaggctacaggtcagtccttttttcgagatacgctgaatggtaactcatgtaactttattgaggcataccctcaatcatcaaactccaaggagttcaaaaaaatatggtttacaaaagaaactaatttctctgcttggttgaataattatctctcaaaaccagttaatcacgaaattcctctcctacttccgcggaactcaggcgaattagcacaattcctcgatgttgcaacacactttggaaaagaaattccaaatttcaattcaaaaattggtcccattagcagaatctcgggagatgaacatcttaaatgggacaagcaacgagtcgctgcttatcaggtcattttggggcatatacacatgctgattcatggtagaacccaaaacattccacaacaacgatttcataggcctcgctctgtaataagagagttaccaatgttcttggtattgtgcatgatattgcttccagcaacccttgctgcaccaattacctcaaaaggtcctcctccgaacttgaaaaactcaacctttgagtcagcaaattttatattagcattaccaaccattgtagccataattatattgagtgctttagtgtattcaaggagtcgttcgccaatcagtgcgattatacgtgcaaaaattaatggtttagaaattagggcactagctgatacgggagcaacgataagtgtagctcctctctccttagcaaagaagataggatgcgagctttatgagtcaaaagtggaagctattagcgtctcctcacatgtaataagcatatgtgccgtgggtgaagtaataataaaacttggtgatatatctctgcggagttcaattaattttatacctgatgaccaagcaggagccatgaaaaattatgaaataatcataggatgtgatatctttgttaacctgccaccaataacatttgacttcacaaaaaaggaagtcatgataggtaaatcaaaactaaacatggaatcaaatcatagtaccctctcaaacctaaaagttcgagctctagagcaccaccgaattcctcctggtactcaaatactggtcaaagccaggatagatactatcttctcaatagacaaggacattcttgtagaaaatttggacccaagattatctgatgaacacctaagcacaccagccacagtttcaaagcctaaggacaatttattgaacattgtaatttgcaatccaaccaattttcctaaaaatataattaaaaatatgtgcattgcgactgcatgtgaattaaacaaatctgatcatcctaatcttgaaatggaatgcacctcggatgagatcaatctcctgagggagtcacaaaaaataattcacgcagatccgtcatttaaagttgatttttcaaaatcatcagtctcaggtgaaaatcttaacaaattaaaggaattgtgtgaagtattccaagatatttttagcaaaagtcaatatgacttaggctcttgcactgcaggagagcatgatatagtgaccacgtcggatactcctgtgtcgtcgaagccacaccgaacaccattcaaatatcgtgatgaactccaaaaacacattgatcaacttttggcatccggagtcatggttgagtcggacactccatgggtctcaaatatcgtcctagtgcagaagaaggacggtgggttgagaccatgtatcgattttcgtaaacttaacgaagtgactgttccggatcattatccacttcctagattggaaacgatcatggaacgaataggtaattgccgctactattctagtctggacctgtccagcggatacctccaaataagactaacggaaagggcatcccgaaaatgcggtcttattactgaaaataaaatttttcagatggtcaatctcccttttggtctaagaaatgcaaccagtgcgtttgccagatgcatggcccatgtcctcacaggtttggacgattgtgtaatcgcatatgtcgatgatattctggtatacaccagggatgataactttggtgagcatctcaatgctttgagaagtgtttttgaaagatttaggaggttcaacctaaaattaagccctaaaaaatgcacattcgctgcggcgaccatgaattttctcggatacttagtcaatgctgacggctacactcctagtctaagcaaagtggaaataattaaaaaccttccagaccctaaaacaactcgagatgtgaaacatgtagtaggaatggcttcattctttcgtaaacatgttcctaatttttctacaatcgtagaaccattgaccagactaaccaaaaaggaaaccaatttcgagtggggtacagaacaggctgcggccttcaatgaagtaaaaagaattttgagtgagaaaccaatattggtgtttcccaattatgataaaccctttcacatcttcacagatgcctctaatgttggccaaggtggcgcactcatgcagtggaatgagttggcggaagcatatgaagttattgcttattgcagcagaacgctttcagcatctgaacgcaaatggcctgctgtacaagcggaattgggagcaataatttttgctctgcgaaatttcaaaccctatatttttctgacagaaattgaattacattgtgatcataaacccctcgccttcctacttaaaaaggcagaagcgcatccacaccttgcgcgttggttaattgagttacagaattacaatattaaaataattcatgtagcggggaagcagaatcttttagctgacggtttgtcacggtacccacatgaaagaacccaagagattgccattagagatttggctgaattagaagacatag

SEQ ID NO: 329 - DNA, 2488 bp, Heterodera glycines
  misc_feature (34)..(34): n is a, c, g, or t
  misc_feature (66)..(66): n is a, c, g, or t
aaaggttagaatttttctttgtcaaccaaatcanacatttgttggtagcaaaaatggagaaacgtnggaagaggagaaaaaggatgaaaatagcattggggaaggaggagagacggaagagaaagagagaaaaaggaaaaattcgacggaagaaggagggggagaaagaggaggaaaaggatgaaaatagcattggggaaggaggagagacggaagagagagagtgaaaaaggaaaaattcgaagcaagaaggagggggagaaagaggaggaagagagaatgaagcagaaaagagggaggaacagcagcaaatcgacactttttgattttgccggtgctaattgctaatggatgtcgtaaatccccgtcaaaatcctgaaaactacacaattttcgaaagaaaaatgcattcattcgattacacataggcaaaaaatttatgttgtggcgtgggttttgcaggagcacagcttgttccccaaatcccattaacgatttaaaaaaatcattaaatttctcagggaatttccggcaaatttcaaacaatttattacaaatagagattcttagaccccctaagaatcggtcggggccgttttcgcgtgagtagctgttcaggactggaattggtcggatttgtgcaaaacatccatgtttcgaatccgaacccgcattcggacaaatttcttaactttttaatttttttatttcttgcggctaatatcttctacagtaatttgtcagtttggtcggatgtgcgtcaaacggaaaaaatatttaaaattttataaaaatataacaaaaaataacaaatttcagaacaaactaaggtcgcatttcatagtttcgggaaacaccagtgagaaaattgataatgttttcgggattcacattggcattggcataattgtgatcattttgggggaggtgaatgttattgatgtcgttatagaatgcgccgtttttgcaaattttttctcctccaccggcagaagaaacgggacaaagcatcacaaatgggccgtcttcttctgacaattagtgacggacaaaacaacaaaaacagtgatcagcagcagaagaagaaataaattgattaaaaaatgatcggttaagaatgatggaccaatcataatttatcagtgagcaaatgcattttatgaagaaaaactctcaattgataaataataaaaaatggtcgatcgtaatggaaatgggctctgaccccccccccccccccatggggggccaaagtcgatcgtaagacctctttaacatcatatttttatgtactttttttatttattatataataaagtttttatttttatctcatttttgccgttttcccaactctttcgcctgcagcagtttgtgcctgtctttttgggtcaccgttttgccctgaacaatcaaaggcaattcgaataatgcataaacgactcaaatcaaataacctttctctttttattatcttttgtccatcccattttctctcattttaaagcattaacagtacaattatggtgaataaaaagtatattcacaaatttttgtctcaaaaaaattttgcaaaacaaaagtcactccccccttttgttttgataaaattaaaaatctgtcactttataactagcgccaagtttgttaataggcccaaataattgtcatattcgtgatcactgatcagcgacctctaaaacccccgggcacttggtttcatgactttataaacaaaacaaaaaaatttaccaaaaaaaagtttaaaaaattttcaaaatcggtgactttttcactagcgcctcgagatttttagtcactaaaattcctagccctagttattaccaaaaatgttgtaaaaaacttggttttttgagcttctcaagtcctcccattggcacattgtccaacccctcggacgccaattggcaacaatttaaggcgaacaaaattcagaaattatttggataaaatgtgatttttacgtttctttcatcaagtacatactataaggacactttggaaaaccgaacaaaatctcaacaactaccaaaaagaaactgataaaataagctaaataagaaagaacaaatcttttttcacatttctgtttattttgcgaacagaaatatgtcttttaggcagagttatgttgaattttctaagttttcaggagaaattaagggccaaaaggcttaaatcgcctctaacatttgcccaaccgaatcaaactaacagcaatcagcactaggataagttacagacatcctttaagcattttattcattttatgccataaaaaaggcattaaacacaaaatttttgcgggtgaaaaaatacgaaaatctgagtaaattcgaaaaaaaaattctagggggttggaaaaaattttccgtagaagatgattatgacgaacagaaagagcacaaaattctctacaaaatggcctttgaatgagggaggtctctacgtcgcgtctccgcgaagg

SEQ ID NO: 330 - DNA, 10352 bp, Heterodera glycines
tcatcacaagacatggatggccagcggatttttcatgaaatatggccaattttttcggcaaatattcgccacttgggctttctcaatggtgatgatttggaccatttgcgtcgtctcatttcaccgacaattctcactgatcttaatcagttgaattcaatcgatttatatggtcggttgcccgctgcaattggtgattttgatgggccaaatgcaactgctggccaagcattgtccaaatggttgcacacgccgagaaaagatggccaacccaagcgattgcgttgtggcagaaatttgaacgcacaagcggacttcgattgggtcaacaatttcaaggaggtgtggcccaacatttttgtgatttttgttttccctaattgtttagcattttctccgtgccaatgccatttcttccgtcagttaccaaattcatttttcttttcgcgtgccgtcaatgcaaatggtgccgtttgaattggtgaacgaatggacaaaggaaaagctgacattgaccaaaaaaaacgaaaatgactgggagatttggataatgaagcgatgcaaaattggagaggccgcggatgttcagcttcagaaagatgaaaattggggcaacaattttaacaatgtggccatttggcttttcagtactgattgcattgggtgagcaattaaaaaaaaggcatttaattttgtttaaataattcaaatttcgcttaattaaggccattgtctccgccatcagcagaagaagaacaagaagcgggacaaagcagcgaaaaagggtcgtcttctgctgacaattagtgacggacaaacgaacaaaaacggaacggtgatcagccgcagaagaagaaatgaattaattaagaaaataatggaccaatcataattgattagtgataaaattggcatggaatggcattttgaatgttaggccaaagaggcaaagggcgtggccaattgttggcatcattttttggaggggaggcaaattattatttaattgatttacacccaatcaaacattaaattattagagagccctcctgtaaaatttcaaaaaaaaattggccaaaactcaaaaagaaaaaattgaaatttctcgcgcactttttgttttttttgccataaatttttgcgaattggcaactttttgaaattttttgtgaggtgataaagcacactatacgccttcaaaaggataacaagagaatgtttgagtttgtgggcaaaaatattttggcactattttgaagctaaaccgttataaacagtcggccaaaagtgatgtgcctggttagttttcgtcgcccattgcgccggcgggcaaaggcaaattaattaaaaaacggggcggggggacaatttaggatggaaatttaatcgaacaggaaaatttgctaaaggatagaaacgaaagaaagagaatgaatgtgaatggaattaaaatgggaacaaagccgattaccatatgccgaaggaatgaatgggtactgtagcaattataacaataatttctcgggaagtattattaatttacataataaacatgattttttcgaaaacataaaatcaacaattaaaaatggacaaaaaaaagtatcaaaacaacaatttttcattcaataattcgaaatgatcggcaatttgtcaaatgtaattaattggctaccacataattaattaggcgctcttttctccgcttcttttgttgattgtggatacaatggcctaaattaagtgcaatttgaatttgatgatgaacactttaacaaactttaacaatggcaaatgtcgttgctgctcacccaatgcaattattgccacaataaaagtgtaagaatgtgccgttcaaattgttcggcggattctcgttagtccagcgaaccgtctccccaattggacaccgccggattatccattgaatagtaaatccaaatgtgccgtctttggccattgtcagcttttcatgggttcgttcgttcaccaattcaaatggcacaattggcaatgaggcggacaaatataattgaattgtgtagcaggcagaagacgaatctgatttaatttttgaaatttttatttatttttccattattttttaaattattattttttaaatgaaattttaaaattaatttatttctaccttgaaaaaacctggggattcgataaaaacaaaacaaaaaaagttgcatttattaattgagaaaggaaaacctaaaacattttcaaaaaaaatttgttataaatttgtgcgtccgtcgtttttaatcattttaatttcttcttggcaccagggacaaatacggcgacttggacagcaacttgatttcgttcgggccgtgccaaacgccgacattggcattttgtgtgggacgacatgacgaaattgtgcagttcaaaccgcaaccgtactggctgctgcaggccgaggtacagtacacacccgagacaattaactatactgtaattatgggcagttttttcgataaacctgggccagaaataaaaatacggccaaaaaattttaaataatttccaatttatttacacggccaaatggttttgaatttggacgtgggttcgaccggaccgggtcggttgggcgttcgccgattgggcgccatggggaaatttcatttcattaaccctgcctcgaattggggataagaatcataggtgaacaaggggtgcgccggcgcacccccccccccccccccttgttcgtcgtaaggggggcggctgtaaaggagagggggggggggggggcataacgtagggggaaaaacctaaaatttgcacatttccttagcgaaatcaatacaaaattcaaaaaaactttctggcggcgcctagcggaaccgccggcccccttgttcccgaaaattttttggaaaaaccacgccgaaaaaaactgttttttgaatagcaaaaaaaaaggtcgtcgttgggaaaaattgggggccttcgtacgaaaaattggtccttgcgcaccccccctgcgccaatcgttcgtcgtatgggcctcgccctggcgcaccccttgttcaggtatgataagaatgctttccaggacggggatattcattttcaagaacataacgggaaaaatttcattaaattcaatgacacaaaaatcatattcaatgaaatttttattcaaatggtttgtagttttcgctggaatgaattttttcaatatttttttttgctgatcattttcctcatttcatcgcacgttctattttcaaaaaattttttgagaacattgggtccggctgtgccgaccacccgtaaatttttttgaaaatttcagtggtaatttgtaaacatattttgcacaaacaatgccatatgattaaaacattgtataaaatttcaaatactgtaatatgttaaatgttttttctcgaattctctttttcaaggacattaaattcaagggcagtttcaaatttcaaagttagagggcctaatttcgaggacccttgccatttaaggacgaatgggagacctcacatactacctatttaccgcaagtctttggtaatagacggtagtagccagtccccctctccaatttttcgaaatttttttttttcataaatcagaaagaattttgagactgacacagattttaacccactgaacattaagggtgtcgggaacggcaaatgaacattggcattgcacaggcatttctcaacaaagtgaaggtcggtttctgtaccgccagttccgtcccaggcatgtttaaaacatcataacttttttcacagttggccaaattttataaatttggcatcattcggaagctctacatatttaaaagcagtgataagctatttctaagcgattgaacaacttttaaaaaggttgcaacatgaattctgcaaaattcgattttgcatatttttatttacaacttttttacatgtaggtatatagttgtgatttttggaaaccaatagagcttgttaaaagctctcgaatgatcccaagttttttgaatttggtcaacaaagaaaaaagttatggtgctttaaacttttaatctttctgtctattttcataaaatatacttttgaaaattaaaaaaagacgaaataaaatacaatccgagcccctgataaagtaacaaaaattttaaattagatacctaaatggaattataaacagtgacttttcgcttttatacccaaatttatatgtgccgacaaattttccgataattcattttcctttttctgtgaaaatcacactcaaaaagtgtataaatatggccacttttcggctcaaaaatcattccttccaatatttttttttcattttaatttctatcgtcaattcgtcaatttttcttctaataatttcacccattcatttcatttagcgttcacacattttgccatctgtcaaccaatcatcatcatcgtcaacatcgtccgtcaacagttcaacaacaaaacgttcaaaatggcgcagaaactttgcgcaacacaaccgccgtcagtggaggaagtggggacaagcgagagtgggagcgagtcggcctcggactccagctattcgttttcttccagtggtgagtttgagtgcggggcggggaagggcacaatttcaatttgtatccattaataaaactgaattttcagattcagatgagagcgaacaacccgccgggcatggaggaggacgttctcagacgccgcgcgagaagaaacaaccgctgaagaagaaggcgccgggcccgagcagtcgcaatcctggtcgacgcgtgaagaaaccgtcaacgaagaagtcgcctgctccccgccatgcaaacacctccaccaagaagcgcggacgtcctgccaagaaagcggaacaagccaaaccatcggacagcggaacagccgccgatagtggccgcgacgacagcggacgtgagttgaatgggggtggggaatggcacaatttcaattgtataatcctaatgaaattgaattttcagattccgaagagagtgcctcggggacgaagaagaaaccaactcgcaagagcgctgctgctggacatcccacgaaacagaaggcgtcgcgcggaggacgtgcgggcaacaagaaggcgcaggaagaacgctctgaatcgtcaactgaatcgggctctgatcgcgaggaggatgaagaatgaatgagccagccggagaagaatgctgcttcacgagaccaccgcgataataacactaaccccaatttaaaaaagagaaattgtatctctatgtatgaatatgtatatattgtatgtccatatccctgtggcattgtcttgctgaatgtaattctcccataaatgtttgttgttctatttaactatgccatatatatgtgtatttttaataattgtaatatgtttgccctgtttatgcatgtttatggtcatttattctcattgccgaataaatacatttatatgaatgagtacattttccatgtcatcatagcaattcctctaaaacttgttgatttgtcgtggtgcctatgagtagggctccaatttttaggcactaaaaacggttaaaaaaagtggttgaagtaccgagtcaaaagccctttctactcgagatttaattgagacgaatcgggatttgttgcttaatgacccaattaatcccaaatgcctttgtcactttgcatttcgcgccccctttcccgtcattctctgtccctttttttacttattgattcccctccgaggttcttttctactactactgctagcactataaaatggggcggagtgtgtgtttcattcgcacaattctcgacaatttgtttgctcttattttatttggatttggaaatttaagctgagcaaaatggccccccgggcgcccttttctgttttaattatttcccatttaaattttattataaaggttaaaggagagagcggggatctcgcgacgtaactgaatctatttgcccccccccctcctcattttggtcaattagtcatgccctcttgctcttgcagccctcccccctttttgcccccactaatcgattctcaaaggtcagtcaattcgttggtccgtccgttcatttggccgtttgtcccatcgattgattggtcggtcgtcgatcgatcagcagatgtttgttttttctttgcccatcacccggcacacaatatcagcagataaagtaacgtaatcacgcggtggcggcatccttttcatcgattacgacattcatttaccgtagcaatttatgccaatgaactcgctgaacatgggcaaagaagtggccaaacggtggatggccagcaacaacagagtgagtgacggaaatatttttttttaaatacgaaatgaaattccattttaaaaatgcaaaaaagcgctgaaaattacgaaattaaaaaaatcaaagaatgggagaaaaacagcagagagagagagagcatcatgggaaagacgctgtttctttgctgaatgaatcaaaaacaaacttaaaaaacgaactctgagctcattagcctccccccccctcccccgccttcggctgtctctttgccgtcattattcgtttgttcccgtcggcaatcgccgccaccaccattttgtcggccgaccaaagtacgctgtggcgagggggtgggggagggatacaaagggggggggggggacctttgggcctccccgccatccaattgggatgggagccggaaaatgcgacaccagaaaatgcgacaccaagaaaatccgacaccagaaaatccgacaccggcggaaaatgcgacaccgtagaatttttttaaaaaacggaaaatccgacaccgggaaaatacgacaccaaaattaaatttttaaaattatttttaatttaataaatgaaaatgaactacttattttccttaaaatcgaacattgagctataaaaataatttaaaatgatttaagtaatataatataaaatgaactatgattagttcaatgcaattctcatgaccctttagtaaagtggacagcagataatacaaaaaattcttatcagtttccgatttgcatatggacgagaattttcatcatcggcaattaattccctcaaaatatttacccacccacccattctcctgtcgatttctgcaattttcgtgagaagaaatcgacgcacaaaaaaacaattcttgtccacgacggttatgagtacgggttcgacaaattaagccgtgcagaccccagtaatattttcgccatcctctgcaatatttgcgcgcaatttcccaccgaatggcagaacctcttcaggacaaaaatcaatgatttttcatttttatagtttttaaaacgtaactaagaaccttcatttttaaaattaaaaataattttttaaaatttaattttggtgtcgcattttctgttttttaaaaaaaatttacggtgtcgcattttccgccggtgtcggattttctggtgtcggtgcgattatgatgagcgaaaattatgttggcactttgccatttaaatattgcctaattgtttgtctgtttatatttgacctttgcttgctcgcaaatgcgtccatttccgttgtgttttatgtgtattaattaattaattgtgagtaattgttgaaaaacggtaaaaatggttgagggtattcgttacttttcgagtttgccaaaaatatttcaacgatttgtaccgggggtaggacagggaccggaccaaaaaatgacgcgttagagaatgtagcaaaaaagttgccggtgatacgcaaattgcggtcgccttccacccatgtcttggaatttacctacgtttttaattttcgtttttttagagccattaaattttatggattcaaaaattgctgttgctcaaaatcacagcaccagctacctattttgttgtacttagtagtgatgttcgagagtctcggtctcgactcgagaaaagtctcgggttttttggtctcgagtctcggtctcgggttttcagtctcggtctcactttcgagactcgagaccgagacttttttacacccctaatgatcggctttttgtaagttagaaataaatatacttttggtatatttttgcttcattacctcaatagtgtgcgtggctcagtgggttgtgttcttggtcatgtcttcattttagcgttggatcggtacccctccaagtatttattttttcttctaatttttcaaaattattccttttaaagtgaatctaatcaaattaaaatcataaaatattgtcatttttagtactaaatttgttcacaaattgcactcaaattttaaaaattttccccggcggcgcctatcggcaccgccggagctccgaaataccctttatttttttaaattgacacaaaaactgcgaaaaaatcaaactaattttttgttttgtgcttttttgaaatgataaatattgtaccaaattgaatcaaaatttaaaaaaaaccaaaaattagttaagaatagagtcaaaaaaaatttttaagcgaataggaaaattttttgaaaaaagtctcgagtcttgggttttttgggtctcggtctcggggtcggggttttcagtctcggtctcggtctcggggttttcagtctcggtctcggggtcggggttttcagtctcggtctcggggtcggggttttcagtctcggtctcggggtcggggttttcagtctcggtctcggggtcggggttttcagtctcggtctcggggtcgggtctcggtctcgagtctcgggaaattttcggtctcgaacatcactagtacttagaacctcaccatccacgaatataagctgcccttggaggagggttgggtacttgcacagtttggaccacataaaaattttctttgttttttttagataaaaacgtgcttccaaacgtattcggggtcgctgatcacgaatataacatccatttcgaccagtttcgaaccccggacctgaactcgaacaaaagtcgaaaattcgtttttcacctaatacttttattgtctaaaaccgatgaaaatacaatgaattgaatagcaaataggggattcatggccattccatgcattcgaatcgattttgaacaataacgatggcttctatcagcaacaaaacaataactaacaacaaaataggtagcggtgctgtgattttgagcaacagcaatttttgaatccaaaaaataaaggaatgaatggggtccgaaggcgggaaaattttggccaaatttttaacaggcatttccaataacgtgattttttgatgcatgaaagcaataaaagtataaatatatcaacctacatgtatatgtatgtatataagaaaaagtttatgccccgcccatttttcgaaaaaataaacaagctcatattcgtgtgatcatctccataaattagactataaacagctttttatttgaaaatctcggggggggggggaactcacaaaacaaaagtaccaaattcccgagcaaaaatcaaaaaattgaagtcttcagttcagagtccatcttcaaaaacttccaagatttaaaattaggtaggtatggtgaagtgttggatttttctgtttttgttaattttttttcatttaaaagttttttaataaaaagcacgccgcagaaaaaaacattttttatgtcaatttcgggcggaaatgagtaacaacactaattcaaataaaggaatcaacaaatgaaagtgagagagcatttctcatcaaatccgaatccaattggttgagatcgttgaccatttcttaaatataattaataattttcgttgctttcattcgtccgctttttcttttccttcttccgctggtggcgacaatggcctaaaatttagtgaaatttgaattggatgaattatttcggagcaggacaaaactcggccaagaaaaaatcttataaaaattctttctaagaaaatttgatgaaaaaaaaaattcaaaaaagtttcaagcgatttttttcagttttataataaattagttttttcaaaaaaaaatcgctgggaatttttttaactttgtttttcttcgagttttctaagaaaaaaattttctatgattttttcttgaaaaatttcatcaaatccgttgttgctcacccaatgcatttactgatggtaccccacaaactaaagtggacattgttcaaattgtcgtctttcttccgctgaaccgtcgccgtctccccgacaattattggacatcgtttcatcagccaattacactcggattcttccaacagtatcagcttctcatttgtcgcttcgttcaccacttcaaaaaatggttcagttacggtttgcgttgctttcatataataagaaattcgaatat

SEQ ID NO: 331 - DNA, 2515 bp, Heterodera glycines
ttggtacgggtattttctgatcacatgaagcggttgtcgggatgtgctaaccatgcccgaaatgatgaattcgatggccaagccgaatatggtgcctatggctatgttgatcggttcattcgaaactggatccaacaatcagcaaaccaaaatcgggcagctttgtttccgatggaattgtggaacatgtgtgatcggtaaaaaaaaccaaataataattaaatgaattttgtaaatgatagggtggaaggcgacctctgcagaaccaataacagtgttgaagcttggcacagaaatctgaacgcgttattccgttcaccatcgccacgtctaagcatttttcttcggaaagttcggcaagaagaaagccattggcgtcagcaagttgaagactttgcaaacaacccagcaaatggaatacgtggcaagggaatgaaacgcaagcaaacttatgtggaccaagacatgaatcttaatgagttatacgtcacgcgaaacaatcgccatcctctgcaatatttgcgcgcaatttcccaccgaatggcagaacctctttaggacaaaaatcaatgattttttcatttttatagtttttaaaacgtaactaagaacctctttaggaataataattgatttatttttcatttttaaaattaaaaataatttttaaaaatttaattttggtgtcgtattttccgggtgtcgcattttctgttttaaaaaaaaaaatttacggtgtcgcattttccgccggtgtcggattttctggtgtcggattttcttggtgtcgcattttctggtgtcgcattttcagggagccattgggattcgcatttcatttcacattcatcactcctcacttatattcgctgtcgtcgtcgtcccatttccaaatgcagtaaattgaatgaattgggcggggggacacacaaaaaacaatatgtggcattacacatgtttttccaaattttcaactctttttttccatttttgcgtttccatttttgtccttttttctcagagaatggcgcccttttccctttcgcccgtcgaccgaatgcgtcaaagtgtgttccgagttcgaagtcgtcttgtcgtcaatttgttgtccgaggggttggccacctttctgctgctgctggtcggcaatggcattggggcacaacacattttgggaggggggaagctggacaattacatgcaggtgaatttcaaggggaagtgccaacggccaattcaatggagccaacgagaactaggaacaacagacaaatgggatgggagagaagaacatttatgtaattgagtgtcagtttgacaactttagctttgccaacggcaaaagcccaaacaaagagttggccatagctaaagctccccgggtaaagcagagggggggggaggttattttaagttagcttttccatttttgcctccctcatgccatataaaacgacaaattttcaaattcattcatttctttattatgtaccgagtctgtatcgttttggcgccgccgttttggcgccgctgttttggcgacgccgttttggcgacagggtcgttttggcgctgccgttttggcgccaagccaaaattaaaaaattgtgaatccaagatcgattccaatttttaaaaattaaaacttttcataaaaatgtaaataacaataactagggccccgacttttagtgaaaaaactttttttttgctcaattgttttgaagaaaggagctcaaaaaacgcatttccgcgtaaaaaatttttcatttggacgtcatttttcgtcactaaaaatcactattttggcgttttgtcacttaaaatagtgaaaattcacttttttggcactttttcgtcactaaaagtcggggccctaacaataacaaacaaaaagaagacaaataagaaaattcatgggttcatatgataattgcgcgaaacgccacgaaaaaattccaaaatgatatgatgattttgatttgggttaatgtggtaattgtgatcgttatcattgttcgggttcacggaatgtaattctgcaccaaattgaagaggcgcttgtctgccgcttatttctgcgtctctgattttttggcgccaaaacgaccctgtcgccaaaacggcggcgccaaaacgaccctgtcgccaaaacggcggcgccaaaacggcgtcgccaaaacggcggcgccaaaacgaccgattcccttatgtacccaagccggctcaccaaggaaaatgcgtcagtgatactgtgtttttttaataatattctgtagctttataaaattgactaggaacatagttctgaattcaccaaatcaatttttaaaaagtttgtatactttaataaaattttcaaaaattcctaaatccataaaagttaaacaccgtgaatggattactgtaggtttttcctatatcaattcacgcgtaaaaattataatcattccactatatatgtacaatatctcgtttcaaagtaatactttgccactgacgcattttccgatca

SEQ ID NO: 332 - DNA, 12103 bp, Heterodera glycines
tgggattttgcgtaggatgcatccgtcgtaggcattgtaggcatgcataataccgtacatacctttctcgtctgatgcatctgttgtaggcattgtaggcatgtatgctaccgtagtgggattctgcgtaagattcatctgccgtaggcatcgtacgcatgtacgatttctggaccgttgaatatcgtgagtaagttgatgcgtacgcacgcatctaccgtaaagccttaatttaccatagtcatgtagacaacgtaggcatcaagaatacgtatgtgttgatggacgtacgcatttctggagcgttgaatatcgtgagtatgtggatgcgtacgcacacatctaccgtataacattaatctaccatagtcatgtagacaacgtaggcatcaagaataaatatgtgttgatggacgtacgcatttcaggagcgttgaatatcgtgagtaagttgatgcgtacgcacgcatctaccgtaaaacattaatttaccgtagtcatgttctttgcattattttgctgcgaaaaatattggtggctggcgggggatttttttaatctcttccattactgtctcggctttgctgggcgatagatgaccgtggcttttaagccacctaattaaaacgaacaaaaaagcaaaaacacaggaaatgcaatgatataattagaaaaaagtaatacatgcaaaagggtttcattatgctcttcaggggaattcaaaatttgtatgtctggcttcgttgtattagtgttattcattttaaactaaatttaataataaagttatttataatttatccaagctttgaatcggtcacaatgtgccggttgtaatcaaccataatcatttgatcaaattctcccatgacaatgagatgtcaaatgaacgctccgaattagccatacccagtgcctcatacatgtcaacaaaggcgtagacatagtgatcttttgaaaaatttagtttataaggaacagctgggtagacaatccctccagcatgtatcgaaatttaacgcaaatcaaacggctcaaacatgaagggactcagtttgtagtcaccatgaaatgctgaattgccaaccaacgcagttattacgcgtcgaggaatggtcgcgctgaatacattgtactcaaattcgtatcgaccaacactgatgaatgaagacttgatttccgtcttgcgtacagcgtacgtggcgggttgtttttcaagtgttttgtaaaggctcatatttagtgagggttgtacctcaaccattttagcataaatcttgacatcatgaacggccaaacgatatttcgttgcatcatttgcttttaatgtttgcaaaagaaagacatctttggccttgtaaattgtgaagagcaagtccaaattatttaagagataaagctcttggtttcccaaatcaaagtcgagacgggagaggaattgcgcatttttaccactcttaaaaattttacaacgctctttgaacccctcgtctgttgagtcatcttggtttaaggtgtgataataccctgttgaaccaagaaaatttttcttggcatttattggaaagcttaactcattggtgatataggccttgaatgggtataggtttccgctatcgtatacttccgtgttgccaaccgtaacttttagttgctggacaaatgtttgaccaatcccttgaatggcagagacactagtatccgcgtcctctatcgcaacccatttatcgtttgctcccggtttttcaatgtacagttcgagataaagatatatccgagataaatcagtccacaaattgtcactgtaaagccgaaataggtaaggcgattcttgcgtgattgttgcgagcggaagcacctgacgaaagaatgaacgaacaacatacacattggtaggtggaactgagaaaatattcagaccactgttaattgctagtggactgctgtcactgattttttgtgggcaagtcgtttttttagtaggttcctaatgagtcaatacgcagacgtttatttttggttttagcaaccataggtggcccgattgatgactgcagtttatttatattttttcgcctaatttttacaatttttggagtcgagtcttttttgtatcgcttaaaatcaaaaccttggcccttctgagtgtttatgttgttggctgctttttcaagaaggttttttagtcttgatttactctcactaacgagcgaatctttgaggtcttttccctccaacacattggtgaggacgcggtttccactttccattccctgacgtccaattgcagagccaatttgctttcctatcggcagcaagtatctcataaggctcctgaacactgcgccaactcccgctccacgctgatagggtaatccccggtaaatgttgtatccaccaaattgcacatactcggacgagaatgtggaccaatccacttgtagaggatcaaaatcaacatgcattttttttaaaaattaaaaccgcacctgcgttttccgctctgtgtgaggggtccgcacggcgtgagagagggtccacccggcgtgagagagggtccgtaaggcgagaggtgggtccgtctgcgtaagatgcatctgccgtaagtatcgcattcctggagtattgtgtaggcacgcatctaccgtataacattaatctaccatagtcatgtagacaacgtaggcatcaagaatacgtatgtgttgatggacgtacgcatttctggagcattgcatatcgtgagtatgtggatgtgtacgcacatctaccgtataacattaatctaccatagtcatgtagacaacgtacgcatcaagaataaatatgttttgatggacgtacgcatttctggagcgttgaatatcgtgagtaagttgatgcgtacgcacgcatctacagtaaaacattaatctaccgtagtcatgttctttgcattattttgctgcgaaaaatattggtggctggcgggggatttttttaatctcttccattactgtctcggcttcgctgggcgatagatgaccgtggcttttaagccacctaattaaaacgaaccaaaaaagcaaaaacacaggaaatgcaatgatataatgagaaaaaagtaatacatgcaaaagggtttcattattcttttcaggggaattcaaaatttgtatgtctggcttcgttgtattagtgttattcattttaaactaaatttaataataaagttatttataatttatccaagctttgaatcggtcacaatgtgccggttgtaatcaaccataatcatttgatcaaattctcccatgacaatcatctccacaccaccaactggaattggtgaattaaatgtggctcgtacgtttgttgtgccgcttctcaacagctcaaatccacagctgtcgtcaagtgtggatgtcatgacaaaaaaggcccacccttttttgaactgggtcattgagatgtcaaatgaacgctccgaattagccatacccagtgcctcatacatgtcaacaaaggcgtagacatagtgatcttttgaaaaatttagtttataaggaacagctgggtagacaatccctccagcatgtatcgaaatttaacgcaaatcaaacggctcaaaaatgaagtgactcagtttgtagtcaccatgaaatgctgaattgccaaccaacgcagttattacgcgtcgaggaatggtcgcgctgaatacattgtactcaaattcgtatcgaccaacactgatgaatgaagacttgatttccgtcttgcgtacagcgtacgtggcgggttgtttttcaagtgttttgtaaaggctcatatttagtgagggttgtacctcaaccattttagcataaatcttgacatcatgaacggccaaacgatatttcgttgcatcatttgcttttaatgtttgcaaaagaaagacatctttggccttgtaaattgtgaagagcaagtccaaattatttaagagataaagctcttggtttcccaaatcaaagtcgagacgggagaggaattgcgcatttttaccacccttaaaaattttacaacgctctttgaacccctcgtctgttgagtcatcttggtttaaggtgtgataataccctgttgaaccaagaaaatttttcttggcatttattggaaagcttaactcattggtgatataggccttgaatgggtataggtttccgctatcgtatacttccgtgttgccaaccgtaacttttagttgctggacaaatgtttgaccaatcccttgaatggcagagacactagtatccgcgtcctctatcgcaacccatttatcgtttgctcccggtttttcaatggacagttcgagataaagatatatccgagataaatcagtccacaaattgtcactgtaaagccgaaataggtaaggcgattcttgcgtgattgttgcgagcggaagcacctgacgaaagaatgaacgaacaacagacacattggtaggtggaactgagaaaatattcagaccactgttaattgctagtggactgctgtcactgattttttgtgggcaagtcatttttttttttttttttttagtaggttcctaatgagtcaatacgcagacgtttatttttggtcttagcaaccataggtggcccgattgatgactgaagtttatttatattttttcgcctaatttttccaatttttggagtcgagtcttttttgtatcgcttaaaatcaaaaccttggcccttctgagtgtttatgttgttggctgctttttcaagaaggttttttagtcctgatttactctcactgacgagcgaatctttgaggtcttttccctccaacacattggtgaggacgcggtttccactttccattccctgacgtccaattgcagagccaatttgctttcctatcggcagcaagtatctcataaggctcctgaacactgcgccaactcccgctccacgctgatagggtaatccccggtaaatgttgtatccaccaaattgcacatactcggacgagaatgtggaccaatccacttgtagaggatcaaaatcaacatgcattttttaaaattaaaatttgacgttcttatcattatttatattctttgaaaattatgctttttacaaaatagtttacgagcttatcaggttgcagttttccaaagtgcaaaaggctaacaattttctcaaaggtcactccaacacatcgacagtacaaaaagaaaattacatgtcgaccacacgcacttgagttgggagactgaagggggagagagttatattgaatttgtttgcaacgagacaaataatccacaatgtgaacactgggcggtggccacatccctaaggagtcataatattccaaattcaaaggagaaggacaataaatgcatacccaatgagagccatgcgaggtgctggggtcaatattcactaccatacagtgtggaaattttacaatgacaccggttggtatttggtctgccgcaaaacaaccaatataatagtggcgagttacgttgttgtttgccaatattttgtcaatttccaaagtgttcattatttaaaaataggacatttttctaaagttcagtgttaatgtacatgttccgtattggaatggcatcaagcttccgctattggtacggatctcaatcagaatttcagaaacttcctttaataaaattttgtgatactgtatggcaaaaaattgttcttcaaccacttggtcggggtctccccgtatggttacaatgcgtaacactggggccgtgacgtcgccaatcatcattggttcaataaggtctggagtgtaaacgtgaaaggatgacacaccgccgctcatgtctggcatgaatcttgcctcctttttgggctgtgtaaactctgtgttgttgaagccgagaatgtaagcaagttgaggcgagatttcaacctttttaacgtaccgtgggtcagtgttcagaacaaaacgattcctactgatgtcataattaaattggcagactagacgtatctcacggtaggcttgaatccatgcttccgttcccatttcctttgtggcttcgaggatcacacgttcctcttctgtcaaatttttgatttcggcattcaattttatcatacccaattcatcaacaatgctcaagtttttctcacttaatttagaaaagtagtcatccaattttttctggtacgaatcgttatcgtcagttggcgttctcaacgcgatattgcttgtttcagcatgcttttcgcgtgccagaaggccttgcgtcacggtgttgagaccaaccaatggtccagtatctgtcattagggcctgtaggagcagctcttcgtcacggacgcccagtttttctttcgtttttcgcctaatgtactcttctctggcccagcggcgagccttgtttgttgcaagcatgaaagaattctgtgttgagcgaaccttttttgccaagggatcacttccgtcagccaagagcctgtataaatttttgctaagctcgtgggggttggtgacatttgatgatggaagctcaatccgcaccatattccctgtctgccactcaatctgaacaaattgttgctccacagtgcctatggagggccaagagtggggatacacaataacggcaagacccacctcccattccgaattgaattgcaacttgcgaggtaaacgcactcggaaagaatttgtcctattcccttctatattggtgttagacggaaggacaacataaaaagaatttgaaggcattttttgttaaaatttattaaaaactgctttttatatagatttctcgctaattgagtgtgctgtaatccaactattgaagcgagtatcgtaacctttccatttcacaagtgcatattttacaccgttctgcctctttttctttaatattttttcaatttcatacattttttgctgtttgttttctagcgttttgcataaatcatttgcgtaaaaccaaccactaataatttcattattgtcatcacgcaaccgatagacaactggtgaacgctcagagtgtacctctaccaccgtgaagagttcattgctgaagcgtgggaggtaacccttttggaacacgtgcttatacttttcaatgcgcacacgatcccccacacggtattttggctggtgtcgtagaacatttgaagctgcatcatgtaatttttgtctcaatgcttctgcgtttttaaagttcacgtctgctgggcacattccaatgctcgaattttgcgagtggttaattgcgtaaacaaggtcttgcacaacacctatccacttgtacgtgttatgctccgtaaagtagcgataaagtcgctctttgatgctccgattcgcacgctcagccattccggcatgaaattggggagaagtgagcatacaaaagtgttcaacgtcttttgtgcggaaaaactgttgcactgcgcgggcagtgaattcctttccctgatccgttagcaccttccaaggaatatatttagaccttttgaatatttgttcaaaggcattgatcatgttagcgctcgtcttggtctttacgggttcgacaaacacctgtcggctaagggtatcaatacagactagcaagtacttgtagccacgattttgtttagcaattcggtcaaaaatagccaaatcggcctgccattcagtatgcaagccgggtgccaaggttggcaaacggcggtagcgccgctttgcctggcgatgcagtgtgtatgtacgttgggtagctaaataattttgaacatcaattcgattaatttttggttgacttttccgcgcctctttcagaagcggctcaacgctcgtgaatgagacaggcgaacttaagtccttgtacaagaactcgagcaaacgaaagtttttcaaatccatatggatggtttaaacttaagtaaagtgtttttataaattcctttgccggattggccttcggaaaataaatacctactcaattgtcgattctgctttgccctttcaataaattctttgaatgctgttggctctttttggccacgcttgtccttattcagcaggtgactaacaatatcatcgacactgctggttataaatggccgtccacccgctctcaagacctgtccttcctccgacacccccagagattgagcgtttttataaattaaatttaaaatttccatttgtgtgggacgtttatttgtactcgacgcgcgtggagtttcataatcatcttcatcatcatcatcttctaattgttcaacattttcttttcgcgcacgcccaaccttgagatggcgacgagtagctacaacaatcggtcttttaatgttgaatggttttggcatggcgtcaacaacatcactcaaattttctaatttaacaccgacgggacgttcatcctcgtcctttttgagcttgttgagacgcttaatttcctgctcatatttgactgctctttccgcctcatttatggcgtcatcattttttatttgtttaattctggcacggaccagcccaattggtgaaccgtcagacggtgacagtgttgccaaactctgataaatctcttcggggaccaacaaatagcgctttgtatgttgcattttactttttttaaaactttatcaagcactatgtataattttcaatgacgttcgcaataagcggaagggcaatcgatgcaatgagccctacaatggctgggaggccgtctccgtgctgtagcaaaacgtttttggcagagcgagaacaacgtgtgcgggcgagacgacgaagcatctgtgcgtgagctttcagcttctttaaatgacgtggacgcaatggaactcggccctttagaatgttcagacaaatttcgaccatgcataatatttgttcatcggatgcgtctctaataacaattttcgcctttttggaattagacagtgtctccaaaaaggattcatttcttgcaatcaattgcgaccctttcattttggcatataaactatttgtttttgttcatatatatttgttctaaggcgaatctcttccgaactctccgggtgcatgtcaaccaaaaggtagccaaaatttttagcgcatgcgtcacgataggcttccataaagtatgcggtccttgacgggaagaggtgggtggctattgtgcgaatctgaagggcgcccgctggatttctcattaacaccaaataatgtgagtttgtacgagagacgcgcaactctttgttgaacaggtgttgggtcaccaaaattacgctcacgccccaattgtgtgagccgcgtgtgaagagcgcgtccaaatactgttgactcatccccaccaccaaatcatccaatattagcaagagtttttcttttttggcgcaatcgcgcacctgttccgcagatgggacgccgctgtgcacagtgactggcacattgccaattttaccagtgcgttgtaaattcaaaatattagtgttcaactctccgtaaccataaataacgcgctcaattggggtagagatcattttctctaaattgtgtagcagacgcattacccactctgacttcccactgcctgtactcccagacacaatcattgtgaatggatgacgaaattgcaagtccacgtgatcaatgattggaaacgaatccattttttatttattataaattcgttggcattttttatatatatatatatatatataaatacaattagatttcttttacagattctttaaaaaaatggatttaattcttgctaccgattggatacataacgcttatcccgaaatggaccaacaggaccataacaaggaaccgccaaaaagggaccagcaggaccataacaaagaaacgccaaaaaacgaccaggaggatgaggaggagacgaaggagcctagctggatcagcctcattgacgaagagcagaagcaggaccagttcaccccaatttatgatgagccgccaagagcaagtattcagttttcttttttttttaaacaaattgattaatttaggtaccccaaagacttgtgcttgtgccgaacgacctcgcccgattccgctcgtcgagcatctatgcaagcggttcaactgtagcgcgcatgagctgcacgtgttgttccgaaacttggagaagcgccgagacattgtcgagcacttgcgctctgctcagctgcgaaccgcccacttgcgcccttttgttcgaaatttcccggtgcgctgtaacgacctctccattctcgacgcacactcagccccggcctaccgcggcttcttgggaattacggtactttttttttggaaatttggtggacataattaaagattttaggtacgaatgcattactacataaaacatggaatccgtttgcatcatcccaacttgccgtgtgtcgtcgaatttggaggcggagatcacaaaacctttttcccgcttgaaatgctcactattatgttttaaatgttttccattatttaattgttgttgtttttttttttaataaaattgttgcgtaaaattttttttcattttaatttagatgaaaatttctaactgtactgtcatttttaaaattaattcattgaacacgcaacagtttttgactattgcacaacgtggaattaatacagaatataatccacgccgtttccacgcaatcatcatgcgaatccggtatggagcaaaaactgtggctgcactcatatttcaatcggcacgtgtcgtcctcactggagttccacaccctgatcaagcccaaaagtttgcagcaagggttctacgacgaattcaatacactcaatgcagaacaatgacaatctatgagctgcgtgtggtcaacattgttggagttttaacgtttgaccaaagaattcgagtggagaaactacaacaatctctgggtggcatctatgaccctacgatattcccagcccttcggtgcaaattagataatggagccacgtgtctcatttacatttccggaaaagttattctcactggggtgaaagatgtagaaaatttaaaaaattcatttgattacttgtctaaaattgttcctaattattttcgataattttatttaatacaaataaatgcttacaaaaaaaaaaacaaaaaaaaaatacattgaaaaataagttaaaaccatcgcgaatgacccgggttgggtgggatccgcttcaatcaaagtcctctttcggcgtactggtggcgggggcgggggctgctgttcgacatccattggctgtggagcgtcttccacataaccaaatgggcgcgtttgcatcccagggcgcacacgtccctttgcgtagaagggccgatagtccttgtgggcctcccgggtgaagaggtcggcctggacattacggtcaatctgtggaaaggagacgcggatggcgcgatgtgctccaccaccgtagacgaacaagtcgtcgttgtcaatgacatcatcactaaattgaatttgtattattattaaaaaattaaagtggaaactttttacatgggtccatcaatgttgtacgtagacagcgtcagctccttcattgcatcgaaattgataagctgctgcgttgcgtaggagagacggaagctccgtatcttcagattcgcacgttcatccgctctatctcgggctgtgtgtcggatgccgtagttctttgggcctcctgcgacgaactccacgatgcgcctgtccacgagttcccgcttcatttgtcccaacgcttcgccctccggtacgcacggagctccaatcttgttgacgtaatagattgagtccgtgtctgaattaccgtcactgataacattaaacggtagaagacaaaccacagtagagaacctcagcgttgttcaatgccaacacttgctccatatatccgtacagatggaggcgtgcgtacgaagtgacgaagatggccactggaaggcagttggtcaatggtgctttggcgaactcgggtcgcttccggacgacgacacggtccatgtggtcggagacgtggacaaagtccagtttgtcgtaagtcgagtcgtcgagcagcttgtggaattcggcaggcgtgcgcgtgtactgtatctcagtgtgaccgacgcgctgcgcgagctttccccttcaaa

SEQ ID NO: 333 - DNA, 2705 bp, Heterodera glycines
atggaatccgtttgcatcatcccaacttgccgtgtgtcttctaatttggaggcggtgatcacaaaacctttttcccgcttgaaattctcactattatgttttagatgtttttcattatttaatttttgttgtttttaaaataaatttgttgcgtaaaatttttgtccattttaatttagatgaaaatttcaaactgtactgttatttttaaaattaattccttggacacgcaacagtttttggctattgcacaacgtggaattaatacagaatataatccacgccgtttccacgcaatcatcatgcgaatccgatatggaacaaaaactgtggctgcactcatatttcaatcggcacgtgtcgtcctcactggagttccacaccctgatcaagcccaaaagtttgcagcaagggttctacgacgaattgaatacacacaatgcagaacgatgacaatctatgagctacgtgtggtcaacattgttggagttttaacgtttgaacaaagaattcgagtggagaaattacaacaatctctgggtggcatctatgatcctacgatcttcccagcccttcgatgcaaattagataatggagccacgtgtctcatttacatttccggaaaagttattctcactggggtgaaagatgtagaaaatttaaaaaattcatttgattacttgtctaaaattgttcctaattattttcgataattttatttaatacaaataaatgcttacaaaaaaaaaaacaaaaaaatacattgaaaataagttaaaaccatcgcgaatgacccggttgggtgggatccgcttcaatcaaagtcctctttcggcgtactggtggcggtggcggggggtgctgttcgacatccattggctgtggagcgtcttccacataaccaaatgggcgcgtttgcatcccagggcgcacgcgtccctttgcgtagaagggccgatagtccttgtgggcctcccgggtgaagaggtcggcctggacgttacggtcaatctgtggaaaggagacgcggatggcgcgatgtgccccaccaccgtagacgaacaagtcgtcgttgtcaatgacatcatcactaaattgaatttgtattattattattaaaaaattaaagtggaaactttttacatgggtccatcaatgttgtacgtagacagcgtcagctccttcattgcatcgaaattgataagctgctgcgttgcgtaggagagacggaagctccgtatcttcagattcgcacgttcatccgctccatcacgggctgtgtgtcggatgccgtagttctttgggcctcctgcgacgaactccacgatgcgcctgtccacgagttcccgcttcatttgtcccaacgcttcgccctccggtacgcacggagctccaatcttgttgacgtaatagattgagtccgtgtctaaattaccgtcactgataacattaaacggtagaagacaaaccacagtagagaagctcagcgttgttcaatgccaacacttgctccatatatccgtacagatggaggcgtgcgtacgaagtgacgaagatggccactggaaggcagttggtcaatggtgctttggcgaactcgggtcgcttccggacgacgacacggtccatgtggtccgagacatggacaaagtccagtttgtcgtaagtcgggtcgtcgagcagcttgtggaattcggcaggcgtgcgcgtgtattgtatctcagtgtgaccgacgcgctgcgcgagctttccccttcaaatcattttttttttaatatatcgtagaaaaaataaaataccatagagagttcgccaaagtcttggcgatcagacggagacccgggttcaaggccatcttcgtcgggtccagatgaatcccttccgtacgcagaaactctgcgacgaaggcctgacgttgctcttcggcgtcgcatccctccggccatccactcgcctgcactttgagaccgacgaagctgttgacgtagctactgaatagcgtgtcgtcccactcagcgtagtcccacacctattgaaattggttcaaaaaaaatgctttaaaaaaacaacctcaaagaggtctgtgacgacgtagccgagttgaagtgctttgttcagctccacgtgggtgtacgcgcacacccacgatcgtttgtcgtcatcatgccgacacggtcgttgttgccgacggtccgcacataagccacacagtggaaatgtgaagcgctcgtctttggtacggtagccgagaagtggcacacggatgtttcgtggcgccagaacccgtacaaggagaaggccacggaaggtgttgttttctgggcatgtccacggaagaggtgccgtcggtggatggaggagcacttcacgcgtcagcaccatcgggttccccacgggaaagggattcaccttctaaaatttaattgttgaaacgaacccataaaaaaaatgcaaaccataacgtagggatagaggctgacaatgtcgatgcacagcacctcttcgtcgtcggcgcacacgtggtggagcttgaagggctccgtgcggcctcccctcaatgcgtcattgcgggggtccagtgggcatggcgtgaagacggcctcgtaccgttgcttcagctcgtggtcacggcggaggcgctccttccactgacagccccacatcacatgtagttcacagcctatgttgatgttccaactcaaaga

SEQ ID NO: 334 - DNA, 14667 bp, Heterodera glycines
tggcacctattatctgttgatcattgcctctaaggatttttttttttgatcattaggcacacattctcttttgatcagtgccactccccaatttttctttgatcattaggcacacatcctcttttgatcagtgccattctccttttaatcaattggcacatatttttctgatcaataccattccccttttgatcaattggcacatattatcttttgatcagtgccattccccaatttctctttgatcattaggcacacattctcctttgatcagtgccattctccttttaatcaattggcacacattttttctgatcaatgccattccccttttgatcaattggcacacatttttttctgatcaataccattccccttttgatcaattggcacatattatcttttgatcagtgccattccccaatttttctttgatcattaggcacacattctcctttgatcagtgccattctccttttaatcaattggcacacattttttctgatcaatgccattccccttttgatcaattggcacacattttttttctgatcaataccattccccttttgatcaattggcacatattatcttttgatcagtgccattccccaatttttctttgatcattaggcacacgttctcttttgatcagtgtcgttctccttttaatcaattggcacacatttatttttgatcaatgccattccccttttgatcaattggcacacatttttcatgttgatcaaatcgccgcgatttttatttgatcagtctctttttcgatcatttcctttgatcagtcccaccctgaaatattcatttatacaaatatccatgccatctatcatctatgattctttcatgcatgcattattcatgcaaacattcattcatgctagccttattcaatcattcattcatgccatgtgctttcatagagtcatgcggttataaattttcatgcattacttataaatgtaataaatattataaatggtgcggaattagcttatcgcattcagatgagaaccaaaaatctgccttccaagctttccaatcccgaagttttaacaagtgatgagagttcagcaagttttgaaagccctgcggggaccatttatgaatcattcgaggcgttgagcattgatagctcaaaagtagcttcaagccctgaggggtacactaatgttggggctgaaatcgttattgaagagactgaatccaatgaaaaccctgaggggtccggatatgatgaagtgagaaacgagggtagtagcgtcacgtttaaagcgatggaagtggcccttgaccaggtcgatgcagagggttttgcgaataatggctttgatgatgaggagcctgaagcatgtcctccggctaaagatgtgagcaaatcatcgcttctttatttggtttcgcaagccggagatggctacgtaattgcttgcaagaagtcgcctaagtcgaagccaaattggccattcttcatgaacatcgaagacaagctgattgagtcggcccctggctttcagcgtaaacttgaagttggtgattttgtggcggtttcatcatttgagtggaaccagaagctgcgatatttggctgaacatcgccaagatgccacacagtcctgcaaattttggttcaacgaaaacacgcaactgttgccaaagcaggctgatgccactgacgtggttcaactcatgtacatgaacatcggacgcaagcagatcaccggggtcgtttactggataaagaggaagatccaaagcgttccatccagcttcgttcacgcaaacatcgcgtgctgtggtctagcggtttcggcacgcataaatcggcgtcatcttgatggcatcaatccggaagacctcaagctgggctcacttgtgacggtggttgttgccaacattccacaggactcacttgtatcaatgggatacattctgcctgatgcttcaccgtacaaactgggaacggaaagaagagccgaaacacctgaatttttcggtgcagttgcgtgcattcgtcctcatctgttggagtggccaaatctgaatgcaaacatgacgcccaaggtttatccatgctccgcggatactaaacatcatgttgtggcgatggagcatgttgttggagcagctctccagattgagatggagcgagaggttgacatgatgattgaagcacgctttgaaggaagggctcggaagttcgatggtgctgattgtctgattgtctttggttcgagatcgaagaaagaagtgaatgagttggccaaggtctgggagccggagtcccaagtgaaggtcttcaaagaattgggtgagaagcattttgctctgggagtggtcaaggatgttgaggtgctccacgcagaatacgaaaagttggaactccacatcgtcatcttcttgaacaacatccaggaaaggaagaatgtcgacatcgcaagaaaagtggatgagttcatccagggtggcagtgttgtcatacacccggtccctgccactgcggttgaagacagactgttctgcttccgctgcaacgtgccttcgataattgctgatgaagactctccaaggggaaggataatggcagtcctactgggccgtccagccatggagggcattcgtatggagaaggaaagcgttgatgactcaacggattcgtggatggaagaagagggaccactccaccctgcaattcttgctctaaactcaagacagagagtgactgcacgcctaatgttgggaggaggtctggtgcaacaacaggcgccgccaggcaccggcaaaaccaaagtcgctgcggcgatcattaaggcaatgatggactccaatcccgggttccggattgtggtgatggcttgtgccaacattccagtcgcaaagctggtacaagaagcggaaggaacgtgtgctgcaaatgatttggatggagcgcgagcaattgccttattttccggttttgccagatgcaaatacacggatcaaataaaagatgttcaacggcatacgctgccgaacaaagtaaactctgaggagttcgtcaagcagttatcgcccaatgtacagaagcaagtgaaggagtaccttgctcattgtgagaagaacccgcgcttggcgcctgagagagcgattggaaaagtattcaactcatgtatggcaccgaaaatagtcttctcaacagctgccatggctgcgaatttacttcatggtgaaggaaacatcactgatgcagacgttttgctctttgatgaaagcactcaagctcagtgggcagtggtggttcacttggttgcgcggatgcccaagctcaaggcattgcttttgacgggcgatcgtcatcagctcggagtgcatctgcaagaactgcctgacatcttccactcaggatatggattggaaagcgtcatccttcaagcagaggcttcgatagggacgaactatacattcctcacaaagatgtacagaagccatccatttttggcaaagctcatcagctatgcctcatatgaattgcacaatgagcaactcattccagcaagaagcgctgaagaacgctcactcatcacgggctcagatttccttctgccggttcaagaatgtcctgtgggactaattaatgctttctcgtcatttcgtgtggacccaaaaagcgattcgctcacagatgaccatcaaacagaagtggcatcgttcttggtacaagcacttttggaacattttggcaacgctttttcgtccagaattatcgttctgtgtatgtacacgtaccaaacttcggaaattgaacgaaagctgaagcactgcggtgttcgtgcactcacagttgatgcctatcaggcacaggagtgcgatgtcatcataatagtgacaacaagatcaaaatactccgaggtgggatccggaaggacggacaacatgcacttctttgaagacgatcaacgggctactgttgctctttcaagagctcgccacgctgtcttcatcattggagacttggtctcaataagtgcaggacaagtgtggaaacgtttcatcgaaatggcgataacaagaacaagcgtagtccgagccgagtatgttttggcacttttgggacgaacactcgtgaggtcgtcgacatgcctatttgattcggccaaaagagaatcggtggaggatgaaggctttcttgaaagttgggcattgaagcatgggttgcgcctggaccgaacgaattcctttggacaacaacaatcacagcagccgcgagctccctcattccaattccagaatcgccactttcctgcactacagacgacagggccctcagatcaagccggtccatctggcagcggtggtcaacaaagaggtgcgcctactttggcaccacagtatggaagaggtcaaggaagacgtggcccggacaaccagtggatgcactacggcggaaacccgaaacgacagaagggtggcagacgctgaactcacatgacgtcctgcgggtctcacttctctccttttcttcaatcagcacggtatgtctttcggtcattttttttattattaattagttgggtaattttcctttttgacccctatcatttaagcactttattttctttcattttctctgcactcacaagctttttgatttcacccctccttagcttccgatgttcgcaccatttacactgtgatacaatcagtaaggacactttcccaccgcattacggttttaatagatttccgctattttttctcaaagcgatttttttttacactagttccgataacaaaatattgtaacactggaatgccagccacgcccattatcaagggcctttaatctaagcatttcacattcattcattcattcttccattctctcgttttactatcctctattttagatattcttgcacaattccactgctaattctcatctcacattcccattccctctcattatgtttcctttctctgatggggatccacctaatcgaagcgctgcggcgtcaaacaatgcactgacagaccctgaggggctctccaatgatttgcctgagttatcagtagttgataaattaatgtttgctggaaagattttaagcacaccagcacgtttgtctgatgtggacaagctccatacggacttagttcggactgaggatggtgtcaatcgcatgacacgtcaccttaacaggacgataaatcaaaccaatagggacttgactgaactcaaggatgatactcaaaccctgataactcaagtaaatactctcgcaaatagttatggtacagttcaagtgttgcaaaaccaaaatcagtcaccattagtcaacaaccctccggtcttaaattgggcaactccctctccactcaggaatccgaacaatagctttggcaatgctaatacttcggtgattgaagccatacatagtgaggaagaggatgaggaatttgaattaaatccttcgggattccatcatgttaacatgcttttcgctgaaagcagtccctctttcacgatcttctctggaaattctccattagaatttgatcgatgggcaagaaagttcatggatctgcttgactgcaatggcagaaagtgggatgattctgaaaaggtggcacgcctcaaggcatgccttgatggtgaaccaagacgaatctttgataatttaatgcctgcccacaaagcaacttcttcggaagccattcaaagaatcaaggaaaaccttgacactccacaaaataaagaactcacctatcaggcactaagcatgtgtaaacaaagggaaggagaatctgtagatgagtttagtgcacgactgattcctctaattgaggccaccacggcagaccttacaactaatgctagtgaggaggtactctgtcgagcatttttggaaaaattgaatccaaatctcaaatttctcactcgaaccctgagtgggcccgtcagaagggatttccaaatattgagaatgaatgcacgggaagcagaaatgatgcatagagagattcctaaatctattccagcacctcttttcccaatttcggaacaacaaaatccgagattcaacaacaccgagccgccgaaccacccggaaggcaactttagaacatgggctcccacaggctctaacagagagcctataagtcccagacagaggaaccggaacaattgggataacaatgcccaagcctcaagaggctcttttaacagatcaaataatcatcctcaaaatgacagaagatggaacaatcgcacttccagaaatgatagacgatggaataatcaaacccctcaaaatgaccgacgctggaatgctcggccagtttgcaactactgtgggaaggttggtcacctcgcgtttaaatgttttaaacgtcgtgaggaatttacccaagcatccaagaatttgaatttcatcagagcaattgatgaacaaaacagattgataaacgatctttcaactaaagtcaatagtttaacttttagaaacgaccaatccgctgaggcggcctctcaaaatataaacactattcaaaaactcaccaaatctagtacagacaaaagtccatctatgatgaatgatactctcaaagcaccctccaaaataagtaattgggaaacgagtaaaatggttcaaccgaaattttttcctgtgctaatgggtttgactcttatttcatctctctcttcgactttagttaaagatttcaatacaatcccagctagtccaatgatttgtcaaactcgcgttcaaccaatgacatggtctcttcccaaatttccacgatgccccaggatgtcaattgacacaagcaaaccactaaccaaacaaagacgcaccatctattttcccaattcacttgaattttctaccaaagcctgggcctgtcgcagaattatcaaaagtattcagaaatatactacaatcagtggtgtatctgtagaacaacatcttgactctgaacaaatagtgatgagtcatgatgaatgtctacgaatggcaaacaataagcactgcagcttaggatatctcaaaaatgattcagggttgtggcacacagataggaaaattgaccagacacctcgtccttggttattaggctctttttcctggaagaaagtccagagtgagaattgctttgcctttgaaactgaagtatattcgcacattggtgctacttcaattataactcctgcgggaaccgctcaagcttgtccatatgagaaaggaaactgtgtcctctttgacaaaactgtcttagtctgggtccctcaaaaggacaaaatgtgcaaatacagtcccatcggaatcatggatggacataatcttggaaatgtttggctttccactttaggagatttaggtttaaccagctcgattgtcagaaatatttctgattgcggtcgaaatctcactgtttctgaccaagggccagcttttacaatcaactcacaaaccccacgtcataaaaggggtatttttggattagattcagaaggtgtagtcacctcctctcagttagcatcacaactttcttatttacacactaacatatctcgttctgttaacattgcttttgctcaagcatttaactctttttgtgatttaatgcttgacacacaacgttgggtacagtcatcctatctcaatgatcccacaagccttacgaggtttattcaccaaaataatttcttaattgccaagcgagttggagtctctcttctgagaacatggccatgtgtccctctcagtcagtctgactttgaatttcgtccaacccataccaattcatcctgttttgaatttcttccaataatagtcaaattaaatggtaaggaacatattgctttcttgaaccctacgtatttgacagtctctcttcattctaaaacagctccttgcgaggaccagagaaatattttaattcaaatggctgatcgcacaattgaagttgaccaagtagacggaacaatcaacaatgttcatgtccatgaaatcagggaggttgagcttgactttggtaagccaacgcgcattccaaagctctcaccacatgccttccatcatctggtcattcttaatcttaccgatctcgccacacatgcctttgcttcaaacttggtacaagtaagtcaattcacataccgagctgataaaactcattcctctgaaattaaaactacgctctctgatgaatggtcagcactagaagaatctatagttcaaaaagctatgggaaattattccctggcatggcaaattggtatcaccatttgtcttttattgtgcatggtagatctcctgacacgccttttctttgcatacattggtatcagacttcaagatcccgtagagacattaggtcgaccaatgatcaccactatagctaatctttttggcaggaagaaacaaaatctagactgcgataacaagaaccatcctaattcgccaaccaaaaccattggtcacattacttcctcacatcttcgaagcgttgctgcaacgcccataaatgaggctacaggtcagtccttttttcgagatacgctgaatggtaactcatgtaactttattgaggcataccctcaatcatcaaactccaaggagttcaaaaaaatatggtttacaaaagaaactaatttctctgcttggttgaataattatctctcaaaaccagttaatcacgaaattcctctcctacttccgcggaactcaggcgaattagcacaattcctcgatgttgcaacacactttggaaaagaaattccaaatttcaattcaaaaattggtcccattagcagaatctcgggagatgaacatcttaaatgggacaagcaacgagtcgctgcttatcaggtaattttggggcatatacacatgctgattcatggtagaacccaaaacattccacaacaacgatttcataggcctcgctttgtaataagagagttaccaatgttcttggtattgtgcatgatattgcttccagcaacccttgctgccccaattacctcaaaaggtcctcctccgaacttaaaaaactcaacctttgagtcagcaaattttatatcagcattaccaaccattgtagccataattatattgagtgccttagtgtattcaaggaatcgttcgccaatcagtgctattatacgtgcaaaaattaatggtttagaaattagggcactagctgatacgggagcaacgataagtgtagctcctctctccttagcaaagaagataggatgcgagctttatgagtcaaaagtggaagctattagcgtctcctcacatgtaataagcatatgtgtcgtgggtgaagtaataataaaacttggtgatatatctctgcggagttcaattaattttatacctgatgaccaagcaggagccatgaaaaattatgaaataatcataggatgtgatatctttgttaacctgccaccaataacatttgacttcacaaaaaaggaagttatgataggtaagtcaaaactaaacatggaaacaagtcatagtaccctctcaaacctaaaagttcgagctctagagcactaccgaattcctcctggtactcaaatactggccaaagccaggatagatactatcttgccaatagacaaggacattcttgtagaaaatttggacccaagattgtctgatgaacacctaagcacaccagccacattttcaaggcctaaggacaatttattgaacattgtaatttgcaatccaaccaattttcctaaaaatataacaaaaaaaatatgtgcattgcgactgcatgtgaattaaacaaatctgatcatcctaatctcgtaatgaaatgcacctcgggtgagatcaatctcctgagggagtcacaaaaaataattcacgcagatccgtcatttaaagttgatttttcaaaatcatcagtctcaggtgaaaatcttaacaaattaaaggaattgtgtgaagaattccaagatatttttagcaaaagtcaatatgacttaggctcttgcactgcaggagagcatgatatagtaaccacgtcggatactcctgtgtcgtcgaagccacaccgaacaccattcaaatatcgtgatgaactccaaaaacacattgatcaacttttggcatccggagtcatggttgagtcggacactccgtgggtctcaaatatcgtcctagtgcagaagaaggacggtgggttaagaccatgtatcgacttccgtaaacttaacgaagtgactgttccggaccattatccacttcctagattggaaacaattatggaacgaataggtaattgccgttactattcaagtttggacctgtcaagtggatacctccaaataaggctaacagaaagggcttccagaaaatgtggcttgattactgaaaataaaattttccagatggttaatcttccttttggtctaagaaatgcaaccagtgcgtttgccagatgcatggcgcatgtcctcacaggtttggacgattgtgtaatcgcatatgttgatgatatactggtatacaccagggatgataattttgatgagcatctcaatgctttgagaagtgtttttgaaagatttaggagattcaacttaaaattaagccctaagaaatgcacattcgctgcggcgaccatgaattttctcggatacttagtcaatgctgttggctacactcctagtcttagcaaagtggaaataattaaaaatcttccagacccaaaaaccattcgagaagtgaaacacgtagtaggaatggcttcattctttcgtaaacatgtccctaatttttctacaatcgtagaaccattgaccagactaactaaaaaggagagcaatttcgagtggggtacagaacaggctgcggccttcaatgaagtaaaaagaattttgagtgagaaaccaatattggtgtttcccaattatgataaaccctttcacatcttcacagatgcctctaatgttggccaaggtggcgcactcatgcagtggaatgagttggcggaggcatatgaagttattgcttattgcagcagaacgctgtcagcgtctgaacgcaaatggcctgctgtacaagcggaattgggagcaataatttttgctctgcgaaatttcaaaccctatatttttctgacagaaattgaattacattgtgatcataaacccctcgccttcctacttaaaaaggcagaagcgcatccacaccttgcgcgttggttaattgagttacagaattacaatattaaaataattcatgtagcggggaagcagaatcttttagctgacggtttgtcacggtacccacatgaaagaacccaagagattgccattagagatttggctgaattagaagacatagcaaattttcccgtctgtcttgcgctgaatatgaagccaagaatggttcatgagcattttcttttaaccatcactgctcgtgatatagaaggaaaaacattcgccattgatgttcggaaagaacaaaatgacgattctgaggttaggaaattaattgaatttgtaaattttggttcattccctgaggggaccacagaagttgaaaaggaagatattgcatcaagagcggaaaatttgagtctttcctcaggcatattataccaacacttaccagatcaaaatgctcgaatgtacattccgctttctcttcgaccactaatttttgaagcttttcatacttcacaaataaatggtggtcacatgaatatcaaaaagacattagggaaatgtagaaagttttattggccgattatgcaccgtgatataaccaattggaccagacaatgcatcacatgtcaactaagacattcacccaatccttcatatcgtgcataaatgcaaatgccaccaaaaaatactctcttcgctcaaattgcacttgatttggcaggtcctcttcccctcacgcagaaaggtaacaaacatatccttaacataatttgcacatttaccaaatatgtaatctctgtacctgtccctgatgctaaatctcaaacaatagcactagcattttttaaacactgctatttaaagtttggaggctgtacgagtcttttaactgataatgccacggcatttacctctgatttttttaagtccttctgttcgcttctctatattaataaatgttatgctattccccattggagccaaggcaatgcagtagttgagcgatcttttaggacatttcacaatatacttgcgaaatatatttcaagtgaagaaccagattttgatgaatttcttgaatgtgccaacttctgctataacacatcaattcactcttccacaaaggagacccccttctttttggtctttgggcgagacccgatattttgcattgagcaaattctgaatcccaacaccgaacccgaaaacaccagtgaagttgacaatgtcaagcagaaattagttaagtctcttagaaaagcttgggaatccgctgcggcggtcattaaagaagctcagttacggtcaaaagtacaatatgacaagttagtacgaaatcaaaccgttcaaataggagatagggtcctattacgcaattacgcaggaaaagtcaaaacatccaagaaatttcaattaccctggaagggactttatcgagtcattgagattaatggtgtccttattacaattgtaagctgcacatctcctcaaacgaacccaagaattgtacacattaatcaagttaaaaagtattttgagtgctcaggacccccttgcaccacgaaaaatcttcaaaaagatgaagaacaagcactaaaggaggtagaatcaagagaacagatcaatgtacctggctattctcatgactcctatcagaaaatttctgataacacagtattaatagaaaacacacctgcactcacccctaatccctcacccccttcacagtccaataattaggtaaaagaaaaagaactaaatagaaatctttgctcaaaacataatctccgcgaaaaccctaggaaaaagaaacattttggtaacttttcggaggactaattacctgggatagccaaattcaatcattttttccattcttttaatcatactgtattttaagtacgtggaccaacctcgggaaacaacttcagcctgtagaataccaacaaaattgaacagtctttcggaatttttttttaaacaataagtcctgcgggactatttattgctttatctctcctttatcagttctgaggaacttacatatcatcgttttattaaaaaatatattctaatcaaaatcttgaaacttatcgctcttcttttgatcctatacagttcgaataattatctttaagtcttaaaaaaaaaagaatagtatattttatcactaaccatttttattgtcactaagcaaaatgacatacgccgcggcgttcgaaaattttaatcttggagagatgaggatgatttcgctacctgatggccattctttgatggcctttcaaggagcgaacgatccatttagtaacttccatttttcgccatttgttcatgaggaggaaaaatactgctgtgtggagcaggcatttgtaatgaagaaagttcgtacatacgaactcaatggagtggcggcggaagtgatgcaatttgtccacaaagacgactccacaccaaactccccgcggtggcccgacggtcacccacgtgaattaaaatggttcggacgtgaagccgaagagagagcctctcccgccactaaaagaaactggtcggagaacgcacaaagaagctccatcgctttctttgtggagctgaagtttcggcaaaatcagcacttggcagctcttctgctagcgacaaacgacatgtggattgcggaagcgtgtaaagatcgaaagtgggctgtcggatactacaaagatgatccattcttgcacaactacccaccagaaaatggggcatttgggcgaaattggatgggcaacatcctcatgagcttgaggatgcgaatgctaaatgagcagcaaagtgttgctggtccttctaggcaaattggtaaacgggaggactcaatagcttataattaagaaaactatgaggagttaatataattttgaaactttggtctttatattatgtcttgtcacagatccgccgtctgctcctgtctatctcatagcgcaggagcttggcaatgggctgataggagctaaaattgattttgacaacagctttcacgcacatttgttcgtgctgcacgagatatgttctatctgtcgaagctggtcgtatggctatgatgatatgggaggtgtgtgacaagaaatttttgtaactttcggtcgcgcgcatacgacttaattgtattaattgtgtgtagtacgctgatctattcctctaccaccactatattacatttccgtgttatatttaagtcacgtcccttcttctcccacagcattgttccttatccattcatttgttattttccatttttatattttgttctgcatttctcctccggcataaattgtgtttattattttattgtgtgtccaaagttgagacacaacaattggcgcagtcagcagccatggttctcccatttgaagtcgcgctgggctgcgaccctacctcatcaaaaccaatagtcccaagacgggtgaggtccgcaaaatttag

SEQ ID NO: 335 - DNA, 832 bp, Heterodera glycines
  misc_feature (21)..(21): n is a, c, g, or t
  misc_feature (44)..(44): n is a, c, g, or t
  misc_feature (97)..(97): n is a, c, g, or t
  misc_feature (115)..(115): n is a, c, g, or t
ctcccatcccaaagggcgctnaaaggcacgggataccagccaangggggcaatcggagttcagtcgggagtcattcagtggaatggctaatcgatcnccgcctgggaggcgcccncaggcatccatcaacatcccttccctttccaagccctgcggggcctaattacggacgcgtaagagggctcctctggactaaatccctcattaagcactgggtatgggacttcacggctttactatatatatatatattcgttaacgagatataaattaaaaattttctaaatccaaataaatattaaaataattagttgcacagtaaaaaattcatttaaatttaatttatttataatcaataatttatttgttcacaatttttcggaatactcaaattcaatttttccctttttggatttattatctgatgtgatattgtttctttatgataattgaagtaatggtaaaatatcatttaaaaaagctgttttagaattaatataaataaacacatttttgcatcggatctgaaattttgaaaagtgatatacttaaactgtcataagaaaaagtgcaatattttccaaccatcaaatttcataattaaaaaaaaagaaaatacttaaatatgcaggtagaaataagtgaacaatctgcatacataaaaaccgatttatgaaaaataaataaatatttatcacaatgaaaatttcgaaaattgtcataaacttttcatgttttagtaaaattttagacttttgttattcttgtttttgtaacctggtattatattgatgaaaatattctgtatattcaatatttaataaaaacaata

SEQ ID NO: 336 - DNA, 7006 bp, Heterodera glycines
  misc_feature (6978)..(6978): n is a, c, g, or t
cagttgctggataatttagctttatctttttttactcttataattgaaaaaattattgcctattatttcctaatttggggaatattttaatgtatttaagtaataataatttccctcccgtaaaaatgtcatgttatggaaaatataagaaacttttctgtgatagttttagttgctaattaagaatctgccagctttagttattattctcagaaataacccataagtttattctttacaattatatattttttacttggaaagtggtgaagcaaatgcctttttaagaataaaaaaaattttacaacaaaatattatattttagacacaagtcgaaattataattatgacaaaaagaaatgaaattaaataaacattccaaaaatgacatttagagatggaaaagagaaatggtggcaataaaatattataaaagtgagcgaattttaaatttttaaaataatgccaaaatgtacaaaagtaagggtccgtatcgttttggcgccgacgttttggcgccgacgttttggcgccagggtcgttttggcgccgacgttttggcgccgacgttttggctccaagctataataaaaaaagaaaacacccaaatttaaaaattttgtaaaacaacaaaaaaaacgtatttttcgcgaaggtaatactgccgatggttggttgcccccctttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccaaaacgttttggcgccgacgatttggcgccatgtagggaggaggtagaaatgatgaaatcgttataatttttctgacgaagtctatcaaagagccggatttaattcttcatttactctttttcgctttggcttatgttctcttaattttgtatttaggtaatgaatcgtcaaattgatacgaaaaaacaaaagcctaaaataacgcatgaaggccagcttcggccggtgggctgatcgaatgaaagaatgtttcggagacggcacattctcattggcacctccaatgttctaccaaataaattgtttccatttcttcattttgttaattattatatttaacgaaaaatttcattttttataatttttacaatttcttcctgcctttttttcatttttggcttggcgccaaaacgtcggcgccaaaacgaccctggcgccaaaacgtcggcgccaaaacgtcggcgccaaatcgtcggcgccaaaacgtcggcgaaaaaacgacctggtccccgctttttatttttcaatttggcccatcccttgttcttatccttttttcaccccccctgaaatttttttaaattatattttctagggtaattttatgtgctgaacaaatatatgacgtttatttttagctgttatgtttttacgtgtgttacgtgaaattttttgactagtcaactacagaatttcgtcggtaataatgtgctttgaccccccccccccccgatttttcgaaaaaataaagttttcaaaaagtcgtgtaaaacgccttccctggaggtttaaaattcaaattttttaaaatttttaatttttgttctaaaattgataaaacttcgactttttgttcgaatttaggtccagggctcggaatcggtctaaattaatgttagattcaaaattacccagaaaaattattttaaaaaaatttcaaggggtgacaaaaaaggataagaacataaatatgattattttgattttcaaatcgtttaatggcgcgctatttctaaaaaattttgggaacaaggggagggggaggtttggaggtaccgataggcgccgcctggaaacatttgaatttgagtgcaattttgttaaagattgtgtaaaaaaagtgcctacctattttgtaatttagagcaattttttaaagaaaattaatgtttttttggtcagtcgacggggaaaaacccgaattttgaagaatttttgagaaaaagaatccaattttaataaatctatttttttaaataaacaaaaatttactttaaaaaatttttttatagaaacaatcgcttcaataaataattttcactcagttatagagaagctatccttggttcttcgattcacaaaaggtgctaatttaggcgattgacaaataatgaaatcggggcgattcacaaaaaagtttaaaaaccaaatatccttatttcgtgatttggtacatattcatgattttatatccatatctcccttccaataaatcacctggcattgggaaaggcattggttcgttggtatcccctactacgacatggcactcccattttgcggcaaagttcggcgttgaaatttgctgaaccatgcgttcattgatgctatcggtattgtttaaatcctcgcaacccataacaaagaagcgtgaatcagctgaaataaaatgaaaataattaattctaatagattaaaattctgtctccctgctgacaaaggagttgtactgtacaactcatgagaataagcatgaaaaacgcgtttctaacatggttagaggcttctaggtataaacttttcatgatgatttttttaaaatcaatgaattttttaaagtctaacgttaaatcaagatttttaaggctaccgaatataaaaattagttcggctcaatttacgtttaaatgatttaaaatttttaatcactataattatatatgtatgcataatcatggtaatcatagcatgtttaatgcttttaagtagagatcggcattttccacatacacgggcacgggctacggggttggaaacccgtgttcaacagtgacatggggtccgtacactggcacgggggtttctttaaataattttttcaggtaaaaatcaatttcaaaaatacaattttgaataattatttaattataaaatgctgggctaatttttttgtgcttaatttagcattttagtgcattttttgtgattaattgacattctttgtaaaattttgacgaaaacagtaataaaaacggaaaatacatagaactttttaaaatttctaatttttgaaattttaagccgttttttaagaatctggcagtattaccctttttattgcagttgattttgaattctgaatttttattgccagtaaaattacaaaataatgaacagatacaacccgaattcacttccactttcaaaatttaattaaattttatgcatttaaatgattattttggcgaaatgaaaaaaaaacacaatttagctggaggaaaaaaccccgtagcccgtgtcccgaaatatacgggcacgggttacggggttggaaacaacacggggtacgtggtcacgggctaaaaccccgttacccagtgaaaccctgtcagcccaaaaaaacacgggttacgcggtacggggtccgtaaaccccgtgcacgggtctgtcccgtggtcgatctctacttttaagcaataacattaaaattttctttttaaattgtaataatctattaaaattaataaattaaaaaactattgagtttcaaaaaagttaaaataaaaaatcatgattaaaaacttattgaaactttatgaccataacttttttttattgtaaaaaaatttcgatttattattctggtagataacttaaactattaaatatacattaaaatattaatttgattgaaattgagccaagttagtaatttatatgttttccattttttggttttctagttcttggcggatttaagaaacgacccagcccgatcgccttttaccggctgtacaatttcctttgtagcaatagaggttcttggcagatggacagtcttgaactcgaaatggaaggtcatccttaactccggttgacccccaggcacatttcaatgcttttcattaaaatatttattaatttaataaaaaagcaaaataaaaaataccgccacaaaaatgggggagaaaagcaaaagaaaccaaaattgcggcaatattttgaagagcagtgaagaaagtcattttgtgagttttcgttttttgattatctgtcggtcaaaagttttggctttatttgagcaaaaaaacctaaataaaaatgaattcatttgaaaatcaacgcacccaaaaattaattttattggattttgggaaatgaaaaaatgatgatttgatggactgtgtgctgatcgtggctaatgctttcgtcagtgattattttcgttcatacagcaccctgtgagtgtgattcattgggaaagtggtggtgctcagcagggttcccagttttatatgtttaaaaaaattttaaataacatttgcgggtactttgttagaaaatatataaaacaaatacttataaaatttttaaaatctttttttcttgttgatttataaataagagaaaactcttgtagcataaaggattcattctcaaacttaatgttttaagtaaattaaaagatttaaagtttttaaaatattttttttgtcggaacgaaaaatgataagctgttttcagcctccgtacattaatccagtaaaaaaaattttataactccggtggaaaagctcaaaacgcctaggtattaggttttgaggaaaactttattggaaaataaatataatatacattaattattaaacagaattttttttttcattttccgttgcgtatttaataattttctttaattttaaaataaatttttaaaatgaacaccagttttttgatcaaatatttcctgttgaagatcaggtatattcgtcgatgaaacggtggttgtgatggaatacaaaattgttgcgaaaaattattcatgctgattggggaaaaaatggccaaatatgcactaaaatatgcctttagagcagcaaaaaatggcttttactctcaaaaaatgcaataattatctaaaaattcagaattgactttaaaaacatcaaaacaatatggctaggaagctttttagacaattgtaaaacatcattttattttaaaaatttatatatgcaattcctatattttcatattttattattttataccaaaataaatttttttagatcaaaattttttcaatagtttttggaaaagttcgaaatttttcggttttaacgttgtatttttattaccaaaaagtcgatcttatttgttagggggtgtattttttcgtttttattatttttctatgaaaatttgccaaaatgaccgaaattgcgcttgaatcgccaaaatggcaaaatatgcattattctcgaaactcccaagaatgcttttatgcactaaaagtatacactaaatcaaaaaaatttaacgaagaaatgttattttcgattccctttcttcatagcatataggcagaaaaaacatgcatatcataaatttatactctagttatcatgcattcattaaaaataggcactgttttagtggcttaataagaaacaaaataattgaggaacatgaaaggcttaaacaggcaagttgaggctgacgctgcgattcacaactccgtcagtaattaacaattaaccagtaatggacgcgcaatccatcagtaatggtgaatccgtacaatccgcttacaaagggaggtggccaagtgtccgtgggatttcggaatgagattttttgggtagatagagcacccatgggttcttaagaaaaatggttttattttctgccaaatgagcacgagtgccgagttatgacgtgccaaagtttttaatgattaaataaaagaaatacctatttgcacaagagcacggtgtccagtggtgtagcggtagtgcgctagtcagcatcttttagcccagggttcggatcccctacgtataaattagtttttttatttttgtcttttacgccaagtcaattataaaaatttattttatgaaaaaatttttatttttaattttttttaaattttttaatgcgcaaaatattcaataaaaatattcgccaaaaaaaatattttttaatttgacagaatatgtatgtattacatttatgtttaatgcaatttttgatttttaatggaataaaattaaaataaatattttgataaagaaataaaatttgataattgaattgctcacaaaaagcaaaaataaaaattacaaaatgaatttacacataggggattcgaacttttgacccaaaaaaaattttgactaacgaattacctctacactaacaatttctttgaagaaaggaaatagttgttccttttctttaattataaaaaactaaaaactttggcacgtcataactcggcactcgtgctcatttggcagaaaataaaaccatttttcttaagaacccattggtgctctatccacctaaccaagtttcattttgaaatcccacggacacttggccacctccctttgtcagcatcactttgtccgcgtacaccacccactcgccgccatcttcctttcttttcctgctacactcttcttgcagcacacgtcgggccttgagttcctcttggctgagcgaagggcgaattcggatgttgctcatccccattttttgattgatttgcgcgcgcactttgttccattgtgccttccattgtgccaaagtttgtttctgatgtttggagcatccaaaaattactttcatcaatctcgggcggttttgacctgtctttgtttggtctggggaacccattctgtaaacagtgattgggctctcgataccaagcttatcgagaacgcctgagatggcagttcggtcctcagcgactcgcttggacggcttttgtttctgcgattcggggagacccattacgacaacgcttcgccgacgctcatggtcttgaaccgcttcgtccgcaatttgccgctgtttgagagtgaaaagtcactttgnttgctgtggacttgttgtagaagtgtca

SEQ ID NO: 337 - DNA, 5278 bp, Heterodera glycines
tttttgatttttaatgggaataaaattaaaataaatatctttataaagaaataaaatttgataattgaattgctcacaaaaagcaaaaataaaaattacaaaatgaatttacacataggggattcgaacttttgacccaaaaaaaattttgactaacgaattacctctacactaacaatttctttgaagaaaggaaatagttgttccttttctttaattataaaaaactaaaaactttggcacgtcataactcggcactcgtgctcatttggcagaaaataaaaccatttttcttaagaacccattggtgctctatccacctaaccaagtttcattttgaaatcccacggacacttggccacctccctttgttagaatttttttttgagaaatgagcaaaaatcttgcgataaaaattgtttaatataataaaaaatataaatgatttttaaaatatttctacttactattttaataaatcaggtttttaaaaataaatcttactggcgtattttcactgggcgaaaaacccctaagagggggccgaacaatttggctctgtatacatcaaagttttgatgccctgcctttttgttgttttggaaattcttcatgattttttttttgcatttttggcggttttcatacccgattcttattgttagcactaataagatggctaattccttccggtcaaatgatgggctgaagaataaaaggagaaaagtaattagttctaagcatgtttgaaaacccaaaatatttattatcaaagggttaaaacaaattctatgctttcagttatttcgcaatgaaaaattaagtgctgtgctataaaatgaaaagaagctaaaccaataaaaagaaaaaattgacagaataaagagatgaagtgaaaaggtaaatgataaaacaatgaatggtttgaaaataaatcaactaatgcgaccaccaagctggctgccagcattagctccaattaaatttaaattttaatgaaataatgtgcgaaatgtcatatagctgaataaataaaatgagaaattgacagaagaataggcataaaataaaagggtaaattatgagaccaccaagctagccagcttaagctccctatataagcaattgctcaggcagaaattatatgataaacctattcaatgttaacttaaactacattgcagtcctattagtttttaaataaaattttatttattatttattgaaaagtaatttttaattctcgtaccaattgttaaacatctcataaaataaatctaaatattaaaaattaaaggccgttcagtcaattaattggccgaattggagctaaactggcgtttcagttcatttgatcatcattaccattcaaaaagttgagtatttaagaagtcttaattgtcagtaccaatcaaaattttgactttagcccaaaactttttaaattttatttttagttggtttgtataatgtcttcgcaaaagcccaacaagcaggacaatgacgtgatgtttgttgtttctgagccggactgggcggtgtacgatgaaaatgagaggagaagggcggaacataagcgcctacggcgtgaagaacaatctaggtttaggatacattcattatatatttgcttattgtttgtttgtttgcttgctgctcaatggaccgcgttatggcaactgattggattcacaacgcctaccctgaatataaacagtctggagccggaggcggaggaggagacgaaaacaacgaatcgagcaacgttgccattgctgatggcatcaactggctaagagtcaatgacgaggacgaggaagaggaggaaaacaaaagatgcaatggcaatgaggaggcggaggcggaagtggttaattcttttatgttgctatttaggtttttttaagacaaacaactataatttcaaaaaatgtaaatgtgggcacggcgtcccataccagcagaagcaacagcatgaagcgaaagaaattgaaatgccattgattgagcatttgtgtcaacgctcaaagtgcacagccatggaacttcaagtgttattgcaaaatttgacgacacgtcgccagatactgcaacatatgcgtttcaatatccgcctccgcacaaactatctcaggccggccatccgaaactttgtcgtgcaatgtagcgatttgtcgaccctttccgctagtgatacttttgcaatgcgtggctatttgggcattacggtttgcttgttttttgctaatgcatttggtagttgtataaataaaaaattaaaggtgcgtatctattattacgtaaaacacggaatccgcctacggcacccaaaccttccatgtgtagtgcgttttggtggaggtgaacattacgacctgttccccatggaatgtttgaatgtagtgaagtagacgtgagagagaagaaaacgataacagaacgttgattgattgactttacttgcaaatgtcaaaaaacagatataattcatttcttcattgattagcactagggcgtgtaattatatgcacatgcatatttttttttcatggactgtgggaggcccgaaacgcacaaaaaacatgtgttttgcttggtttgaagtttctaggccgtatttccatatgcatattttgtgtatctgtgcatatttcgcgatttactatgacgaaaaaagtttcaaaaatatcattattaggtattttctaaaaaatgtaactttaaaaaaaattggaaatttatgcaaaatcataatagaaaattctccattttttactcaattttcttcaaaataaataaatttacttttattttggtttttggttctaaatgaatattcatactatatttagctattttgggtattttatgcttaaatttaatatgaagtagatttgtaaagcatttaattacacgccctaattatcagaattgtaatactttttagccataaaattatgccggatatttaaggcctttttcctattgtcttcattcattcatctttacaattttgaataaaaaatgcttacaactattcgagttattagcacctattttctaggtttttattttcattgaacattaaaaatcggcctgaaattttgatttaaatttatgtatctcaatactatactggcttaattttattgatttttggacaaaaacgattttacaccccgaaatttgaaactaattactttatactgtcgaaaagtctaatgtcgcaaagtcccctcctaaaatttatactaaaatgaaaatgtcctgattgtcagaaatgatctgatttgaagatagcgaccaaaattgtactgatttcttaaataactttgaaactttatggcagaatttcactattttatcaagaaaatataaggtttgcgctaaattttgccattttttgcaaaaatctgttagcaaatcgcattaaaagttacaaattttccccggctgttgtccaaagaaaaaaaatgaagaaattcttttgtggcgggttcttttatgtacttgtgtaggtgcgtgctaatgacgttagtcaaaacccatcaaaatgtagtcaaaaaaccataaatgaaaatatttttgataattttgcttaaaagcaatcaaatttttacttcttaatatcattcgatagccctaaatgttctctattagcctgtataatttcaaaaaaattgttaattttcaaaaaattggttttttgagcttctcaggtcataaaaattttagggaaatggggttgataaaaaaataacttatccgaattttaaaaatccattttgcgggccgatctctatttaagccgcccgcacaagaactcaatgcaatgggccacatttgatgccaccacaaccttcaattgtcacattttttgtcgagcaggaggaacaagcggattttggcaattgccatgggaacgttctccgatcgctgggtctgctgcactgccagtacttttggctcttgtagagtttaggccccataaaatttttttacatttcagaataaaagaagccaatctataggttttcgtgctcgctgatcacgaattgggcatccatttcgacccatttcgaacccctgaccctaattcaaacaaaaagtcaaaagctgccatttcgttcttttgttccaactgaaatgggatggagggagggagggagggggtaaagaagggctttgaacggttgtcacttttttcaatcataattttcatttaaaatttttatccaaaattgccgcgcagtcgcaaactccgcgcatcgcgaaaatcccgcggtcgcgcatcgcggattcaatccccacggtcgctaatcgcggaaaaaaatgccgtgattcgcggtcacgctccacccttgactgacagctgctgcgcgaaataaatgaatgcctctgcgccaacaaattgtaaaaaattgaacattttcaaaatttagctaaacgaccatcgataatgaatcgcgtaagatatgggcattagtcctgtgaatttgatcatttccctccttttcacaaccatctttaaatatgttcgcctttattttgtgctgatcacacgttccgcggcagctgatcaacgtttttaaagcgccatataaagcataatttgcatatttgaacaaaaagaagtattacgagaatgtatttcgtaattttttacaccttatcattagggattaggggtgatatttttagactctaaaaactcccaaaataggcactaaaaatggaaaaatatactcagctgattgatcattaattgtccaaactaaagatttgtacttccaattccttcaccaattccgcgtcaagattgaaattccgagaaatttcaatagttttgaaaaaaatattaagggtaaaattttatgtccatatgaacgagcatcaaattcactacaaaatgctaaagatagagccaagagatagaacgaaagaaaaggaaaaaattgggacagaacatcaaaatttgatgattgatcatccgcgtgactggacaattggacagtggacaatcggacagtgaagacaatcggacagaggtggacattcggacagtggacaatccgacagtaaaatgcataaaaaagataagaaaatgccgtcgccggaggggaacgattgtgccatatccacaagaaggcattgtgcgcgagtaatggcaagaaaaggcgcttatattcatcaaatgtgcaaccgttgtttatgaaatgccaaacccaaactaatttgaaaagaataatgttttagactgcattcgcacttttttatt

SEQ ID NO: 338 - DNA, 4964 bp, Heterodera glycines
acagttggacaatcggacagtgaggacaatcggacagaggtggacaatcggacagtggacaatcggacagtaaaatgcataaaaagataagaaaatgccgtcgccggaggggaccgattgtgccatacataatccataagaaggcattgcacgcgagtaatggcaagaaaaagcgcttatattcatcaaatgtgcaaccgttgtttatgaaatgctaaacccaaactaatttgcaacgaaataatatttagactgcattcgcacttttttatttgcctgttttccctttttcttcatatggcacaatcgatcctctccggcgacggcattttcatatcttttttatgcattttactgtcggattgtccactgcccgattgtccaactgtccgattgtccaactgtccgattgtccactgtccgatcatccgcagtaataacggaatttctctttcaattccttcaccaaatcagcgtattcattgaaatgatcgaacagaaaaatgacatttttgaagcaaaacttttcgttcgactttgccaaatttatctttatactcatagatcttgtaaaggttattttctatcattgtttcttgagtgattaggaatttttcaacgagataattaatattggaaagatatcttcaacagttaaataaaaaatgtgccaagacatttcttccgaaattttcttctgaatcattgcaaattatttaattaaggttatattctttaccttcatgccaatgaagttgtattgatgtgccaacagaaatttatgaatgaatggctttttgctttttggaccaaaaaatgtgcacaacgattcacaacagaatacaactgaaaacgatcagccaatagaaggaccctttcaacacaatcatcttaattataatttaatacaattaagagttttattgtgcaaatttaaaaccgtaaaaatatatcgattttcgatgggaattccatgcccacaaaattaccctccaattcggcattcggtgaattcatgaaggaaattaatttttcaaaatttcccactgcatttttatcattgtcaatttctatttttggcattttttcgttaaattcaaaaaacaaaattttgaaaaacaccgaatgagcggccaaaagctaaaaagaataattcttaagttttatatttaaattttcacatttcttacatatttgttcacattcataactttgccattaaccattaatttgtcttctgcttgaaacttactaaaaatggattaaatttaaaagacattatattaatcattaattaattacatggttggctctttcttcttgtttttcacaatgatttccgctttgaatgtcattgcgtcctccttctcggcgtatacgcggtttattgggttgaacaaattcttaattttcacaattgaaaaaaatttataataaaaaaataatgcactttataatttctataacgttcatcccgattgagtccagtaaaccattccaaatttccttctcgcattagccattcatcactttttgtggcagaaataatgccaaattcgatagcagcttcaaaattccaatctgaaaaataaagtgaaatatagaagatttggagtttcagcaaattaaattttcaatttatcaacaaaatttataaattcatttgaccataaattccacaaggtgacacttgatagacaaaacggtcataagcgtcataagcatttcgttgaatcgaaatttgccatggcattccgtcgatggacactttttcactttttacaaactcatatctttcaggaaatgagctaaatttggtcactttaaacccaatttgaccttggtctctgttaatttcaacggcagacaaattaaaatctttggctaattgaagaacatttacaacacaatcttctaaataattgttggcatttaaaagttttttcaattttaccatgaacagcgaaattcggtgaatttatcacggaaattaattgttcaaaacatttctcgacattctcaatttcatgaatttcaatcttgggagtttcatctgcattctctccaaaaaataaagttttaaaaaaattcgattgagtcgccaaagaaaatttgtgcacaatgaaactcaataaaaaaacattgctatattatactttgaaaattgactaagctgctcttcaaaacttatgaacatgaaatcccgttttataaaagcataaaatattgagtcttcatcggactgtgttttcaaatgatatttagaatttgtattgacattgatccctaaagaattgttgtaagtccagcaattaacatggttttgaatagaacattccgaaactcaattttatgttattttaaaaaatttcaatttcaattatttttattacgtatttgttcaaaattatttgccattgagcaagaaagtatcatcagcagaaacatcgctaaagttaatgaacagaaactaattataaataattattaattgccgagttaggaaaggttttaccgctttcacttttgctttgaatgtcattgtgtgctctttctcattataaaaccaatgcttttgtccatcaattgctaaatttattaaatattacacggaaatcgattatatgcttatattgctaaattattttttttatttttcgataaaatttaacgattttacaccctcaaatttgaaattttttagcaactattttgaattttttagggtaggtcgggaccgggaccgaggcgggaattccctgtcctccgaggtaatcccaaaaatcagccttttttgttgaaaatctgtgaacaaactaaatttggtttgaaaaatttcattaattcaatttagctttaaattttggttttattaaataaaaaacaaaataaaaatttaatttagtattattttcacttgattttaattagaatttttaattttttaaatttttttttgaatttttaatattcccggttggtcccggtttccagtcccggtcccggacaaaaaccgaggtcccggtcccggtcctggcttctcggatcccggcaggtcccggtcccggttttacacccaaaattcccggtcccgtaccactctaatttttttagaatctaaaaaataattattttggcagtttagtaactcaaaaattatgtctccaaattttttaaaattattttcctgacaagaatttttgattttcaaaattctgtacagtatctaatactgatctggcttaattttgttggtttttagataaatttttatgactttacacgccaaaaattgagacttaattactctttactgtgaaaagtcccctcctcaaatttcaaatatttctgtcgaaaagtccggcgtccctgcagaattggtgaagtgaacggagttgccaaataaatgccaaactccccaagttgcaaatccccaaaagtcgcaccactctgtcagggacatgttcattggaaaaaaacggattttttttgacaatttttacaatttctaaaaaaagaaacaagaatcacaaatcaatgtgccacccaattggcagttgttcgggaaaatcgaatgtggacgccagggatgggccgaggtttcgcttttcgcctttcgcattattcgcattttttggcgtttcgcatttcgcatttcgctttttggcgcgaaatgcgacttttacacctctaagaattggattaaattcccataaaatttttcaaaattttacctataaattggctaattttcagtgaaaaactgtttataaatgatcaatttggcccatccctggtggacgcttatgtgatcggaccggattcattgtaaggcaatgtgaccaaaatttcaggaagaggaggaggaaatgatcgtgccaaagggccctgcaacagcaaaaatgccgacagtaagccatattaccgccgtggtaaggcatacatgtgcgaatatccgtcccagaaaactgacaaatgcaataaatgcggaaaagtcggacattgggcgacagtatttaggacatatggaggaaacaaaaattcggcaaatgcggaaaatcggccatggaaatgcagatacaccccaaacggttttggcgcgcaacgattatttaggaggcataaaagccgcaatttgagctgcaataccatcgaatggaccgtcgtcgtcgtttaaaacgccgcaaaaaactatttaagaggcataaaagcccaatactttggagtgtttcagcataatgaaaaagtaccaattcctttcgttttattactcgattcgtttttgagccgaaacgcgaaaatcgaggtcgagtcgacgaaatttcaaagattttttgacataccctacctagttttacacctgactctattttaaataaatagtagtcattatgcgatgccgttaaacccctagcataaataaggtgttgcacaaaatctaccaaaccccgggtactttaccgttttgggggggctacaactccggaaaaatccatatattttagcggcctaaattcataacaatgatatgctttaaagaactaacaattttttgtattaaaacggtttaagaccggaaaaaccggtactggccatttttgaccaaaccggttcaaaaaaaattttctcgtcaattttgaaagtcggccaaaatcttttaatgcaattttgtagagcacatttgaggctatatatcaaaatattagcaaaattcttcgatttgtaagaacagtaatttaaatgaaaatgtaaaaaacggacaggacttatttaccaacccaatataataatgtcaaaggggaatcccaaaataattaattggcaaaaccctaattgtctttaattgcagatgaagtaggggctggtttctttgaattcttccatttcattgggtctcccgatttatgctgacccatcttggccagggtttttttgtttcatcacttcctttactacagaacatg

SEQ ID NO: 339 - DNA, 1775 bp, Heterodera glycines
aaaaggcggttttaggggaaacggccaacttggtgtgataatgtaggctcggccaactttgcctcctttaaaaaatggcccttggcgcggcaaatttggcgccagataaaaatttaaccgaaacggtcacaatttaaatatgaatttggggcctttttagattaaatttttcatctttctggcacgtactttctttattttggtcatgaaaattgctaaatttatataaaattaaagatttccaaaacaagctaaaatgcggctttcatacttaactgaatttggcgctaagccgtgccaagctgtcctcgaccttttttagcagtgtatttttcctcccgattttagtgcgtatatatttgtcatacttaagatatttctatataatttcttcagatttttttaacttatgagcccagagcaaatcaaagtttgtcattaaccacttaattacccatttaattacccaattaaataattaattaaatttacaattaaatgaaattcaagataatcgttgcacaacaacgggcaaagacttggtgtggttcgtcggtttgctgctctaccgaatgttgtttaacaacaaacatcccatggacaattgggagccaaagcgccgtttggacatggaattcataacggattggcatggaacaggtggccaattaaaatgtcaaaacggtgtgattaattaatgaataatatttaggattatatcgtcaaattgagaagcattgtcagtgaatttccgttgaataaccaaaaaatgcaattcattactcaagatttgctggtgatgaagaaaataatgcgcctcagaaaaaattgttagatgatccgatgaataatgtgtcaaaagcattgcttcatactaatgaatttcataattcatattgataaatattttaattagaatgactcttccaaaaaacgtatttcccataaaatgttttaaatttcggatttgaatgctactaatttttattataataataagctttataatgtttgttttataaaaatataaaattaatcttttcggcaaaaactgtgttactgtatcccgaagctaccgtaccatttctgttgaaacgttttttcttcacttattcttcatggttaaatctaaaataatcaattaaaagcaattgatgaattcagggaatggcctttgcccgtacaaattgccgaaatccgacccaattcatcattaaattggaatgcatgggatgagcaaaaacatttgttgtcccaatacggtagcggtgcgtacagtaaacttatgataccggtgatcactcccggcttcacggaaagtaatagtacatatctattaaattggcacacagcaaaaatcatcaaaaatgcacttgacgacggtatttatttttttaattatttaaataatttctaaattttgtaaaagttttatttaattatctttaaataaaatactttaatttaattgtttatcatgtttatttacatatttaaaatattaaaataatttccaattctatgcttttcctatttttagcatttaaattgtttcattcttcaaaaacaaatagctaataatatcgaagttcttgttatttatggcattttgtgtcccggctttttaaagaatgctcaattttttgaatttttttgcgaaataattcaaaaaaaagtataggtaaacagtctgtccacactgctattaggtatttccataaaaatacttaataaatattataggaaaattgccagggtatccaaatcattatttt

SEQ ID NO: 340 - DNA, 3699 bp, Heterodera glycines
aaaataaataaataaaattaatttagagagtttttttcaggtttcaaactcagggagaaaagaaaattgggagagttaaaatttaattggcacagctgatttttttattttgttatttatattagcgatttatttaattttttcgacacagccgttagaaatttaaattttttttatttaataagcattatgtttcttatgcaaaattattaaaattgtctttttgaaaaaataatcctcaccctttgtctctaattaatcaaccactttcctttttctcttcctcttctctttcttccttattctcttcctcttctatttcttcctttttctcttcctcttctccttcttcctttttctcttcctcatttcctttcttttgaacatgtgcacgccttaatttttttaacaaatcaaatcaaaaacatttgatcttttgttaacatttaatctgttttaaaaattaaaatttaaaaaaatttgaccacattaaaatgtttgccaaaataacacgaaaaacttttttgaaaatttaaaaataaaaaaactcttcataaaaactaaaaattatttaaaatttctcaatttcttaagaaaaaaattctaaactcacttccaaaaatcgccaaaagtttctttgggccttaaatattaggagtgctttaaataattttttttaaacatgtgacttaccagccaccgtcaaatttgtcgtcgattgtcctataatattagaattaattattatatgacatatatatagaagatatattataatattatattatatatatttatattttataattatatacttatactgactaaccaagactctagggcaaatccgctataaagttgaaatataaatttatacacaattttattttttatatacccacccagaaaatggctcttctctgtcgttgaggtcttgtctataacattgggaataaataatatatgacatacacacataataaatatattctttatttattttttaaaatatttatctatttattctttatttataattaataattatatgtaatatgtatattactgacaggcaagggtttgtgccaaatccgctataaagtttgaatataatttatatacattttaattttttttatatacccacccattatcaaattgctcgggttcgctttaaatataaatcattaattattgcttaaatttatttaaagtaaatttactcaattcttgggtttttcacggtgggtgtttcagcgtctgaaaaagagcaagctcttttttttgaagcaatgtttgcctaaaatttgccaaaggtcacttttacaaaataaaatgacagaaaattgaccatttattatttaaagcactcctaatatttaaggcccaaagaaacttttggcgatttttggaagtgagtttagaatttttttcttaagaaattgagaaattttaaataatttttagtttttatgaagagtttttttatttttaaattttcaaaaaagtttttcgtgttattttggcaaacattttaatgtggtcaaatttttttaaattttaatttttaaaacagattaaatgttaacaaaagatcaaatgtttttgatttgatttgttaaaaaaattaaggcgtgcacatgttcaaaagaaaggaaatgaggaagagaaaaaggaagaaggagaagaggaagagaaaaaggaagaaatagaagaggaagagaataaggaagaaagagaagaggaagagaaaaaggaaagtggttgattaattagtgacaaagggtgaggattattttttcaaaaagacaattttaataattttgcataagaaacataatgcttattaaataaaaaaaatttaaatttctaacggctgtgtcgaaaaaattaaataaatcgctaatataaataacaaaataaaaaaatcagctgtgccaattaaattttaactctccaattttcttttcccctgagtttgaaacctgaaaaaaactctctaaattaattttatttatttattttttctcaaaatttgcacatttccatcaacagaagcactgagaacattgacgtccagcgaattgtcaagtgcaacaacttgattagttatgtgttgtgggattacaatccctcggaaggcagcagagcatatcttcatggtcagctgtttaccattccacctgctgatgcaagcactgacctccagcgaatttcgactgaacactccctcgatgtgaacaaaacttcttaaatcctatcatcatgaaaatatttagaataagctgatggaagcacttcaccgtatcctacgtgaacatcacaagcttgctgtcgtttacgagtctgccgctgaaacataccgccaactgccgattgaagaacgtgttcatttgcgcatgcttttggtggatacgaataaaataggtgttgagcgaacagttgaagatgacgcagcgcaagcacctgctaatttgcatgctgacgaccgtgcgaatgtcaaacagatacatcctgggcgacttggcacggagactgtggctggtagccgtcttgtggcacaagtacttacattgcgtatacaactattttctgttttaatagtggtgttgtcgatattgacgttcaaataatttcagttttaccttgacgatggctccaatgttataccgccaagcgagtacgacgtcattttcatgggccgggacgcgaccaaagtgaagcacatgaaatggtggaacaggaatatcgatcccgcactctacccgcttctgtttccctacggccaatatggatatggtgaaataatctaagtaaacacctgtattcgtgtttgtatagaatacggaatccaactgaaactggaaaaagacgaacgcttcgacacgacatacaggcagatcagagacaaagacaacaaccttctgagcacagccgatgaccttggcgaagaggaagaatttcttggcgcagaacaagagcagcagttccaccgccgcgatcatgtctcgagatcccaatggtatcgatacatggcgcacatcagggggctcaactacaattggcgcgatggacactggctttgggattggcggactcttgctcaacattacacaattagcttcaacaatagaatggaagctcaaaaatttcagttcatgaagcagcatcaaggacgcagacgcctcattttgccgagcgccatcatcaattggcttaaggcgctccgtgataataaaggcaaaaatgacttcgtcgcaaatgaaatgttttattatttaggatataagggtgatattggccgtgtgtacatgaccgatgagcattttcggggctcgcggcaatagagtatgccaattgcatgacaatatgcagagaagttagcaagccggaccttctggtgacattcacaatggaccctgagagccctgagctcgatctttttagcatcctttaatttttcgccttttagcatctcttcaaaaaattctttatttctcctccttttcggtgccaaataattctggaaaaatggtcaattttctgtcattttattttgtaaaagtgacctttggcaaattttaggcaaacattgcttcaaaaaaaagagcttgctctttttcagacgctgaaacacccaccgtgaaaaacccaagaaagaggaatttactttaaataaattaagcaataattaatgat

SEQ ID NO: 341 - DNA, 5067 bp, Heterodera glycines
  misc_feature (5041)..(5041): n is a, c, g, or t
ttcatttgcgcatgctttggtggatacgaataaaataggtgttgagcgaacagttgaagatgacgcagcgcaagcacctgctaatttgcatgctgacgaccgtgcgaatgtcaaacagatacatcctgggcgacttggcacggagactgtggctggtagccgtcttgtggcacaagtacttacattgcgtatacaactattttctgttttaatagtggtgttgtcgatattgacgttcaaataatttcagttttaccttgacgatggctccaatgttataccgccaagcgagtacgacgtcattttcatgggccgggacgcgaccaaagtgaagcacatgaaatggtggaacaggaatatcgatcccgcactctacccgcttctgtttccctacggccaatatggatatggtgaaataatctaagtaaacacctgtattcgtgtttttaagaatacggaatccaactgaaactggaaaaagacgaacgcttcgacacgacatacaggcagatcagagacaaagacaacaaccttctgagcacagccgatgaccttggcgaagaggaagaatttcttggcgcagaacaagagcagcagttccaccgccgcgatcatgtctcgagatcccaatggtatcgatacatggcgcacatcagggggctcaactacaattggcgcgatggacactggctttgggattggcggactcttgctcaacattacacaattagcttcaacaatagaatggaagctcaaaaagttcagttcatgaagcagcatcaaggacgcagacgcctcattttgccgagcgccatcatcaattggcttaaggcgctccgtgataataaaggcaaaaatgacttcgtcgcaaatgaaatgttttattatttaggatataagggtgatattggccgtgtgtacatgaccgatgagcattttcggggctcgcggcaatattaccagaaagagtatgccaattgcatgacaatatgcagagaagttggcaagccggaccttctggtgacattcacaatggaccctgagagccctgagctcgatgaatgctgccagtggtgtcaaaggacaaaaggcaacagtggtttgatcggccagatgtggtttgcagacttttcctcgacaaactacgtgaattgcacaacgacctcacgtataaagaagtcatgggacctgttcgtgggtggttctactcattagaacaccaaaaaaggtgtaaacattttctataaatatttgcttaaagtgttaattcaagaggcctcccccatgttcattttgcgctcatcctcgactgggacaggatccgttgcagtggtgtaattacaacgcctgaggattacattgaccaatatatctccgctgaaatacctgagaacccctctgggcggtcgccagaagtggttttaagacgaaaattgtacaacattataacaacaaagaacatccatacctgttccgttcgtcgctgtttagtcgacgggaagtgttcaaagcatttcccagtaagcaattgaataaatttcgggttattaccttatagtaaattatagaagcctttctcatacgacaatgtgtactccgaaaacgcatatccgcggtacaagcgtcggccgccggcaacagacgaaaaagaagctgctaaaaatcctgacgattatggccgcttcttccagtacaaggacaaaagtgggaagctcattcgcgtcgacaacagacaagtcgtccccttcaacgcctttctttcatcaaaatataaatctcagttagctttagttagattttacaatggaccaattttataaattaagtatcaacactgagtttgtagcgggcgagagatgcacaaaatatttgtgcaaatatgtaatgaagggcgcagacatggccttcatcgaagtccagggtgggccggaaaagcagcaaacggtggactatgatgagttccaccaaatacgccttgcgcgatacatcacatcgatggaagcgttcctgtctctttggggaactcgccttgtccgtcgttctcaccaagtagcaataatgttatttaaaagtccattatgaatttataaaatgtcgatgaattggatgtgcatggaccaagtgggcaccgaattgctgtggaaatgggactgaaagatgatgaagaagatttgaatgcaatttgtgaagcggcccaagccgaagaagagcgaagagcaagaggcgaagagcgagttacgcagcttacagcgtatttcaccttcaacaaggacaatgctccactcggtctgacttatgccaaatgctacaaaaagttgtggtacgatattgcaaagaagcagtggaagccgtatgtgaacagagttgttccaaaattttgccgactcaagaccgtttcgccaaacaaccgcgaacttctggtgaatattatttaaccaattaacacattatggattataataggctattcggatgctcctattggttgtttgtgacccaactggatgggaagccctgaggacgcacaacaacattgtccacggctctttcattgaggctgctcaggcccggggtctgctcagtgacaataacctgtggatgaacaccgttatggaggcctttcaaacaaaaaagtccatccgccagagaatcagatggctcgctgtgttcttcgcgactacaaacctctcaagtccgacaacaatcttggacagcattttgaaggacgccgacaattggcttgtgaacaccagtgttgcaaaggcttcggctgaagatcagaagcaatatgtcctgcgtgctttggagtggttccttctggcaaatggaatcacgcctgactctgagcccagggaagatggcactttcgagtctgcctgagagcacatcggtttaccgcgccctttgggcttggttcttaccaaggagacttacatgaaggtgtatcaatgacaaattgtttattgccgttttcacaccaatgttttttctacagctcgctttcttccgggacgatatcgtgaatcaaaatcttcacgaaagagtaacaatgaggcaggattatttgcagaagtatctggccgggccgaagcctaacaacgaacaagaacaattgatcgactctgtcttcaaggcattagaagacgctcgcaacgttatcgaaggccgacaagcggagtttgaccctgcagttcagcggcttttcatggtcaccggcgaaggcggagctggcaaaacatttacatataatgtagataattttaatttttttggatgtgacgaatattcttttgccttctttctagaagataattgctcgcgcaaagtccgtcagcatgcactttcttgccatggcttctacgggcattgctgccgaactgttgtacgagggacaaacagtgcacaaacgcatctgcaggatgaagcacgtcgactcttccacgtcacccaacgttgactacgaaagcaacttcgcgcacatgctccgcaacattcatggcatgcttatcgatgagataagcatgcaaaacaaggatgttctggagtttgtggaccgtcttctccgctctgttgcccctgatgaactcaaggaaattccatttgccggaaaggtagtacagtatacagttgcatttattttttgtacctaaaatttaaaggtcgtagtcattggaggcgagtggaaacagttgacgcctgttattcccgggggcgccgaaacttgaggcttctgtcaagaattcgccattgttcgtccactttacaactgtgcgactccgtgcaaaccatagattgttataaaattggagaatccccagcagttgctcggttttcatcgaatttgtcgcgcacatcgctcttttgtgagacaatccgaaaggttgccgaacaaaggcagcccaaaattggagtcataacccaattaattaactaaggcaggcattcgagactgaaggcaaaaggaatatgcaattcgaaaattccctcaaatttcattaacattccattttttctacaatcgacactcgagttacgaaattttttttgtatgattttttaaaatattgatgaaaatgtaaatatgaagcttaaaaataccaggaatatgttagttatgaaagcagagtttgctagttttgcttatttaaaagatttgtgcttatttcagcattatgtgcctattgtgaattgaatatttaaaaaatggccacttttcagtgaaaatctctaaaaattgttaaaattcccaatttttcctacggcggcacttatcggcaccgatgggccacgaaacttattttttcataaaaaattagctcaaaatctcaaaaaatggtcatttttggtgaaaatctgttaacaaattgcattcaatttttcaaaatttttccggcggcgcctatctgtgcaccgctggaccccccccccccccccttccaaaaattttttggaaaaagcgcgccgcaaaaaatggttttgaataaaaaaaaaagtcgccgccggagaaatcttgcaccttcgtataaaaaatcgggagcagctcgttaccccccagccggagagggggttaaaaatacagcctaaaattgaatgaggaccaaaatgaagcatttttgacgaaataagagaataatttgagtaatatgggaaaatggaggaaaaattcggtatagatatgtttttttagcacgatcaatttcaattccgttgattttaaagtcatcgaaaaaaataaataaatgccacccctttttcaattttttataaaatgaataaaaacatttttgttaattgtaaaatattaaatagaaattattgacaaaaaaaataccacgaccgattaattcatattaattgttttttataattgttgaaagtgccaaatttctttttacattaaacaaaaaaggcgccactaaagtaagttcggcaaaaaaggccgaaataaaaaacagtcaatgacattggcaaattgcaattgtcgtaaaaagaacaccagcgagtgccaacatcggtttggcgcaggaagcaatcgacacgngattgaattaattaaccaaataaaac

SEQ ID NO: 342 - DNA, 2657 bp, Heterodera glycines
ttttggtggaagtctgttaacaaaattacattgaatttttcaaaatttttgggggggcggctaataggtgcaccgaaggacccccggaccccccttccaaaaatttttttggaaaaagcacgccgcaaaaaaatggttttgaataaaaaaaaaaaaaagtcgccgccgggaggaaatcttgacaccttcgtataaaaaatccgggagcagctcgttaccccagccggagaggggggttaaaaatacagcctaaaattgaatgaggaccaaaaataaagcatttttgacaaaataagagaataatttgagtaatatgggaaaatggaggaaaaattcggtatagatatgtttttttagcacgatcaatttcaattccgttcattttaaagtcatcgaaaaaaataaataaatgccacccctttttcaattttttataaaatgattgaaaaaaattggccaaaaaaaaataccacaaccgattaattcatattaattgttttttataattgttgaaagtgccaaatttctttttacattaaacaaaaatggcgccactaaagtaagttcggcaaaaaaggcgccgaaataaaaagcagtcaatggcattggcaaattgcaattgtcgtggaaagaacaccagcgagtgccaacatcggtttggagcagacacggattgaattaattaaccattaaaaacaattaagcataattagttgcccaatatttaattttaccctattgtttaaaacccataaataaaataaatgaccaaaatgaattaaaatatcaaataattcttttttacctgtgcatttggtcaaacgccagaatgcaagtaattcactgatgactcctcccaagtggtggccatctcgtcaaaaatggataatccgatcgcaagaagtagagttgagcggtaccggtaccggtactggccggtaaaatgtatgcagctataaatttacaacgaatacaaaatatattctacagataatataaaatgataagtatatagtaattttttattcgacaaaaatcaagcattcatgcttttttatattttgcatgtaaatgtatgcagctataaatttacaacgaatacaaaatatattctacagagaatataaaatgataagtatatattaattttttattcgacaaaaatcaagcattcatgtttttttatattttgcaggtaaatttatgcagctataaatttacaacgaatacaaaatatattctacagagaatataaaatgttaagtatatattaattttttattcgacaaaaatcaagcattcatgcttttttatattttgcaggtaaatgtatgcagctataaatttacaacgaatacaaaatatattctacagagaatataaaatgataagtatatagtaattttttattcgacaaaaatcaagcattcatgcttttttatattttgcatgtaaatgtatgcagctataaatttacaacgaatacaaaatatattctacagagaatataaaatgttaagtatatattcattttttattcgacaaaaatcaagcattcatgcttttttatattttgcaggtaaatgtatgcagctataaatttacaacgaatacaaaatatattctacagagaatataaaatgataagtgtcggaatttcaattccgatcgccaatcaatgatcggcgaattaagagggaggaggcccttcaccaatcccccgcccgccgcgcgacatgttttcgccgttccatccccctgcccccccttttccttcaaattgtcaattgtttttgtgtgttcctcccccactccgcgcacaaattaatgaccaatttgtcaaaccgcaacttttcgccgccgtccccaatttggcgaatcgactccaaagaacgatgaacccccaaatttcccgttttccgcccattttgttcatctgttcattttgtcccccgtttttcatttcgtgcccaaattttcggcccattttgttctgctcacatttgccactttttatttaaatttattgttatttaagcggccaaaaatgtcccccaatttcacaaccaaatttcatttggcaattttgccgtttctctccccgcccctccatttgcctttaactgtgatggccccccaattttgatcattctttgaaccccccgattgttgatctttgatccatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgagtttgaggtcatttcccggaataaattttttattaattctgtgtctcgtccctgcctgcccctgaaccccgcaccgtggaattcatttggcccgaccccagagcaagtcgggacaaattggcgcacctgggtggattggctgtgaaccacggactgaaatcgacggaacccggtgacaaagggggaagggaaaagcaaattagagagcctagacaagaccctctgaggcttgtctagtgttcatagttt

SEQ ID NO: 343 - DNA, 3050 bp, Heterodera glycines
ccccccatttgcctttaactgtgataaccccattcgtgatcattctttgacccccggttattgatttttgttctgtggccccggtgccctccatttcctgtcccatcccggtgcccaattccatttgtgataattccccggtgatggaattttatctgtgatcaattttgtgatattttgttcaccattttttaaatttttgtttaattacccaagtttgaggtcatttcccggaataaattttttattaattccgtgtctcgtccctgcctgcccctgaaccccgcaccgtggaattcatttggcccgaccccagagcaagtcgggacaaattggcgctcctgggtggattgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacgaagtacttgccctccgaggaagtacttcgtacaaaagggtgttcaagcgcgcacaaggccattgacaaataaggcaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatctcggaaaaagacacaaaacaacaagtgcaccacaacacacacacgcacaaccaaactgcacgcaatgtctggaccaatacaaaaagggatcatcaatgcactcaaaactctggacaatgccaaaagcgccacctcactccttctacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacggcgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagagaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcctgaactctacgaatccttcaaatcggcaatcggcagtcaatcaatcagtaaagcgcagaagctgaacttactccgcaatctactgggcggagaagcgcgagaactcatagcgggcttccggctggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcctcatgctggaaaagaagctgacgccagcattcctgcgaaacatcctcaacaagaaaggagaagatccgacaaattggacgacaaccaaatttcgggacgtgctaaacgaagccgtccgaaaagaagtccaaatccaagaagtgttgggcgagtacggacaccaccatcaatcactcgatcggccagcaaggccagcgactcaagcacaatcatcgcgaacacgcaatttcgcagcaaatttccggaaccgcaacgcaactcccgccaatcgggaacgcacttttatgtcctcaacaattgaggaggttcataagcgagtgaaccacaacaagccgcaacagcggaagtcccaaccgaagggactaaggccaactcaagcgccttcaactgtgccaatccggaatggcaccgcaaatcaagccgggtcgaggaagccaccctcaccgtgccttttctgtaatggaaatcactggaacgaagattgccagcgatacaacaccgtacagcaacggtcagcctttgttcgagacaaaggcttgtgcttcaagtgcttgaagtcaaaccatcgggccagcgagtgcccaaggccaatcaaatgctacaaatgcaaacagctgcacccggccgtactctgccaagaaggcaccaatgccgcaacgcaaacacaacaagcagcagccgtaatggaacggcacccaaagcaggatgaacagaaatacacaagtcaaacggcacaattaatgagcaatgccgttaaaagcagtgacacccgagctctgctgatgacaacaatggccacaattttcaacccgtcgaggccatgtcatagcatgatgcaaccatcttcattgacccgggaagccaccggtcattcatttcaaacacggcagccaagtaacttgaactgaccgtgctcagaacggaagaatgcttccttacgagctttggagaacgcgaaccaaagcgttacgtcagcgatcgagtcgcaatcggctttttgtgtcccaacggggaccgactcattttcaacttgaacgcactcaagtttctgctcaacaatttgcctgtcctacaactgaacacattggacaagcagcagcttcaacagaagaagctttttccgccgcatgagtcacgacaaccagacgtcatgcttggaatggatgtctggcatgacttgcacgttca

SEQ ID NO: 344 - DNA, 1969 bp, Heterodera glycines
gcccaaggccaatcaaatgctacaaatgcagacagctgcacccggccgtactctgccaagaaggcaccaatgccgcaacgcaaatacaacaaacagcagccgtaacggaacggcacccaaagcaggatgaacagaaatccacaagtcaaacggcacaattaatgagcaatgccgttaaaagcagtgacacccgagctctgctgatgacaacaatggccacaattttcaacccgtcgaggccatgccatagcatgatggcaaccatcttcattgatccgggaagccaccggtcattcaattcaaacacggcagccaaacaacttgaactgaccgtgctcagaacggaagaatgcttccttacgagctttggagaacgcgaaccaaagcgttacgtcagcgaccgagtcgcaatcggcttttcatgtcccaacggggaccgactcattttcaacttgaacgcactcaagtttctgctcaacaatttgcctgtcctacaatgaacacattggacaagcagcagcttcaacagaagaagctttttccgccgcatgagtcacgacaaccggacgtcatgctcggaatggacgtctggcatgacttgcacgttcagccaattgaacaattgcagagtggatttacgatttgtcagtcgaaaattggcaaaatcatcagcggcaatggacgaattgaactcagtcaaccgtcaaatgtgacattcgtcctcacggtcacagactaaaatgtcttcacaacggaagaagacttgaaggccaacgaaaaactcaacaagttctacggcctcaacatcattggcatggacgactcttcaacgctaatcgaccgtgatgaagtgatgaaaaatttcaaggaaaacttgtcgttcgtcaacaacaaatatcaaatcgcattaccatggaacgacagagtggcacaattgccaacgaattaccatcaagcaaaggcaaggctcataagcctcatcagaaagcttcggacaataaacttggtcgacgaataccaagcaattctggatgaacaacagcagaattccatcatcgaactggtcaattctgatcattcttgtggtccagtccactacctgccacacagggcagtcatccgaaccgataaatccacaaccaaaatccgcatcgtgatggatgcctctgcaaaacccaaatccactccgtcagcaccatcactcaacgaatgcctgcacacaggcccgctacttttgaaggacctgaccggcattctccttcggttcagacgcatggaaaaagtcatccttgccgacattgaaaaggcatttctgcaattgggcgtcagagaacaagatcgcgatgccactcgattcctttggcttgctaacccaaaggaagcaaatctcgaacagctgagacaagaagacttccgcatcttccgattttgccgagtcagtttcggattaaccgtgtcgccatttctgctcaatgccacgatcagggaacacctggcacttcacgacacggatgttgcacaacgcatcagtgacaatctttatgtggacaacatcatgatggaagtcaaaccaagtgaaagcatcaatcaactggtcacggaagcaaaaatcatttttaaatccgccggaatgcggatccgcgaatttttcggaagtcaaatcgacgaactcaaagagcttgactcatccgaattggccaaagacctcgaaaacacaagggtattaggcattgaatggaagccacgacatgaccagctgatcttcaaaatgccgctcttcagaagtccaaccacaaagcgaaacattctgtcacacatcgcaaaagtgtatgacccacttggccttatttctccagcactgttgcccgccaagcattttttgcaaatcgtccaaaatttgaatttcaaatgggacgatcctctgccggaaaaaatgtcacttgactggatcaaactaatgcacgcgtgg

SEQ ID NO: 345 - DNA, 11786 bp, Heterodera glycines
  misc_feature (11765)..(11765): n is a, c, g, or t
ctggggccatctgagcgccgggacatttcagtcccagcgctcagccggccatttgagcgccagtgagcgccatgaaaacgcgtgttcccattggagcaccaatgactgtcccccgagttgtcgaccatttgtcctagaccatttgtcctattgtcgaccatttgtcccaaccatattatattgtcttttaattcatcagcgatctaggggatccgaactttgacaagtcatcccatcacactaaccattaggccatccagacaaacataatttattttattattttgtgctaaaattaattctagaaaaatcatcaatcaacaatgtgtgtgtgtgtgtgttcggtcacaaaaaattagggactgaatattttaaacaccccaataagttcttcacggcaaaaggggcaacgcccatcaattgaaacagtttcggcgcatcggttgcagagggcacgatgaccacatggaatgcatgcataatttctctaaaatatccaaaattagttttgcattaaacgctgacgacttttctggtatagcaaacggcgcaaagtgggtcgtcgtcattggaaccatccatatctcgtaattccaatatttcttctctcaaatctttcgtctcgttgaccaaagttgcctttgtctctctcaacacacttatttctcttattaattgttccttttgttgtagcaattcgatttttttgttatggatttgtgttttcctatttttaagatgataaacatctcgttgcagttggtccttgtcgatttctaacccaatgatcatcgcttcaagccgtacaatttcgaaattagcaaatggttggtgggacattgattatttttccgtgctaaaaaaaagaaaattatatgattaaatcggggagggataaaatgggtcaaatgtgtgcaacatctctatataaataaacaggaagttgcattaacatatgcataaaaatgtttattgcaccattcactctaattttgtctggagctactggtagtggcaaaacgcaatggttgatgaaattgttgagaaattacaaggaactaatagacccgccgcctgcaaaaattctgtattgctattcagagatgaatgagtcggttcttgatctgatgaagcggggaattgagacgcacaacggcttgccggatcaagcgttgatccagagccagccgaaaccactgctcctcgtgctggatgatttaatgctgaacgtgggaagcgattttctggatctgctgttcacacgcggttcacataactggaatgtcagcgttatttttgtcacccaaagcctgtacgggcgtaacattagaacagcgcgagctaacagccattatttggtgctgacaaggaacccgtctggtcaactccaggtcagaacggttgggtcacaacttttcccaaaacgactcaattactttatggaggcgtacaatgaagcgactagtcagccgttcagctacttggttataaacatgcacccaaatgctccggaaaatgagcggttgacaagcaaaatattccccggggagagccgtgaggtatatttacctgtagaataagcgtaatgaacgaaacaagtgcgctaaaaaactatttaaggaagggaaatttttttggttcgcaaaatgtacgagttcagtccatacattcgcgcaaattcggattttttcaaaaaattagcctcaacaaaatcggataaaaggaaaaacgatttgctgaaaggcgcatccgtagaacaaattctcggattggttgagatttgtgcaaatattttaaaatttaactttcgcctcaaccggcgacagaggagacgattggccgtgtacgcagactattaccgagcaattgcacgttcacgtagtgagcgcacagccagacagaggctacaacagggcagcggaatagctttaggagctattttggcgccaattttgagcgttttagctgaacagctggtccagaaaattgttgcaactccatcagcacaacaacaacaaaatgaagcacactaaaaagatgctacttgtaccggagagtgaatatttggcgcttatcaacctgctgaaagggggcgcaggtggaacggactcacttcaagccgaaaaagcagcgatcgatgccagcatccaaaaaaatctaaatgacaataaaacgggtgcggacgtgaaaatgaaacgtcactcgtggttgtacaaacagaggcatcagatcaaggacatgattgagaacaaaccacaaaaggtgattgtggaaaacgctacaggcacagcgccacaaaacattgccccgtatatgggcatacagaaaccaaacctcaacaagcttgaagaattgaacgggcaggatggcaaaaaaaaaataaaaaaataggacgaaaatcggtccaggcttccagaattcaaactcccaatggtgccagctttggtgaagaaacggatacgtctgcgcctgagaccgatttgcggctaaccaaaaagagacaacaaaaatttttggagcttaaaacaggcccagagcattatgataagctgcacgaaatgattgaacgaaaccccgaaaagtacggagtcgataagtcgtccggcgaaattctaacaaacttcaaaaagccggtgattaggtccaactacattgactcactgatgtacttgacaggacagagagcagatgtgccgaaaggtcatcgattttttgttcaaaaaattggcagcgacccgcaaatgatgaaatttttccattcccaacggggagagggtggtagtaagcggagcaagcgcaaaaaattcgttcttgttaaatcaagcgctataaaaacggtaggactcagccgaatggagcaaccaaataacacgcaacgtaaattctttaaaccgcttctatgggcaaagctgtagtacaaaaattactggaacaagtgtattacgatcttaggtcgccggcaagttacgctggtattcaaaaagtattgaaggaagcgaagaagcgaaatccgagcattactcttcgtgatgttgaccattttttgcataaacagcgcacctacacgttgtttaagccgcgcaaaaaccgcttccgcagactaaaaactgtgcctagcggactacacacggactggcaatgtgatttgtgcatcatggacgcgctgaaagagcataatgatggatttcgttacatccttgtgtgcatagatgtgctaagtcggaagattttcactgcagaggtagagtccaaaaaaagtgagcacatgattgcggcatttgagaagattttcaataaggcaggtgtgctgcccaataagctgtacagcgacgctgggcttgagtttcaggcaaagaaaatgatggactactggaaacaaaaggagatcatcaagcacgtgatgtacagcccacatttgcatgctggagttgtggaacgcgcaaaccgtacgcttaaggagcgactttacaagtattttagcgaaaagaacacaaagcggtgggttgatgtgctggacagcattgtgcgtaacctgaacagctctgcgaaccgaacaaccggagtaaggccaatggacgtcaactttaaaaatgccgctgctctacggaatcgcctatataagcaaggcgagtcgagtcctaaaacgccaaaatttaaggtgggagacatagtgcgaataagcaaagaaaagggtgatttttcgaaaggttattttccgaattttacggacgaactgtttcggatttctaaagtgaatccgaccgatccaccttcctacaggatccgtgatcaagacggggaagacattaaagggattttttacgagcaagagctggtaaaaaccgttgcagaaacagcgcatagagctgaagtgctgaagactcgacgcagaaacggcgtcaaagaacactttgtgaggtggattggctactctgacaaacacaatcgttggattcgagacgaggacattgtccaaaattaattgatacaaaaaatggacgaattttacattgtacttccgtccaacacaccaggctcaacgaatacgacatcaaattttacggttcggcttccacacacgttggagttggactcaaattggactgtcgctctagcatctataatctacccctattcatttccatcagtcggaattgatgaggatgatatcattagcattaaacttgttaacccgaactatagattcctagacgacaaaaaatttgtgcatatagaactaaaggttccaagcatgcaattttcgagtgtagaacatttacggctcaccctgaacagcctcatacgtgaggtgtatcagcagcagcaattttcttctggccatgatggagctagccggacgaaacggcaggtcacagacctattttttcatgaaaatcctgtggattattgggaaaagattggcgaattacgcaccaaacaagagcagtttgaaaaggaggtaaaacaggaggagagtgaactttcggcagacactacggatgtggagaggaaaaaactgctacaaagcgagcttccactcaaacggattcgtatgctgaggaaaaagtatgagctggaagagttggaacgcgctgctgaacgtcgtgatcaggaaagtccggagaatgagcaaagaaagattagcgattttttccaacatcatcccgaagattataacaaaaaattgaacgagtcaagacttatattcacccaacatctctcggggctgcaagaggtgatgagcaagtacattggtgaaaaagatataaataaaattcgtcagcttaacaccgaggttggcaaaatacgcacaaaaataaaacacatgcagcacaatttggccatctttgaaaatgctgcgcttcagcgtgaccaccaaaaatctttgtcggaatatgaggagctcagccaccagcagaatagtgcatttgttgaggaattttttcaaaaacatcccacaaattattggcaaattattcacaacaattataggggtcttacagaacattttcagaagatagaagaactgcaagcaaaggcagtagggttaaaggataatgcctctttcgaaaagcagattgagcgagcaaaacagctgattgagtacagacgaaagagattcgctgcgcttgaatttgaggcaaaaaagcgtgatgagcaacaacagtttgttgcagcagcagcaaatacaattactgcaccgactgcgtcgtcattgatcggaagggaggcgttaaaaaaacgtacaggcatctctgccagtacggatggtgaagtaggtgataaagcagatgtcggtccacaaacagctaccacaacaacaacacatggggaggcattaagagagaaaatattggagcaacaaaagcatatggatgtcggtccacaaactgctaccacaacaacaacacatggggagtcattaaaagagaaaatactggaccagcaaaaacacatggacaacgatgatacagcagatgccggtcaacaagcagctaccacaacgcatggggaggcagtacgtgagaaaatattggagcaacaaaagcgcacggacgatgatgatgataaagcagctgtcggtccgcaaacaatcccaacagcaacaaaaacacatggtgagacgttaaaagaaaaaatatcgcaagagcagaagcacctagttgacgataagtcaaattctgccgatgcaaaacaagatgatggtagcggtactgatgagaaaatcgcgcatggtcaaacgctaattgaccgacttaaacagagcgaggagcagaaaaaagaatggggggacccaccccaagataaatgatgatgggcgagcgccgaagcatggagaaatgctgtggaaactgttgcgatcaacggtgccgactaaccaacagcaaatgggcgatgtcatccaccaccaatttgctgatgctgaacaaacccgtggacaggtactgatggagctgttgaaaaacattttagaagaaaaaactgacactgcggatgcacagcaaaattatcaccatctacagaaatcagcccatctttcttcaacactgcgaagaggtgaagcgttgaaggaactgattaaaaaaacacaaaatgaacctttgcataaatcctctgcaaaaacgcgaggagaaattttaaagttgatgttggaacatatgaagttttccagggaggaggaggtaagttttgaaaaacttgtcgccaagcagcaaaaagagtcaaccgctgccgagtttgtgttcaacgatcttgcacaacgatttgttctgataaccggtgcgggcgttctgcatgtggatgtaagtaagcatcttgcatatgtgctcggctttgacaacactcgtctgtttcatggggaacaggcacgctatatgccagatctgtctggtggtgttaaacaattgtatgtttatgctccaaagcttattgaggagtgtatcataggtgaccgaatggcgcctctgcttagggtggtcaatgtttcggccgcacctgccagtgggggagggacggacgtgcctgaggttatatataccaatgaaatatttcattcacttcaaaacaaacgcatttccgaaattcgcatagaaattcagaacgcatttggacgatacgtcaaatttaattggggaacctgcattgtcactctgcattttagacggaaattattttaaaaaatatcagcaacaaaatgactcacgtcacatttaacccggatagcattaactggggacctcttcttgctttagaacaagtgggagggggagaaatgcaatattttgttggtacacggcatcagcgtggtgctggtctattgagaaatgttgcccgcttcctgatgccggtcgcttccaatatgctgaaggctgtgtcacgcgagggagtgactgccggaagccggattatggaggatctttcgcagggaaaggccctcaaggaatccattcaggcacatgcaaaacatgggatggaaaacctggctgaaaaattgaagcagtgtgggaagggagcccctacaaggaagaggaagagaccggtgaaaaaggtgaaggtgccattgccaatgcattcgttgagaggcaacaaaagacaggctatagaccaactcacatttgcgccttaaaatagacggtagcgcgcctgtcaaagggcacacacacacacacatgaaaatctataaataggcacgtaaatggatgttctgtctacttgacgttcacttaataaattcagtggcataaaactaacaataatgagcgtaataaagaaaattgacaaagacagtgttgaaggccttgagggtagcctttcactgttttctcttccgccaacgaatgtggcgataaataggaccaatgtccgcgaattgttgcccttgtcggcacttaatcagaccggcccgtatctgttccgtttgttctcggacagtcagtactgcgacttgagcaaaacatacatgtatttgctcagctctattgagcgcaagaatggggcgggtgaatgggttccaatcagtgatgcggagccggaggataagcgcgttggtgtaatccaaaactttggcagcagctttgtccgctcactgaaaatcaacatttccggtatagaagtgttcgacagctccatttattaccattaccgggactacataatgaaggaactgggctactcccatgaaattcgtaagactttccatgaggcagcgtgctattataccgatgaggatgatggacaagacagtgccagcaacgacggcttcatcgcccgtgcagcgcgattctctaacggaaagcaatgcgaaacgatggtgaggctgaactttgatcttgcacatcagagtgcattgatgttgaacaaccaggacgtgatattcaccattcatcgtaacagtgattctttcctcctgcttacgccccccggaaagaaagcagacggaacattgcaggaaaacagcaaggaataccgtattcgcgtgcacgatttgcgtctgtatgttcgcaccgtagacgttacgcctagccttaacctggcaatcagccgtcagttggagtcaacctcagccaaatacccgctgcgtaagattgagatgcgctccatttttctgggcaaaggcaggactgagttggctcacaacgtgttcacttcaaccttgccccgtcgtctgatttgctgctttgtctctacagacgcttattctggcgatcgaaagttatcgcccttcaaatttgaacacgctaatgttcgagcgataagtgcggaggccaacggtcaatcttttcccagcaccccatacctgctgtcgtttgacggtgcacagcaacgttttgtgcgcgcttttgtcgacatgtacgccggtcttggtctggatgattcagacacaaaaacggtgtccattgggatgcaacgcttcctcagcggatgggccttcttcgtaatcccgatgacctccacgctggatgatacgcccggctttgagttgatccgtcagggcacgtgtacgcttaaggtccaatttgaaaagcctataaaagaggacggttacgaaatgttgatccttggcgagttcgattctgtcctttccatcaacgctgaccgagtgttgagcacggacggaagtgtttaaacagtgggaaaaagagagagagagatatgaattcagcacaaatagatgtgctactaaggagaatgcgtgttacaagtgggaagttcatcggcgtttacgcatcaaacaaaataccaattgtacttgagagacagaaacgactgcggcgctacccccactgcatggtcgtaaacacagacagggagggaacacgcggagaacattgggtagcgtgctatgtgccctgtgcgaagcgaattgaatactttgacagcctaggtgcggcaccaaatccagatttgtctgcttatctcaaccattttcaacatgtgcaggtcaacacgcatcaaattcagttcccctcatctgatgcttgtggccacttttgtgtctatttcttggccagccgatgttccggcaccccgttttgcaatgtaattgaaacgctgcgcaaaacacgtgggatggcagactggttggtcaaatggtatgtacgtacactggcgcgccatgtataaaaggccgaccaaaagtggggagggtgccacattgtttctttcattgtgagaacagaaggatgtcattcttttatttcttgctgatcgccttcattttattccattttctccatctatctgccggagaatggattaatgttgagctgagtgtggacccaccaaattcttttgaccgttcattccgcaccatttccaagaattcacctgcgcaacattggttcggctataatcgggacacagcatgtcatgttgagctggagaggaatatcaatcggctgtacaccaacccggatacgtggaacattgccctgacagatgtggataatttaatgagcctgggacggacaacaattgagataccgtcaaccgccttaccatgggcatgttttgggcatggcggccatagttttgtaattttcaacctccaaaatgctgcgggtgaggtgaccgtactgcgtggacaccaacaaaaaatagcacggcaattgagcgcgtatggccgcattttgtttgatcatattgccgcccgattgtacattgtggacaagagcgaacgcagaatcaatgagttgctcattgccgatttggagcggtggtggactctgaataatacggacgatgcgttgaacaggacgtcggcacatgttctgagaagcaattttgttggctttttgccggagcaaaaaacggattatttcattgcagctgatcatgtgtacctgatttggcgaaggcgagtgtacaagttccgcattggacactatttcaacgatccttcgtcacagctccagtttctgaccaactcaagcgacatacgcttcaacttcctcttatttgaagcaggtgcagaaaggctgggtgaaggcggcgatcgtagaaatagcagatcagctgttgttgtaccagcggtgtcgtcgaacggaattgaacgtctcttgctcgcgttgacttacctattcgatcttgtcgtcatattgattgccatttgtgcattccgccagttccgccgattgggaggtggtgcagccgcacgaaatggggatgacgcgattgaactaaatgaatacgatcttttccattcactttcgttgcaaaacaacaacaatgggggcggagcctatgacgtatctgctgcatacaatccaacgaatacagcaccaaggaccgcccaccagctgagatcttgtgcaactatttaaacggctcactttttttttgaattttccaacacacacttgcataaatttactgttattttatgacagccaaaaaataattatattgggtatttgctgcggctatttcatgcaaagagcgataaaacattttcaagaatccttggcactagacaccgttgaacagctgtatgcgcattttaaagaggaaattttgagcgcacctggtgaatattatccaaatcctctttgtgggcttggttgtgtacacattgtcaacgacgatcatcctgatctgccggtgtgcgtcgaaggaacgcttgatttgatcgcgggacttgaactgtactccacatgttatccgaggacggaagcagggacaatcaactggtcagcaagcagagcaatcacaatcatagattataaaattttcaatttatgagcaaagtcctgtacgtggagctgaaggacatgatgatttgcccgggcgagtcgccttgctgtcgctgcgcacaacccatcaacaacaacctgtcacactaccagctgatcgtggacgagctggaccgttggtgggtggacaaccaccaacacaatcgggggcacgtcgtcgaacgagaagaagaggaaagcgtcgaccactcaacctggtgaaggcactgtgtcgtttcaacggaggctgcatgccatcagttttaccccagatgattcagaggagacgaatagaaaatttgtgctttcttcgtgatctcaggctgcgaacagtgcacctgaagaataacattatgatttccgccaactcattgtcatttcacagtgcaggcagtttgcttgcctaccgtggctatttgtccataacggtagagcagcacttgtacgttcgccatcgtgttcgtcttaggttccccttcctgccctgcgttgtgcaatatgggggaaatcaccatcactattattttccattagaactgcttgaaatatgttctcgtccaactgacgaatcctcctaatctacacaccttccgaatactgttttattgttgctgttgctattgtgaaaaataaatgtttgttaacacaagtgccgatttggggttattattttggggtgagcacttttcctctattccaactttcttccctcctgtgcgttattctggactatttagtttgccgccgcctcctcctcatcatcatcaccgctatcgtcatcagtgacttcggcttcagactcagttgaagaactctgggccccttctcgatgagagtcgatagctatttttttaattttgtaataatcatcatcatcatcatcatctgattaccattggaaaaatgcgcggcctcccaatcacgaaccttttcctcagaacgttcaaccctacaaaaaaaaaaaaaaaaaaaaattggttgatcgagtcaacgcagtttatttttgctaatacttttttagtatggtgtccaaangagtcttcccctaaaatcgac

SEQ ID NO: 346 - DNA, 10193 bp, Heterodera glycines
atgattttagaaaaattttcaggtacatcgatcattccgttatcgcttttcttcgttcaaatcaccaaaatttcgacaaaagaggcgccgacttatatttgtggattccatcatcacacatcatggatgtacagccaatttgggacatttttggtcgtgaaatttggcccattttttcgacaaacattcgccatttacgctttaacatggtgatcagttggacaattttcttcgtcgcactacgccgacaattatcactgatctcaatcagttgaattcaatcgattcatatggtctgttgcccgaggcaattgcgattggtgacgatttggcacacaccgagaaaagatggccaacccaagcgattgtgttgcacacttttgaacgacaagtgtacttcgattgggtcaacaatttcaagaaggtatggtcccatatttttttgcatattactgattttgactacttctatttttattttccaaattatttagcaatttctccgtgccaatgccatttcttccgtcagttaccaaattcattttactgttcatgcgccatcaattgtgacatttgaattggtgaacgaatggacaaaggaaaagctgataacaaattggagaagtaataaatgaacatctgctgattctgcagttgcttatattaacatatttatcggggtcaattaacataaattaaggcaaaatgatgacctaaaaaagaatgccccaattcagaattttaaaaccaagagtcaagaaatgccatccttatttaagagaaattaaattattttgtgaagtttctcgtattaatttttaagattcataggaattttttcgaaaaaacttgaaactgagtcacaaaatcgacgttttaataaacgaaattaatagcaaataaaatagtaattagtattataaagccaaaatgaaaattgaaaaaaagaatttaaaaaataaacataaataaagtaaaaatgacagcaattagatgaatttctccttcttccattctttttgctttcttcagagagtcgccaaattgaatttgaaatttggcccaaagttcgcctcgattttgtcgcccacccacaaagaaacgcacggaaacagagaattgagagaattggcgggagtttgaatgaaaaaagaggaataatcttaaaaataaaattttaattaatttgttttttcattttaattggcccacccattcgttggccattcttcgtcaagaagatcagtcgagtatccaagaaaatgccacatccgaccacgtcaccagtggaaaactccgatgatttgtatgccatttccacgtccgccgattgcattgccacgggggaaaatgacgaaccaaataatgacattggcattttgcacggccgattgatgccattacagccaaatgagccatcgcttcggtacccgtaactgttcaaaatttgaccaattgacccgtccaatggcacttccaatcgcagcaaaactgttaaaataaattcaaaattataaataaaacgctaagaaatcatcaaaatgaacaccttttcaatttgaacactttcatttcgaagtagaaaattccgggacgacaaaagttcgtaattggaaatttcgcaaaaacagagtgccatcctaattaagaaagtaattaattaattacattttttaatttttatattaaataccaaatctgttgcccttgcaattgatcgtcaattgcttttccccaatgatttcgatgtctttgtggcaaactttggcatcccaatcattttgttgctgcgaattaggcacttcctgaaattaaatggcatttgtgaaataattaaggtttccttcccacctttgcaactttcgctgagacaaccgccggcggcgaatggtcgcccgatgacgtcactaaagcaactaaattagcaataaatacatttaaaaaaaaaaattaattttttaacacctaaatatttataattagggctgtaaaaaatatgtacaaaaagtggtcatatatgtacataaatatgtaaaaaaaaatcccgaaatatgtaagaaatatgtataaaaacccaaaatatgtacgaaaatatgtaaataaaatttttttaaattgttattttttggaaaattttttttcataaagtgttaaataggcacaaaatgccataaaaatgaccaaaatgtttaaaatcaccttttaacatttgaaaaattatttttggaggggtacatttaaaaaaagattttttaattttttcacaagaaatttctaaaaattttcaaaaattctcagaatagctatgtaaaaaaatgaaaaatttgccgaaatttttggattttttttttgagaatttccaaaaatttccgtaaaaaatcctcaaatatgtaaaaaaatgaaaatatgtaagaaaaaagtccgaaatatgtaccaaatatgtataaaatcccgatataatacgagggttttgtcccctctcaaaaaatgcattttttttataacgccaatttttaattttaaataatttgccaattgtgcccacccaaaacattgtttttgtccaccacggcatattttccatccaatttctgttcggtgtttttgttctgttgaccaacactttccttctgctgcttttcctctgctaaaaaatgtatccaattgaataatagaaaatgaaaattaaaaataattggcattggtcagctaattaaatatgttcatttaaaatttgtaactgatcaaaattgtaaaagcttatggtccgttaaaattttttcgcctttttaaagtatgcaaaatttcggtccgttaattatttattttaaatttattatttaccctttctgccctcctctttgttctgccgattttccaattgtttgattcgctccaccaatgaattgaacacatcgacagaaactgaaataattttgaagcatacagtactgtccgagtacggtaataaaaattatttatttttttaaattgtctctaccgtattttttgtccaattgctgctgcttttcctggtccatcttatcaactttcgccttcaattcactgttttccgacatcagcttctgcttctccaactctgctttaagcgccttctgaattttcttacaaaatttgaaagtttctgttttatgcgcgttcgctctcagttatttcgtcattttttaaatttttttttaataattaatttttcttacattctctgcattcaattccccgtttttgcacagcaatttcgtttctctcaattcggcactggcaagtttttctcggcattccttaaataaaaaaagttttttcagtccactaaataatttccaatttccttcactcattaattgcatgatttttggcaaaatgtctcttgattgctctcggaattggtcggccctttgtccgtgactgatccgtccggcctctctccccctcccccccccccactgtgatcatttgtgctcccccctctgtgctcatttgtccgttctgaaatgtcccaccttcaacagctgctgatcactgaccaaaaattgtgctgccaattggtcgctcaaatctccgtgccaactgaacacttcatacttgtccacttcttctgctgctgctgctaatggtgataaatttttattttattttatttaaaaaagataaaataattttccttttttcgtaattctttttttaattatttctcttaccctgatcagctgttggacggaaaaagcaatttggcgaaccgataaaatttgaagacatttttcgaattaataaggtattaattggactggctacaaattaaaatttttaaataaaaaaaatatgaaaattggaaataaaattcatcttcgcatgtaaatgaatgaatgaacatttgatcttttgcgctgaatctcccctctatttatgggctggcatttgacggcaaaaaagtaatttgggcaaaattatgacccatcaattagaatactttttagaaatttataataatctcttcttttttttttggcttgggctgttgagcaaaatgatgacctaaaaaatgggagagggaaaatgcttttatgcaaaaattgaaaaaaagtaatatgattggagcttaaagtattaatcagcgaaagatgtgatggacaattaaatgtttctttttggtattaatatgtaaattgttcggcattattgtgatcagtgttgaaaaaacggtgatcaaaaatataatatttttatgttctaaaacattccatttcattgacatttttagtgacgaaataccgtaaatacaggggtaggtaccgtaaaaagttccaggggatgggaaatttttttttttaaattggctcaaaatcgtaaaattttgtcattttttgaacaaaatcgttaagaaatcgcattaaaaattacaaattttttccggcggcgcctagcggttccctcacacattctcaaaaagttttttgaaaaaagtgcaaaaaaaaaaaatcaaaaagttttttacgaaaatttcaagattaaatttttgaaaaaattttcagcgattttttctaaatgttttcgaaaaactattaattcctataaaaaattgaaaatccgtttcaaaattttttcaacttttttttttacaagtacatattaaaataatatttttttggtgtgattaaatctattatttaactgaccgatgttttttcaagttttcaaaaaatgcttaaatggttttaaaatacattcttattataaattagatatttttagacgttcccaagcaattaattgattttttcaagcatttgtttgttttttaaaacaaatttaaaaaaatccaggtccaggcctggatccaggtcccgaggagcctggatttttcctggacctggattttcctagatttttgtccaggaaatccaggtccaacatggaatccaggtccaggcttttttcaaaatgtcgatctctaaaaataattaatgattcctaattacgaacaatactattaaaatgagaatgtctgggctaaaaatgagtttttcgcgcatttctcagcgaaacaaagcagcaaaaatgttaaatattgtaactaaaatgcaatcccttctgtaagcatagctatttggccttataaattaattttcattgatattttcattcctcccatccttgagtcaaagattgtgccaccccaacattttgctttctttcccctctcttttctctcattttcgctcctttttttattatgtttgcaatttttgcatcgctaatttttaggtttctttctttgattttaaaatattttttcatcttttttaatttgtcctcatttgaatgtttaacttgtacttaaaaataaagataaactaattaaaaaacaaattctctcacttttatgatattttggcatcaattcttttttccatcttcgtaatgtttctttagaaatgcccaattccttcgcaaattctttttgtttgcctttatacaaccttttaaattcatcaaatcgttcaatgaattctttctttttctcttcataaaaaactatgtttcattattttgaatttaattttatttaaatttaattcatttttccatttgtatattttttcgcgatatatgcctaaaattcatccaattttcctctcaatttttgtttgtattttccattgaaattttcacttttcttcaatttttctttaattacttcaaattttcgaatgatttctcttttttgttgatcatttgggtctgtccccatttcttcacccatttgatcaactgatgctgattgtgagttatcatttcgctcatttcgttcagtttttatcaaaatttcttcacattcatttttgtcccattcttcgccgaatatttcattaaaatttgttcggattttgccggattcaattccaaaatcaaagaaaattgtaaaaaatatcattaaatgccacataatcttaggatatttattaatatatatataaaaaaatttatgaatttattccttcaaatgaatatatttaatgttaatattcattttaggtacttttccgttttggggccaaaattattttatttatttatttatttttttaatcaacagagggcgcggagaattgctaaagctactcaccaaattatttctgaggcataaatgccataatttgagttaatatctcttcgaatggatctgcaattctattagcttgctgttgatttaaaaaaaaataatcagctttggccccaaaacggaaaagtatctcattttatttatctttacaaatattaatctgccacgtaaaccgaacaattaaatcaattcttcaaaatattttatatttttttaaattaaaatttgttattaaatgttatatcttttaattttaagagatttgctgaagtaattttcgttcaagttataggtgctaaaagaaaaccagggaagttaaattaacaccctcgagaattactctccaaaacttaagaaaatttctttttccaaattcttagcgttccatagccaatttgcaatttattatcaattatttttgtcgctaattttcggatttctttcttggattttgaaatatttctttatctttcttaatttgtcttcaacgaattaaacggatgaatatataaaataaagaatctttgttttgaggtaatttaattcggtgctaggtcgtttcttaaaaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaactcatatgattatgtatgtatatccgttaaattaaatattcaataatatctattaatttttatttgttgtgcaagtaagtgtcagccggaaatattattagtctagcagtgacagactaaaaatctttattaaattaatttacaattatttacttaatttttatttggttgtaccaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatattgttggagaacgttttaaagaaggataaaaataattattttattttaccgtcaatagatatgcatatgtattttaaattttttattgttatgtaaacttctaatatatatatatttatatacataatcatatgagttggcggttttaagaaacgccctggcggttttaagaaacgcccacctggcggttttaagaaacgcccaaagtggcggttttaagaaacgcccacctggcggttttaagaaacgccctggcggttttaagaaacgccctggcggttttaagaaacgcccaatgtggcggtttttaagaaacgtcccagcaccttaaatttttattatttagtgaatttttaaataatatctattataattaaatttcaattaatgtattattttattagtttgatacatgcacttttttcgtatttcgcccaccacgcttgcactttcgtactaccttcatcttaacaagtatataaccattatttatctatcaatcctaattaagcggttgattttttcaatcggataaatttgctgtacggcattctcgctgattcttgcactcccgacgcttgcccaacaatgagtggtgggccacgctatgaatatttgtggcaggacggagcccagtacaaaaagccaacaaggcttccagcaaaagtgaaagccttaaaaaaaattatgacaacaattttctaagcactgttgcaccagtcggattatgtcattttttggataattttttgggagcttttgacttaacattcaatccctggtttaccgaaaaaaaaatttgtattaattaaaaggaattttgattttgaaagctggtttttataaaagggacaactttttcagaatttattgaaaaataattctgttattatctccctgtaaacactgatttttcactacaaatcatagagaaaaagctactttaaactcatttcttgtccttaattttttaaaggattatatgcacttactgatggattggattgaggagcgtattaatgacgagaaaattttccctaccgcgacaggtgggctaatttttattttatctataaatatctaaaaaaaaaattttttaatttttatacagatgtgccattcccaaatgattttcgtcaaacgtgcaagaaaatcttgtcacgccttttcagaatatttgtccatgtttacatccatcattttgatcggcttgttcaaattggagctgttcgtttttgaataaattttaattttcaaataatttcatttttgtatatttttatttaaatttgattttcaggaaccacatgccaacatgttgtacaaacatttctactatttcgtaactgaacataacatggtgtcccaaagagaactggacgccttggtaagcgcacttggctttggcttaattgatttatttagggtagaaaaccatcatttgaaaatgttgagaaaaagctaatttttaaaaacagttttacgagttgcatttgttcgagttgccattgacccgcgttatattcgcataattaaataaattatttatataaattattaattatatttaaattaatttttcacttttttttagaaggatttgactgctcgattgataacatcacaacacaaccaacagcatactgctatcgatgccaaaaatggttctaccgcaaaacaaatctcaccagccaaaacaaattgaaatttaataaatgataattaattgttgttaccgtatttcctctaatagggtctcggggctctatttttcaaatcgccggccgaaaggtcgccggaagatttttaggacccaaattttttcaccgttaaccaatttaagcattcttggaattgttcggtagttctatgtatttattattattctgccaaatctcaaaaaaaaattcaaataaggtatgctagaggaactcaaaaaacctagtttttcaaaaaaaattttgcccttttttgtacatgaaaaatttaaatttttcaaattaatagagggttatgaattaacgaacaattccaagaatgtttaatttagtttataaagaacaaagttattgtccaaaaattcgtacgccttttgtcctgctccgataaaattgaggaaatacggtattattattaattatgtgatttgaatattgtcctcatttgcatttctatttttaataattggccaaaaaagtaaaaattggtaaatgtggccatagcattttgcccactcccaaaaatgtttggaaaatgtcaagaaaacacccctcccgataattcgtcatcctcgtcgcatttttcatcgtcaacatttgctgctttaagctgcaaaaattcactaatagggcatatgtgtagggcaattatttaaaaataaacacaataaataattgctttttaaaattcggcttttttgcgatgaaaacaataaaataattatgatgcttattgtagcaaaataaacaaaataaaatgttggcgctttatattcaaatataatccatcaaattttctatcaattaatcaaaatttgagactccaaaagcaaatttggaacaacgattgaaccttgatattctgtcattaactcaattcccattgattgtgtgcaaaacgggcattttcctttgattgagaccaaaattttttgacacataatcatcgtcattaaaacatgatatagatgaagggattaagaaggaggtggcatgttttgcactcatttatgcaatacccccccccccccccgctcccctaaatttaattgaatttaagttatgtgtgcatcatcagccagcctctccgacgacgacgacgccatgaactcctctgatgctggtgatggacggtcggtctgtcggcgggtcgtcgtcgtcggagtggacgagaaatgagatggcgatgaggcgataaggtaacctcatttgagtgagttcccc

SEQ ID NO: 347 - DNA, 1619 bp, Heterodera glycines
cccccccccccccctccccgtgccgccgccctccccatcgtctgctggtgctgtgcgtcgtccacccctacctgtatatgagggacgggggaggggaggtgggtgccccgtgctggtgccatcagatcaaaattctttcaaacaaacacaccaccgccaccttcttcatcaccaaattgaaacggaggaggaggaggaggatgactggctggctgactctaactaaccaaccaattaaaactgattgaattaatgagtgagtgaccggcggagacgagaatgagttaaaacgggggattggggggggggagcgagggatcatcgactggctgctgctgatcgtccaccatcacacatcagcatcagcgcaaaggtggagcagtagaagtagttgaggtagtcgtatgtcgggtcgttgggggtcgggatcgcgctggggcggacaacacaaacgttaaacgatgcaaattgtgaaatttatatgtggatgagtgagtgagtgatgctgatgatggagcgaaatggcattctccgccaaccggcgcggttggcttttagcaatgatggacaagtgttggtgaactgcattcggcgagtaaaaggcgcttttggcgccgccttttccgacaaaattgacgcgtcattcgaagaccaatgcccggacggcagtaaataaatttttattgacatccattttgccgattttcaaatcgcaggtgtccaatcacggcatttcgcctaccatttacaatgtctgaatggatgggctccaaatgaattgctcagatgtgaaatatgtccaaaggtagcaaaacccaattaaacaaaaggcattttaccgacagggacattttgccaccaacggcacttgtgccaaatgccctacggggacatttgccaaacaagcgggacagacgaagtgcacaccgtgcccgggggggacgaccaccgccgaggccggcagtgtggcggagtggcaatgtttgggtgggtattttcaactgttagttttttattatgggatgggcattctcgggtccgcggtcgcgtccgttggtctcgttccgttggtccgtctgtcggttcgtccatttgttgatcaatcggttcatcgtcgttttggtcaaggctcgtcagtcatcggtttcttgcgttgttccggcatccgctcctcgtttgcttgaatcccatcgccttatccgtcttcgctttccatctttctttctttttgtctttttctttcacgcattttcaaattctgtcagttattacaatttttcaaccattttcgtccgcttttgatcagaccaccataattccaggctttgatcgcctctggcgatgttttgaatctctgaatctaaatgatcagttctgtttattcaatgtcctcataacaaacgcacacacacacacactgcaatttctaagtaaattttcacaaacaaatttgttaagaatccactgaatttcatcatgctttcttatatatttttttcccttttcggtatttttccttgcttaatttaagaacgactgacctatgaattcgctgaagctttttataatcacgtaaaaaagctaacattatcactcaattttttagcttccattattat

SEQ ID NO: 348 - DNA, 5014 bp, Heterodera glycines
  misc_feature (4994)..(4994): n is a, c, g, or t
attgtgcacttgacatggatgtgtggagggagtgtggtgatgatgcatttatttgtctgtgagtgacagacacaaaaaaaaagtgccgtcagaaaagtgaattcattttttttgccattgtgaatctgtctccatcattctctctctcaccctctctctaattgtccctaatgtgtattaattagatatatatgctccaagcattatctaacctattcagtgataatgcaacaacaaaaaatgaaatttgtagatgatatgaggctgatgtgtaattgacctcatcatttaaaaaatgttctcatcccttccttcctttcattcgcattaaatatatgcttttaattatgaaactcatattccctttaagaattaaaattgttttatgtgtattagacaatatgtttattaattagtcaattacctaattacattacttcaatcttattcaatttttcaattatatctagcagtgttaattacagacattcaacaatattttagcaaatgaccagcagtcaaaattcaattatggatggcgcaaatctgttgggcaatttggagtttttgaacagccttaatgaaggccgtaatttgcttcatacacaactggcacaaaaacagcaacaacagcatcatgtaaaaatcgatgatttttgtaaattttaaatgctaatctttaaaatacagtcctcaacattttgccaatcgccgtttccactaaaacaaccgaagatggaacataaattggacatttttgctcaacttcaacaattggtgtcctccagcagcagcagcagcactaatggctgctccaactccacagatcaccagcacctagcatcatcattcccgaagcagcacattgcttcaatgcacaacaaaatgcttagtgagaatttggagaaaattttggctaattaaaatgattacggtcaattacagtacatgcttacagtttcgtgctagcacatttaagaatcattaatttttataatttgtttgaaaattgctcttcatgggcactataataggtattagtctttggaaaaatagacctatcagattaagtataaaaatgatttcaattcagtaaaatactgactttttcgagttttcaagtaggaattgttggcactgaactgtgagtgccaaaatttaaaatgcagtaattgatttaatacggaaaattattaaatttaatatacctttccattttttaggtcgggaaaaaaagaaatttagctctgatgtgtcagattttttggtgcttgaagtgttgaaacggaaagagctgttggttgagaacaacacgagccgagtatgtaaatagataataagcagaagaaattcagcaatttttgatcaaaattccctaattttcaaaaataaaacaaattataaaaatgatttttcacacaaaatttaaaatacaattcaaatttttcagaaaaatttcttttattttacaggatttgtctttttcggagtgcaaaagaaatgcttggaatgatgtcagagagttgctggtgtccagattccccggctttgatctgaacattgaagcgatcaagtcacattggcgctacagaaagcgcaaagtgaccgacgcgttcagtgaaatgtgcaaagggtgcgggaatttttaaattgcataacatttaaaaaatttaaaataatttttaattaattaattaaatttttgttcagcagtgaagccgaacaaaagttgaagctacgacttgcggctgtcgatttcgaaatttatagccagttgaaggattcaaatttgttagaaaggacaaggcttgagaaggacgcatcaccggtgtgaaaacaataattaatttatttacgtatcattattattttttaaataattaattaacaggatcagtgtgatgatgggcattttgaaagtatttcgtcgtcaaattctcccgcaacaagagcaatcaatgctgaatcatctgctgctgcttctacaatgtcacttgcgccaactctgccaatgatttcacaggtgtggttgtttttttttttttgaaaaaaatcgtttttatccgagttcttccaaaatttgtccatttttaatagcccgatttttaatacgaattccccattttccataggctcccttctttctgggccaacttggcccacaacaacagcaacacattggcaccacaaacccgacaatgttgctcgaacgcttaacagccagcttattggagcagcaactgaagcaacagcagcagcagcaacactttaccaaaaaggacgtcgaagaggaggagaatgatcaacagcagcaggagcagagaggacgggaaacagttcagcacagaattaatgattaaaatgaagctaatatggggggggggggtgtgtacaatgagtaaattgaaccctaaatcgtacacgccaaaacgtcgtcgccgccgtaacatcaccggaacgtggaattgtcgcttcaaaaaattagaaaaatttaaaaaaaaattaaaaaaactatctcttaaaattatttttcttaataggctaggtaacaaaattttgattttttttttcttatgttttttctaactatttttctaatattttgctgcgacgatgcgcccaggtgacgttttgtcccgctttgtcacaaaacataaccttgttgaaaaaactagcaattcccatcctgctgctggtcccatttacataatcaaaaataaattctaataataaatttatcatttaattttgttttcttttccctaactgaaaggatcaaattgtggacgaacacgacggaattgtaagcagcggagaacgacgaagccaatcggcgtccaccacaatgtccaacctgagcagcacgataatgccaactgcagcagagtaccaccatgttggcaatgcagcaaaggagaacggtggtggcactggcgctggaccggaaccgccggcaccgaagcggcttcgtcttggcagcgcggagaacgaagaagagcgcgagatggcattgctcaaacgagaggcgtacatggtgccgtatttaaaaaaaaagttatggccaaaaataaccgaaaaaattctggccataacttatttgagttaagaaaaattttttgaaattttgccggctcaagagaataattagcgctttcgaatgatatcaaaaattaaatatctgggtcaaaggacgaagctcctatgattataaatcagatttttggattaaatattttggaatttcaatgaataaaagagaaaataaaaactcagaaaaaatgcaattttgttgagtttccaattcctttttaataagcatattaattgaggttgatacatatttgaaattgaaatttatttttaggcgcaagcatcagcatttgatgagatacgatcgctggtgacagaagtgcgttcaactcttttaccgcagatgttaacagctcttcaaaattataattcgcaatttaattcataaaatttgatatttttcaaattaattttttcgactatttcattttgtgagaatgaatattttgataaatttttgtaatttaatttaattttaatataatttttaatggtaatattacctattgtaccccgccccctttttttcaaaaagcaaatttttctaaaaaaaattttaaaatagttgttttataagttttcaggatcggagaatagtagagttatccccctcccatgcataaactatccacaagggtaaatgtgcacattgaattgattttgggtaatacttgaatttttggaaaaaaagaattttaatttttgattattttttcgcaagaatggggagacaaaaaattcaaaatattttaatttctgtagagggattgaaacaggggaaagaagaagggaaaagtcaaagagactagccactagaccatttgcacaatttgtattgtttctttgaaagaatatatttatgattatttcttaattttttccttttaactccaattttcatcactaatttttcactcagaccccattcttaccagcgcttgtttttcccggttcccggttgccctaccgggaccgggacctgagcttttcaaaatccgggaccgggaaccgggacctcggatgaccgggaattcccggcccggtcccgctctactctatccaaaattcaaattctaatctagatttatttatattacgccaaggcgaaaaattcaaaactaaaggtgaggattattggctaactcagctgaattttggtgtctcaaacctcaacaaaaaatttatgctgcctaaattttaaaaaaacggaaatctgctgagaatttttcattttatttttgcagcatataagtgcaaatgagtgccagttttgatgacgaacttcagctcgaaatgcaatcaattgaggccatttttccaaatgaaatccatattgaatcggctcgacaaatttctgtccaatgtgcgtcgaatgtacaactaaatttgaacatcccggcagactatccgaggtcatatgatgctgtgtttttgggggggggggggtaaaatgtgaccgaaatataattatgtatattttaaaaatttaaacttcaggattttttttaaacctcaaaacaactgtaagaatttaaatttggtaaatctgcatattattcatatttccgggacggcctaccttggctattgccttttgaccaagggcgtagccagacccttggctttgggggggggctgaaatcaaaaagtcgatttttaggggtgtattttaggttttttgaaatcccgaattaggggggtgtattttacaattttagccgttttcgcaaaaaaaaaattactattttttgccattttggtttctattattcaaaaatatggtaaaatggccagtggtgccgataggcgccgccgggaaaatttttgaatattttaatacaattttgttaagaaaattacttaaaatttcaaaaaaatttactgaaaattttttactttttagngtttcgggggggggggggtc

SEQ ID NO: 349 - DNA, 13340 bp, Heterodera glycines
catggcatgaaggatgggggcttcctgtccgaagtaacagagatcaactacttcaggacgggaaatagtcaatgtggatttcgcccctacgagggctgaaaccaccacactcctgtaccaaagggaccaaggggtgaatgtttatcccccgtctcccgtaatgtcgaaaaaccgacattccggggtaaattaaggtccgctcagctccaccgcgagttaacccatcaatggttagttcgcgattggtggagaggtgattggtccgaagaaaggctccacttctaagaaagtctcttagaagtgcttctgccgatctcctccctctttggtaccaatggtttcccaagattcgtggaaaccacgaactcaatcgctcgcgatttccttgtggccagattgatctgggtggagtccacgaccaatctgaatcggccgaaattggggaaacctctctttcaagagaagaatcggaaccgggagggtcagagccaagctctgacacttgttcccaattccatggatgttccagaggaatttcttcctctgtggtaagaggatccacctcttcagtgaagagaaaatcctccgggtcgatattttctcgacccgagggagcgagacgacgaggttctcccccgtgttcattccttgaggagcgatttgtgatatcgctaaaaggggtcctctcaaaaggcatggatattttggtcgtgggtgaaagtttaaattgtgggatgaatggtaagtgaaatgagagttggtctatatttatagaaattttttgagggataggcagtgagtcattaggccgtgagtcacctccacatacgaaggatcctcccccggccaagtacagtattgccaatactgtagacacgttaccgtatctttttctcattaaagaccaggaaataaatttccaaagtctatagaaaggagaaattttaatgaaaattgttaggcaaacaatgcctacacaaataatcattatgaaggcaagtgatgattggaggccaatcaaagaccaaagggtcgccttccaatcaaaattccagttatgccaactggattggctatccatcacttttcccgagtgatttgggctgtaatcttctatttgttcaggctggacatagtgtaatgtcccgcttagaacaaaagaagtgcttccagccaaacactttgtttggcactttgtgtcaattctggctttatcaaaagccaaaattgtttggtaaattgatgcattggaatcacattttgtcgaaaaatgtgttccatcggcgcaattaatttcggcaagagaattgccaaaatttgtcgagcacacataacggaattgtgctcccgttgaacatctgtaacacccagatatgttcaacggcaaaattgtgcaaaggctttggtgaagttccaaagccatttggagaccttcgatttgaaggtttaattggacaggactaaatcctgtcaaagcaattacctttctcccagtatttctgagttggtaattttttatgtttaatggaagtctcctctctggactttccattaatttttcaaggttatgtgaacgacaattgcagttcactaaacctgatgaatggtcaggtatgcaatcagtgcatgcctgaacaccaagactgcaattgaaatcaattgcttcttgccgacttttacagttaaagtcaattgttaatggctctctggttagagccatgttgttcccgtcgaaaacaaaatctgagtttaagacgggagcgggcggaaaagttactccgatcggagtaaggctgatgttgttccatttcagtgttcttcctggatagaggaacacttgagttgacttgggtttttcacccaaggtttccaggcgaattattgcataaacaataaattcccaagaattgcagcccatgatttcatagactgtcttggacttttcctgagcataccaacgataaaaaaggcatgcactgccgcctaagaggcatttattgccccaaaaggctgtgctgtccaggcaaaatgaattgcctggaaattcgttggcatcttttagctcaggaatggaagtattgtggcgaacttctccacaatactttccttcgcaggagcccattttagggcaccttttgccggccaaaacattaattgcatatgaacgttgccaggctttagtaaagctttggcactccaaagctaaagccttaagcacaacgtttattgaaccaaggagaacaccttcttctgttttcagaagaagagtgtttgtttggccaactggtagcaacgtcaaagttgctgaactttcgacaatgcatttcatgcttgtcgcatttttaatgcatttttccgatttggccatgactgctatggtctctgctccagtcaaattctggagagagttagccataaggacaacaaacgccattgttctgtaaacacggcgtgatgtccaattttgagaagctgttgcccttggcctcctatctttcggaggccgatttgggccagctaaataaattattggcctgataaattgaattatcagccaaatgaccatataaagtcctgaaaacaggacttttaatatggaaaaagccacaaagcttatgcttatgaatgataagcaaagtccccctgctagcattgatgaaatcaatggataacaggttggattcgctaactgttcaatgcaaaaatagcattcgatgagttcacactcatcaactgctggacataaaatgtcttttttgaacatgtgtttcgaatccatccagaaatgaccttcgcatttgaagtcatttaggaggatctccttgggcagctcgtaagtgagcttctttacattctcatgaatgtaacagttctctgcacagcagagctcaactttattgatttcttttggaatctttgctttaacgcctttgttaaagcaaagaagtttgcattcattgcaatgattggttggataagctccaaccaacgcaaacatagcaaaaaggatggaaagacagttcaaaactgtccccatctttgctttgctgcgagtgatcatgccatgccggttttggtcaattggttgatcaaccaattgaagagtttcagtctccttttcatccattggagcttccaaatgagatatttctttctcatttgttatttgaggagttccatttgaactttcttcaaatttttcttcattttctgtatgattatctaatcctacttccaatgggaaaatcttattcaccggacgggtgataatgattttccgaggcatggttccatacctctttgattttatcccatgaattgggagttccaactgaacgcttctaatggcccctggtcggccattaagctcaatgatctttcccaaagaccattggtttcggggagtgaactcctcatgaatgaggacgatcattccctcctttggttctgttttgtcctgaagacggggactcttgtggtcccatttacctctctcccgcagaaggaggaggtattctttttgccacatttcccagaaaaattcatgggattctttagttgcctgaaaaagggcaactaatttttggtgggatgaaagatttcgatccgatggatcgaattcttcaccattcgtgtcccagtgaatttggacttccggttgaaggaagtccactggacgaaggggcaggatttcatccatcccttctgacacagaagtaatagggcgatggtttaatgtggcttcaacttcagccacaaaagttatgagttgatcataactgaggacttttctccccaaagtccttttgaagcaatttttgcacaattggacaaggcgttcataaacgccacctgcccaagggctgatttgtggaatgaatcgccacttaattttattaagtgcgaaaaattcctgcgtgttttgatccactcctggagtggtcaaatgctcaatggttttttgagccaatttaaatgaagtggcattgtcactccaaattaaatcgggcttccctctccgacttatgaaacgtcggagaacattgaggaatgactcggcagttgtgtcaagcatggcctccaaatgaactgctcgtgttacgaggcaagtcataagaagtatccatgccttgactttctctccggccaaccgtgtttcggttggaccgagaaagtcaatgccgattgctttgaaaggagcctgacggcatactcgctcgtcaggtaaaggaggcatttttggcaatgcaaactggtatgcctgcatccttttgcaccgaaggcatcctttcagtgcttttttcactttagttcttgctcgaggtgtccaatactcgagtaagaactcagtgagggtgccttccaccccaaaatgatgccttttctggtggcattttaagatgatcaagtctcggatggaggattgtcctccgagaatgattggatggctaaaaccaaaaggttggtcacaccgtcccaacctggttttaagcctcaaaatcccctcgctatccttaagagaaggatagctgagggaatcttcagcctttttcatctgatccatgcggatcagaaggttctctgctaggagaacatcttctgctgaaaatggtcctttttcggacactttggcgatttcttttcgatgactctcgaaaagttgatgaggatttcccctctgaattaatttcagacggagaaatcttaacacaaaaagagtcacttggacaatctttgtccaagagctgaatcttttggggtcaatcagaggactatcaatcagttcctctgttctggtattaacgaagaaaactttctcttcgttatccagagacccttcctccagattttctggaggatcttttatttgaaattccatttctttaggccattggtcatggtcttccttaagccaggaaggaccattccaccagagagacttatccttaagttctcctggttttgcgcctctggttgcaatgtccgccggattttcggctgttcggacaaagtgaaaggcgcattcattgagagtacgaatttccttaactcgtctctcaatgaattttggctgtgcttcctttgaagcaatccaacttagagcgatttgtgaatcgccccaaagatggagttcagaaatgggtcgccgaatttgatcggcgacaaatttaagaccgcgaatccctattagaatggccatgagttccattctagggattgttaatgcttttgaagcatttttaggcttgagcctatttttggagaagataagccaaactgatatttggttatcttttactgctcttagataaatagcagctgcaaatgtgtgtatggaagcatccacaaaagcatgcaattcaagggatggattcccttgtagcattgctctgcgtgggattttgagggtctgatccttccaattttcttggaaggaggcccattgaatttgttctttctcagaaagaacatcatcccagcctttcttttcttcccaaagagtttggaagaaaagctttaagggctgaatgcacggccccattagaccaagagggtcaaataatgaggcgaggaagcttagaacaagacggcgtgttgccagcttttctaagccatgagttgggaactcaaagacaatttcgtctttgtctgtgtcccaaatgagccctaggacttttaccttgggcttgttcaggcgatcctcctcaggaatcgccttcattacctctggggaatttgtaacaaattccctcaaattgaaaagtccttctttaaggatggctttagactctgcatatttatgcaaagcctcttctgcggattcacactcaagaagagtgttatccacatacaatgattgggccaattcgttggccactggagaatggtatcccttcaaatggtgctgcaaagtcgcagccaaaatgaagggagaactgatcactccgaatgccactcggcaaaatcggtaagtgatcagatttgctggtgtcagtggtttactgacatccttcacccagaggaatttggtgacttccctatcctccggttccaaagcaatttgcaaaaatgctgcttgtatgtcggagaggagagggaatcttggacatcggaatcgcataagcattccgatgagatccggcagtattaccgggcctctatacaaacaggcattgagactgtttgttcctctggtgtgagcactggcgtcgtaaacgacgcgcaatttcttgcctttggcaaggactccctgatgagggatataatgctcaagagtgccaggggctttcctggcctcttcgattatccctttttccaattggtctctaatggtagcatcgtattgctccattaagtctggagaattacgaagcttaccaaaagtagacattagccttgaaaaggccatgcggtaattggaagggaggtcaggcacctcctccttccatggccacttaacagagtaccttccgtctttttctcgacggatggacttgttaaacaggctcattgctgtttggtcgtcattttcatttggatcgtctttgatccccaatgactccaaattaaagaaatattcaatttctttaactgttggcatttgcccttgattggactcatcaatggccatcattgatagtcctgggttcggaagttccggcccaaagtcggactctccgttaaccaaagggcccaaggttgtttgaattacaaacaaccctggagaaacttcttccttcccttggaagaattgccagaaatgtctagcacctatgagtatttcgggctcttcccgagaaaaactcatagcgtcggccatgtccattcctttgagtgggaattcctcagaattccattctgccattttgaatggcgtggaaattctctccgtcctatttaggaggatttcttcccactttccatccgttcttctgatttggatggaatacacgggagaatggaacctcattggtccattcctttctcctccaaagccatagacttccatttcttcggaagtcactttcggtggcttgagcctctcgatgagagggtcggaggcgtaggaagtttgacttcctgggtcgaagaggaatggaacttccatccaaactcttcgattatttttggatctgaccagtatttttctggtcattagaaatgcgtgaggctttttcgccatcacgcttgtcatcacatttgtagtgatgggtgagcattccgaactgggcacgcttttatgagcatgcttgctcatagtcagatgactttgagaggattttctcgcttctcttttcatctgattatttggttggccccgagaggttccctctcgagacttttctccaaaacacaccataaagtggtgtctttcaccacaatgactgcacctgcggggtgaggtgcagttcttggtgttatgccccatcatcaggcaattaatacacctgtcttgatccgtaaggcgcttccttcgcgcccccggagtggtgtattttgtgcacctgctcggtgcatgcccctttgtttcacaaagggaacataagcgttttgaccccctatctgagataggggtctgtggtttgttgatggccgagaaggaacgattcggttgaggagacatcctcctcaccggttcgtttcgttccattggcctccactgccgttcttgtctgaacggctgggagaaacggaacggtgttcctctcccttggttggctcttcccccatttggatgagggggaaaattgcgaggtttttcctctccacggaaaacctgagtacatctctgtacttcctctttcacttcaacgattgaggtgatagctcttcggagctctgtgcagttgaaggctcctcctgccctcatttccttctccaccacttgggtgagaaggtgatagggcagtttggacttaattgtggaggccatgaacttgttttgttcattttctccatagtccaataactgatggcaaatccgttcaatggactctgagaattgtctcagagactgaacggattcagctggtttggcaaggtggagcaactccgcttggagggactccaccattgtcttttcatccccaaaccgctttttcagaatctcaactacccttgggtagttttcatctgacggtgggtataagtcaattgctctcctagcaactgacttctctgggaggcatcccagcaaataaatgtgcttcttgaagtcttcaatttgaagactttcaacggaagtctcaaagagcttccaaaacaaaggccattctcggggttcccccgagaatttgggcaatgttatcggcggaagcgtcacatcatgacgctgatgcaccactggtgcctgctgcacaacttgtgctggctgatttggctggggaattgcatcccccagctccgagaggcctaaagccccttcaatggtgtcgacaagccctcgggcttggtcgacccaatgcatgaaggccttgccttctggtttgaagtctctgtaattttgctcttcatcttgaagagcttgtcccttcactctcaggaaaatggcttcccattttccattgtatttctccaaaagagaaattgttttgcagagattttgtctctctgcgatcagatctgcacggacactttggtccgccagctctttgcccaagttttcttgggctgtctcaatatacatcttgagacgcaccaccattggtgcaatggagatgcgcaagagctcactcattgctcttacgcttgatgaaaacgcaataaacccctttgggttgtgcgtttgatccaagcgctaaggccgcgctttggattggtttggttggagggtaggcttacgactggaagccgacccctacggggctccaattttgtgggcaaaaggccacaaaaatttgcacttcccggcagaaggggaagcagactctcccggcagaaggggggagtcttttaagcaaagcgaatttctgtccaaaagacagaaattcactgaatgtccaaagggacaaattaaaggaggaaattcctctcctttactgaagggacaatttgaaaggaggaaaatgcttctcctttccttttgtaagccttttctttgacccaacgggggtcaatggcttaatgatctgtatgaaagggctcctgagcgtcccttttacagatagagaaaagactaagactctttcttaatctttattcaatttacacaattacaatttaatgcaaattgcttggacagaaaactgtccgggtgacttaatcaaaaattgatcagagtgaagaaaatggagaatgggccgggcttttataccctcacaatcgatgggggcggggccaggcacgtgaagaaatgcacacaagcaaagggaaaaaattccctcaaaaatgatgactcatagcgaaaatatggagaaaagaaaagatgagtcataattaaaggagcgagcgaagggagaaaattgatcgacgaaaaggatctaaaggaaatttcaaagaaatttgtgtcgcttcggcgacaattcccatgattttcattaaatttttgaatgggtttttcttgcccggaaggattgaaatatcggggactccaggcggtacgcgtatgagcctctctagcggtactttgattggctcgtactctaatttatcgattggtacgacaaatgctgaggaatttgaaatttcggtgattttgtacgggccaaaatgattccaagctaattttctgatgcgcgccttttgtttctctgacggaaacgcaaccataactctatcaccaactacgaatttgccaattttcacatttttccgtgaattgaactcaattcggtccttctctcgacttatttccgcattttttcgagcttctcctaggatttcactcagattttcgcgaaaagcctgcaaatacgtatcctcgtccattgagtgccatggatcaacatcgaattcgacgttttggtcagtgggaaaattgacaactctaccaaacattagggcatacggagaaaaccctgttgctgcggacggcgtcacatttaaggcaaaaattacataaggcaatttcaagtcccaatcccattctgagattgttgtgcgtttaagcattcttatgattgtttgatttgttcgttcggcaagtccatttgcctgagggtcatatccacatgtagtggaaacttccatttttaatattttcgaaatggcttcaagtgtcgaatttacgaattcttttcctctgtccgagtgaattcgacgtggagctccaaaaactaagacaaaattttcaacaaagatttgagccacagtttccgccgatttatcgggaatcgattcggcaaccgtccattttgtgaaatggtcgacacagaccaaaatataacgattttttgcccgactgcggccaatgtcgagaatgtctaaacagacgagttcaagtggctcagaagtctccaccatctgaacacctggctgatttgcccttggctgacgggtgtgggcacaaattctgcaattcaccgctgctcggttacattctccacgcatatttggccagaaatacttttctgacagttgaagaaataattttctcgtactgaaatggccaccacacaagccggaatgacgctcattcacaatcgaatttcgaaactcttcagggacgaaaagacgaagttttcccgtttctttatcgcaatggtacaacaatccattaatcagagtgtaaaaaggagtaaaagacataactctttggatttcccgaggatcgtttggcaaaattcgatctttaaggaattctaccagtgattttaattcactttccgccgttttttgctgccatttacgcaggttttctcgtgaaacatctggagtttcttgggttgttcccacggcatttatgtttgccatatccattttttcggatttctcaaggccaagattttcggcatttggaaaatttctcgacaaaacgtccgcgacaatattacttttccctggtcgatattccactttcaaaatgaaacgcgaacgcatctgcattatccatttatccactcgccaatttccagtttctccattcgttttgaacatcgggattagcgctttatggtcggtcaacacacatgttgggatcatcgaaataaattgggcgaattttttcacgccaaaacaaattgcgagcgcttcgagttcggttggtgcataacgactttcggcttggttgcattgtctcgatgcaaaataaattggccgaagattatgcgcttcatcaggttggcacaaaactgctgcgactccgattttgcttgcatctgtcatcattaaaaacatccgatccggatcattctgtgctgcattgaagtccggaaaatgtaaaacaacattttcagaaattttgctttttaaaatttcgatcgctgtcagctcatcgtcgtccaatgcaaaaggaacttctttttttaattttctaaacaatggtgccgcaattttaccgaaattgtagataaatttccgataataggtcattaatccgaggaacgactgaagttctttttttgtttttggaataggccagttcaaaattggctgaattttttccgaatctttcttgattccttctcgggttagtcgatgtaaatgaagacaaaatcgttaagaattccatcaaacagccgagtcatgaatcgctggaacgtggctactgcattcgacataccaaatggcatgaccaaatattcgtaaagcccaaactctgtggtgaacgcggatttgctgactgagtcagggtgcatttttatttgccaatatccactcatgaaatccatcgtactgaatacttttttattgcccaacatcatcaaagtgttgtcaatatttggcaaaggaaatgcgtcttttactgtaattgcgtttaggcctcggtaatcgacgcagaaacggattgttccgtcttttttcgggactaaaacgatagggcttgcgtaaggtgaccaggaaggccgtatgaggcctctgtccaaatagtcttgtagcatcgttgccactttttctcggaatgcataaaggacgggccttacacgcattctcaaaggaggagctgtcccagtttcgacgtgatgcattacgaggtcagtttgtgtcaattcctggtcctcaaatgcaaatatttcctcaaaatcacaaatcagttgacaaactggccgttgttctacttttgccattttaccgagaaaattaggcagaaaattttgcaatttttcagtccgttccataccgctcatagtggcttgaactttgtaaatttttggaatgctttcatgcattctaaagctaagaccattttccgcctcgattatttcttcaggttcctccgcaactcccatgatttcgtccttcaaaagttcaatggcacatgcaccataattcgaaactggcgcagaaaattttctattgttcgtgcaaacgatgctcggttcgacccgaaaaagagtctccaattcgtccattggtgtcacaacaaaatcatttttaatgtctttgttgatttcgagcggcactaatgtgatcgatctcggagcgagtacagttgtacatgcgactaggatttcattcttctcagtcttttctttctcggatatgcattcgaattctattatcgaatcggtcttctcgtcgtacaattttaaacccaaaagaccgagtgcattcgtcccgattaacaaatcgaatccgaaagatgcagatgtgatgaaaaactcgatttcaaccggttctaatttatctcgatttactgaaagagtgacaacaccgaaggtgttaatcttttttccattaaagtcgtatgccgttttaagggttctattatagttccctttatgtagatgaatagtcccttcacggacgagcttataaagcgaattggcagaaataaggcaaagttgcgcgccgccgtctaacattgccgaagtctttgcaccattgatgaacagctccaacacgaccagcttcccaagtttttgcgcccccttctcttccttattcagcaaaatcagctcttccagccagttttgaacatcctctttcgttccaattgttccgatggtaaatttattctccgccggaatttcctcaatttgaatgcaatttgctgcatttgtaccaccaaattgattcggtgaacgtttgaaagtttgttgcattaatggctgttggtttccacccgttctcggtggaaaattctgacggttttgccaactgtcacggttttcatttgctgtccttgaatttgtctgcattcctgcattaaaagggtctcgattacgcgcatcgcgtgaaaa

SEQ ID NO: 350 - DNA, 1132 bp, Heterodera glycines
tattcttctctccttcaatttcattcaaatttatttattatatgttttttaaattcctcgaataataattaggcacttccttctcggccccgctgttctcttttgctgaagagggttggctgttctcggcactttacctcggcactctgttgggcaccattccaattggccatttgtgcgctttggtcggctttcgtcgcacattcactgcctacggtattctgaacggattgggtacggtggcggtgccattggcggccgaatttctcacaaagccattcacttttatggccatatttggtgcccgattcttccaagtaaaaattcattaatttaatttgatttaattcctgaatttgttttttagggattttacctttcgatgtcattggtggcaatgggtgaataattttgattgctaattaattgaatgtgaaattagcggaattatagtgatgctggagagtttcggtctcgagaaaagtctcgggtttttagttggtctcggtctcgggaggtcttgagcatcactagtaattaatggggacacatttcgcaattgcttaagcaataaaaaagtgtcccttttcttttgtttatttaaaaattttcatttaagaaacaattagcaaaaattggagcacactgaaggagatgactttgttcatgagcattctctccattaattttcaggtctctttaatatatttttttaattaaaatgccaaaattttcatttttggggtaaataaaatttgaatttaatttcactaattttaaaaaatgcttacaattagttggccttttagcttggccgtatcatcacaatgcctttgtccggctttttgtgcgactcttcgtttggttggccctccgtttattatttccttggcattccgacacttttcgcattttcacttttctgtttgttttatcgggaaacgccgtcacagcacaggtgcgacacaaccatcagaagcggcattaattaattaatttggctcgagactctcgaaccaattgtcttaaattcgaaatcacatgaaatgggaaatattcgcttttttatgccaaaaggcatttaaagtgaattcagattggcttgtgccgccgaaatcgatcgccattcaat

SEQ ID NO: 351 - DNA, 4717 bp, Heterodera glycines
ttggcctgtcctcgtaaaatccgaatcaacatatgggaattcggaagtgtctgaataaatttgctaatccggctttatccattggtatctgctggtcttggtatttttaaaaaacaacccattaattgcctacataattatttcttaattacctaattgatttcgcagtcaattagcattgacatgcatcagacggggcttgtggtggcactccatttgtcatctccacctttttggccattgtcgtgggccgagtgtgcgaccgtctcatcacaaaagcggcgttggttctgctcacatgcgtgtcacaggcaagaatcactgattgaactgttcatggcatttttgcggtcgctgatcacgaatcaccgacatttatttcgactaattccgagcccatgattcaaaatccgaacaaaaatgttgaattttttaattttgtctttttgctcaaatttgggttcgggattcagaattcggtaatcaaaattggttttgcctcgtgttgtcaccgacgccgaaaatatgttttcaacgaatagaaatcgtattaaaaatgttttcaaatcagggtcccctatggttttaataattttcaaatttaattattttatttcttgcgccgatataaagtgacaacatgcctcattaattatcaatttaatgtttaacctaattattcaccatatttgtacaatttaattcctccaatagaacaccccgctctctcaattagtgataaagaaagcttgcaaaattaattcggctttttaaaaatatttgaatttggcaccttttcagtacggcatggcaattggctacacacttttagcattcataacgccctccaacccgttgctaattcaaagtatgtacgtcctcatcatgtctttggttggcttgtgcaccattggccttgtaaagcaagcgcgatgggtgagtaattattactaattaattaattagctaattaaggattaattcaattcaaattaaaattcaattgtctatttttttaaattcaggtagacgctgagaatgctcaagcaatcaactcaacaaacacagcaattatttatatcatagtgatgtaagttcaaaaaataatttgtataacaaaaaatttattaaaaaataaagtaattattatttaataaacgaaaaaataaaaataataaaggaaattatggacttataatattatttcaaaaaacattttaattttattgaatattaataaaaatgttacaaatgaaatataaaaaacttgatgattggtcaaattttacaaaaataccgattttcgcaaaaattttattaatatttacagctagaatcaagttaattttttaagcatgatgctccatattcaaaatatacgtgccataagttcatatacctatgaacaatggtcttaatatttcaaaattttaatctattttaatgttcatttaaattaattaatttttaaatatcaaagtgtttttaaaaatctgattaaggttgatccctgaattcgtcactttgattattccgaaccctgatgatcaaaacgggagaggggtaaatttaaatttaatttaattaatattatttaattattaaacattttaagtggatattgttttcctttttattgctgttttgcaaacattgagcgcagcaatttcgcacatttcgattatgaggaagaaataaaaaaagaccaaaaacgataaatatgtttgtctaattcaccgcaattatgtacataattaattaatttaaatatttaataaattataaatgattataaatagggatgatatttttaggcaaatgcctattttttcctgagctccccgtggcctgaaacgcacgaaaaaatatgtttttttgggctgttgttaagctacttttcgagttattaacgcctattttctagtcttttatcccctatactaatttggtgctgtatgtacgtaagtttttaaaattgttaacaccaaagttcaaaaaccaataatactaatggtatatgattaactttaaaagtgccggatcgatggcagttgtgccaactctcaaaaattagattggtttaaaaatgcccgtcattgtgccaaaatggttgtcgtgtgtcgagagtggaatcagttcgggattcagaacagatttacgggaattagcagcaatccttgtgagctgcttgtgagttggcacacaccaaaatgccaatttggcactttctcgaggggataatcaattcatcccttacaagtggtaaaagaatgtcttaataatggcaccagtgagaccaggacgggaaaattttttaattcaaattaccaattttctttggaaaatccacgcttattctttggcctcgttgaacttttttttagtcttttgcagcttttcctttttgttgcttttcatttcaaaatttatgttttgtgttttcaattttctgttgctgatgcaattttcttggaccaaaggccacaaaatgaaagtgcccatttttgtttttgcattttgcaaccaaagattatgaaatattatgtgattttattgttgttatcctcggctgttcttatgtttctttatctttgaaaattggtggtgctttgttttgtacccccgggggtcaaatcgacggacgaacgaacgacggaccgaactgaacacatgacagatcaacgaccttcccgttcctgctgctaatgatgcaaccaactgaacaaattgcatttttccgtgatcagaaaatggatcagtgaatcagaacttcttgtaaaatgcgacatacggtagttttgaggatttgaattcatatgccagcagatatggaaacaaatttaacttttttagggatttgggtaaaaattttaaaatttaattaatcttttaacctttaaaaaagtgaattgtaaaaaaattcagaaaaaaaggatttaaattcgatttaatttgcaattttgccatttttcttcagtttttcattggtttttcttccctatttttggccacatttaatttcaatcatcaatatgacaagacatcatttaagttgccagcttaagaaattctctatcatttatgctttccatcaatttttggatgctttcgtttgcatattctttccttttcgcaaattatttttatttttcttggtttcttttttttctccttttttttgtttctgatttcagaaagttgcctaaataatctttaaaagattttttttaattgttgctaaagccattgctagtagtaaaaaaaattcggtaacagtatgaatggtaccccctctcttttaaaaaaattttaactttcgtaaagttgttttattggttttcgggccggatacggttctgacatccattttgacctaatttgaaccctgaacccggacttgaacaaaattttcaaaaatctccaaataggcacttaaaaaggcagaacaaaatcgcaaaacaggcattaaaaggcacaaaaacaagcaaatcaaattttttgttcactctttttaggtagcaaaacacataaaacttattatgttaataaatttaaatattataaattatatttttcgtaaggataatttttaaatttttatcaagaaaataaaaataaatttggtgcatcaatttttgggatttttttttcaatgcttagggaggggtgtattttccaaattataatttcttaggggtgtattttccaaattataatttcttaggggtgtattttccaaattataatttcttaggggtgtattttccaaattataatttcttaggggtgtattttccaaattataatttcttaggggtgtattttccaaattataatttcttaggggtgtatttttcgtttttattgtatttttgttaaggatttttccgaaaatccaaaaataggggccaagaataggataaaagtcattgtagacaccccaaacaaagcggaaaaggcgtttttcagctgatagttacgagaatttacaaaaattataaaaaatgataaataagcaaaggaattcaggggtttactaaaagcaatgagttctgagtaggattttccatgttgccatatttacactatattttaatcacctgtgaaattttaacatttgatttatttttattcatttttattacggtattcattttgtattttttatttgatcatttttatttgtttgtttatggcaccatataagagcactaatgtgcctttggtttgctcgataaaattaaattaaattaaaaatatttatgaatcttagttaagaataaactataaatttttttaacaattttctttcgggtgtcatgacaatttgtacacagacaactcgtgcaatggcttaggagctttaggctaggcctaggcttaggcttgcttgggccggagagacttagaatttgaatctcgaattgactccgacatgtgattgagaagaaaaaataaatttattacaaaacaaggctcggttgaaatttaaaactattaagaatgaatgagagtatttttaaaatctcgtaaatggtaaaagccgaggctgatgctcgagagtctcggtcttaactcgagaaaagtctcggttttttggtctaggtctctctctcggacttttcagtctcggtctcgattttcagaccaaaaccgagattttttacatccctaatgattatcttttgataaacttaattcttcacatttttggtat

SEQ ID NO: 352 - DNA, 7215 bp, Heterodera glycines
tccaatccagcaatttcctgtagaaaagatgtggtttttcccatctaaattcaaaaatcgagaggaaattgacaaaaaacccacgggttcttgaacatcctcttgaggtccaccttttctttgcctgaaaatggcaaggatataaaattaagttcatatatgtaaatttgccataaaaatctgtcttattattaagttaaaagcctatcgttaacattggaaaaaaacgtggagaatttgatttgttccaacactcacagtaagggcatgtctgcaatttgcccaccacacaccatccgcggatgaatgtgccaaatcacgtccaagcacaccgtaataaaggcaataaaacaacaaatgcacgccaaaatccaagctcagattactgctaattccttaaaaagccttttttgaatttttagaaaatttaattttaccgaacaccgaatttattccaatgacagtaaagacgagtgaaaagtaaccgacaataccaaaaatgtaactgagtttatgcatgaacaaaaagtatttgtagacgagcctaaaagggaaatggacgaatttcccttttttgcgtaaaacccactgacaacctgggagttgatccggaaattgccggctgattgaccctccgccaaacgtaaaatattgaagaagtgaacacagtccaggaaagaatgaatcaccaccagccatttttaagtgacaccataaaagggattagccaaagaccgaccaaagtggcgaactgaaccaaaatcatatttattgttagacaaagccctttcagcgaaaccaccacccgttttttacccggtatgagcgaaaatgtcttctcttccacaacatcaagattatttgtgccacaaccattgagacaatgaaaatgatgaacatttccgcatgcaatcgcatcgtggcctcagaatggtgataagacagaaaagtgaatgacgcaacataaaattaattaaaagtacaatgtcaaactagttttaagttatttgatagcttatattttacaattaaggtttacaaaaaaaaagagagaattttcgaggacaataaaacaaatgattttatgaattgaatctaaaaagaacaaaatcccatcttgaccacccctacacacaaagtcagcacatttatttattctcacacgcatacacacctgaatggttacgagttgcatttgcatagaaatctgacaagcttccccgtcgtcgatgaacaattcaaggtcacggtgctttaaattttttcaggggtattttgtgaaatctcttccattttcttaatgacacttgttggcggcgcctcttgattttggtgacattgtccgtgacgacgtccgtttcgtcgacgatttccgcttgtaaaatctcctcgacgatgtcctcaagcgtcacaagcccgaccagttcgtatttgctttctttgtcctccgtcgaaggggcaacgacacggtccaccagcgccatgtgataatctggaaattaaagacaagcgaatatttatcgtttttatcagtaagagttaatacttaccgccttttttaaactcctcgagcattgttcgtagcggggtattttccggtacatgacgcactggatgctggtagtactcacacacagtcttaacctgaattatttttttagataaaaatggaaaatcaagatattagcccacaaataaattggcgtcgggatccaacagaatcaagtccttgacaaaaagcagagagaccacattgccgcgcgagccgtcgaatatcggtatgcgtgtgtagcccgagcgcacaatttcggcgatgttttttgcgttgagaattgtatcctgcggctgcatgaagacgtcctaaaaacaaataaagtacacaaaagttacaacaaaattctcacctttattcccgtcatgacgtccttcacaattttgtcgttcatctcgaaggcgccaatcgcaatcttcagctcctccgcttgcgccgcattcttcatgttcagtttgatgagctcgatgaggcgcttgcgatcatatgactcgacttgttcacccaacagcttgtccaaaatgaggctgatcgggtaggatacctgagagggcgtgaacaaggaaattgcttacaaacagtataccaaaaaaaacatactataaaagtgagcatcatgaagaaccgagtgacccatatggtacaggcacccacagccaagcccttcttcacacacagcgcctgcgggaagatttcgccgaaaacaacaatgccggtcgatgaaacgatcaatgcaacggtgccactggtcaaatcgtcgaagagaattgagatggcagagttgacgcaaacatttccgatgagcaacgagcacagcaaccggttgccggacttgcgcactggcaggatggtctgagcatacttccgctcttttcgtgaacctaaacagaaaggaacatcatttctcgaaaaaaaacaacgaccaagaactatcaacaagcagataaacaataaatccatggtattccacaaaaattttctcaccaacccgaatttttgatgagagtcaactcttgtggagtaagtgacatcagcccaaggttgagacccgagaagagaccagaaaggacgagcagcactgcaatgatgacaatttgaagaggcattgagaagtagtatttgcgaggcggtatattcgtagacacccaacagtgagcttcatccgtctgcaagcaaaaggagcgatatgatagttatttaaaaaccaaccaaccaaatgaatgggaagctcgtgtgaatagtcaggatggggcttttgtcgcacgcacaatttgtataatgaattgcttaaagttttatgggtttaacaaattcaatcatggcgtcacaaaaccttgcaaagtgatagatgaccacgacacgtctttccgattggataacaaattcatttcgatcgatgagcaccgccgcgtcggagcaattgtcggtggatgtgaagccgacaaggtcaatttcgtccaggtggatgccaaacagcacaacgcgcacatccatgtccggctcaacgatgctgacgcccttatccctgcgaaactttttgttagatcttacatcgacattaatgacatacgcatatccgacgaatccgcccgcgccctgctcaggttcaatgcgaatgttggacacctgcgcttttttgtccgttgttatgaatgaagaggtctgaattggagaaaatgaagttacagattgctgaacatccgccaaatttgctaaaccttggccggttgaaacagaaagaccataattacgccaatactaaatagcccattttgaattcgcatggagtgtattaaaagctgaaaaagcatttatttcacagtggtttaaacaatgtgtacaaatggaataagatggtgatcaaaaaaatgttcaaaaacaagtttcctcgagttttcatgctcgctgatcatgaatctgacacccatctcgactaatttcgaaacgcgaccccgacaaaaattcttaatattcaaatttaaggacttagcacttatttctcgaaaacggctttacatgaaaaaacagaaaaccatcatccctgcaacaaattgtaattttgttctagtttgggtccggggttgggatttggtcgaaatgaatgttggattcgtggtcagcgactttgaaaatccaggaaacatgtctttatgaaaatggggtgggaagttggaaaaaaatgtggattgtggctagacaatgcagaaatggcacattatatagaccaatttgagtggtggtggaaaaggcggacaaaccgacggaaatgcaaaaataacaaccgcacagccacatacatataaaacccacccattttcttctcacatacttatttgaaaatttagtcccagagacgtatgtacaagaaataagggtcgggatcactttggcgcgggccattttggcgccgcgaactttaaagtgttataacttttttcttatccaaccaaataaaataattttgataccattaaataggcctaagtgttctttattagcctgcaaaatattagaaaaaataaattctgtttgacaaaagatatagcgtgcggcgccaaaatggccagaaaaagtcatttttttgaggttttttggccataacttttttgtgtttcaattaaattttttgaaattttgcaggctattagggactatcaagcgctttaaaatgatatcaagcttatttaatttgaatgagaaataaaaatgttatagcgtttgccaaagttgccggttcccagaaataaataattttgatgattgccatcttttttcgaaaaataaaatttttattcgaggaaagattattttaaggattttttgggtcggaaaatcgaatctgacattaggtaattccaacctgtcgaaccccgaacctggattcaagcaaaaagttcaatattcaaatttctcattgttcgtatgaaaatggtttaaattggattcctactcgagaatgtgtgcctttgcggcaaattgtggccgtaaacaatttttaagatggaagtcggactttttcttgcccaaaagtatgtccaccctcgtcacccaggaaacatgtctttatgactttttaatttggattccaacaaatgtaattcagtggtgacgcaaagttgtccccctccaaaaaatgggtgcagatccatcgacaaagtaccggaataaaatgtgatggtgtgtggcaatcaaatgcaatggagataagaattaactaacacaaatgcataattgatagtgaataaacaacaacaacaacaaaaaatgggtgtgggcggaggacagaatggagtgtgagtggaaggaatgtctgatgatgacggcgtaaaagaaaaatggaacagaaccaaacagcagcagagcaatattttccaaaggtttcaggggaaaaaaacaaagttgaaaattgaaggttagggttaggagagttggttttttgaaatccgatagagaatcatattgcggcaagttgtgtgtccgtaaacaattttgaagatggaagtcggactttttcttgccaaaagtatgtccagccccgtccctcatcaaagtcatcttcaacagcaaaggaagggacagcagctccagcagagacagttatattttgtcgtcgtactttcgggacacgatcgataacactttttcccaccccagaaacacttccgtcgcccaccatcccctgaggggccttttggccaggcaaagtcaattggtgagggccatcccccgaagcaaatgatagaccggcgggggagaaagcaagcagataaacggagcagtcgtcccaaaaactcagagaaagcaattgagaaatgaacggctctccacaagtaaattcagctggggcaaatttggaacaatcccatgacgtcataaagcaacagttcgaccgaattttcgagtcggaaaggctaatccggaaagtatggccacttcgtttagaaaattgttccttaatgatttttttttattttgaaaattccgacaattgagaatcagccgaaggcaaaggtgtagaattgtggtcccgatgggaaaaaatagtaaaattttaaaaagcattttttctggggtagaaaaatacgctgatcacgaatctgaactcagaatttgaaaagtcattgattttgtcaatgactttttatcaagtacttgattttttccaaaaattttaagaaaattaatgggcaataaaaactcatacacagatgttgtagagcttaataagagctttcggttgagctattgaatttatagagaagtcaagtatttaattttctatgattttttaaaatttagttattaatccctaggggtcatatgagttggggtgtgcgttcgagcccgcttggctgcagtttatttttttatgcttattggtgaaaaatcatagacaaaattaaggttcttgcaaaatcagagctcagattcgtgatctgcatatttttacccccaaattcattgggaaaaaattttttacagagattaaaaattaaaaaaatcaagtaatgtacttgataaaaagtctagggttgccaccccgaaccccgacattttaggccatttttcggggttaaccccgaccccgacgcttccaaccccgacgaaccccgactcggggtcggggctaaatatacacccctaagaatggcattttcgtgagagaaaaggcaaaaaaattacaaaaatttgaattttttttaaccattttgccaaatttttataacctaaaaatattgctcaaaatcgaattataatttttgggcaaaatctgttacatatctatccaaattttcaaaaaaaaaaatttcccggcggcgcctatcggcaccgccggacccctttctcctaaaagtctttagaaaaagtgtgttgcgaaaaaaagatgttgaacactaaaaatttatcgggaacaagggtccggcggtgtgaaaattaaagaattaaaatgcaattttttaactgattttcaccaaaaataaccaaatttttcgactttgaggcaaattttttttaagaaaaaataagttttgggggcccggcgccggaggaaaaatttgataaaattattattatgaataataaaagatttttaagaaaaaataataaagttttttgactatatagcataaggcaaaaatcgaaaaaccccgaccccgaccccgatttggtcaaccccgaccccgaccccgaccttgctgaccccgacaaccccgaaccccgacttttccaaccccgacggtcggggttgcaaccctagaaaaaacaatggttgtttatattagagttggtcgggaccggggcgggaattcacagtcttccgaggtcccggtcccggttttggcaaaaattcccggtccctaccaactctagtttatatgttcattgatttcggttaattttttatcgcgggtaaaaccaaggttctcatctgtccttatttgtaagatttgtccttatttggagggagtgacccaattttgttcttatttgttgcttctccgaaaaatctgtaaaaatttctttataaatttgtattggcgtactgtttaagaaaatatttttcgattttggcgtttaattccttgctgtaattttggctaataattttttgtatttattgttttatcgttttctcttttgtttttagatgtagcacctgc

SEQ ID NO: 353 - DNA, 9002 bp, Heterodera glycines
  misc_feature (6547)..(6547): n is a, c, g, or t
tgtacaagttgtcacgacacccgaaagaaactgttaaattaaaaaaaatttaatagtttattttgaaccaagataaatattttagtttatttgtttcattatttttcaatttttatagttttcgtaaattctcgtaaagctgagttgtcctcagctgactgatcctgtcgcgtccatattaaccggtccatttgaaaccaaaaaacaacgattggcgtatttgaaaataattggagtttaacttttgcttatatgaaatgagaaaccaattttaaatttttaaaaatattttttaacttttgttttgaattttttgtttccttgtaatgtccggttcccggtcccgaatgaaaatccaggtcccggcttttcgactcccggcaattccccacccgattctgctcagaattccgggtctcgtgcaattaattctagttaaataatgaatttgtaaagaaaaagagtaacaattcataattgactgtcaaaaattcataaatttatcatattaaatgataagaatcaactcactctctgaaatcagaaacaaaagtgacgaaatataaaatgaaatgcaaaaaaaattcgagaaaattaaaaataaatttgcaaaaattttcggaaagaaaaaacgaatgcatctctaaattgatgaaatcacatgataattaataacttcttaatctggtgatttaaactgatgtcttgtcatattagtaattgaaattaaatgtggccaaaaatagggaagaaaacccaatgaaaaaataaagaaaagtggcaaaattgcaaattaaatcgaatttaaaaccttttacttgttgccaataatgtttaatttggttcactcttaaaaagttatgacgattttttgtatgagttgggcgttgtccgtttttttataaaaaaaaatcttttttctgattttttttcaattcacttttttaaaggttaaaaaattaattaaattttaacaaattaaccaaatccttaaaaaatatactgtaaatggattattgtcaaatttattccatattgcaggcatatgaattcaaatcctcaaaactaccgtatgtcgcattttacaagaagttctgattcactgatccattttctgatcacggaaaaatgcaatttgttcagttggttgcatcattagcagcaggaacgggaaggtcgttgatctgtcatgtgttcagttcggtccgtcgttcgttcgtccgtcgatttgacccccggggggtacaaaacaaagcaccaccaattttcaaagataaagaaacataagaacagccgaggataacaacaataaaatcacataatatttcataatctttggttgcaaaatgcaaaaacaaaaatgggcactttcattttgtggcctttggtccaagaaaattgcatcagcaacagaaaattgaaaacacaaaacataaattttgaaatgaaaagcaacaaaaaggaaaagctgcaaaagacaaaaaacagtgaggacatggaaaatggcgactttcccaaaaagttaataaatgaatttcaaagatttcccgtcccggcctgctgaacgccactggcgccattgttgttaaacattattttgccaattcttcggtaaagaattgatcaccaccccaccctcgagaaaatgccaatctggcactcactcttggcatatatatgccaactcacaatcggctcgcaaggattgctgctgctaatttacgtaaatccgtactgagtgccaacccgactttactctcggcacatgacaaccctttctggcacaattacgggcattattaaattaagccaattttaaaagttggcataatcgctatccatctggcactttaaaattttatcatatgccattggtattgcttttttggtgcttttgcaaattaattaatggtggagtgatttcttggggacgcccccccctcccagcgccccaattttcgggggtttcccccacgaaattgcatcagcgacaaaaaagtgcttaacactccgtcgttttgccaaaagtcattgggttttgtgtgttctgctggtggtgctgttgtaccagcagaagaggctcaccaatttaatcagcagataggaaatcggtatttaaattaatttgttcgttttaattttacagtttgtgctaattgatgggagagacgtttaattaccccaattcatacattaattagttaatcagtccaaaaagagagaatatcatgtgaattatgtttcagggcatattaatgaaaatgaaaaattaagaataaattataaagccttctctaataccagcgaatttttaaatagcgcggcaaataattgaaaattttttattttcaaatttcttttgccaaaatttgccagaacaaaaatgactgctgcaattattggcattaattgccgccgcaatttccgtggcttacgctttgtgattttggccctgagcacattgtgcttaaccttcggcatgtgcggcagtgttgtgcttcatatgaccgtgatttgcatgagagaagagacaacgataaatggtgccaaaaataaaaaaaaataataattattagtgtattaattaattggctttcgccgcgtccacaaatttctctcattagcaaagagagggcttctgaaatcagaaattttttgaattttacataaaatatttgtttttcggagcaaatatttatacaaattttattttttaatttattgaattaaaatgcctcagtaaaaatttaaaataatcatatattttacaaaaaatataaaaccaaaaattgaatcatcagtaatgaaaatttagaaatactaaaaaaaaggacaaaatgaataccataaatataaaaattttgtaaataaatttttattcttctctccttcaatttcattcaaatttatttattaaatgtttttttttattccttgaataataattaggcacttccttctcggccccgctgttctcttttgctgaagagggttggctgttctcggcactttacctcggcactctgttgggcaccattccaattggccatttgtgcgctttggtcggctttcgtcgcacattcactgcctacggtattctgaacggattgggtacggtggcggtgccattggcggccgaatttctcacaaagccattcacttttatggccatatttggtgcccgattcttccaagtaaaaattcattaatttaatttgatttaattcctgaatttgttttttagggattttacctttcgatgtcattggtggcaatgggtgaataattttgattgctaattaattgaatgtgaaattagcggaattatagtgatgctggagagtctcggtctcgagaaaagtctcgggtttttcgttggtctcgtgtcttgggttttcggtctcagggtcaaatcttggtctcggtatcgggaaattttcggtctcgagcatcactagtaattaatggggacacatttcgcaattgcttaagcaataaaaaagtgtcccttttcttttgtttatttaaaaattttcatttaagaaacaattagcaaaaattggagcacactgaaggagatgactttgttcatgagcattctctccattaattttcaggtctttttaatatatttttttaataaaaatgccaaaattttcatttttggggtaaataaaatttgaatttaattttactaattttaaaaaatgcttacaattagttggccttttagcttggccgtatcatcacaatgcctttgtccggctttttgtgcgactcttcgtttggttggccctccgtttattatttccttggcattccgacacttttcgcattttcacttttctgtttgttttatcgggaaacgccgtcacagcacaggtgcgacacaaccatcagaagcggcattaattaattaatttggctcgagactctcgaaccaattgtcttaaattcgaaatcacatgaaatgggaaatattcgcttttttatgccaaaaggcatttaaaatgaattcagattggcttgtgccgccgaaatcgatcgcattcaatcgggcaaaattgaaacaacccgagggcacagaaaaggattcaaatttgtaatttattacatttaatttttattaaatttaatatttccgtttttcaaagctcgcaaattggcacgtgctctctttgtttggcgttggcattggcattgcgtttggtgcccataccttttcactgtacggaccaatttatttgcacaatgtaagtgtttagcatacattgattactattgtaaaattgaattattttaataatatttttatacgttttttaattcctacctataaaattttggcctgtcctcgtaaaatcccgaatcaacattgggaattcggaagtgtctggataaatttgctaatccggctttatccattggtatctgctggtcttggtatttttaaaaaacaacccattaattgcctacataattatttcttaattacctaattgatttcgcagtcaattggccttgacatgcatcagacggggcttgtggtggcactgccatttgtcatctccacctttttggtcattgccgtgggccgagtgtgcgaccgtctcatcggcacaaaagcggcgttggttctgctcacatgcgtgtcacaggcaagaatcactgattgaactgttcatggcatttttggggtcgctgatcacgaatcaccgacatttatttcgactaattccgagcccatgattcaaaatccgaacaaaaatgttgaattttttaattttgtctttttgctcaaatttgggttcgggattcagaattcggtaatcaaaattggttttgcctcgtgttgtcaccgacgccgaaaatatgttttcaacgaatagaaatcgtattaaaaatgttttcaaatcagggtcccctatggttttaataattttcaaatttaattattttatttcttgcgccgatacaaagtgacaacatgcctcattaattatcaatttaatgtttaacctaattattcaccatatttgtacaatttaattcctccaatagaacaccccgctctctcaattagtgataaagaaagcttgcaaaattaattcggctttttaaaaatatttgaatttggcatcttttcagtacggcatggcaattggctacacacttttagcattcataacgccctccaacccgttgctaattcaaagtatgtacgtcctcatcatgtctttggttggcttgtgcaccattggccttgtaaagcaagcgcgatgggtgagtaattattactaattaattaattagctaattaaggattaattcaattaaaattaaaattcaattgtctatttttttaaaattcaggtagacgctgagaatgctcaagcaatcaactcaacaaacacagcaattatttatatcatagtgatgtaagttaaaaaaataatttgtataacaaaaaatttattaaaaaataaagtaattattatttaataaacgaaaaaataaaaataataaaggaaattatggacttaatattatttcaaaaaacattttaattttattgaatattaataaaaatgttacaaatgaaataaataaattaaaataatgataaaaaatttatgccgattggtcagagttctcaagtgtacgaacttttcaatttctcctgaattggggatagtcaatctaagaaaacaaaaataccctgaattttcaatttttaaaaaccttgatgattggtcaaatttttcaaaaataccgattttcgcaaaaattttattaagatttacagctagaatcaagttaattttttaagcatgatgctccatattcaaaatatacgtgccataagttcatatacctatgaacaatggtcttaatatttcaaaattttaatctattttaatgttcatttaaattaattaatttttaaatatcaaagtgtttttaaaaatctgattaaggttgatccctgaattcgtcactttgattattccgaaccctgatgatcaaaacgggagaggggtaaatttaaatttaatttaattaatattatttaattattaaacattttaagtggatattgttttcctttttattgctgttttgcaaacattgagcgcagcaatttcgcacatttcgattatgaggaagaaataaaaaaagaccaaaaacgataaatatgtttgtctaattcaccgcaattatgtacataattaattaatttaaataaatttttaataaattataaatgattataaatagggatgatatttttaggcaaatgcctattttttcctgagctccccgtggcctgaaacgcacgaaaaaatatgtttttttgggctgttgttaagctacttttcgagttattaacgcctatttctagtcttttatcccctatactaatttggtgctgtatgtacgtaagtttttaaaattgttaacaccaaagttcaaaaaccaataatactaatggtatatgattaactttaaaagtgccggatcgatggcagttgtgccaactctcaanaaattagattggtttaaaaatgcccgtcattgtgccaaaatggttgtcgtgtgtcgagagtggaatcagttcgggattcagaacagatttacgggaattagcagcaatccttgtgagctgcttgtgagttggcacacaccaaaatgccaatttggcactttctcgaggggataatcaattcatcccttacaagtggtaaaagaatgtcttaataatggcaccagtgagaccaggacgggaaaattttttaattcaaattaccaatttttttatgttttgtgttttcaattttctgttgctgatgcaattttcttggaccaaaggccacaaaatgaaagtgcccgtttttgtttttgcattttgcaaccaaagattatgaaatattatgtgattttattgttgttatcctcggctgttcttatgtttctttatctttgaaaattggtggtgctttgttttgtacccccccgggggtcaaatcgacggatgaacacatgacagatcaacgaccttcccgttcctgctgttaatgatgcaaccaactgaacaaattgcattttccgtgatcggaaaattgatcagtgaatcagaacttattgtaaaatgcgacatacggtagttttgaggatttgaattcatatgccagcagatatggaaacaaatttaacttttttagggatttgggtaaaaattttaaaatttaattaattttttaacctttaaaaaagtgaattgtaaaaaaattcagaaaaaaaggatttaaattcgatttaatttgcaattttgccatttttcttcagtttttcattggtttttcttccctatttttggccacatttaatttcaatcatcaatatgacaagacatcaattaagttgccagcttaagaaattctctatcatttatgctttccatcaatttttggatgctttcgtttgcatattctttccttttcgcaaattatttttatttttcttggtttcttttttttctccttttttttgtttctgatttcagaaagttgcctaaataatctttaaaagattttttttaattgttgctaaagccattgctagtagtaaaaaaaattcggtaacagtatgaatggtaccccctctctttttaaaaaattttaactttcgtaaagttgttttattggttttcgggccggatacggttctgacatccattttgacctaatttgaaccctgaacccggacttgaacaaaattttcaaaaatctccaaataggcacttaaaaaggcagaacaaaatcgcaaaacaggcattaaaaggcacaaaaacaagcaaatcaaattttttgttcactctttttaggtagcaaaacacataaaacttattatgttaataaatttaaatattataaattatatttttcgtaaggataatttttaaatttttatcaagaaaataaaaataaatttggtgcatcaatttttgggattttttttttcaatgcttagggaggggtgtattttccaaattataatttcttaggggtgtattttccaaattataatttcttaggggtgtattttccaaattataatttcttaggggtgtattttccaaattataatttcttaggggtgtattttccaaattataatttcttaggggtgtattttccaaattataatttcttaggggtgtattttccaaattataatttcttaggggtgtattttccaaattataatttcttaggggtgtatttttcgtttttattgtatttttgttaaggatttttccgaaaatccaaaaataggggccaagaataggataaaagtcattgtagacaccccaaacaaagcggaaaaggcgtttttcagctgatagttacgagaatttacaaaaattataaaaaatgataaataaacaaattaaataaactaaaaatatttatgaatcttagttaagaataaactataaattttctttcgggtgtcatgacaatttgtacacagacacactttttcactaaaaagggacccaattttggccgttttacggaaaatttgagtgctatttgttacgaaaattgtctataaaatttttacattttcgtttggggggggggggggggggaattcgaaaaaattttccattatttgctggaaaatttttaaaaattttcttttgatttcgggggggaagataaaaaaaaatttaattcataaattttttttttatcatactttaagaaaggcgggggcaggggataaacgagctgatccaagctacgagtgataagaaacagagaataaaccaaaggtatgaaacatttttttttcagggaccataattatttattaaattagctgaaaacaaaatttactttcttccgaatttattttttcccgcgtttacgagagaaaattgtaagaacgggtaatgtaaaaaagcatatggcaaaataaaaatcattacaggg

SEQ ID NO: 354 - DNA, 4668 bp, Heterodera glycines
  misc_feature (4610)..(4610): n is a, c, g, or t
ctttttaataaatttatggaaaaaccaggggaacaattccttaaattcatgaaccaaataaataatttaaaattattttttagaaaaattacccttgtgttgggtactaaaatttgtattccgaaatagaggctttttaaataaatatatggaaaacccagaggaacaattccataaattcatgaaccaaataaataatttaaaattattctttagaaaaattacccttgtgttgggtacttaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatttatggaaaaaccaggggaacaattccataaattcatgaaccaaataaataatttaaaattatttttttagaaaaattacccttgtgttgggtactaaaatttgtattccgaaatagaggctttttaaataaatatatggaaaacccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgtttgtcgcgactcacgtcacgagaaataaaatggaaatgataaattttataagcatgatgcaatttcattaaaaatggggaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatgggttcagtcggaataaaacatcattcccctgcttgtctactgtttgtcccaatttctattttgccaaaatttttgccgggccgaatttgcctctgtttggtcccgacaagtggtgcaacggccgggaacctctgcactgatgaatgcttgtgatcagcgggtggcagacgctggtacaagggcgacaggacggagatgagtcagtctggtcaactgatcgctgtccaccgccgcggagcggatcttcacaagcaacaagggatcagcctggtcaactgatcacctcacagattttacgattaaccaaaatcaaccgcccgcctttctcagcacagacaacccggaatgaggcataagaaataaaacaacaacatacaggcagacttgcagcaactgaaccccccgacaactttgctgtggggagtgtcgcgactcacgtcacgagaaataaaatggaaatgataaattttataagcatgatgcaatttcattaaaaatggggaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatgggttcagtcggaataaaacatcattcccctgcttgtctactgtttgtcccaatttctattttgccaaaatttttgccgggccgaatttgcctctgtttggtcccgacagtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaactagcgggtgtgtgcttacatgtttcttgggtgcttaaagcgcttcgcgctttgggagcttcgctacctaggccttgtgttagggtctttgcgtcagccgacatgcacttggtttcaccttgacacactgcatttttcaatgcaatggaaaccggaagtgccctaactcgcacgtcattggcccacctgcctccttcagtccagctggcagcacttttttgaatatgtgtccgttttaagtgattagaagaggtacaacagtgattagaagaggtacaacagtgatagaagaggtgcaaaagtgattagaagaggtgcaaaagtgattaaaagaggtacaaacagtgattagaagaggtacaaaagtgattagaagaggtacaacagtgattagatgagtccaacagtgatcagaagaggtacaacagtgattagatgagtccaacagtgatcagaagaggtacaacagtgaaaaagcgatacaaaagtgattagaagaggtccaacaatgattagaagaggtacaactgataagaagatgttcaacagtgattagaagaggtccaacagtgattagatgagtccaacagtgatcagaagaggtacaacatggtttaaaattaaataaataatgaaaagtttttataaaaatcgaatgcattttaatttaaaattttttttataataaaatactctttttattcattaaatataattttgaaaattaataattgaatatttattttgaaatgaaattcatttttataaattcaaaaaataaataatgaaattaaataaattcaaacaaaaaattaattttaaaaaatttttcacaaaaaaataatttaatttaaattaaaaaattaattaaaaaaaacaaacactcttttaaatgaattaaaaacattaaaaataacacaaaaataaatagaaaaataatttacaccgtccggatccgaacctgcccccccccctcaaaatgatgcctcagaatccccaatcacacagggattctgaggtctgaacgatgtcaaaagtaaaatatgatcacgtattcgtgatcagcgtcataaaatagccctaatgacatgtttttgaaagatttttggtgaaaaaaattttccactcaaaaatcatggtcacacccctttggtcccgaatcccaaaatcacttttatttttataacatctctcaaaaaagtgataaaaatgccaaataaaatttatattatagagaaaaaaattgcggatttttgtagtattttacttttacagaatgacttttcagaagggagttctgaatttttttctgaaaaatctaaaatttccagaatttctggaataacttttttatttttgaagacagaaaatccaaataaataacataaaattctcctgatttttctctatttttaaggctttattcctgtaaaattgatcaacccttcgatttgttatgaattttcaaatattaggccaaaatcccgagggccaaaaaattgccaaaaaataatgaatttttaaaaaattccaaaaattatgaaacttaaaatagacatcatattcgtactcagcaccttattttaccccangaaaaatatttttcacaacgcattttcgtccgaaaaaaaatttccgaaaatttctagg

SEQ ID NO: 355 - DNA, 1316 bp, Heterodera glycines
tctcggcaccaacctggggcaaaaaaaaagttaaaaatcccccggggggggggggggtcacaggaattctatcatccgtctttgaatttcttccaaaatttcaaaagtaatttttttaacaggaagattttgttttcattttattgttaggaaactgttttttccgactttccgtgttcataaaatgctttttgaaaaaggaaatatgaattttttccaaatttttccggggtgaaaaaaagtgtacaaagccccgaaaaccgtggccgaccgacctggaaatgtccaccagccaggccatcagttgcggttcgtacgcctcatgggagagcggaagttcgcgttggaggagtaactgaacacaaaaatttgacaaaaaaatggggttgaatggccaaattttaaagtttggtggcgttttttcggtcatattctcttaaatggaagaaatttttgcattagaggaaggatttttaaaaatacaataaatttcatcctaaaaatgcaattgagacacgaacagagagcggcgacttttgttaacgaaatctgaaaaaggcggcacagcaacagaaattgggcaatcggctcgaaccggttcagcaaaatgaggaacactttttgccccaagcgtctcgtatgttcgcccgtcgcatgggccgaccagcggagcaaagtgccgaaaaccgcattaaaaagtaagggggtgaatgcaaaaatggaatttaatttatgcgggtgtaaaacaaattgcgtgtaatttccatgttgccgagattttatggcgccgccgtacgataaagttcccattttttcaacaacaaaaaaagaagaattgctttcttttgacgaggctttgcttaccattgatccacaggggcaaattttaaacggcaaaaaaattgtgggccgaagaccaagaaagaagtcgccggattccctcctccgaaagctctttttgttggttattggtcggtaaggtttaacaacggtaaagttccgacttattgtgtggcattttgatgccacaaatcacaaccccaaaaaaaattacaatgaacagtcccatttcggtcctgcgctgtgtccgcatcgaaattcgggtggtcaacgcgagcaaatggcgcagcacccgtcgcacatgacactccccgtcgtcgtccgtattccgtcgttgttggaggcatgagtttccttcctcttcccgctggtgttgggacaggagcaaaagtttgtcaagctgttcgcccagggcgggcacacattggacaaaccattcgtcgtgggagaagaccatgggtactttaaaatttttt

SEQ ID NO: 356 - DNA, 6505 bp, Heterodera glycines
atataagaaacaaaaaaaaagaaatttttaactgtgcttttgcaaaaatcaaaaactgacaaaacaaatatgtaagaacgaaaaccaaacatttctttttttcaaattcattttttaacgcaaaataataacaaaacgccacgccaattcaaagcatggcggatacagacactcaactttattaaataggattattcagctcagtccttttgattacacatataaattttacaaattaaaccaacccaaaaaatttcaaaatgaatgtttcttctgcgtgaaagaacaggtttcaaaaatttggctgcatttcgcaaaatgaaacgcggaatttaattaatttatttcatcaaaactacgacgacaattggccaaatccgccgcctaaatgcgtggtcggtcgtaagcagacatcagcagcagcagcgaagcgcgtggtgcattcgattgggacaaaaacggcggagaattattgagaaatgagaaaaataaaggaaaagagctgccgaagcagttaaaggggggggggggacattttaatatgagtgggctgccggcgggggagcccttcggaatcgacgacgacctatggccctttttccgctccctcgtcggccccgaccctttgcaccattcattttagtcaaaaagactgtcagattcttgatcagcgacccagaaagccctttaaatatgttttcacgacttgttagaacaaaaaaatttcttccaaaaaaattatgggggttaaactgcataagagccaaattttcctattttattttctaattcgtaatttttaaaaggacaggtggtataactatgagtaaaacctcaaacccagtgtcattgttagacaaaatgattcataatgccaaatagcgatattttcggggcgctaaatcaaaaaatatgctgatcagcagggaacggatttttaagtgctaaaaatcgcgaaataggtacatatacctaaatagttgctaaaaactgaaaaacgccaaaatagttgctaaaaaagttgataaaaattggaaaacatgtcaataaatatgtgaattttccaaaatttcctcatctttatccttttcggttgcacaattgtaaatcaaacacatttgaagattttcaagcgtaaaaagtttttggtcgtccgccaaatcatggccaggatttttgatttttgaaaaaccgatttttaggggtgcattttttgaaaaaaggggtgtatttttaaaaaaattaacctcgattctagaggtgcattttttttttaaatttcacaagccaaaatagttgttaaaaagtttcataagcgaaaatagttgaaatcaaaattttccgggacgggagacccgatcgggaatcccgtaaaaatcccgcgggattcccgatttcgccgggctctactaaatactaacactttcaaaaatttcatattaattttaaaaaattcttaacagtatcgaatttctcaatgtcgaaatggcccagtgtcgaaaatacaggaaaacatgagtttttgaaatagttcagtgtcgaaatttcaatgtgtcgaaaatgtagtatcgaaattacttagtgtcgaaaatactcagtgtcgaatttacccagtgtctaaataacattgcgcccgcgaaaacgtaccccacgcgaaaacggccacgcgaaaatggccacgcgaaaacggcctgacccgatattttcttggagattcacgcttttttagacgttggacggttcagtcccaaagcatttggccaattcagtcccaggtccgtaactctccagggaattgtttcaaccaaaaaattctttcggcttcgttagttagagaccaagaggaatcgaatgttatattattcaacaagaaaaccggagttgtcttcagtttttccttttcgacttttggttgaattcaggttaggggttcgaagtggggtacttagtcgggtttgggtcccccgtttgggtcgaaatttttttcaatttttttcgtttaaaaattcctgaaaagaaatacccaggagttttcaaggttactgatcgcgaatataacaattattccctattccgaattccgaacccaaactcgaacaaaaaatcgaaattttgaatttttaaaaacatgcttttgtgttagaatttgaacaaaaaaaatagaaaaaaatttcaaaccaaaagggggacacaaacccgacacactatgggtacgccccagtgtccgacaaaatagctcataacgccaaatagcgtaattttttacgtgttaattcaaaagatacactgatcagcctttttgaaggccaattaacattgataaactttattcaaaaattttgatcaaaaatttgggtatttacttccattctcttggttgtttctacatctcgatcgtgaagtgcatttagcagtgtttcgtgtttcaccaacttaacaaccttctctagagtgccgagatgagcaaaacgaccaacttggatttataattttaatgagaaaaattattcattaaaccaaattgttgcacattttgtgcatatgctcaattccctgctcactgatcaacccccaccaaagatgagaacgcgcaaaagggacgacatgagcggcaagacgatgaagttttgggcggctggataacgggcagcgtcaattgttcgaagttgctgccagtggcagtagaactttttggtccaatgttcaagtgaattgaggtccccgggatgaagaattttggcccgggacaggcggtaaatgttgcgcaggtcattcatcgagtcgacaagcaaaaatttcaacggtccaacaggaattagtgccgtgaaagcagcaaaatttgcgtggtcgaagattttgtagaggtccaaattttgtccgacaattggtcactccgagctgcgcaaagcggacaagtgaatgtcgccgtcgatccttggtgcctcatcagtgccggagtgaatttgaggtaggcacagagttgatggtgtcgccataagctcacagcgtgccgtggatgctgacggcacgggttcggcttgttggtcagcgtcggcaggtgttgaagggaatggcacatcggtgtccaccatctccaccgacggcacgtccaattcctgcggcgtcatgggtgtaggtgttgttggcagttgttcggaggtgtcctctaccgattctactgatgtcgacggcccttctttggtttgttgcggcatttctgcatcggggtcgggctggggagaaggtaaaaattggaaaaattagagattttatgaaacaaatggaaaaactcactttccttgacccatcgggcttgcatcgccttggccggccgtttgcgctcgcctttcctctctcttttcccaccgtatttgcaccggtttgctgatgttaaaattcttttttttttgcccattaaattccctaaaatatttatcgcctttaatcaaaaacaattgtacagtttgctttatttttgcaaataaattctaattgatgcgaaaagtaaaatgttgttttttacataattaaaatgaagagatagtacgccaaagtgagagaaattacaaagaaaaaaagaaaggaagagatagtaccactatgggttaactccggtgcgctgtcaaaatcccgctgcgtcgaaatcccgccacagccaaaatgagtcgaaatcccgccaaataaaattagcgaaaagtcgaaaaaaaagtttttcaagactttaagttatcaaaatttatcggaatcgtgtaatcaaataccaaataataaaaatttcaggaaaaaacaagcataacaaaaagagttaaaaaaacatggaaatgaacaattttaagggatatgcacgatcgaatcttcggtgttttcgtagtccttcaattttcctgcgtatccttcgacctgtagaccaagagccgtcattacatcatgaatttcggcatcattgttgtatgtggcgtccgttaaaattcacatgatgactgcgtcttgcagaacgtagcgtttgtgcacgaagttcgagccgatctagcagcgtcaacttgtttgtcgatgcttctgttgacttcagaaataaagtcggaaagggccgggtgatgacaaagacctttctaaaattgtttttttgggggggggggttataagtaaaaaatacagagaaatgaaggtgtgttgcttcgaggccattgttggtcctcgcgagggtaaagccgcatgtgagtgcacgttcaatgaacattttttctccatcctttgccccttcattaattaattaatgctatcgatcggtttcactgatcaatcagagtttatctcctcccattaatttgtgtgtgcgcttttgtttttataatatgaactgactgcaacaataagcccataactttcagagcagagcaaaaagagtgagtcagtcctcttcaccctttcatttttattatattttgtttctttttttctgattaccatacgttttgatctgctgctgctgtgtgagaagatagagtcaggtgaagaagtgacgagagagtgtggggagggaggaaagcggaaaaggccgagatcggatgacgagaatcggagagaatgagcccggagcaggaccggatcctgcgcaggattttgcaggatcccagtccgcaatcctgcatttttggaaaatgcaggatttatcgatttgagtaattttttttgttcgaaataagcattttgtgagattctgagcatgaaaaatcgaagttgattttttttgcaacgcttcttccaaaaaacttggggaattgaggggccggcggtgccgataggcgccaccgtgaaaatttttgtaatttttaatgtgatttgttaacagatttgtccacaaaatggccaaattttgcaattttgagtaaaattgaaaaaaaaataaaaaggatttttagggtccggcggttccgataggcaccgccagaggggggaaaattgagaattttgaccatatttttagcagattttcatttaaaaaattcataattttgtggattttcgaaaaaaattgtaattttctggctaaatttgagtgagatttccgtttgatactctattaaaaaccaaaattcaaattaaataattgccaaacattatgccaatttatcaaaatttaaaagattctgaggattttccccaaaagcctcaaaatttctcaaaaagccacaaaaatcctcattttccaaaaaaatcctcattgacctatcaaaaagccacaaaatgaggataaatcctcagatatggcaaccctgagtactaagcttttctctgcacagagtggcgtacccatagtgccgacaagtacccgaaaagcgacgaaacggatgtcagattcgaattgggttgggttttataattcgtatatgagtgaataaaacatacataatacgggatcaatcacaatgaacaataaatacataatacggatcaatcataaatgatcaacaataacataatacgggatcaattataacttatcacaacaaataacataaatacaggatcattttccaagaaagtttatggttgactcatatactctgatttgtctttgattggcttcttggtgctgccgccttcagaagatggtccttctccttgggcaggcgcgttcgctgtgacctggaaatttgttgggttattgatgctctgccgccttttgaagttgcttcatctacctgggcattcggcgcgttcttggtactgctgccgccttcagatgctggtccttcttcttgtgcgttcgacttgtccgttttgctgccgcctttggaagtcgttcctcctcctttggcaatactcggcgcgttcgttgagacctgggaatttgttaggttattgatgctctgccgccttttgaagttgcttcatctaccatggcattcggcgcgttattggtggtgctgctgccgccttttgatgttgcttctttcttgtcctttggcttgtccgttttgctgtcgcctttggaagtcgttcctcctcctttggcaatactcggcgcgttcgttgagacctgggaatttgttaggttattgatgctctgccgcatttttgaagttgcttcatctaccatggcattcggcgcgttattggtggtgctgctgccgccttttgatgttgcttctttcttgtcctttggcttgtccgttttgctgtcgcctttggaagtcgttcctcctcctttggcaatactcggcgcgttcgttgagacctgggaatttgttaggttattgatgctctgccgccttttgaagttgcttcatctaccatggcattcggcgcgttattggtggtgctgctgccgccttttgatgttgcttctttcttgtcctttggcttgtccgttttgctgtcgcctttggaagtcgttcctcctcctttggcaatactcggcgagttcgttgagacctgggaatttgttaggttattgatctggggtgggcatttttgaagttgcttcatctaccatggcattcgg

SEQ ID NO: 357 - DNA, 4530 bp, Heterodera glycines
gcccataactttcagagcagagcaaaaagagtgtgtctgtcctcttcaccctttcatttttattatattttgtttctgctgctgctgtgtgagaagatagagtcaggtgaagaagtgacgagagagtgtggggagggaggaaagcggaaaaggccgagatcggatgacgagaatcggagagaatgagcccggagcaggaccggatcctgcgcaggattttgcaggatcccagtccgcaatcctgcatttttggaaaatgcaggatttatcgatttgagtaattttttttgttcgaaataagcattttgtgagattctgagcatgaaaaatcgaagttgattttttttgcaacgcttcttccaaaaaacttggggaattgaggggccggcggtgccgataggcgccgccgtgaaaatttttgtaatttttaatgtgatttgttaacagatttgtccacaaaatggccaaattttgcaattttgagtaaaattgaaaaaaaaataaaaaggatttttagggtccggcggttccgataggcaccgccggaggggggaaaattgagaattttgaccatatttttagcagattttcatttaaaaaattcataattttgtggattttcgaaaaaaattgtaattttctggctaaatttgagtgaaattccgtttgatactctattaaaaaccaaaattcaaattaaataattaccaaacattatgccaatttatcaaaatttaaaagattctgaggattttccccaaaagcctcaaaatttctcaaaaagccacaaaaatctcaatcacaatgaacaataaatacataatacggatcaatcataaatgatcaacaataacataatacgggatcaattataacttatcacaacaaataacataaatacaggatcattttccaagaaagtttatggttgcctcatataatctgatttgtctgtgattggcttcttggtgctgccgccttcagaagatggtccttctccttgggcaggcgcgttcgctgtgacctggaaatttgttgggttattgatgctctgccgccttttgaagttgctgcatctacctgggcattcggcgcgttcttggtactgctgccgccttcagatgctggtccttcttcttgtgcgttcgacttgtccgttttgctgccgcctttggaagtcattgctcctctttgagcaggcgcgttcgttgagacctgggaatttgttaggttattgatgctctgccgcatttttgaagttgcttcatctaccatcgcattcggcgcgttattggtggtgctgctgccgccttttgatgttgcttctttcttgtcctttggcttgtccgttttgctgtcgcctttggaagtcgttcctcctcctttggcaatactcggcgcgttcgttgagacctgggaatttgttaggttattgatgctctgccgccttttgaagttgcttcatctaccatggcattcggcgcgttcttggtgctgctgctgccgccttttgaagttccttcttcctgggctttcagcttgtccatttgagcgtttggcgcgttcttggtgttgatgctgccgccttttgaagttccttcttcctgggcctttggcttgtccgttttgctgtcgcctttctgcaaaaagggaaaagggatttttaaattgataaaacgaaagttcttttctgaacacacctttttcacacaaccgccgcagcactggctgaccaaaacaatggccacgagcaaaagcaaaataaggggcaaagggaataagaataacattatctgttgttgttgaatgaggaatggaatggtcgaaactgagaaaatgcattccttttataatgatgacgaccaaaaaagaaacaaaaaatttagcaaaaaaaggagtatgattttcttcttctctatcctccattatataaaagaagcacttttccggttatttgatcatcacacatttactatttatgcaataaaaaagggaatttctacgttaaatttttttgatttggtggaggttttttatgcttataaacgcatattgtagggattttcgagaataaatgcatatttaccatttttgcttttttagagatatgtatttcgggcattttttgtaatttttacaagaaaagcgcttcacaaaaaacccaaaatttttgtaattctctaaaaaactctctttagccattgtttttatgttttgaaagtcaattaagaattttacataattttctgtattttttgagggttcaaagccatttttggtagtttttgaagcatattttcgtccatatttgggcatttttcgggtttttaggcatatctgaggtattttgagtgcatatttggcatttttagtgcatactaatttcatactactcattattttaggtatattcatttttaactgctttgactattgcacggataggacttggcaaacctatttttgcttttgtcagtctcagtcgtgtggtgttcaattaaaccttttttcgtctcgcggtttacaaccatccactttttgcctatacaaatccgatttctttcatttcatttcctttacaatttatattcggttaagtattcagggaatgggtcttttcagttcggagttaggcgccagctcgagttttttggaatgagacattttttcattgtcaacaaaatcctagaatattggcatcattataaaactctacataaactctatcagccttaaaatccacaaagattttcggtaataggcagtttagatggtcacacctttttgttggtttaaaatattgattaaatatattataatttaattaaccgttaacttttgagttaataaaaaaccaaacaaaaaaaataataattatttaatatttcacttgaaataaattaaaatttgaatttttttgaatttttaaagtttgccggttggtcccggtcccggcttctcaggtccggttttggcaaaattcttggagtattattcgccttaatatcatcacaatccacatagaatatgatcttgttgactctgtttggattttttagcgtatttgaattgcttttcatttcaacaatactaaacgccattattttcaatttccgactgctgccatcaaaattattttgctaatccaattttgagacattacgaataaaggcgtgttgggcgttggatggatgtgagggacggtgcgggggacggaggatttatgtaggccttaattctgttgaccacatccacgtggccactcgttgtgaatacctgagtcattttaattttatgtgtcgattattcagctcagtccttttgattacacatataaattttacaaattaaaccaacccaaaaaatttcaaaatgaatgtttcttcttcgtgaaagaacaggtttcaaaaatttggctgcatttcgcaaaatgaaacgcggtacaccaaagaatggttattctatacagctacgaacatagaagtgatttgaaaattttgaattttcgactttttgttcgggtccgggattcgaaattagtcaaaaagactgtcagattcttgatcagcgacccagaaagccctttaaatatgttttcacgacttgttagaacaaaaaaatttcttccaaaaaaattatgggggttaaactgcataagagccaaattttcctattttattttctaattcgtaatttttaaaaggacaggtggtataactatgagtaaaacctcaaacccagtgtcattgttagacaaaatgattcataatgccaaatagcgatatttttggggcgctaaatcaaaaaatatgctgatcagcagggaacagatttttaagtgctgaaaatcgcgaaataggtacatatacctaaatagttgctaaaaactgaaaaaatgtcgacggcccttctttggtttgttgcggcatttctgcatcggggtcgggctggggagaaggtaaaaattggaaaaattagagattttatgaaacaaatggaaaaactcactttccttgacccatcgggcttgcatcgccttggccggccgtttgcgctcgcctttcctctctcttttcccaccgtatttgcaccggtttgctgatgttaaaattctttttttttgcccattaaattccctaaaatatttatcacctttaatcaaaaacaattgtacagtttgctttatttttgcaaataaattctaattgatgcgaaaagtaaaatgttgttttttacataattaaaatgaagagatagtacgccaaagtgagagaaattacaaagaaaaaaagaaaggaagagatagtaccactatgggttaactccggcgcgctgtcaaaatcccgctgcgtcgaaatcccgccacagccaaaatgagtcgaaatcccgccaaataaaaattagcgaaaagtcgaaaaaaaagtttttcaagactttaagttatcaaaatttatcggaatcgtgtaatcaaataccaaataataaaaatttcaggaaaaaacaagcataacaaaaagagttaaaaaaaca

SEQ ID NO: 358 - DNA, 10487 bp, Heterodera glycines
attgtcaaaattatggaaaaaatcagtgaaatggaaaagtagcaaaaacagcagcagaacgataacacgagcaaaggcgaggaattaagggtaaaacaaaactatttttattgattttatatttaagcaattttattttaatacaatttaatgttttattttaaggcacttttaaatttccaacagaatcattgggatgccaattattgtcatgagaaactcgaaatcattggcgacaaaaaactcattgtccattataagcaaaatgatattggtatttttccatattttacttatttatgtatttatctttaaaagattggtgttccgtctttgctaaatatccgattttgctgaataataattggtccgacactttttactacgaaatttcagtcaaaaatatgaaaaggtaagataaataatatttttaattttatataccaaatttaacagagaaatattaaaagtgaatgattattaataaaattgttatattcctttatttatactttttcagtttaattaccttcggattcgctgttaaacagcagaacaaattcgatggaataattcttagccacaagggcacttattcatattataatcgtggcgatatttggattaacggaaaaggaaagggaagaaatggcaaatattcctacggtgttggcgataccgtaggaattggtgtcaatacggccactcgacagatctttttcactaaaaatggacttcgtttgggttggtaaataaataattaatttaagaattttaaatataatttttatttaattaatttttgtatttaaattatcaaaatcccataactttttcacagattcctctgaatttttcgttgctcaatcttttgctgatgattcatttcatccatttgtttctatttggcattatggtggccaagatcaaattgaggcaaattttgggcccaatttcaaattcgatttggcaactctctgaggaagaaatattcaccaaagctgatcaatctgttctttttactgatcaatttgttcgtttaatcttttttttaagagtattcttggaatcagggaatataaatatcggtatgtacatgtgtatgaggtagagaattgatgactttgaaatagggttcggtccggtgggaaaaatattggaaatttcaattgaatagtaaataagttagaatcaaaaattttactcattttaaaaaaaatttcatttcgacgcgtcgtggttattaataaagcctccaaatttcaaattgcggataccgctgcgggattgtaactcacaatttttgcgggaaaggaccacgcgggattattctgttaacaaatttcactcaaaatttcaaattgaccacgcccccatccacaatattccaaaaaagtttttgaaaaaacagcgccacaaaaagagcgattaaaaacaaaaaatttaagagatttcaatttattaaaacaatagaaaaattctcacagaaatttttatttttgtccattaattaaaaaaataagacacttcgaagaaaagttatcaagcgtcaaattgcaccgcactaaaactccccctagtctctgcctcccccgccccattctcatttcaaaatcttttttcaatggaaagtcgtacatgctgtacaaagcaactgttatttcgcaaaataaagcttaacaagcctatgcccaaaaaagcttaagccaaggcctagcctaaagcttaggcctaagcataaatcctaagcctaacctaagcaattgtacgagttgccttatgtacgatttgtcatgaaacgaatattccattcacccacttggaatgctcgagattcgtgaattgaccccgtgaaccgtgaacgtgatccaaaacgtgctgtcgatccaaaaaaaactcagtgattgataaaattaaataaataaatttaattattgtattcacaaaagcatggtgccgtctgattaaccctaatgtgcggcgggacgcaagtcattttcaaatttttcaatttttcacatcacttctcgccaatttgctccatttgtattacacacagtcggagatgcctaaaaattattttttaaattttatattgcccactgtcggattgtccagtcacgtttatttcgagcgaattaaaaaaattaatgtgttttgtcgtactcttctggtgcgaaagtgcttttcggtgcggcaatgtcaatggaaagcaattagggataattcgactccttttgaaaacaattcactgttggttcgactttccaaaattccaaactcagtcaattggtggccaaaaaatagaatccaaaattatatttagcacaaaagaataaaattaatgagaagatgagaagacaaccataaacataaaaacataatggtccaaaactgagaaaagaaaataactaaattaaaagagacaaaatgccacacaatatagcactaatttaaataattatccaaatatcacatcccccccctttaaaatatcaacgtccctgttgagaatgaaaagtcaagagatcaaaataaatcaaaaataggcaattcggcagagtcaaaaaggctttgggtggcggatgagcagagatcactgttgtccacgtcgagagctacgaaactgatcagaaccacgacgtcgccaagacgccgaagcccattccgagcggtcgcgtccacgccattcctgctggtgtccttcacgattagacgtttgaagagatggacgagaaaagctgtgccgacggtggtcgacaagaccaaacccgcggctaatgttgggacggcggcgctcttcagaagtactagcaccaggtcgcacaacttcagaacgcggtcgcgggcggcccaattccttctcaccaggaaatttcccaacttcgtaaatccatgccatcattgtcttcgctccatgttcagtcaagagtcccgactggttcactcgatttcccgcgtttgttcctccatagcgaaacacttccatgaggcttcttccttcttccgtcacagctccgaaccgaatgtgagtgtcgtcgcagagtttggccaagcgtcgaacgagttcgagaaattgagcttttcgtgagtgaatgtacggcggcacggcccagtagatgaaaacgtgaccatagcgctcacaaatggccctcaatcgctcaaagcattcgcaaatcgtttccatcgtctcgttggccagcagtgcatcgcgtccacatacaattagcaatgcttttactttgctggagagaacggcattgtcaaagttgcgcacgagcccagccaagccttcttcttcacttatcagcatttcgacggccgtcatctcggtgaaattcaccaattgcttggcggttgaatcgcccatcacaactcttggcttctcgatcaaacgtcggcgatggatgagttgggctcgaatgacttcaaatgcccacggcgctttcgcaaagaattcttgccatgccaattgttcagtttggctttcttctccgaatggcagttttggcggcgcgatttggagaagctgatagctgctttcctccagagttcgccacaatttccgacacgtgcgaacgcgcatttcgatcacttccatcaaattttctgcggacgggagcatgtccgaaggcaccatgtcgccacgggcaccaataaacagcacaaattcctggccggccgtgccatccatgatcgtttccaccaaacgacgagatgccgttgtcgaaccaaattttttgagcagaaatgcacagaacagtgcttgaagcggcgttgtcacctctttagcgccaattccgattttgcgatttaggacggcatcaaaatcggcaacgaccaactgcgtgcagtgctcatggccttccccagagcaaattgtggtccaaaaacaagttccgtcgccaagacagtactcgtcgcaattggccgcttcttttccgtccgcccctgaaaaattcattgtccctaatgaataaaccacttccttatcagtctcattttcaaaattaatctcgccatttttgatttcttccgagacacaaattaagccaattaaattcttaaatttggcttttccttttggcaaaattgaattatttgggatcccagggggaacacgaatcattctttcgattggcacagaaattggatcagcttttaatttatcagcagggaccactttagctgaacttccggtcatttcaatgatttggtaaggcccaaaatggttccaagctaattttcggtgtgaggcttgtgctttcgttgaatggacgacaatcataactctgtcccccggcttaaatttttcgcgcgtcacgtttgggcgggaattaaattccaatttgcttttttcgcgtgcaatttcagcgtttttgcgtgcatgtcccatgatttccatcagattttcattaaaagcttggagataagtttcctggtccacagtataacgtgggtcctcttcaaatttgatgttctcatccgtcggaaaattcacaactcttccaaacattaaagagtagggagaaaaacccgttgttactgatggtgtaacatttattgcaaaaatgacgaatgggagtttcaaatcccaatcccaagatgacggagtcgtccttttaagcaatttcaaaatagtctgattcattctttcaacaaggccattggattgagggtcgtagcctgaggttgtgctggtccctgttttcagaattttggcgattccctccaatgtcgaattaacgaactctttccctctgtcagaatgaattctttttggtgccccataaataagaatgaaattttcaacaaatgcccgtgctattgtttcagccgatttatccgggattggctctgccactgtccattttgaaaaatggtcaacgcaaactaatatatatcgattttttgcgcgacttcgaccgatattaagcacatccaaacacactaattctaatggttcatttgttctaaccatttggattcccggttgattggcgcgtggttctcgtgtgtaggcgcaaatacgacagtccagagctacttttgagcaatctgctcgcatgtttggccaaaagaaatgttcagacatttgtaaaaataattttttggcgctgaaatggcctgcacacattccagcgtgtctttgatcaatcaacttttttcgaaattcctctggcacgaataaacgtaactttccagttttttcgtcgcagtaaaaaagcttattttttatgaaggtgaaaaatgaagcttgggccaaaatttgttgtactttcctcgggtcttcggggagaattcggtgttccaaaaattcaattaattggccaaattcgctttccataattttctctttccactccatttcgtcggcacaaatttcattatttccattttctgtctcattttcgattactgtaactaatgctgattttagtaaagcaacattttctaattcctcttctattgataaactttcgtttctcgggaaatttcttgacaaaacatcagcgaccacgttactttttcctggattgtactccacttgaagaatgaatcgagaacgaagttccattatccatttgtcgacgcgactgttccccgtttccttatttgttttaaacatgggaataagcgctttatggtcagttaacacttttgttggaatcatggtaataaattgtgcgaatttattaactccaaaacgaactgctaatgcttctaattcagttggagaataccgactctcagccgaattgcattggcgtgacgcaaaataaatcggacgaattctttggttttcatccggctgactcaaaatcgccgaaattcccactttactcgcatccgtcatgatgataaacattctttccggaattttttgcgccgcgttaaaatccgggaaatacaaaacgacattttctgtaatcttctctttcaaaattttaaatgcttccaactctttttctccaaaacagaacttggtgtcttttttcagcagacgaaacaaaggtgcggccagctttccaaacgaatgtatgaactttcgataatatgtcataaaaccgaggaaggaatgcaattccttttgcgtttttggtaccgcatattcaaaaatcggccggatcttgtccatatcttttttaatgccttgccgagttaaaatgtgtcccagaaactgaatttcttccgcaacaaagtgacactttgtgatttttaatttcaaaccagctttttgtattctttcgaaaacaattttaaggtgttccaaatgttgttcgaagttttcacttgccaccaaaatgtcgtcgacgtaaacaaagacaaaatcgttcaaaacaccttcaaaaagtcgattcatgaacctttgaaaggttgccactgcatttgtcattccgaatggcataaccaaatactcaaataatccaaattcagtcgtaaacgccgatttttcgatggaatccgggtgcatccgaatctgccaatagccactcataaagtccatggtgctaaagacttttttgttgcccaacatcattaaagtgttgtcaatgttcggaagtggaaatgaatctttaacggtgaccgcatttagtgcgcgataatcggtgcaaaatctgattgttccatcctttttaggaactaaaacgattggacttgcatacggtgaccaagaaggacgaatgattccacgggataaatagtcttgcaacattattgagactttttcccgaaatgcatatggaattgaacgcatgcgcattttcaccggtgagctgtctttagtgtccacataatgtgtaactaaatcagtctgagtcaaatctttgtcatcaatagcaaaaatttgagagtggtcgatgatgagttttcctaactgatcagtttcgttcgcacagttggtgtttgcttgctcacgccaaacagattcaatttgtttaacatgatttgcttcaagctcattcaaaaactgaatggagctaatggtgactgaatgattcaaacaatcccaatttaaggaattttccgcggtgacttgcttctccactataactcctgttccaattttatcattctcgccaagaacgattggaagtgatgaaaaatttatgaccggtatggtcgcttttccaaatttaggcattactaatgtcggttcaattttcagctccgacacttctgatgccccttcaatcaatacatcttgttcgtcaatctcgtcgtttactgccacttcaattatcgtcgatgaacgcggttgaattttcacattgtacactactctaactgcagtttcctttttggtttcagtatctgctgtttcaaatgtcaccaatttttgatgcacttcatcaaaaagctttatccccaactgattcaaagcattggtcccgatgatcaaatcaaaaccaaaatcagacgcagcaacttgaagtgttatcagaacaggacgcattccatctcgcattattggaagtacaatctctccaaccacatcgattgtttttccattaaagtcccttactttcaaatttgaatgaccaaaacaattttcggaaattttgagggactcgtctttgaataggctatgcaaaaattgagccgaaattaacgagacttgagcaccgccatccaccattccttgtgccttctttttacaaacttcaaattccatgaccacaagtttgccaactgctggtggtgaagacaattcttttttacgcccttcactcacactcaaaattttcaatttttccaattcctgattcacattcacacaggccacaaggttgttaacaaccggtgcattctcaagctgtatgcaattagccgattttgtgacttctttttgcgtttgagcattgttgaaaaagtttctctgactattgccaaaatttggttgtgctgggaaccggggggtattgtagtttcggttcggcatttgagagtctccgttggtttctcgaacaaatttattggacggattgttaaaagtttggttgttgcgtctcggttctcgacactcacgtgaaacatgaccaattcggttgcaattatagcaggtaaggacttgtcgctgttgaggataatttgattgtggttcgtgtacttgtccagaaaatgttggaaaagttcggatgttctgtcctctgttacagcttctcaccgcttttcgcgtcgcctcagcacgcgcagccattgtaacgaattgatcgaagtccattccttgactacgagtcaattctaatgacattgcaatatcggggtcgtctagggcccgcagaaaatgtttgatagcataatcattgattagctgttcgtctaggcctgggtaggcacgccttacaacgcttgatactctgtctgcaaactgatcgatcggttctactggctttcgcttaagccccgaaaacaattggtcaaatgccgtaatttctttggcgtcaagctcttccaaaattcttatcatttccgcccgtattttttggtattttggttcccgaagaaccaagcgcgcacttatcttttctgatgcaagcgctgagttaaaggctctctctgcctttccctcaatttttgattgcaaagcacgcaggcgctgttggtcagtccattcatcggtactgatatcaaatttccgaaaaaatgctcgaattttatcagcaccttcccttcccgtgaggtccggaattctgtccaaaatgagtgccatttccagtctgctaacaaccggtaccgcttggtaatgcatagggttaagcgcgttttgattgaacgggttttgagtcccgtactgaatttcgcgaccaaaattttgctgcgggggttgttgcctgggaatgtatgcgtgaggcataggcaatttgtgtctcggttcgttttgttgaatattttctctcaattcatttagccgaatataacctcttgggtgaatggcggacacttggtgttccaacattgaatcagtccggccacggccatccaacggaagtccaagcagttcgttctcgttgtgctggtccaactccacctcctctcccgctaatgaaagagtgtcgttgtctaaacggcgagggagcatgttttggagaacaaaattctgagccggtggtgcaacggggtcccggttctgattattgggacttgaagttcgaattgggacccgaagtgagctaaaagctatttcgcgctgatgattttccagaaaaacggcggccggttgaaaattccgcgacgcttcgaagttctccgccgcataatccgtccaattcgtccgcaatccttgctgatgtgcgacgtttatctcgttgtcctcaatttcgactgcaactccattgtctaacagacgacgcaactcctgtcgtgtcatataccgacgactgttttccattgtgaagagaagagaagaatttgcaagtttctacaagaatgcttgctgctgctttttcttgtacacttctacaagaaagtgcacaaatgttgggcgagacgatggcgattttgtagtttttttgatggtttgttactcttctacaagaatgagtaacaggcgcgtcaattgatgactcctttatttctctgtcgaatttgtggtgtggacaattgctaatagtccccgaattgttgttgcaccaccaaatcaatagaaattaatcgaacaaactctgctcacccttgtccaggagcgccatgtcgtactactctggtgcaaaaatgcttttcggtgcggcaatgtcaatggaaagcaattagggataattcgactccttttgaaaacaattcactgttggttcgactttccaaaattccaaactcagtcaattggtggccaaaaatagaatccaaaattatattttttgcacaaaagaataaaattaatgagaagatgagaagacaaccataaacataaaaacataatggtccaaaactgagaaaagaaaataactaaattaaaagagacaaaatgccacacaatatagcactaatttaaataattatccaaatatcacactatagatggtacccccccttttgacgaaatttttttttattctgaaaagacatgttggcccgtcaacagaaacaaacaaattatgtgttaaaagaatttttattaaagaaatttataacactttgggtgtaaaataagttctaccggtcttccttttggttaaaccataatttttcattatagtaaaaaattataaaagaaaatattttattaaaaaatatttaattatttaaatattcttcaaagaataaagacaattaaattaacttaatgcaaaaatgaaaaaagtcaatcacaattattaataaagaaacaaaaaatttatctatacggaccaactattcgaacgaaagacgagttatttgatcatgagaataaaaaagaaaagaatagaatgttcataataagctaaaaaataacacataaataataacataaattattttggatatttaaatgtttgatattttaa

SEQ ID NO: 359 - DNA, 3930 bp, Heterodera glycines
  misc_feature (9)..(9): n is a, c, g, or t
  misc_feature (3873)..(3873): n is a, c, g, or t
  misc_feature (3884)..(3884): n is a, c, g, or t
gggtccgancctaaactaagcataaatcttttttaccaaaacatttcgcaaattttttctgttttttataatttaatttttcaaaaaaatttttgatgggaaaaaattttgcgataaaaagggaaaaatttgctcggacatccattgaaatttgaccttcactcctttcatttttgcaccttgttcagttcaccatcaaacaatttgggcccacttattacaatttggactccaaattggccgccccaacactgatcagcacagcaaatgaaatggcattgtccactacatcaacacacttttggcccaaggcaacgaactgttgctggttgtccgccccgaaaatgaggccaattgtttgctggccaatgaccaagaagaacatggaggaggaggagaatgattaaatgattataaatgcctcaacaaatgtgtcttatttatttatattactttccatattttaagttttatataattatattacttaccatatttcaaatatttgttgtttttggttctattgcagtgtacacgactataattgtatatttaatagctctgttttctattagcctataaaatcacaaaaagtttttttagtttatggaagaattatgaccaaaaaatagttggcagattattttttgctggtcgagaaaactgcaatagaacctcaggtaatactatagatggtacccccccccccccttttgacgaaaattttttttgttctgaaaagtcttggaaacatgtttatgggggttttcagggtcgctgatcacgaatatgaccttcattggaccaatttcgaatcccggacccgaattcgaacaaaaagtctaaaactccaaaattctcactttagttcctaaattgattaaaacatgctaaatttggtcacaaaccattggaatatcaaagaatggtcattctgtacagctacgaacataagtgaattttcaaaattttgagttttcgactttttttcgaattcgggtccgggatcccgaattggttgaaattgatgccatattcgtaatcagcgacctcgaaaaccccccataaacatgtttccaagacttttcagaacaaaaaaaaaatttcttcaaaaagggggggggggggtaccatctatagtattaccgcgaattgcggtcgcgctccagccctgatacaaaacccaccgcacggaggaagtccttttgtgctgctgatttctgttgtcccaaaggacccaggaaacctaaaagattttcatcgttcagtaaaaaagtgttaatgaactgtcagcgcactgaagaaaattgacccagccaaaaagtgagttcctcgcatcgtttgcttattatttatttaactatttcttgatttagaatagtaaaggtatttatatgaacataaattcattgtgggtataaagaagatacctacatatgtgatacgaatacccgaaagaaaatttattttcgaaaaaaataattctaaaagagttaaatatcggaaattacgtcatttagtcatccgtttgctttttgtgttcattgatgcagtcactattctgattgtgaggcgaatcggctaaaaaatatttttttattggaaaattttaaaaaattgtgtggtcgcaagcaaatgccaaaagtatcactttgcgctgcgacaaattcggccgggtaattgctggccaatgtttgtttgaaggaggcgatccgtcggaagattgagtccaagtcggatttagctcggcaaatcttttcccttccaatggcaaagtcttttctcgcccgatccaatcgcttttctgccagcgaagaacacgtcgccagcatttcgttggtcttctcaaaacgttccaacctaaaaactttttctttataaaatatgttatgtatcaatttttagtgacccaaatttggtcaattccaaacccagaaataaatctttccttacgcttttttctggctttgaatgatttcctcgatgttttctccgtccacctgcgatttcaatgaatgtacgaagttttcctctctaagcggtgacccatccgcggaagaagccattgaaatgctttgacttgaagacggaggaagaacagtggaggcagccgcttccttaacgtcattcgttgacatttgctgatttgatgaaaattttgggtttcaatttacttctataatttaaaaaaaattaaaccaaacaaaagaaatgcaataattgcgcaatagaaatgagaacgaatttatgcatatttaaaatctgaattttcgtagtataaaaattgggaggtcacattatcgcggtcaactctctgcggcaacggccacacaatgggtcccagcactatgggtcaagcccagtgttagacaaaattactcataacgccaaatagcgtatttggcgtaaatttttgcgcgttaattcaaaatttacactggtaaatgccttttttgtattgtttattttaatcagacgtaactcacttcattcccaactaaactgaacaaatttggtacctaaaaaaagtttttgaagaggagaatctttttctaagcgaaaactaagcaatttgattttttagaaaaaagttgtgggagtttcaaatcttaattacgttataactcaagtcttaaactgctgatttcaaccaaaatgcggaaagtaatcatttttctattgattctaaatgtccaacagattttgtaccgtatcaacaaaaattaatataatttgcgaatttcatgatttttaatgtgttagagacatgaaaatagtacgccaaaaagagagaaaaaaaatgcaaaacttttattattccataacttttcaatttgacctattttaatattaacttgacctattaaccgatgcagaatttttttctctatcgctatgcaaaatttggtgtggatttaacaagtaggaaaaaagttaaacaggatgaagtgaatgttgctttttacataattaaaatgaagagatagtacgccaaagagagagaaattacaaagaaaaagagaaacgacgagatagtactaggcttttctctgcacagtggagttgacccatagtgtcccagcagtgttagacaaacaaatcatttcgccaaataatataattggcgtaattttttgcccactaattcaaaaaatacactgatcattgcctttttgcattgtttattttgatcagtcataactcgattcatcccaacaaagccgaacaaattgatatctaaaaaaaagtttttgaaaagaatctttttcgaagcaaatttacgaatctccgtttcctgggttccccactttagtcatcctcggtctgatcaaggatcatgcccgggcacaatcctaataaaaatattagagctcggtattttgaaaaaagcctggacctggacctggacctggattccatgttgaacctggacctggatttcctggacaaaaatccaggaaaatccaggtccaggaaaaatccaggctcttcgagacctggatccaggcctggacctggattttttgaaactcatcttaaaaatcaaaaaaaggtttgaaaaaattaattaattgcctagaaacatctaaaaatatctacttaataataataatgtatttttaaattaatttaatctttttttgaaaattaaaaaaaaacatcggtcacttgaaataataaattctaaaattttgtccaggaaaatccaggtttttcgtgttttgcctggacctggacctggatttttttcacattggacctggaacctggatttcctggacaaaaatccaggaaaatccaggttgccgaaaaatgacctgggactgggacctggatccaggaaaaaatcaggccctggatccaggtccaggncgagctctaanaaatatatatgtccttattttttcagttttgttggttgaatttaaa

SEQ ID NO: 360 - DNA, 1383 bp, Heterodera glycines
ccattagtctaccagtctccaattatgtacccttttctgagaaggttgaaaaataatataccatggcacataaaaaagagcaaatacggtatgcgaagattcactttctcgacattggacccagtatctttaattgaaaaaataatataaaataaaatgcccaaatatgcactaaaatgtgccttaaaactgccaaaaaaaggtttttaaccctcaaaaatgccaaaattgtgtaaaaattcagaattgattttaaaaacagcaaaacaatggctaatggccgttttttagacaattgcaaaaaagtttgactttcaaaatttatttcgatttatttaattaccttttataacaaatcatttcatatgtccaattttcaaactttaatacctttccggtaataaactcgtattgcataaacagtgacagtgaaagacattttaaattttcccttggaatattgtagttttctgaatcattgataaaatttattaaaaagttttttaatatatcattttaattaaacttaggagaatgtgcgaaaatttaatatatttttttagatttattttaaaattcctcaaaatttacattttttgtcgaatgaaaatttttgtgttcaaatgaataaaggcaatttgagagaaaactcttgagttaaatattgtctgttaataagtgactgacactataaaatataattgactattgtttgtgttaatggcaactgcgtcatcgccaaaacaatcttttaacaaattttgaaaaatattttcatgacgaaagagaattttttggtatgaaaatttaaaggagggactcttggaaagatctgctgtctggctgtggtaataattaggaatgtctgctacaaaattagccatttatgtttcataataattaattaagacaccaaacattgcccgcgtaatatttcacatattaattttcaaatcataaagcgtaaaacttgtttgcctacatgaattttccgagaaaatttaatgtttttatttcgaaacactaccgtagaaatgcgtagaattagaaataatagtcatcaaaatggataaattaattttgggtttttggcaagggctgcatacaattagagcagggctcccattcgtccttggatgccaaggaggtccttggaaatgagcagctggaaaagttttaaaaaattcaaagaaatttgagaaatctgtaattttcaacaatattttgattaaaattatggcattatgtcaataaaaaatgaaattttttcggaatcgctcaagtaggcgcttacgtttgggcgcgcacggttgggcgccagcaagtttttccacaaaagcttttttatttgtcttccaaatcccatcaatcttggtatcattc

SEQ ID NO: 361 - DNA, 4185 bp, Heterodera glycines
  misc_feature (4111)..(4112): n is a, c, g, or t
  misc_feature (4149)..(4149): n is a, c, g, or t
acttttacaaaaatgtttatgcaattcaaattgcgcttcactatagctgttgtatccgccataccaatccatcaatcttggtattctacttccgccattaccatggtccattagactgacagatcatcaaaaaaaaagactgtctatttgatcaattttattatataataacttgaatagttcgactttttctcaatactcatcacaattctttcaaatttgactactttgacataatgtttgacgatcctttcaattcaattttttttgatgaatatagcatcaaagactatatctctcccatacttttcatgaaaaccatttcataaaccatttttccgaaaattcacaaaattaggaattttttttaatgaaaatctgctaaaaatcggtcaaaatcttaatttttccccaggcagagtctatcggcatcgccggaccctaaaaatcctttattttcttaaaaatttgctcaaaatcgcaaaatttggccatttttgtggacaaatctgttaacaaatcgcattaaaaattacaaaaattttccccggcggcgcctatcggcaccgcctgactccccccaccaccctattccccaaaagttttttttgaaaaacgtcgcaaaaaaaaaatcattttcaatttttcatgctcagaatttcacaaaatgctaatttctaaccaaaaaattgctcaaatttatcatggacaataaaaaatataacatttgaacattttaaacgtgttttgaataaatttgtaaaaatgaggctttttgacccaaagtgaggtttttttgcatgccaaatgaagcttttgaaaattttcaaggaaattgttttatcattttaaaattgtgagttgttgtacttagaacatgtgcagttaaatgttgttccaaaaggccataggcatggcacacaaaaagctctaattaattaatgaattattttataattatttttcaaaattaccaaacaaagcgccaaaaactatgtaagaagcgccgaccaaaaaatgtttatgttgttccaacaggatttggtcaatttcatagctggtacaattgtacaaataagtgatttggctattctttttactcaaatgactttcaataaaacttttataaatttaatatttcaatacctaaatttcatcaaatcttttcatctcaacacataccattttccatctttatattatttcaatttagaacagggctcggatcgcaacctccctttccaaggacgggtataccaatttccaaggacataagaggaaagttccattaaattcaaggacatttaaaatttttatcatatgcaattgccggaatttatttttaccaatattttttgtttctgttggtaatatttcttatttcaccgcatatgcacttttttgatgcgcactttttccagaaaacttttgggaaagaagtgggtccggcagtgccgataggcgccgccggggaagaatttgaaaattttagggtaacttgttaacagattttcactaaaaaaaggcggatttagcgatttgagattatgccgatgaccatatttttcacttttcacaacaattcttgcgggcgctttttccgaaaggctttttgggaatgggcgggggggggtgagaaatttgttaataggtttttccaaaattgacaatttttaacgctttttgggtgtctttttgaatcaaattaaaaaaaaaatgggaatttttgtgcaatttattaccagattttaaaccagtaatgcaataagttaataaaaattggtataaaagtcaaaaattaaaatttttgaattgtttctttatatgctcattttcaaggacatcttgaattcaaggatattttcaaattttcaagtgagagggcccaatttccaggacgtccttgccattcaaggacgaatccgagctctgatttagaaaattgcctgagtattcattttcaataaatttaatgggcattaaccagcagtctaattcgttttaggtgttgcccataggggagaagtaatttgtatagttttaaagcagaataaattcaatttgaaaaggtctagttatcagtcaggcttatgtctcaaggcgtcagataattaaagagaagaccgagaggcttcgggtaaatcatttgtcgaatttggtgaggtttatatataaaaaataacaaattattaaacttacatgtataaattttttcaatcatttcaaaagttcattaataagcatattaaaaatgaattgctcaaaaatgaaaattaatttcataggctgtgctaataaaaaaaatagaaaaacgcattcaaaatgttggagatttacgtctctgagctgtcaaaatcactcaccgtaagctgaacaaacaaaatttagccaaaaaatttgaaaagtaaaatattgaacagaaaagcgcataagctttttggatgaacgggatatgatcattagtgcatgcgcaagctgaacaatcaaaatgtttggcgaattcatcaaaattttaaattgtcaaattttttccgtttcgtcgccctataaatactctttccaaaatcagttttggcaatccaataaaatttctcttaataaaaaaatactcttcaaataaataatcattcctagctgcttttggtttgatcacaaatgttcgtccaactcgtcctccttgccatcgttggcattacttttgtcgatgctgccgcaccgccgttcggccaattgtccgtcaaaggcaccaatttggtcggctcaaacggcaaaccggtgcagctgatcggcaattcgttgttctggcaccagtggtacccacaattttggaatgcccaaacagtgaaggttggaaaattaaaatttcattttgagcggtttggattgacacagattttggttaatctttgcaataatgacaaattgaaactaagttgaaattagacactcactgttcttggcaatcaatttttgcatattttgtgattctttttcgggtttgagttgctaaaaatgggctgatcactcacgccaggcactcaaatgcaattggaaaatttaaaaagtgaaaagactgagccgagatttggctaggcaaagcagctttttggatgaaattattaatcgagtccgatgcttaaattaaagactccgaataaaaaacaaacaaagtttttggctcaaaaagaaggcaatttttaaaccaattaagcctaattgcatttatgcttgtaggcactcaaatgcaattggaattccaatgtcgtgcgcaccgcaatgggcgtggaacagggcggctatctgagtgacgcgaacaccgcctaccgactgacggcagctgtgattgaggcggccattgcacagggcatttacgtgatcgtcgattggcacgcgcatgagccgaacgcggacaaggcggtaattacataatttgattttgcataatatattttaaaaaatcagagattataatttagcagtctgaaaaagatggtttagccaaaatatcaaacatttcccctttattggcccacaattattcatttaatttttgaaatatttacctctgatttaatttttatgaaactttaatagtaggaatcttgggttctcgagtgttagaaatttcgattcttgagcacgattcattgttttgcttcttgagattgaattcttcaccaaaattgcgaaagcgtacggctccaaccctcacttgctttacgaaacgtttaacgagccattggatgtgtcttggaacgatgtgcttgtcccttaccataaaaaggtaattcgctgggaaatgaaaattgctaacattctcccccttaaggttatttctgcaattcgtgccatcgacaaaagaatgtgatcattctcggcactcccaaatggtctcaagatgttgacgtggcggcccaaaatccgatcaaaggattcagtaatttgatgtaagtggactctccataagtgtgtaatagtgcattccgtaatgctgcacaaactaattaataattttttgcaaataattaataataattaattaatcagaattatattaatatattcgcgctattaaggtacactctccacttctatgcgtccagtcactttnngtgatgacttggcataagcttaagacgccgtaataanggtatcatatgatactgatcgcccaaaccattactg

SEQ ID NO: 362 - DNA, 8316 bp, Heterodera glycines
  misc_feature (14)..(14): n is a, c, g, or t
aagtgcaataatantggacaaataataattcacaggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattgttttttgagcgcagataaatcgcaaagcataagcaatcgtttgtaacgtttgataacgaaaaggaatagagatattctcgagtttgacaatgatacgaattttccttataaaatatttttgttttgtaaataatttctgtaaattcttaataaaattcttctggtcggttcaaagcttcaattcttaatctctggttcatatttccataatagcagctggtccctttgaatcaaaaactgattattaaaatgataaattcaaccgaaaaattgacaaaaaattttaacaatttatgccaacgaagtattttaagaatataaaacaaaaaatgaaggatttttggctaggtcaggtcaaaaccggtcaaaatcaccggttccgggccgggttgacatttcaagagaaccgatttccgggcccagtttctcaaaagccgatcaaacatgcgaaaccggatttttccaaaaaaaaaccacggttcaagtttccaggacaggtaattccggtaccgggcccggcccggtctttactaaaaacccgagaataagacaaaaaaagactagcgtttcgagtcgaagtgggcgaagtacgaaaagtgtaaggttcggcgaagtacgaaaattgaaaagtgggcgaaatacgaaaagtaaggtttggcgaagtacgaaaaagtgccgaagtacgaaaaagtgcaaaatgggcgaagtacgaaaaagcgcaagtgaacaaattaaaagcaaaataattagtttaaaaacgaaaagcaaaatattattttaattaaattaattataatatttattatttaaattccgctacataattaaaatagattttccaggttatgaagacttctttaaaaatccataagaaacattcattttgattacaaagcggatctcgatggtggattttctctttccttttcagcaattggttttgctttcctcgcaacactgcatgcgggattatgttggaaattgtcgattttaagtttttggaattaaaattagcgtaatataaaaaattatttgctgtgtttatttttaaataattatccattaaatagtatagatttagtgaagctttggctcaccacatatatgattaattcaaaaacatttcttaattgtgtagcgaaatttaattaatctatatatattcaaattaaatttaattaacataattagagtgctcattttgcagcatatgctgtttttttttttgctaacttggggcgtgataataggcatgaaaaacgcatttctaacttggttgaggcttctaagtccacttctttcatgctgatttttgctgatttcttgattttttaatttttgtgcagatttttggaggttttttataatcagggagcaaacaatcgttttttgacgccttttttcaatttttggtgcctttaatctcttaatttttatgcttttttccaattttttgtttttgccttttttgtgcttttttcatgcttattttggaatttggtgctatttactgtggtgcttaatcggttattttttgtgctgaaaacgagcactctaaacataattattttgcttttcatttgatcgcttgcacagtaccctttgtatataggctaattgccaaagctcttagttttaaaaattcatcatcggaattttattcaaataaatattcacaatattctcaagaattatcaaatccatttcattttaataatttttcattaaactgtaattaaaaaaagttgaattattttaagacttttgccaattaaaaccctattttgcgtgatgctaatgtgtttgctaatgtgttacgaccacacgcccaatttaatgcaaatataattataaacatttaaaattttcatggcattaaaatgcaattaaatcaaagtgatttatcgatgattgctgttattaccatgatttatgctatataaacaaatctgaaaaacgctacgattgcgacaaaagcttttgcaaatgtttgtatgaaagtgctaaatgttcattaacaaaagtctgttttatttgtattttaaatagtttattttagagtgcccacgggaccgggacctggtttgcccaaaattcccggtcccgtggcactctattttattttttagaatttgttatgcttgtcagttcatgttttttgcgtattttattacaaattgcagcacaaggaattttattaagaatttacagaaattatttacaaaacaaaaatattttataaggaaaattcgtatcattgtcaaactcgagaatatctctattccttttcgttatcaaacgttacaaacgattgcttatgctttgcgatttatctgcgctcaaaaaacaatttaatcggaatttcgataaacattcgcatgcaaattttatatatatttatttttcgcaatcttcacattttccattttcttcagtttcagttgatcatccggacttcagactttatttagcatttcacacctgtgaattattatttgtccatattattgcacttttcagttttatgagtgactggttctgattaaataaatcccttaatccgtaaatccagatcctcaatatatttcttgattgtgtcctgcccttgacggtttaattggtcagacaaaccggtggattttttcttgtgttgcgaagctaccatattgccagactgcgtccagcgggaggaagtgccaacctgaaatgagcaaatttgtaggagaaatggctgaattcgagagatttagtgttcgactcgagaaatattcgcttttttgtggcgtgaaattctcggacggcacttcctatcagtggcccccaaaatcactcacattggcagccgatgttccgccagtgagcgctgcacaagcttcgcttttgtcagtgattgaccaattgacgtacgaaattttcagttggtccaacaggctccaccagcttgacattgagccggagttcagattaccgttgccagacgcttcgcatgtaccgtactcagtgacgaacaccggaagaccttaatgtacggttgcaaacagtaatggttttggacgatacagtatcatatgattacccttatttacggcggtcttaagcttattgccaagtccatcaacaaagtgactggacgcatagaagtggagagtgtaccttaatagcgcgaatatattaatataattctgattaattaattattattaattattttgcaaaaaattattaattagttttgtgcagcattacggaatgcactaattacacttaatggagagtccacttacatcaaattactgaatcctttgatcggattttgggccgccacgtcaacatcttgagaccatttgggagtgccgagaatgatcacattctttttgtcgatggcacgaattgcagaaataaccttaagggggagaatgtgtaagattttagcaattttcgtttcccagcgaattacctttttatggtaagggacaagcacatcgttccaagacacatccaatggctcgttaaacgtttcgtaaagcaagtgagggttggagccgtacgctttcgcaattttggtgaagaattcaatctcaagaagcaaaacaatgaatcgtgctcaagaatcgaaatttctaacactcgagaacccaagattcctactaaaaattaaatcagaggtaaatatttcaaaaattaaatgaataattgtgggccaataaaggggaaatgtttgatattttggctaaaccatctttttcagagtgctaaattataatctctgattttttaaaatatattatgcaaaatcaaattatgtaattaccgccttgtccgcgttcggctcatgcgcgtgccaatcgacgatcacgtaaatgccctgtgcaatggccgcctcaatcacagctgccgtcagtcggtaggcggtgttcgcgtcactcagatagccgccctgttccacgcccattgcggtgcgcacgacattggaattccaattgcatttgagtgcctacaagcataaatgcaattaggcttaattggtttaaaaattgccttctttttgagccaaaaactttgtttgttttttattcggagtctttaatttaagcatcggactcgattaataatttcatccaaaaagctgctttgcctagccaaatctcggctcagtcttttcactttttaaattttccaattgcatttgagtgcctggcgtgagtgatcagcccatttttagcaattcaaacccgaaaaaagaatcacaaaatatacaaaaattgattgccaagaacagtgagtgtctaatttcaacttagtttcaatttgtcattattgcaaagattaaccaaaatctgtgtcaatccaaaccgctcaaaatgaaattttaattttccaaccttcactgtttgggcattccaaaattgtgggtaccactggtgccagaacaacgaattgccgatcagctgcaccggtttgccgtttgagccgaccaaattggtgcctttgacggacaattggccgaacggcggtgcggcagcatcgacaaaagtaatgccaacgatggcaaggaggacgagttggacgaacatttgtgatcaaaccaaaagcagctaggaatgattatttatttgaatagtatttttttattaagagaaattttattggattgccaaaactgattttggaacgagtatttatagggcgacgaaacggaaaaattttgacaatttaaaattttgatgaattcgccaaacattttgattgttcagcttgcgcatgcactaatgatcatatcccgttcatccaaaaagcttatgcgcttttctgttcaatattttacttttcaaattttttggctaaattttgtttgttcagcttacggtgagtgattttgacagctcagagacgtaaatctccaacattttgaatgcgtttttctattttttttattagcacagcctatgaaattaattttcatttttgagcaattcatttttaatatgcttattaatgacttttgaaatgattgaaaaaatttatacatgtaagtttaataatgtattatttttttgtcggaaagcactttgggtcaaattatggactgaaatgactgattagaaataataatttaggtgacaaaaaacacttaaaatctctttcagattttgaagtaggaagaaggaaatgcgagggacgggcgaagctcggcttagcactcgaagccgaaggcgaagcccaatttttttcaaagcacgaagttcgaagccccaaaaacccgaagttttcaaagctcgaagcacgaagtttttgagaaaataattttcttccctatcaaaattttaatgggtggtaaaaattatttgtaacaaaaaatcatgatcaaaattaggctgttcgagaccgaaaattcctgagactgagacttctttctataaattaaaaaacaaattttcatgcttttcgaacagatttttttgcggcaccggggtgacgacaagcgccgcctgggaaaatttgaatacaatttatcaatagattttgtccaaaaaggccgatttttgcgattctgagccaattatcgaggatatttttattttatttttcacaccgcttttttttgcggtgtatttatttaaagcttttttgtgggggagaggggggggggggggggtacggcggtgccaataggcgccatctgggaaaattttgaaattttgagcgtactttgttaacagaattaggcgaaaaatgaaaaaatttgcgattttaaaaattgggggtttaggcgtcgggggttaattttggacctatatattaaaaatatacgatttccatcatgtttttcaaaatgttaatgtttaaaaaattaaaagaaaaccactacttggaggggaactgatcaaaaataaatagaatatataaatttaagattagcaaaagctaatcattaggggtgtgtttttcactttgataggtatgcattttcccgaaacttcgggtaaattacccgaagctgatgctcgaagtttgaatcccaaaaaacgcgaagatttcgaagcacgaagctcgagtttcgcctgtccctgatgcgaagacggagcaagtatttagggcgcaggaagcagtctgacgagcgccacaggcaccgcctgcggatcactcacatttttttctgactgaatcgctttaaaacagcttaatttttgaggacccaaaattcttgttaattccttttttattttctacgttaaaattttttgatttggtgaaggtttttagtccatataaatccatattttgggggttttcgggaaaaaatccatatttcggccatttttggcaaattttcacaagaaaaatgctaaaaaaagcgaaaaatacacctctaaagatcgacttttttggaaatttttaaaaaataacccccctaaaaaagagattttttcgaaatttcggaaatttttttaggtctttttttcgcttccgaaaatttttactgacaacatgagattattataaaaattttgatacgtatttggttggcaattgttaagctagaatttaataaaaattgacattttttaaggttaaatccattttttggcagttttagcatattttttagtctgtttaagtaaattttgaatatataaacacctttttcataatttttttaggttttaaagcataattttggcagtttttagtccatattttggtccataatttgccatttttgagcttttaagtccatatttcgggcatttttagtccatatttggtgttttttagtccataatttataaccctactaatgatgttcaaacgcagggaaaaaaaatgcaattttgtttggttacatgtccaaagttccattgaaatgagtacaaaattttgaatttataaatgctcattgcgaaatagctacaattattattttgcctcggatgcgcttcgcgtccgttttgaattgttaacaaaaaattacatttttaagtgcttggcaattagaaaaagaattattaatgagttaaaaatacaggacaatcaatcggccatataaaaaattttgcggcactattttattcaagagaacagcaggaggtgtacgttgagaaaatttttgaaatttagttgttattttcttattagatttcagcaaaaaaatttgaaaaaggaaaaatataatgtccttattgttgagctcatcattagggatgcgtttttcctcaatctttagtcgtgtatttttcttataatttcgggtattttcacgaagctcgtagttataagcccaaaagcgaagtttccggtgttgaagaagctataagtttcgctcagccccactgggaaattttttttgcaaattttggtagacccttttggcaccttaggaattatcttcattttgtgcttttggtcgatagaaagggattttttaaagattcaaacgaaaaatttataaataaatctatttcgtttgaaataaaaatgagaatttgatattggattgtccttttaaaaattttaattcttctatacctcactgtttgggcattccaaaattgtgggtaccattggtgccagaacaacgaattgccgatctttgccgtttgagccaaccaatttggtgccggagacgcacaattggccgaacggcggtgcagcagcatggagaaaggtaataacaatgagcatgagttggaccaacattgtgatcagaccaacagcagctaggggtaatttttattatttttgatttagagtaaattgtaaaatgattttggaaagcatatttataggacgaccaactggcaagaagattgaaagtgtaattttgattaattggccagctcggttgcattttaggtgttcatttaacttacaagttccaatacgtttttctcttaaattttgttaaagaattttcttttttacctgggcctatttcaattcggatcaagtcctcgacttgatgactcgacttgatgaacaaatcgagtgttttgtttcaattaatttttatttattacttgatctcatctagtgccgaattacactcgatgtaatttcatcatcaagtgtgagaatttaacatcgagtaaataaatttgtgtttgaattacattttaaagactcgacttgattttttgcactcgatg

SEQ ID NO: 363 - DNA, 1316 bp, Heterodera glycines
cattaaatgaccaaaattatgacaaccatgctttttgttcaatgacttaatggttttaaaaaataaaaaaataattccttcagaatttcccaggaccccgcgcatttttgttataccggtgtttaatggcattataatgacaaaatgtccgacagtcatgcttttcttgccatgatcgtataattaagaaaaaatccaatagttgttgaataatttcccaagactatgcgaataaatgtcactctagcgccaaaaccaaatgagcatgttaatcatcaggatcttgatatttttccctatgtgatttacggatttaagaaaatcgcaaattaattattggagaatttcccaagaccacccgcacattttgtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcgcaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaaat

SEQ ID NO: 364 - DNA, 973 bp, Heterodera glycines
aatccgtaaatccatagggaaaaatatcaagatccctttgattaacatgctcatttggttttggcgctagagtgacctttattcgcatagtcttgggaaattactcaacaactattggattttttcttaattatacgatcatggcaagaaaagcatgactgtcggacactttgtcattataatgccatttaaacaccggtataacaaagatgcgcgtggtcctgggaaattccgcaggaatatattttatttttctaaaccattaagtcattgaacgaaaagcatggttgtcatacatatggtcatttaatgccgtttaggtcgccgccatctgcaggtgcctcggaaccgtccactgatttaaacttgtccaacccgtcgaacattgacagcagtgcccaaatggtgaagtcgcaagtgcccgggtgtgtgcaaatcagttgtaacaacttatgaaaccaaagggaatatgaacaatgaataagtaatttttctacctgaagtcgcacaatgtcgaaattctcctgatccaacaggaacaggacgagaagtgtgcttatggattctttgtcaagcagtggcacagtgcgctcgtcaaacgaagtgccggctgcgtcagatgcgtttttaatagtatgtatgcttttacgagccattgtcgactgctcttgcattattgctgcgatctgtttcagttccactggtggcacatcggcatccacccgagcagtggtattgtccgcctgactgatctgctgctggagtaaatggtctctgataacctataaacaggaaaaggaataaaatgtcgtgttttttttcaaatttgcctcttgtctcatatcttcggggagtgctgccaaaaatgccgggtcgactccttcgggcatggcagcttcattcggttgctgtgcattcgtaccggaaacagccgtagacatttgacccgcattgtcggcagcttcccgtgatg

SEQ ID NO: 365 - DNA, 4352 bp, Heterodera glycines
  misc_feature (86)..(86): n is a, c, g, or t
agcatgtcatcatcagcatcatgatatttttccctatgtgatctacggatttaagataatcgcaaattaattattggagaatttcntcaagaccagccagcacatgttgtacgctggtgcctaaacggcattaaatgaccatatgtatgacaaccatgcttttcgttcaatgacttaatgttttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcacatttggtacgctggtgcctaaacggcattaaatgaccatatgtatgacagccatgcttttcgttcaatgacttaatggtttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaatgtccgacagtcatgcttttcttgccatgatcgtataattaagaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaagtgtccgacagtcatgcttttcttgccatgatcgtataattaagaaaaatcgaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaagtgtccgacagtcatgcttttcttgccatgatcgtataattaagaaaaatcgaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaatgtccgacagtcatgcttttcttgccatgatcgtataattgagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaaatgtccgacagtcatgcttttcttgccatgatcgtataattaagaaaaatccaatagttgttgagtaatttcccaagactatgcgaataaatgtcactctagcgccaaaaccaaatgagcatgttaatcatcaggatcttgatatttttccctttgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaatgtccgacagtcatgcttttcttgccatgatcgtataattaagaaaaaatccaatagttgttgagtaatttcccaagactatgcgaataaatgtcactctagcgccaaaaccaaatgagcatgttaatcatcaggatcttgatatttttccctatgtgatttacggatttaagaaaatcggaaattaattattggagaatttcccaagaccacccgcatacttggtacgctggtgcctaaacggcattaaatgaccatatgtatgacaaccatgcttttcgttcaatgacttaatggtttagaaaaataaaaaatatattcctgcggaatttcccaggaccacgcgcatctttgttataccggtgtttaaatggcattataatgacaaagtgtccgacagtcatgcttttcttgccatgatcgtataattaagaaaaatcgaatagttgttgagtaatttcccaagactatgcgaataaatgtcactctagcgccaaaaccaaatgagcatgttaatcatcaggatcttgatatttttccctatgtgatttacggatttaagaaaatcggaaattaatta

SEQ ID NO: 366 - DNA, 1586 bp, Heterodera glycines
  misc_feature (1442)..(1442): n is a, c, g, or t
  misc_feature (1561)..(1561): n is a, c, g, or t
caatgaatgtcaatatttcgcatcacttttctttcttttttctcatcattcactcttcgccaccgtcgcttccttcttcagggcgcgcttgcgcgtctgcagtgagttgtcgcgcacgaatttgttcagcaacggggcggggacgtagccgaacatcagctcggcctaaatgggggagggcaaattctaacaaatttggaattcgtacaaattcgaaaaatgcaacaaaaaaaaccccgaaatgaaaattttgccggttcgaccgacctgaatttggtgggacaaacagccggtggtctcgtcaaccaaaccaatgctgcggagcgcttgggcggcaaattcctcggggctgggcgtgaagaaggaagccttgcgaatcttggccattttggtggccaccatcatcgggcacaccgtttggatgacaatgtcggtgtcggcgtattccatgcgcagaatggaggacaaccaacacacgtatttctgagacagagattcaaatgatttttttgataagattgaattctttaaattatttccaaaatgaaaaggaatcgaataaaattttcttgtgtatttttagggtttttagtgatcggcgtatcttagaaaattaaaagttctaatcatttgaaaaacattttttgagaaattctaaataatttgaaacgttcgatgacactctttagttggtggctccattttaaaattatttctcatgaatttttaatattcaatttaaaatcggggtgagtcatctataaagtattaccgaattgttttatgaggtcccaaatcattaattagaccaaaaaatatacaatacagcccaataaaagcaaaatgttttcaaaattccaacgcggcaccccccttttcccctccaccttcgacgcggaataagcggccaggtaaaaccaattgaaatacgctgccgaggaggccaaattgacgacgacgccgcgtccccgttccctcatctgtttgagcacaaaagcggagagtaccgtagtgggcagggtgttgatcaccttgaaaggtacaaaatcaaaacacttaagaccaccagcagttcaactgatttaaaacgtacggtaatgtcggagacgcgttgcagtccgccctcaatacggtccaatcgctcggggtactcgtagctcatcccgacattgttcactgaaacaatgtttacattcgtttgattattaattgatgctctttaatacaatccattatttcgggaaaacggacactctaaggaaatgttaaacataaaaaggtccaagtggtgcgctctttatacgatggtttgtttttcaccggccttttttgctctaaaaatttttggtaaattaatcttgttgggatttgaggggaaggtgaatttgggatttttgacgaattcctcaccaaaattcaatatgcttttaaagacttactanaattccaaaaatatatatatatatcaggaattcataaagcattcattccgtgctaacaattttgtcatccatcagcggtagtgcctaccgagcattcccactttcatgtggaaagttgngagaaaattgtctgctcgtagtcct

SEQ ID NO: 367 - DNA, 1181 bp, Heterodera glycines
attttcctccgccactgcgttcagtttgtccatggagcgtgagatgagcaccacgttgaagtttttcttggccaactcgagcgcgtatgccttgccaatgccgtcagtgctgccggtgaccactgcccactcggcacccgcgagcacctggaaacaaccgatttgaacggaaatgttagggaattggaacgccgcattccccaccaaagattttgcaatgcttaaatttcaaaaaatgaattattttgctccatttttctatatttttgaatgaaatttaaaaaagtaaaaatttaaatatgaaaattaatcttttttttgtgagtgtattcttttattctgacagttctcttcacccataatttgggaaaaatataaattgatattttttgggaaataagacttggtcggtctaaatccgacgaggtcctctacccaccttgatattctgaggaacagcgaacaaataggggaaaaccacattgtacagagagcggaagagtttctggagaaaaatggcaattgtcaaatagccggctaatgtgacaagaaaagacatggcaaaatattaaagtgaacaaatgccttaaaatttgttacacaaaaattactaaggaataaaattaaatgagaaattccaaaatttaatttttgtgggaaattttataagattaaaatagcaaaggccaattgccacgccccaaatcatcgaattggacaaaaagttaatgaatgcgtggggcggttgaattgaaaaggtggccgattaaatttcttttgcaaaaacagaaatgaaagtcgcacaaaaatgcgaacgtaaaattggaattgtaatgaatgaatagaaaacactcatcggttgattggagaaaaatgtgggaccattttgaagagaaaggagaggagaaaggtggggcggttaaaggtcaatatctttcgattttatatgggaaagtgaaaaaaaagaataatggaaagtgcaattttaattaatcaattgcataattaattaattaatgatgtattaacaaatacatacataatgttttgaatgaagaaaggaaaacgaataatcttgaacagcgcagagagtagttaacctacagctctcatcgcagggtgtgaaaatgattaatgggttttttttccctttgatctttgccgccggccggggggggggg

SEQ ID NO: 368 - DNA, 817 bp, Heterodera glycines
ttccttcttcattcgccgtttaatgtaaactttcctccccccccccccccatcaattgcttaacttttttttttctaaattgtgttatttttttttttttgacatgccaaactttgcgaggcgtactggtggcgcgccttgccatcaaaaaagaatggctgcgcgggtggccatccaccttgtaaaaaatgtaacttttttttttttagttcaaaatttctttcaatttcgcttttttacagttttatacaccgggaggcacagaaacaacagcggcaaacagtgggcacttggtaaaaaaatcaaatcattttttttcaaaatttaatttttccttttcgattttaggcaaatgctcgacgaggacaaaaacgaagggtatttttttcttcttttttttttaaatttttaataatttcccgctcacatttaaggtgttcaagttgaaaggcaatgttgaaatgaatgaagctgatcgaacagccaacgaagtgggtttttttttttttgaaatttttttaaattcaaaattaaaaattttttgaggaattggacaatgtgatcaacatcagtgccaacgccaatgccaacaatcggaccaatggtgatgaggtgaggtattgtaattgaaatttaataatttaaaaaatttttccattttgatttaaggcggcagcggcggtgagcgacggcggggcccaatgccaacaatgggacaaatgccgaaacggtaagcaattgtaattaaatttctaaattttgatcaataattttcccattttggtttaaggtggcggcagcggggatgagcgacagc

SEQ ID NO: 369 - DNA, 2092 bp, Heterodera glycines
cccctgaggtgtgggcccagattgggctcacccttggggtgtgggcccatgttgggcccaactttttgttttttgggctctgattgggctcacccctgaggtgtgggcccagattgggctcacccttggggtgtaggcccatgttgggcccaactttttgttttttgggctctgattgggctcacccctgaggtgtgggcccagattgggctcacccttggggtgtgggcccatggtgggtcccttttgtcttttggagccctgattgggctcacgggctgtgagccctgctgtgtattaatcatttaataaaaaaaaatttttttttcataaaccgcgttcgggggcagccaagcgaagagcgaaggagcgatctgttgctcaaccaagagcacctgctgctactaccaacaacccgcacatgccgtttccaatgatgatgccgatgatgatgccaatgatgatgcctttcaatttccccttcccgcctcctccccctccaccatcacaacaacaataattttttttgcattttcacatttatttttatgcattttcatttatttatttttgtgcttaccttcaataaatcaaattacaaaattcacggtcgaaattttcagtttttcttaatgtttactaataattcaatcaatgacagtgtgattaaataaagatggcaaattttattggttaatgaaaaatgaaaatattaacgattactgtaggcaatgaaaaagtgatcatgaggaaatacagtaggagtacaattacacaaatattgtaaatacatgcgatccaaagcaaataaatgtggcaaattttattggttaatgagaaatgaaaatgttaacgattactgtagacaatgaaaaaaagtgatcatgaggaaatactgtaggagtacaattataggagtacaaatattcgaaataattaggatccaaagcaaatattcggtacacgtttatgatcctaagtattccaaatcagttaatttttggaaacaaatcagacattttggctggtcaacggccattatcgcaatagtgcacggtggacagctaaacacatgtccgcatcccctaactccgaataacacttcacctttctctaagcaccaattgcaccgatcacttattatcaactttttttcctctgtctctctcgtattttccttttcttctcccccctctgcgactcgcttactcatcagttgtccaatcaccgccgcgctttgtgccgcaatccgctgagtcctttgttgttctttgttcagcatcgtcgcccatttgtgatcaatccgctgctcggcttccagcagattttggcggaattcttgctccatttgttggcgcatcgtttccatctgcgcctccgttgtcgcggctgcaccttcttcaagctttcgagtgcgcatctccaggccctcaatgtcttcagccaagcgcattttgatctgtgtgaacgccgccagtgcaagagctgccacttcttaaaaattattaatttgcatttatatttttcacattaattataccccggtcatcttccgagaccaattttggctttttggctgatgttgctgctgatgatgatgaggacgaagccatagcacgttttaaggacgaagctgctatggtggccacctcctcatttccatattgcagaactcgatttgcaattgcctcatgttgtttttgctgctgatttagcaattcaaacgtctcacgcaacatggctggcgacactaccgtagcccggtttgatgtgtatggagaatagcgctaaaatttacagaaaaataaataaaatcagtaaaatgtaattgaatttctcacttcattattagcccaattctccattaattcgatgcgtgatgtacagttgagcgtcatatttttgaggtcactgaagaggtaccgtagaaagcggtactttccccccaagtccttcatttgtgagccaatgtcagaattcatttttattcttaaatttaattataaaaatgtaaggtcaataagcagaaaaggaatgaatgctttggctttgttatgcgcatgccgccggttattaattaattaatttccgc

SEQ ID NO: 370 - DNA, 3542 bp, Heterodera glycines
ccatttgtggtcatccgctgctcggcttccagcagattttggcggaatttttgctccatttgttggcgcatcgtttccatctgcgcctccgttgtcgcggctgcaccttcttcgagctttcgagtgcgcatctccaggccctcaatgtcctcagccaagcgcattttgatctgtgtgaacgccgccagtgcaagagctgccacttcttaaaaattattaatttgtattatatttttcacattaattataccccgtcatcttccgagaccaattttggctttttggctgatgttgctgctgatgatgatgaggacgaagccatagcacgttttaaggacgaaactgctatggtggccacctcctcatttccaggacgcagaactcgatttgcaattgcctcatgttgtttttgctgctgatttagcaattcaaacgtctcacgcaacatggctggcgacactaccgtagcccggtttgatgtgtatggagaatagcgctaaaatttatagaaaaataaattaaaatcagttaaatgaaactgaatttctcacttcattattagcccaattctccagtaattcgatgcgggatgtactgttaagtgtcaaatttttgagatcggtgaataagtaccgtagaaagcggtactttcctcccaagtccttcacttgtgaattaaggtcagtagaattcatttttatttctaaatttaattataaaaatgtaaggtcaatgtaattttaagcagaaaaggaatgaatgcttggctttgttgtgcgcatgccgccggttattaattaatttccgcaaccacccaacccaccccctccaccgcgaatcagttgtgacactttcaaaagcaaagagacgctaattaattattaccgctaccgctatgtattgttaaaaggcaagcaataattcggagggatgttctcaatgaatttatttaagaaaaaataaaataaaatagtgaaaatgatttaaaaataattaaaaaaagcatcataaatccaaatttgcttcattcattgtttggctttttcttcatgggtgcaattaagtcagtcgctcggcaattgacccgcacgcattcctgacatagctcaaagttgatagaaaagcggtcgtcgtccaggcgcttcaccttctgctgattgtgatacaatcggttccagtcgtcttaaaatattaattaaaataaaaaattgtctattgttaatttacccgggcagaggtatgtagtaagcaaatattttcccttcgctaatttccacaaatctcggtcctccaccgcgcgcttttttgttggcggcggcccctttgtctcatgatctggttcagtttccacatgtgtcggaatgggttcaattttattctcatgctgatttggagcggcagcagcagtagaaagagtagcagcggatctcttcattttgtataaaataattttggtgttttgaattaatgaaggatgattttgggtttggacagacaaattaaaatgatttcggtttttagtcaggtgaattatttaggtgagagtgggcggggctaatcagtaactaaatgatgggcgtggcccaacttttgagtatataaaagtgaaattagtcgttataacattcattcttggtgaaatggtactcgtcagcgttttctgtgctcagcttcttaactgccctgtcaaatcattgcgtgatcgactcaatcaccccgaggatcggagcattgtaataaaacatctgattggacgaaaagtgcgtacaacatacaacgaccgtaatgggatgcggaaaacatttttcgtcagtggaatttcggaccaaggggcagccttccttcccgcatacggtcatttgcgccgaccattcaacatcaatgtagctgctcatttttattcgcgacaccgtataaagctacactttccttatactccatgcataattgagagattttcggggggaggcgaagatcggcattttccattggaactccttgaaattgttgatgatcaagaccataaatgttggttggggcgtctgttcacagaaattggcgagactgatcagaaatcctcaaagtcatcatcctcatcatcatcaactcaaactttgcgcctgcccgatgatgaagagatgacagaaaatatagggcgcgatgagtgcagtcaaaagtttccatcattttggtgaaattttaaattatttatgttaattatgcatttttctaccataaaaggatcactttaatttcttaattaaaaattgcttttcaaattcattaattttttgacaattgtatcttctttggcctaattatgcacttttctacctaaaaataacatctccaaatacttaattattttaaaatttcatcttccattcataaattatgcatcaatttttattgaaaaacgagttaaatacaatttatggtgtattgatgagaaagacagatacatcagaaaacaaaaacattacaaagtgtggccaaaattcttcacattgaaatcgctgcctataattcccttcccaacatatggtcggtaacatttctgtaggggcatggatacgaccctccctccctcccgaatgttcggtcggaggaagttaggataagtgacaatgattggctcataatcacccgttgttgcgtaccgcaccacttcttctttgaacgtctcgtaacgcatgccttggttgttgatcacgtcgtagttcagcgtcaatccgcgcaccttgagcacgtattccttttcggcatccgccccagctccctttcgtcgcaaacacagaccatactaaaatgtgaaataatcaatacaaattaatgtataaacattaaacttacttgttttgcacccccactgcaaaactacacaatgtcgtggtccgggtactcgtcagtgaactggcccaggtgtggaccagttttgagcggacatcgctcctccgggtggacgaggatgagactgtctgtatctaaaaaatatttgcaatttattttgtgtaattttgttagggcatatgtaccggtgtagagcagctcagagcctggcgacctaaccaccttctgcatagctttgagcagaacaagccgcgcagcggaagtggtctacagagagatgactaaatttatcaatttagcacaattttataagtttattctcaccgatgtttgagcaagcgtgctcatcgacccagtcctttttgtggaggtaggtgatgaggatgtgcgtctcgtccagctgatcaatcgatgtgacttcgatcgatttgttgtccaagtactcggccagcgtcaccgggtcgtcagtgatgagtgtctggcacaggccaaagttacgaagcgaaaaacgtccccctaaaaattacattttctgtccaaatcatatgtcaaaactcacataaattgttcaggcagagctttgccagggaccgtttccccttgttgaccaccatttttgcaggatcaatgttgatgccaaactgctcagcacactctcgtacaaattgttcttccttctcagcgtcccctct

SEQ ID NO: 371 - DNA, 7180 bp, Heterodera glycines
tttctctcctccggcagagtgggcggtctgcacttccacttcgtactcctccgagtaccagtggaagaaccgtagggcgagaaggctttgattttgagcgttgtcgtaaccgcgctctgggacgatggccagatggtcgtcaggcaggtggttggtgcgaaagtgtcgcatgcacgcgccggcgatggtcatgcactcacgcagtacgtcgataccatcatggttctctctgtcgtcgatcccgtccacgtactcctggcgacgcgaaatctcgaagaattcccgacggaatgcgacaagggcggccatcagaatctcgacatcattcgtgcaataactgaaacagaaaaatttaatttgtacattttaaaaaaacccctttacctggctagcgcctcatcgagcataaaaggctcttggtggtgcgcggcataccattcgtcgaactgtcgcctctttccgggcatcataccgtttgccaaatagtcgttgggcgttgggcgaatttctctgccgtagttttccggtctgttggccaaatgcgggaagaagggcttgtcctccacgtccagaccataagaagggatgagtgcagctaacgaacacggcatcaggttgaacgaatcccggaatacaatgtttgggttgcgccttttctgcttctgtactttcatttcgtacattttatttccctgaaattttaaaattttgacacaaaaattcgtaactgagtacccgtcgcagcatttcggggttaaaaccaatccgaaacagctcgcggaagacaagcaccatatcgaagcgaccaccaaaatgcgagtaggcataggtgtcgcatttcttgggcagttcgaacacgagccaattcacgaatggctccagcgggttgtcagctaccacttgcttgtccacttgtgtgtccatgaatcggcgttgacagaacacaacggtccgatgtggtccgcagatttgacatcttgcagttgccctcttccatttgccgttttcaatgcagtcggggcatgcaacccgcgcagcaatgaagtttggctgatgttccctcttctcaggttgttgggggtccatcgcctggtgttgcatagtctccaagtcaaaggccacaattcggtaggggtcgttttctttcggttcaatttgctgaatgtagcaaccgcgttccacgttgtgaaagttgttgcacgtctgacaataacgctcgtcgcatttgtgaccctaaatccaacaataactgaaaattttatttaattttagtgtttacctttctcccatctctgttgtgcactcgtgtgtcccaaattactccacattctttgcaacgttttgattgagcacaaaagtttgatgtcaaatggtgttgatgacagtcgttgttgcgaaatgccttgttgcaccccgcacattcacggaaaaacccatccaacggagagcaggggaagcgaggtccaacacgagaacagagcatacagcgcgccttgcaagagttaaggtgtcgtgacggccgttcataaggcttttcgcattccagacagtaatgttgaccgaacaagccatactctttcttcacaccgtcaaaatgaccgttgtttaggtagagcacaatcggtgtgtcgtaatagttgttgatgtacttgtatagcggcttgtactgacccgtggagccaaaaataaacacagcaaaacgatgtcgttgctggctgttgttccaatggtccaccacccggggcacaacaatttcagcatcatacgcattgagtccaggccgtgcgccaatttgttgcatcagttgcaaagcatccctttgaaggcagccctgttggccgtgttggctgtgaaggtagcgatggaacttccaacttgcccagccacggcttttggccaccattgttgcttgtaaggcataaaataaacagtagctgcgctcatcaggattgtttatcttaaaacaacccatcaaaactgttgctttatcatgtaccggaccttaatcaaactccgatcattaatacgatggtgaacaggtgctagagctcgtcgtgcgcctcccttcagcgttcttttggtcggcagtccaggtcgattaactgtcgtcacaactacggtaaacggttcaccccacagtgtgacgttctgttgcttcttgctctgtgccactttgacgaattgatttaagatggtgttgaccgtgttgtccgtgatttgccggatagggatggggatgtccccgccagtcaacagtggactactgatgaggcagccgaggtgtgtaggatgaattccccgctcacggctgtctgccacagccgcatcaatgctgtactggaaaatgccagcaataagtccttcaggatttgctgctgctggtacgtcctcaatgctgaaccgcgacttggctttgctgtactggaagcgcggcacgtgctcgatagtgctgtccagctttctaacgtagtcttttgcagtttttgatgtagatgaggaggtcccagcaccttcttggaccatttctcccaataattcgttgatgagaaagcggcgccgcggctttttattaggcattgatagaagataatcaatagaaaaattagagggccgtttgggaggttgattttgcattattcaaaatctaattaaaggaaagaaatgagtgtgaatgataaatgaatggtcaatcgagccaatttatagcgatcatattgggcatgggaaatgtgaaatcgattccattaaaagttgtaattgcaaaccaaccatgacctgatgagcagcgcactgccacccatgaagcacaagacgacagggcacctaaacggctcgtaaaattagacaggtttattgtattacctcaaggcctaaaagacattaaaaattgctgccaggataaacggggctctgtaaatcgagcaaccgccctggttaacagcaaaactaataaaatgtttaaatttaataaataatgtggactaagaaatggaaataattgtgtcctggcgtgcttataaagcctcccagaaatcgacaagctcctcccatcaatcgataattttcgacgccatcccgaaaggcggctttttcaaattttcctttgaagtaattccctcgggaattgagagtgcaatgagcacttatgaataattaacgacacctaagcaacagaagaattatacatttattgatttaacatttttcgtaataaaacaatcgcgtacatgtccggacttgcacaattattaagaatacttagaaattgtgtaaatgaatcccccagggacatgtggtaaataaaaacaatacaatgggcggcacaagtagagagtaaaggggactggtaagtgtgagtattccttcttgttccctcacgaaattcgcacaaaaaagatgacgtaatgctgggcgggatgggctgggcaaggctgtcaaaataaagcgctggtgcttccattcccctcgcgtaaatggcgcaccaatgagagccctccttgtgtcgggggtccctgttcacaacgagcgctgccgggtactgtagtgtggaaggaggcggcaattggtcactggcgaagcagccctgaaacactcgcccggtcagaaggttttcgctcaatatttttgtgatttgcacgctgtccattcttcaaccaaaaaatagagcaaagttgatgcagcacaagactgattatgagcattaaataaagagcgaacagtgcccagcaaatggcttgctgcgcaaagttgctttcctctggtatgtccttacacaattggataagcggtggaagaacagcagaaacatgttcatcaattaacttgtcactttttggagggattttggttgtagttgttgttgttggtggtggtggtattgttttggtagaaaaataaatttttgacaaagacaaccttctcaaatattcagtgtaggaatatgacggctcgtgttgttgtcgagataaagtcaaattttttatatacgcagaataagtatttttcggttcttctcgcactgttgttgaaataaccggaagcgaaactcgtagaaagaacaaaatgatgcccaatttttttgaatacattttaattacaaaatgatgaaatgacaattgtgggaagcttaaatagtggtgtccgtgcttattgatcggtttttgtccagcatcaccaatgagtcgcattctcccatcaccacaagcattattcctccgtctggcactgggtggttaaatttgatgctcaccgctgtagtgccattctttatcaaatcaaacagtgccgcttgatcatccccgctgttggtcaaattgaacacgtaaatgcaatgcgtttttccgtattgggcaaaagttatcccgttgctctccgatgagtttgcgaatcccaccgcttcattcatgtcattgaatgggcgaacatacctcccgttggggtagtccaagtcatagggcgcttgtgggtaagatcgtccattagcaacaatggaaatttctcggacattaaacggttgaaaattgaatggactgcgccgaattgagccaacataatccgcattcgccaccagacccattgtcacacgccgggggatttggtccatgaacaaattggctgtaaactcgtaacggccttgactgatgaacagcgatttcatcattgttttcctcacagcgtaacgggcaggttttacctccaactttcgcgcaatatccagcgtcaacccatccatcaaagacactttcttcacatacaatttcagtcccactacctcgaaacggtagcggggtgcacctgcgagcggcgcaattagcacaaattcgttatcgttgggcaaaatttcaatgtccagctcacaaaagttgatcagatacagcggctggttgaataggtcggtgtcaattttggcaatgaactgagcaacgttgctgagcgcaaacaaatcgcgtcgcgctgtgcatccgtctcccgtctcaagcacatcacccgggtcccggtagtagcccgctgcattcaggtgtgagtcctttgctgtggttgaataggagagctcatgtgaaaagtatgttttgtaagccatcagtgcattggcattaaaaatttcgcgcccgttgatgctcattttaatgttgcggatgaaagtttgaccgatcatttgaattggcgcaatgtttatatcatcagcggttaggtcaacaagttgtccattaacgttttctttacggattcgaaactcagtgagcaaatagcatttggagaggtcaatgaaattttggcttgagtgaagtttgaagtggtagggcgtgtcggtcagagggttgctgggcaaaagctcaaacacttttgaagacgagacgctcacatttgtagggggtatacggaaaaagtccaaagcattggtgattgagttcacggagtcagtgtcgattttgtgaaatgccattattatttagtaaagtccaaatgcgtctgagcgaacccgttttcttgctggctttgcaactggtcgtccaattattgtttgatgaccaggcacacgtgttctctttctttttatacccgttcgtccgcttccaaactgtttgggcaggccgcctttctccagcacagtatcaattccccgttttccctcactgaccaacgcctccttgagcggcaccccctcatgcccgactcgctccagcacccgctggccagtgctcagcgcctccgaccctaccgtagttccaacacgacgaagaatgggcaggaaaaagcgccaaagtccccgaaacacatcgccaacgcccgccccgcgttggataccgtagcccctctgaaaagggctggtgccacgaaagtagtcgaattcctctttttctaagccgctaccgtactgcacatactcatcatacccggcaatgcttgggtcaaacacaatatgaaccatttttataatgtcaaaacaaaatgaatgatgaaatcagaagtttatcactttcttaaatatcagtacgaccatcgttgtcccataggcgaacggcacgagacggcctttgtccattgtgcgcagttcaatctcaatctcattgatctcccgtggtaacacacgggcaaatattggcgagtcgtaaatcttctcgttgtactcccaagggatggcaccgctgatagacacaacacgaagcagcgaactcagtgaattgccaatgatcatgttttcggtcaaccctttcgagtagacagcaaagcttgagatgcctccgcgcaaatctacaggatattttgacagttcatttgacacgacatgttgagggttttcaaagccaagcacatagcccaactgcggtgagaaggacacatgactgacgatcgcctcattgaacaccagcttgaatcgttccatgttctcaagatattgaattgagacggaattgggcacatatgagagagggtctatttgaacgctgagggtattttctggtaaattcaaatctgctaatgttaaagcagctgatgttggcggtggtggtggctgctgtttctgttccgttccttcaaaacgctgttgagagcctgacggttttgcgggaaccgaaatgggagctgatggttttacgggcacttgctgtttttgttgatgaggcgttgccgagctttttagttgcgccggaggcgccgtaattgtcgtcttagttgaaggttttgcggcggttaatttgtctgttttattttcttcttctccttcgtcaaaacgcggtggagagtctgccagaggagcgcgaggagccaattcagcggaaaccgaagctggaggtggcgcattggctgtcgattttagctgagctggtggtgccgaaattgtcggcttaacagatgggctctttaccacaggtgttacaggtgttgttgtctttggcggcggaggggcggttgttgcctttacaattggcggaggggcggttgttgtctttacagttggcggaggggctgttgttgtctttacagctggcggaggagctgttgttgcctttacagttggcggaggggctgttgttgcctttacagttggcggaggggctgttgttgcctttacagttggcggaggggctgttgtagacttaacaggggcggcggtagtagacttagttgctggttttgcagttgcggaagggtgctacagctggaggagcgggcgttt

SEQ ID NO: 372 - DNA, 2308 bp, Heterodera glycines
  misc_feature (2298)..(2298): n is a, c, g, or t
ctttaaaattaagctacttttttggcttttttcaatttttttttgcctgtgtagcaaactgattttgtatagtttgattaacgaaaccaccaataaatattttccttctttaagccgtgtgatcattgggcgtgtatcaatcattggattgatctggggatacacacaccggaatgaagataaatttagttccttttttttttgcttttcacgccatttattagtgtttttttttggaaaattcggtgagggaagtcttgaaagggatggtaccaataaggaaattggaaatattcagcacaaatacctttcccataaaaattcttgccagaccgtagccaaaggggaggggaaattcttcctctctccccttaagtaaaaatttttcaagaaaagtgaacattttttgaaaattattagatacaattttgttatcatttcattttgaaaaagggaatttaggaaaaaatttataagctaacataataatttttttgctaatttcaggcagagcgaccagttgttgttacgttgtgctcgacgtggcgtggccttgtttttttttaattttttttttttgccttatgagttgaaaccgacggtactttcctttttgtcacaccccctgctgaaatattttttaaaacaatttccctatggtaattttcagcgctatacacgaagataactggtccaaatgttcacgtaactcacgtaaaagcataagagctaaaactaactttaaaataaaaacacccaaaaagtgacagagactagccactacgccatttgcactgatggtcttgctactttatgaatatatttaattattatttctaaattttttcctttaactccaattttctcactaatttttgcactcagaccgccattcttaccagtgcttgtttttgccggttgccctaccgggaccgggacctgagcttttcaaattccgggaaccgggaccgggacctcgaatgaccgggaattcccggcccggtcccgtggcactctaattacaacttcaaaatcaatttttgtaaattgagcaaattccgcaaaaaaatattcgaaaaaatcacttccatttatttattcgatcggcgcaacacagcaaacatataacatttatgagttatgaatacatatgtatatacatagtattgtacaacagcgaatatacaaaaacagagacaataacatcataagacacatcggtcaatcattcaattctcatcatatacgcacgtcggcaagtatttcttcacaaagatgttatggtccacaccggcaagtgtcggatacttggaatatgtgaggaaaaagaggggatcacaggcaattacgtatcgtcaaagaaatttgagttccaatcccgcagcgggatccgcaaatttgattttttgtgcgggattatgcgggattttattgattttttgaagatttttctaagacagaatgccaaatatttttaaataaatttaataataaatttaattaaagttaactcatttttcatcgcaaatttcattcaaaatttgtgaaattttcccggcggcgcctatcggcaccgctgtaccctcctccaagttcccaaaaagtttttgaaaaaatcgcgctgtaaaaaacgtgtaaatagtcactccttttcccaaaaatgttctaaaataatgaaaaatgacaaaaaaagattttgataaaataattgaataattttttcaagcgaatatactaaaaacatttgtgaaataccttttacttggttaagaattaaaaaatttagcctattaaaatatttagaaatttttttattatattgtatatttttttaaaaatttccgatttccgacggttttggggttggaaatccgatttccgacacttccgaaaatttttggggcctcggaatgccatccctgataaggaccgccggaccccctgttcctagttttttgaaaaattgcaccgcaaaaaagtggttttgaaaagaaaaaaatagtcaaatttatgaaccgttaataatttgatttccgatgaactttttaccgtcggatccaatcgaaaaatcttagtcgacccatcagccccttttaatgcatcccgccagcccttaaacatttatttttcagcattttttgatttttggaaattttttaaatttaattgaaattttttcgaattttccaaaatcccgcaatcccgcacgggatcccgcaaattttaaatgcgggatttgcgggattaatcccgcgggatcccgtcccgcaaaaaatttgagttccagtcacgcagcgngatccgcaaa

SEQ ID NO: 373 - DNA, 1775 bp, Heterodera glycines
ttcgttaaacgtcgattcaaaattgacaaaaatagaacattttttctttgggtgacattatatgaacggcaaaaaaaatatcgggaagaagactgtactctatactcgggggagaagaagaagtcccacttgagaacaagtatgacatgaaattattaattaaagggatgaattaattcttagtaaagttaatcaatatatataacatagaagtgcaaatcacgaccaaataagaattctattatattcaatcgaaattcgttcatttcttataattgagaaataatgcgtttgacatgcaataaaaacgattaatttatacttctactacttaagacagtatataccataggattcgcaaattctctagaatttaggccgtaagatcattggtgctaatttcgcatataaattttcaatttttttcctttcagtgattgacggcatttcgttataacagagtcgtatcttgtcctattctttaatcctttttttccgcttcatattataataattacccgcaaaattataacgatttcatcatttctaccccccctacatggcgtcaaaacgtcggcgccaaaacgttttggttgttttaatctattttagaaacaaaaagagaattttgaaattttttattttcgattttttgttcgaatttcggctccgggttccgaattggtcgaaatggatgcttggttcgtgagcagcgaccctgaaaaccattggaagcatgttttcatgacttttgaaaacaaaaaaattttcttcaaaaaagggggcaaccaaccatcggcagtattaccttcgcgaaaaatacgtttttttttgttgttttacaaaatttttaaatttgggtgtttttattttaaagttagttttagctcttatgcttttacgtgagttacgtgaacatttggaccagttatcttcgtgtatagcgctgaaaattaccatagggaaattgttttaaaaaatatttcagcagggggtgtgacaaaaaggaaagtaccgtcggtttcaactcataaggcaaaaaaaaaaaattaaaaaaaaacaaggccacgccacgtcgagcacaacgtaacaacaactggtcgctctgcctgaaattagcaaaaaaattattatgttagcttataaattttttcctaaattccctttttcaaaatgaaatgataacaaaattgtatctaataattttcaaaaaatgttcacttttcttgaaaaatttttacttaaggggagagaggaagaatttcccctcccctttggctacggtctggcaagaatttttatgggaaaggtatttgtgctgaatatttccaatttccttattggtaccatccctttcaagacttccctcaccgaattttccaaaaaaacactaataaatggcgtgaaaagcaaaaaaaaggaactaaatttatcttcattccggtgtgtgtatccccagatcaatccaatgattgatacacgcccaatgatcacacggcttaaagaaggaaaatatttattggtggtttcgttaatcaaactatacaaaatcagtttgctacacaggcaaaaaaaaatttgaaaaaagccaaaaaagtagcttaatttttaaagtcatttgcaagcgtttgaatttagtgaaagggggtgaaagggtaaaaagcgaaggagaaaagaaaagcatttttgccaaaataaagtactggcgccaggggacgatggaattgtgtacaaagacccaatgatcggcgttgttgttggcttagcaagaagcg

SEQ ID NO: 374 - DNA, 8229 bp, Heterodera glycines
aaaaacccaaaccgcaatgaaaggcaaattcactacaatggtcatgcccgcagggaacaaatcagatttggagtcacttccgaaaggaggaagaatcggaattacgccgaaatttgtcagcagacttaaggaagcggtcttattttgtttccctatgccagtccggtccgttggggaatgagtttgtcacccagttataggcctaattttggatgcgaggacagatttgttatctaaaattgccgttattttgttaatgtgattattgtatttattcgcgcatttgttatgttattgttaactcgcaattgaagactgaaaattggaggacaaatgaattcgaacaaatatttctcttagttcgacaacaagaaacccaaaaatgggaaaaagaaagttaaaagccaatctacttgataaaaaatcatagatatggcaatgcatagactactacataaaagcgtgtgacaaaatctgatgatggattcatctggacatgggaaccatccgagctttaactcggaaaatgtatatgttcttttatataaaccattggatagagtgaggtcgatttgtacttattgaattttttattctactcccttatggggccccaaaaatatgattgatttttgctggttgacaatgttgcacgtgcagtgggactaaaggaaagaaaggagcgatgaatgtgtgtccgagtgggttaaaaacgtttgtttggagtccaatgttcaaatccacttgactaacgttttaattaaattttttttcgttattgcccattttaaagtgaaaatataccgagagaaaaatgaatgaattttaattaacatttaatcagaaattgacgtttttattaacccatctcggtcaccgaagctcatttcccttcgtcccactgcagactcacaaggaagcatccctaactatgactgcccaaataaaataaaaccatttgtacaattggcagtgcgcgcgcgggacggacatcggcaccgctagcggaacaaatgagcacggaagatgatgctgatgaaccaccatggagatgacgggcattgacggaggatgatgttgatgatgccgaggatgggacaaaaatggagacgccctcgcaataggactaaaaattgcaaggataaggggagaaatgagtggggaggggatttgtgttggaataacgatgaaaaaaatgccaacaaataattggaaatatgcaaaatggcaaaggccgacatgaataaatcaaaacaggtcgttgttacccaaaaaaaaaattcgggagggacattcgaagttttttttttgttgttctccggcccaagaatttgccaaggttactttgtaaaaaatttccggaatgttttttataactggacacaaaactcgcacaagctacattttgacataacttccaatgtaacaaaaaatagggagtgtttggatgatttttagagacgccgtcaggaaaagttcaaaatttcaagattttgaattacaaaaaaaaacaactcaagggccaatatgcatgtttatgtttgcatttagtttccataccaaaccaatggcttacaattaaaatttccgaaaattatttcaccctttccaacaagttcgggtgcacaacacatggcctgctccaggatccaaagtgcggactcgaacatcggcgatggtttgcgggtcgacgatggccgtgtcttagtcggcgagaaaaatcgcatcgatcgggtggaaaatttcgaaactgaacccctcgaagagctggcgccctttcctggaaaatggacagcataaaatcagtggcacaagcacatgacccgttaaatgaatgtaacaaatgggtttctgtcggtaatttttccaattgttgactgacaatgagagataattacgcgaccaaagccataaaattcaattttttctcacaaattggtggttgtgtaacaattccggtactttacttttaatggggacacatttcaaatacttgactccgaattttgtaagcatttgaagtatggccccgtaaaaataatgtacacaaatccgggtctgctagccgatggaaacacgaacaaaacccgtactcatttattgtggagaatcccaactcaaaccagcatccaacatgatatttgttcgtcatgagttgcaagttttcaaggtgtatgatcaatttttcaaaattttagccaaatcaaatgttggacatgggtttgaactttgttccgtctggtccatgaccatggttagaatttcgtctgacttatgaaaacatttcgcaatatgaatttttggactaaacctaaatggcacaaccccaactttgcgtgcccatgttcccaagtcaacaaggtttccaaacctgaacaccaacaacagcgaagcagcaatggaagaatcggcaatccttcacatagctcgaaatggcattcggcaaagccaaacactgaatttgaatacaaaacccgccccaccagtccccatgagcggcccaaccgcgaaccgatcacattttgaaatgcacacatttttttttatcttagttgactcaacaaacctgttgggtttaatttgagctgcatttgcagaattcgcatgcccattaaatgttgtttgaattgttgatttttcatcatccgccaagcagtcccaatggactgttagtagttacaagggggccagggtcccacttttggcgctaaatttgaattcaaaaatttgaattcaaatttgggcttgctttttttctctgcctatagggctatttcgtttattggctcgtgcctattgagcggttttgggaggtcagaaggtgtgggacgtgtttggcgccaagtttagaatttaaaattttctttttttctctgtcagaaagactgttttgtttttcgtcgtacacctattgaatggttttgggtgatgtccgtggaaatgaggcgctttggcgccaaatttaaattcaaaattcctgaaagtattgaaaattgaataatttatgttttaaaatattgtactattatttttgtaaataacaaaattttttattctcctagaaacaggaaattttttaattgttttcggcttttgtatcggaatgggaaattttttttctacgggaattgctgaacgtaattttacaaaatttttaattttttaatatttttctatctaaagctgaagttgaacagccgtttggaccagaccagcgaccgagtgcgccggtcgtgtgtgtgtgtcgtcgtgtgatgacttgggcatggaatgaacgagtgaccatgctgctgctgctcattctgctcgtactgatgtgccagttcgttttttggaacatcaccatttgagatttttttggatttttaaatgattcgatgctttcaatttgatattaaaaaacttttttcattctttattaattttattaagtgtttttcctcatttaaatatcgcgaatattttcttagcagctaatttattgtttgtttttgtcagtgtccgcacttcgaagaggccgattgttttgcaggtttgattgggtttagatgaaaatgaagagaaatctatgcaaaccgccacccgggccaggacgttttcgtaccgccgttttcgtaccgccattttcgtaccgccgttttcgtaccgccgttttcgtaccggacacgttttcgtaccgccgttttcgtacgagtgagtatcgaaaaaattgcattcaaataatttgttaatttttttaaattacttttaatgttttgacagttaagcttttattaactacaaaatgaaccagcagcaagtaattaaaacaaaacgaaataatgataaattggtgcatgatggtgcactttatgtgttccacaaattcagtaacgatggacttaagaaattttggcggtgtgagtttcatggcccggcagaccaatgcaagggtatgcaatatattattttgaattttgaaaatcttttaaaatccaggacgcttgcacacggatttaaataacgttgtgcagaagttggtcggagttcattcgtgcgacatgaacgctgcgcatgtggaatgtcagcgtcttgtaactggactcaagcgacgtgctgctgagacgtgcgaagcacctgcgaccattcgtgctcaagtgcttcaaaacacatgcaacctgtgctggcctcttttccgagcaaagatgccacaaaaaaggtgggttaatatcaaaaacaattttgtaaataattttgttttctttttattcaggtcatcaaacgtttgcgccgtgaggaaaatgcaccgcgagtcgaacctctcaatttggagcagttggagattccgaatacctatcgtgtttataagcgcactgagattgacgaggagcaattcctgttggcggacactggcgtttttcaaattcacggatactgaggttgaattggacaactcaaaaatgatcaattttgatcattttccattgaaatacggtagaaaatagttttttttataatcatcaaattcaaccaagtataactttatgtacgggtcgtagccctaccattcaaaaggcaattcggtagacaattttgtgctctttctggcacccaatcaaaaattccaaaaaaatttcctagccccctaggaaatgaattatttcaggtttttaaatgaactttaaggtggtttttcatgtttgagtcaagacttttttccgcccttttttgagtcaagtctgatcaaatgaattaatctcgggaatgaataagtcaaataaattttcttgttgtgtgcgaacgagccatatattgagggtaataattatacaaaaataaaaataataagtttaaatttattcaattgattttttatcaagtagattgccttttaactttctttttcccatttttgggtttcttgttgtcgaactaagagaaatatttgttcgaattcatttgtcctccaattttcagtcttcaattgcgagttaacaataacataacaaatgcgcgaataaatacaataatcacattaacaaaataacggcaattttagataacaaatctgtcctcgcatccaaaattaggcctataactgggtgacaaactcattccccaacggaccggactggcatagggaaacaaaataagaccgcttccttaagtctgctgacaaatttcggcgtaattccgattcttcctccttcgggaagtgactcaaaatctgatttgttccctgcgggcatgaccattgtagtgaatttgcctttcattgcggcttgggttttttcggcgattgatccaactggcagcacaaatcctttgatcgttaactgtccagttatcgcgcatttttcctcggtttatctcctctcgcgatcgatatgaaagcgattgcctccgcgagagcgccggatggtccacttttgccgaagccatccttaaaatatttttattggctcaattaagattttttggtccgtgctttaacatcatactgtacaatgttggggggggggcgtcaatgaaggggtagtgcgttcggcgggggggggggggtgaggatcatcggcaatgtttttttatgcgtttgaccatttttctccacctgtttttgctttgcatatccctttttccggcgccctttttggcagcggaaaattttttgaccatttttgcccggtgcaaaattagtcaattttcaagcccatttttcgacaaaaccttttagggttagtcgaacgcactgcgcgactttttccttgatctctccaccactttctcgtgttttcctttcctcttcttcctttttctcgaccaacccgcctcgtgcgttcgacaccctccgaccccaagcgttctgcgtcacgaccctccccctcttgcacagcgattgacatattccgccggaaacattccttcattttttgggccccttgctgacgagggggagcgggtttcaatcccctacggaccgcttgtttttaaacatttacacctaaaaaacaaaccgttgaaactaggttgatgtggagttgggctttctccaggtaactgtcgcccattttgcgcatgaattttttggaagctgtgtaggcaattgtcaccgagtcgcttgcagctttgtcgagctctccgcctccgcctgtcgttaccagcgtcccttttgcatttgggttaaatgtagtggtttcttccacttcataaaacattaagccgcctccctttttttcttctgtcacggttccgcttcttgctaagccaacaacaacgccgatcattgggtctttgtacacaattccatcgtcccctggcgccagtaccttattttggcaaaaatgcttttcttttctccttcgctttttaccctttcaccccctttcactaaattcaaacgcttgcaaatgactttaaaaattaagctacttttttggcttttttcaaatttttttttgcctgtgtagcaaactgattttgtatagtttgattaacgaaaccaccaataaatattttccttctttaagccgtgtgatcattgggcgtgtatcaatcattggattgatctggggatacacacaccggaatgaagataaatttagttcctttttttttgcttttcacgccatttattagtgtttttttttggaaaattcggtgagggaagtcttgaaagggatggtaccaataaggaaattggaaatattcagcacaaatacctttcccataaaaattcttgccagaccgtagccaaaggggaggggaaattcttcctctctccccttaagtaaaaatttttcaagaaaagtgaacattttttgaaaattattagatacaattttgttatcatttcattttgaaaaagggaatttaggaaaaaatttataagctaacataataatttttttgctaatttcaggcagagcgaccagttgttgttacgttgtgctcgacgtggcgtggccttgtttttaattttttttttttgccttatgagttgaaaccgacggtactttcctttttgtcacactccctgctgaaatattttttaaaacaatttccctatggtaattttcagcgctatacacgaagataactggtccaaatgttcacgtaactcacgtaaaagcataagagctaaaactaactttaaaataaaaacacccaaatttaaaaattttgtaaaacaacaaaaaaaacgtatttttcgcgaaggtaatactgccgatggttggttgccccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccaaaacgttttggcgccgacgttttgacgccatgtagggggggtagaaatgatgaaatcgttataatttttctgacgaagtctatcaaagagccggatttaattcttcatttactctttttcgctttggcttatgctctcttaattttgtatttaggtaatgaatcgtcaaattgattgtaaaaaacaaaagcctaaaatacatgcatgaatgccattttctgacgttgggctgatctaaggaaggaatggttcgaagaccgcacatttttgttggccccccccatgttctactagataactagcttcacatttgttgtattagtgattattcttctctgtgaaggatgtgatgttttataatttttgcgacccatgtgcacacacggatcgtttacgctcatggaagtcaacgtatgctgtttttttcgattaatgtctatgtcaaaaaattgaggaatactcatgtccaattgaacaaagcactcgaacttggatacacagtaacggatctatttgaagtaatctaatcaaatgaagatatatgtcatcaaaaaaaaataggcttgacattatgatgcttgagatggagaaatgtttcgaggatacatgaacgcatttgtcgggatgaaagttaaagcgagtgtgtggcctgcggagtgtgaaaatgagcaacaacggtctgagtacatatgttgattgcgaacgtgtcgattgttctcagcttgcgcgtgaaaagatacgaattatcccggtctgagaatgttcgctagggagttgacttgctcaaatttttttttgaatccatcaataaattaa

SEQ ID NO: 375 - DNA, 2900 bp, Heterodera glycines
aattttgggcaaaaccgggaccgggacctgagaagccgggaccgggacctcgatttttcttcgggaccgggaaccgggaccaaccgggaatttttaaaaattcaaaaaaattcaaaaaattcaaaaaatttaatttatttcaagtgaaaatattaaataattaaatttttatttagttttttatttaataaaacccaaaagttaaagctaataaattaatgaaaattttaaatcaaattttcttcatttctttcaaacaattaatcatttttggactaagtgatcgaatattattagaaattcagatttacgtttcacataaattttttcggcgcgctttttccaaaaaacttagcggaagaaaaggggaccggcggtgccgataggcgccgccgggggaaattttgaaaatttgagtgagatttgttaacagattttcaacaaaaaaggatggttttgggatcactaggctcaatttgtacggattttctttaaaaatgataaaatacaattaaaaaaaaattaagaatcatattttgtcgataggaaagccatgagtatatataaaaagaaatttcaaaatattttcatttctgtagaggaatcgaaccaggggaaagaagaagggaaagtgacggagactagccactaggccatttgcacagttggtcttgctactttatgaatatatttaattattatttctaaattttttcctttaactccaattttctcactaatttttgcactcagacccccattcttaccagtgcttgtttttcccggttcccggttgccctaccgggaccgggaccgggacctgagcttttcaaaatccgggaccgggaaccgggaccgggacctcggatgaccgggaattcccggcccggtcccggtcccgctctactctaatatcaatcgatcctctcggtgggaccaggtcgttttggcgccgacgatttggcgccgacgttttggcgccagggtcgttttggcgccgacgttttggcgccaagccaaaaatgaaaaaaaggcaggaagaaattgtaaaaattataaaaaatgaatttttcgttaaatataataattaacaaaatgaagaaatggaaacaatttatttggtagaacattggaggtgccaatgagaatgtgccgtctccgaaacattctttcattcgatcagcccaccggccgaagctggccttcatgcgttattttaggcttttgttttttcgtatcaatttgacgattcattacctaaatacaaaattaggagaacataagccaaagcgaaaaagagtaaatgaagaattaaatccggctctttgatagacttcgtcagaaaaattataacgatttcatcatttctacctcctccctacatggcgccaaatcgtcggctccaaaacgttttggttgttttaatctattttagaaacaaaaagagaattttgaaattttttattttcgattttttgttcgaatttcggctccgggttccgaattggtcgaaatggatgcctggttcgtgagcagcgaccctgaaaaccattggaagcatgttttcatgacttttgaaaacaaaaaaattttcttcaaaaaaggggggcaaccaaccatcggcagtattaccttcgcgaaaaatacgtttttttttttgttgttttacaaaatttttaaatttgggtgctttcttttttttattatagcttggcgccaaaacgtcggcgccaaaacgatacggacccgtattttattcttttagattaaaaaataataacccataaatccaacaaaattttttggggataatctttgttttttatacacattggacctacaaatgttcaaaaattcagggcgaaataccagaatttagaaataaaattcataaaaatgcccaatttttcactcaaaaatttcttgccgtttattttcagtcatctcaatcaatttatggcacttgtactgttgctccattacagtccagcacttcatttgcgtcatttgattctccgccacccggccttagcaatagtcaaaatgtcagatttttttcaaacgttaaatattcggtttttgcctgaaaactgaaatttttttctttttcctccaaatcgataagttaataaattcataactattttaaatcaatgaaatttaaaattgtttttctccagtctcacaatggcggtgccaattcatcgtcgtcatcttcgcatcctttccgttaccgtggtaacgaaaaaattcattacagaagaatgccattcattgcctataaaattttagaaaaaattttatattttgaaaaaaaaagaattgcgtgctcggcttatgcgtttgctgtgctgttgttgctccaacaatgcacaacatcatcagcccatcaaccgggaaggacaagacgaattaaactgaagatttgatttttttgaacgcccgaaaatgaatcatatggctaagatttttatacaaaattggcattttaaatttttttttgatcccacattttttgctttatttttcttcgttttgcaacatttgttcttctgcttttcctattctcgccttcttatacaaattgattgtttcaccttctcagaaaagaaaaattcttcttttataattttttaaaaatccctttgcacttttaagaattgattatagggatttgtaacttggggagtcgacatctgggaatttctaaaaaccgccaaataaccaatctatttatcaccaggttcccaagtgtccttatttctaaaatttgtccttatttggaggggccagatcttcgagatcaataatgtccttatttctaagatttttcttattttcaggcttccactaactttttaaatttttgatgcttaatgatttatttcgctgatattttt

SEQ ID NO: 376 - DNA, 8394 bp, Heterodera glycines
tgagccaatgttcaaccaacgactcatctccgttttctctgcacccgcctacacaggccaaacaaacgcgggcgcggtactggaagtgaagacgtcgagccactttaccactcactttttcccgccccaatcccagtgattgattgtactttgtattgttgttgttgttgtgtttataataaatgctcttttgtgcttcaattgagatggttttgtagggaagagggtggcgagggcggtaaaattttgcgtctgtttggttggagggttagctctcgaagaactcggtctgcttaattctagtaaattcatgtcaaaattatgatggattttccatgagttttagacaaaaaagtggtccctcctataagtctatcagcaggtcacacatttcgtttgaaattcgaatgttagctgcccaaatttgagagaaactgaaattcaaagtgtgccattccttctgtttaaattcatgggataacactggtacaaaaatgacgagaagagcttgcaaaattcataaacaaggaacagaaacttttgatctctaaggaccgaaaaattttcaaaaatttcattttttggggtttttcaaaaatattaataaaaaatgtaactttttaaaaaatggaaaatatgtccaaaaattaaaaattttctatttttactcagattcttcaaaattaataaattttagctatatttttgcatttagctattttcgagatttttagcttaaatttaacgaatttgaagaatttgtgaaaatgttgcccaatttggaaaaattcaagaaactttcaaattaattgacggacaaataacaaaatgaactccaaaatgatctcattaaaaaattggacaaaatcttccttattttagctttaaatatttattgtataattgtaatatttataaatttttctttaataaaataaattttgaacaaaatttaagaatagtttatgggcacaaaattatgctctaaatccttttagttaattcaagaaactttcaattaattgacggacaaataacaaaatgaactccaaaatgatctcattgactcattttcattgtttgtgtgagccggtcaatccgggcatagaaatcacactgtccgtgccaggcacatttcgttgggagtgatcaccttaagagatcgcataattaatgaattattgtctcttattagttttacccttggggccgtcaaatggcactttggcaatgccaatgccaaactcggcacatttcgagtcaatttcactgatttgctgaccaaactgggcactcaatgcctgccattcgctgttgttgctggcatgggaagaagcggaggcggcaatgacgaacatggcacggacgaagccgaggctgtgggcacactcatcaaaaaggggaaaaacataataataataatttattattattgggaaatgatccattagtttgagccattcccacttattaccagcagaatgagtgccaagagatgcttcgatgtcggccaaaagggttgcgtcgccgcccttcgagcagccgatcagttggcctttcaatgcgcccgcaactctttgggcatccgaacaaagcgatgcctttgaaaaggaatgggcgaaagtgccaacgtaattggccatcagcgaaaccactttttgactgccgggacagcacggatctgcagaaaagcaattaattaattaattgtaaatgaaaacaattaattacgcggtgccgaaacgcaacatttgcacagcaaacagaaaattgtgacgatggcgagtagagagacggacgaagaaggagaagacatttttgaaggatctttggcagatttgatggaattaattaatgatgctgattggttgatgggattagcttattcgttttgcttaaatacgtttttagtcggaaaaatgccatccatagaatggcatatccgatgttggcatttgtagtcaaatattttggaaaaaattggttaagtctatgcatatattgcaaaatttaacagcttccatttaagctaaaaatctcgaaaatagctaaatgcaaaaatatagctaaaatttattaattttgaagaatctgagtaaaaatagaaaatttttaatttttggacatattttccattttttaaaaagttacattttttattaatatttttgaaaaaccccaaaaaatgaaatttttgaaaatttttcggtccttagagatcaaaagtttctgttccttgtttatgaattttgcaagctcttctcgtcatttttgtaccagtgttatcctcgggggttatcgatggcgctgatcacgaatctgacatcagattatcatataaatcatctaatctatgatttttcatcaagtgataacgtcaaaaaaattttttgatggattttcacttttactgttattcattcacaaaaataaattccatcaatatgtatgtagctggaatagttgttcgagacgaatgacacaagtcaaaaatccaactttcacatgaaaacattttcgacaaattttatgttgtcaattaattttatgcatattcaagtacatacataaaaggtataaacaaaacagtatattagatgagtttttttagtgggtgaacaacggtaaaaaagtgaaaatccatcataattttgacatgaatttactagaattaagcagaccgagttcttcgagagctaaccctccgaccaaacagacgcaaaattttaccgccctcgccaccctcttccctacaaaaccatctcaattgaagcacaaaagagcatttattataaacacaacaacgacaacaatacaaagtacaatcaatcactgggattggggcgggaaaaagtgagtggtaaagtggctcgacgtcttcacttccagtaccgcgcccgtgtttgtttggcctgtgtaggcgggtgcagagaaaacggtgatgagtcgttggttgaacattggctcaaatccggattggatgaactgcaaatggggaaacattaatctctgattagaacgaaggccgcttaaactcacttggtgcgctcggatgatgcacgaaatcttcagcagctggcaagttctgataaccacatcttcgccgaacaggacacctgcgcctcgtggattcggtagttgtccttgcgcttccatcgggtcggcccacataaggtcaatgtgcagactatcggtcggcggtagcagcatcgggcgttccaattgtttgagctgttcaatgcttcgaattttgtcgctgatgcctccatgcatgcctgaaaattgaaaggtggagaatgaacaaaaaaaagagcatctcacataatattttttggccgattagcccggtcagcggcatccacgcgaaggtgtcattgaagctgtcgaacagggcttgcgaatgggccggatagcgttcctccagttcctttttgaagccgtacctaaaaaaagagggggaaaatttaaatatgaataagtgtgagaaaaaaaacccacgttgcgttgatgttgctcgtctcgtggttccctctcagcagcacaatcgatgtcggatatttgacctaaaaatggaaacgtttctttagtattggctgaaaaagccaaaccacaccttgtagcaaagcagcagcatgatggtctccacggattgcgcgccacggtccacgtagtcgcccaggaacaggtatttcttctccggcggggtcccgaggcagttgaagattctcatcaagtcaggaaattggccgtggacgtcgccgcagaccataacaggcggaaggatttcgaccagcgatggttggcgtttgaaggcgtcagttgcggcagcgcacagttgttgaatttctccgctggaaacctgcaaaaagggatgaaattgacaatgcaaaactcgctttttcacctctttcggaaactccatttgtttcgaccgtacaattttttggatcaaattgtcggggaatggtctcggagcttctgccatcgactttgctggtgctgttgttgttgccccttggacgcacatcgtgtggaatttgatttgggcctccacgaagtccagcaggctcttcttcatgttctgcactttcttctggtagtccaagacgagctccttcagctgtgtttgaaggcgcgtgaactcgctctgtgctcgttgcaattggggctgaatctgaaaaggattgaaaaatgtgaactcagcagcaacaacaacaaaacaacattctcacggcatttttttcctcggttgttgatgcgcgcctaaatttcgctttgaagacgtccaaatccaagcgtttcgtctgcagcagtgccagttgtttctgaaaaatgggaaattaccagcaaaaaacaaaaacagaacaagctaactcacgcggatagcgctgattgttgtggtggtgcctcccagcttcacgtcgcttttgctgagctgtcgtcgcgccgcgccaagagctgccagagtttgagccgtcttctgcagggcttctccgaagggtgtccgctctccgaccattttggacgccaccagcattgctgtgccatgtgccaatccgctgctcagtttttgcttgtagagttccatcttttccatgagcttctcctgttgcactgcgatccgttcggcgtttgcacaaagtttttccagttctgctcccaacggagtcgtctccgcgcccaaagcctcctccgctttctcaaaaaaagtttgtttaaaaaaatttacaaaggaaaaaaaaattttacacctgtagcgtgcgctctgctatggatttaattatttccataggaaaataatagggagtagttaggcaaagtgatgatgaatcaaaattcgaccctttttataaacttttcaagtgttcaaagaatgaatttttcttaaaaatttctaactaattaccaacgagaagggaacaactacctatataatgcaatgtgcaggtgcgaaacagctcattctttttacgcatttgtgtgtctttttttcacggacgacaaattcacggaacggacttttgcgtctgtgatttgcaggctcaagcggagacgaaggagggggatttggattccgttaatctttcagtgtgaacattttccttcccttcagaaaatgctttttcatttcatgattcttaacacgccttatctcctaatacgtttaattgccggcgacgactacgacgaaggctgcgaacagcgcaactgttgcaactgtgtggcggtaaaaatgtcggtcgatttcccatgcatgtgaattgcctatttcagcaagcaaaaggcgaccagatgtacttgttcgaaatcacggagagcgcgtggctaccccactgcaacggtagcaaagcgtactttcgactaaacaattcggctacttacacaacttgttttagcgtgcaaaaagtccatttcgggcagaatggccgcggaattggagtgttccaagttcaactttcatgggaaaacgttccacgtcgaatgctcaaaactcgcgaatgacaaagtgtgattgtcaagatctctattgtgttatttccgtcataataatgtttatgtacctctctctctctctctctctgctgtgttttctttaatacccaagtgctaattattggtccgaaattcttcaatttgtatgcgttttcgtgccaactgtttaattttaacgctgcgtttttgatttaaatttttggcattagtttcaatttttcacttaggtatgtttggtcagtcattaatttaggtaaccgattcgaaaatttggacaatctgccgtagtataatggtccaattaaaattcacattgaaatagatttttttcgtgcatccattcagcatataaatttttacaatttgaaagtgcggccccaaaagcacccaaaaagcgctgatttagaagacaattttgtggttttcactaacagccaaaaccaattcactaaaactcaaaataaatttgtgccaaccaaaggcatccaaaacaaagatcctttgctccatttctcattttaaataaagagagatttcatgtgtattcgccaaaattaggaacaaacaaaaaaaaaatgcaaaaatgtagcagaagggggggggggacctttccctcaacggatttctctcgttccatcgcttttcgttgcaaaattatgaaaaatgaaacagcagcaaaatttgcatttttccgccgatctttagcaaattttggagggattccgaagaaattgaatttggcaacttttctgcttttgttggtcgtcctatgccggcaaaaactttttgaaattcaagtgagaattgttattagattttgcactaaaattgcctttttctatggggatccatccctaattctaaaattgtaaaatgttgccaaaatttttttgtatctaaattctctgttggataagtttaatgaaaacatttaaattaaattctttcttgacaagcaaacgataaatttagtcactttttgtgctaatttttgaaaatggcaaacaaaaactgacaaatttcaacaacatttggccaacaaaactgacagattcaacaaatttataaaagaagagagagaaaacggaaataaaatttgaaataaaaaatgaatttttgaaatttttagggaaattgggggggggggggaaattatggaagaataagagggagaaaatgacagaaattcaacaaataaagcctaagcttaagcataggcccaagcaagcctaagctaggcctcgcctaaagcttaggtctaagcctaggcctagcctaagccagccttttgtaaattctcgtaaggctgagttgtccatcagccgaatgtgatggccacacagcagggacggcacggaattccgatttccaaaacctttttgagccttggaattctgattcccgaaaatttttggggcctcggaatgccatcgctatcatttccattttgagttgaatttcctctcggattatctgagcggagggaacactccgacaacgatggcctccgcttcttcgctggagaaactgccgaaggagaaaagcatttttaaattttggaaatttggtgaatttagcggcggaaaatcaaaggaatggcaaaatgattttatttgcataattgtcgaaatattaaaatttcttgcccttttatacctttgcaaaacccacgcatttccgtttttgcaattgaatttgggccaaaaattatttcgcccactcatttccttttgctttacaaataatgctgacaaaacaatgccattcttcgaaattagccattttattttccaatttaatttgttgggcttagccaacaaattatgtttcaatgcgttggcgaacgaagttggaaaattgggcgacaaatgaatttgcaagcagaaaatgccggcaaataaatgccaatgatttaataatcgtattttcaattaaataagtctatgcaaaatgtattccaattaagcggtttaataattatttatttttgctaaattacaaatccaacaactaattgacggacaaataacaaaatgaactccaaaatgatctcattgactcattttcattgtttgtgtgagccggtcaatccgggcatagaaatcacactgtccgtgccaggcacatttcgttgggagtgatcgccttaagagatcgcataattaatgaattattgtctcttattagttttacccttggggccgtcatatggcactttggcaatgccaatgccaaactcggcacatttcgagtcaatttcactgatttgctgaccaaactgggcactcaatgcctgccattcgctgttgttgctggcatgggaagaagcggaggcggcaatgacgaacatggcacggacgaagccgaggctgtgggcacactcatcaaaaaggggaaaaacataataataataattattattattgggaaatgatccattagtctgagccattcccacttattaccagcagaatgagtgccaagagatgcttcgatgtcggccaaaagagttgcgtcgccgcccttcgagcagccgatcagttggcctttcaatgcgcccgcaacactttgggcatccgaacaaagcgatgcctttgaaaaggaatgggcgaaagtgccaacgtaattggccatcagcgaaaccactttttgactgccgggacagcacggatctgcagaaaagcaattaattaattaattgtaaatgaaaacaattaattacgcggtgccgaaacgcaacatttgcacagcaaacagaaaattgtgacgatggcgagtagagagacggacgaagaaggagaagacatttttgaaggatctttggctgatttaatgaataaattaatgatgctgattggtaggtgtggttggcttattttattgcttaaatatgctttttat

SEQ ID NO: 377 - DNA, 1552 bp, Heterodera glycines
tccaacgtacccaatggtcttttttctgctcgtttcctttatttttagccttttaaatgtgcctaattagttaattaccccctcttttgcaggtggccgttgttctttcgtccgttcatctgaaggaagacaaaattgatgtgccgcaggtgaccaaatgcgctgactcatttatattcaattttcccctgtttttcagcgcgttaaacgcggagaatacggcggcggtgcctatggcggtgacggcggtggcgttggtgcgcctgccccgggcggtggcggcgcggcgaacattgccaatgtgaacataaaccaacagaacggatgcaacgggcggggaccgcagtaccaatgggcgtacacgcggaagacgggatgggtgtgcatcaacatcataaacgtgatcatcaaccagcaaagtggcggaaagtgatgagaggagccgaaaaaaaagagagagagggaaacggaatgccaaacggaaaaaaagcaatcgaacggtgtgaaaaaatcatactgtaacggatgtacgataaatgttttttggaatagttaataaataaaaaaaagattgcaagaatatgtatttattatcctgcatattagccgtgacaagtcatgaggcagcattttaaaatgataccacaaaattagtgttttcatggattccttggataaaaccctaatttccattcaacaaatgtataaagtcatttttctctgatgaaaagggattaattattaatataattttataatttttttcaaaataaattttcaaatttctaaataaagtaaacgctagtaaattttttacagcttaaaattcacaaacaatgagataatcttttttatttacaattagcctaaagaatgaacattttggtgcaaaaactgttaagaaattgagccaaattccgagttttttacccaccagggtctcctcctatttccttgcctaggaatttttcaaaaatttaaataagaatttttgagcgaaaatatgaaaatcttcgaataaattcaattttttttttagaataggtatcagtcagtagtgagtgatataggttgaaacttgttaaagtcgcgccttttcttcctagggcttatggactagtcagctgatgacaactcagtttataaaaaattacaaaattaagcctaagcttaagcataggcccaagcaagcctaagctaggcctcgcctaaagcttaggcctaagccaatcagctgagttgtcctcggttgaattgtcctaagctgagttgtccccagctgactgatcctgacgcgcttgctacaaaggaaaagtaaaaataaataataattttcgaaacaaaacccgaatgtaatggccacacagcagggacggcacggaattccgatttccaaaaaatttttgagccttggaattctgattcccgaaaatttttggggcctcggaatgccatcgctgccacacagttgtggttattgtttattacttctttgttgcccaacaattctcacgcattttctgataacggaattaattttaatgcatagaaa

SEQ ID NO: 378 - DNA, 2228 bp, Heterodera glycines
tataaaaaattacaaaataaagcctaagcttaagcataggcccaagcaagcctaagctaggcctcgcctaaagcttaggcctaagccaatcagctgagttgtcctcgtaatgcatagaaataaatttgtttttaactcaaaccaaaaaatcaaatttataaaaaaaacatttggaaaacaaatcaaattcttttgaaagttcgtcattttcttcgtctttctttgctttgctttgccatctctccgcttcgcccactcatttccttttgactttacaaataatgccgacaaaacaatgccattcttcgaaattagccattttattttccaatttaatttgttgggcttagccaacaaattatgtttcaatgcgttggcgaacgaggaaaattaggcgacaaatgaatttgcaagcagaaaatgccggcaataaatgccaatgatttaataatcgtattttcaattaaataagtctatgcaaaatgtattccaattaagcggtttaataattatttatttttgctaaattacaaatccaacaactaattgacggacaaataacaaaatgaactccaaaatgatctcattgactcattttcattgtttgtgtgagccggtcaatccgggcatagaaatcacactgtccgtgccaggcacatttcgttgggagtgatcgccttaagagatcgcataattaatgaattattgtctcttattagttttacccttggggccgtcatatggcactttggcaatgccaatgccaaactcggcacatttcgagtcaatttcactgatttgatgaccaaactgggcactcaatgcctgccattcgctgttgttgctggcatgggaagaagcggaggcggcaatgacgaacatggcacggacgaagccgaggctgtgggcacactcatcaaaaaggggaaaaacataataataataattattattattgggaaatgatccattagtttgagccattcccacttattaccagcagaatgagtgccaagagatgcttcgatgtcggccaaaagggttgcgtcgccgcccttcgagcagccgatcagttggcctttcaatgcgcccgcaacactttgggcatccgaacaaagcgatgcctttgaaaaggaatgggcgaaagtgccaacgtaattggccatcagcgaaaccactttttgactgccgggacagcacggatctgcagaaaagcaattaattaattaattgtaaatgaaaacaattaattacgcggtgccgaaacgcaacatttgcacagcaaacagaaaattgtgacgatggcgagtagagagacggacgaagaaggagaagacatttttgaaggatctttggcagatttgatggaattaattaatgatgctgattggttgatgggattagcttattcgttttgcttaaatacgtttttagtcggaaaaatgccatccatagaatggcatatccgatgttggcatttgtagtcaaatattttggaaaaaattggttaagtctatgcatatattgcaaaattcaacagcttccagccttcaattatttaaaattcataggaaatacaccagtgaaatatccaacaatttcctcttaaaaggaaaaagccgtcgccagccaatgccaacttggaaagaatgtcggcacttttttcgaaataaaaagcatatttaagcaaaacgaataagctaatcccatcaaccaatcagcatcattaatttattattgcttttaattagttaataattaatcaacaacagcgaatggcaggcattgtatttaaagctaaaataaggaagattttgtccaatttttttcatattacttagaaataagaaaaccaaagtctttcattcactcatttgttcggcactttcttctggcgaattcattttaaactcaaaattcagccgatcaaaaaatttgtgtataatcattttagtgatttcttctgtttcacgggtgccacacttggacacactcttccgcggactgatcttttgccaaaaagcatcattcatattagtagggctgccaaaaatatgtacaaaaatatgtaaataaatttttaaaatggttattttcttgaaaaaggcacaaaatgccataaaaattatctaattagcagggatgctaaaaaacgccaaatctgtacatatatatgcgccaaaaatccacagaatatgtgctaaaactcaaaaaaggctaaaatatgt

SEQ ID NO: 379 - DNA, 4233 bp, Heterodera glycines
aattgggagcgcagggacctcgccatagtttggttacggcccaaccaattcacccgtgacggtcaacagcccccgtggtccgtgttcaacaacccccaaccgacggacattgagcaaggtcaccctactcccgcttcaccaattcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattgacggaatttggcggcggattatcgtcgacgattttttcccttgtcatcggtcaactaaacgccaaatttttgcggtggggaggagaagccaactttgggtgtcgctaattgagaaggcacttgcgaagtataatggcaattatgccatcctgaaatccggactaatttcagaaggtataaataaatttagtggttttggcggttactacatgcctttttttaggattttcaaccctcaccgggcagccaaccctttttatcgaccttgaatttttgagtgactccgactttgacatcgtttgggctaagctgttaagtgcgagacagctgttctttttgatgtcatgttcttgtggtgcaggtcagtttttttgcaaatttatttcgacccttcgttgtcccattttccaaagtaaatacaatgtccttactgtgaaaattaaatccagaattaaaggtgaacgcattattgaggaggcggaatatcggcaggttggactgtcgccggaacatgcctattcgctgttggatgttcgccaaaccagcgatgggcatcggtaacctaggaaaaagtctaaaatatctctgtctctgtccaacatagagtgatactgttgcgcaacccttggggagtaaactttgtttggcgcggtgaatttagcagcgaatggcttggttggactcaccagctgagaagggaactcgccatgggtgaagcggctggtccgggcacattttggatgcctcttcaacaatttgcgttctatttcgactcggtcgaaattgcgcagctgagagaacattttggatggacagcgacgcgctatttgatggacatcggatgggaccagcaaaattcatggtgaccaaaagcattcggtgccaatgtatatgttttcatttagcatgattcgaccgataattgatgaacgaaccgaactctgtgcgactcttttccaacaaaatgctcggaccacggtggaccaagttgacattatgttgctgctccataaacaggaagatgggacaacaacacctggtaactttggacggcatttttcatcgactgccattcatttctttattatcaggtgaactgatttgccggtcaccgcgtcgaattacgccgagtgtgcgaatcgaggacacttttttgccgcctggagagtatttgctctgtgcccattcattttcaaaatttggaaaacaaatgattccggggactattgtcatacacaggtgacaaaaatttagagtatttaaaaattaggataccgattgatttctcttacaatttaagttcacgagaaatttttacaatgaaacttcggaccacaactctcgacgacttgcgccagtcaatgtgttctttgctgctcaaagaaggcgtcctccaaaatgtttgtttttggttatttgactgactttattattagggcttatatttatagttgctaaaaactgccgaaatacttaattgaaaacagtttttttcaaaaatactagaaaaatagcttaacaacagctaaaaaaacgtttttcgcgcatttaaggttacggggagctcagaaaaaaaatagtgaaaaaattaaaatatcagccctatttattatatattgtcctattttgagttttctgagtttatcacacatgttctccatgatgatgctggtttggcttacatggtagacaatcacagccgggacaattatttaaaggtcgtgttttggattatgaattaattcgttttgtttatcttttttgctcaaagaatccatttcttcctatttgcgcattatttttcgaattaattcccatatttctcatttaaggtccattccgattgtcaaaactcaacaaatgttctttccactagctcttctttgcttgcgttcgattccatccctccgctgcatcgacaggtccttccttccctttctttatcaacttgccaatatttggttttgccggggactccaaattattgtttatggacaatgatttcggtcgggtcacttgcccaattggagcgcagggacctcgccatagtttggttacggcccaaccaattcacccgtgacggtcaacagcccccgtggtccgtgttcaacaacccccaaccgacggacattgagcaaggtcaccctactcccgcttcaccaattcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattcacggaatttggcggcggattatcgtcgacgattttttcccttgtcatcggtcaactaaacgccaaatttttgcggtggggaggagaggccaactttgggtgtcgctaattgagaaggcacttgcgaagtataatggcaattatgccatcctgaaatccggactaatttcagaaggtataaataaatttagtggtttgggcggttactacatgcctttttttaggattttcaaccctcaccgggcagccaaccctttttatagaccttgaatttttgagtgactccgactttgacatcgtttgggctaagctgttaagtgcgagacagctgttctttttgatgacatgttcttgtggtgcaggtcagtttttttgcaaatttatttcgacccttcgttgtcccattttccaaagtaaatacaatgtccttactgtgaaaattaaatccagaattaaaggtgaacgcattattggggaggcggaatatcggcaggttggactgtcgccggaacatgcctattcgctgttggatgttcgccaaaccagcgatgggcatcggtaacttaggaaaaagtctaaaatatctctgtctctgtccaacatagagtgatactgttgcgcaacccttggggagtaaactttgtttggcgcggtgaatttagcagcgaatggcttggttggactcaccagctgagaagggaactcgccatgggtgaagcggctggtccgggcacattttggatgcctcttcaacaatttgcgttctatttcgactcggtcgaaattgcgcagctgagagaacattttggatggacagcgacgcgctatttgatggacatcggatgggaccagcaaaattcatggtgaccaaaagcattcggtgccaatgtatatgttttcatttagcatgattcgaccgataattgatgaacgaaccgaactctgtgcgactcttttccaacaaaatgctcggaccacggtggaccaagttgacattatgttgctgctccataaacaggaagatgggacaacaacacctggtaactttggacggcatttttcatcgactgccattcatttctttattatcaggtgaactgatttgccggtcagcgtcgaattacgccgagtgtgcgaatcgaggacacttttttgccgcctggagagtatttgctctgtgcccattcattttcaaaatttggaaaacaaatgattccggggacttgtcatacacaggtgacaaaaatttagagtatttaaaaattaggataccgattgatttctcttacaatttaagttcacgagaaatttttacaatgaaacttcggaccacaactctcgacgacttgcgccagtcaatgtgttctttgctgctcaaagaaggcgtcctccaaaatgtttgtttttggttatttgactgactttattattagggcttatatttatagttgctaaaaactgccgaaatacttaattgaaaacagtttgttcaaaaatactagaaaaatagcttaacaacagctaa

SEQ ID NO: 380 - DNA, 5370 bp, Heterodera glycines
  misc_feature (5147)..(5147): n is a, c, g, or t
gtccattccgatgtcaaaaactcaacaaatgtttcttccactcgctcttcattgctgcatttcgatcccatccctccgctgcatcgacaggtccttccttcccttttctttatcactttgccaattatttggttttgccggggactccaaattagttgtttatggacaatgatttcggtcgggtcacttgcccaattggagcgcagggacctcgccataatttggttacggcccaaccaattcacccgtgacggtcaacagcccccgtggtccgtgttcaacaacccccaaccgacggacattgagcaaggtcaccctactcccgcttcaccaaatcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattgacggaatttggcggcggattatcgtcgacgattttttcccttgtcatcggtcaactaaacgccaaatttttgcggtggggaggagaggccaactttgggtgtcgctaattgagaaggcacttgcgaagtataatggcaattatgccatcctgaaatccggactaatttcagaaggtataaataaatttagtggtttgggcggttactacatgcctttttttaggattttcaaccctcaccgtgcagccaaccctttttatcgaccttgaatttttgagtgactccgactttgacatcgtttgggctaagctgttaagtgcgagacagctgttctttttgatgacatgttcttgtggtgcaggtcagtttttttgcaaatttatttcgacccttcgttgtcccattttccaaagtaaatacaatgtccttactgtgaaaattaaatccagaattaaaggtgaacggattattgaggaggcggaatatcggcaggttggactgtcgccggaacatgcctattcgctgttggatgttcgccaaaccagcgatgggcatcggtaacctaggaaaaagtctaaaatatctctgtctctgtccaacatagagtgatactgttgcgcaacccttggggagtaaactttgtttggcgcggtgaatttagcagcgaatggcttggttggactcaccagctgagaagggaactcgccatgggtgcagcggctggtccgggcacattttggatgcctcttcaacaatttgcgttctatttcgactcggtcgaaattgcgcagctgagagaacattttggatggacagcgacgcgctatttgatggacatcggatgggaccagcaaaattcatggtgaccaaaagcattcggtgccaatgtatatgttttcatttagcatgattcgaccgataattgatgaacgaaccgaactctgtgcgactcttttccaacaaatccacggtggaccaagttgacattatgttgctgctccataaacaggaagatgggacaacaacacctggtaactttggacggcatttttcatcgactgccattcatttctttattatcaggtgaactgatttgccggtcaccgcgtcgaattacgccgagtgtgcgaatcgaggacacttttttgccgcctggagagtatttgctctgtgcccattcattttcaaaatttggaaaacaaatgattccggggactattgtcatacacaggtgacaaaaatttagagtatttaaaaattaggataccgattgatttctcttacaatttaagttcacgagaaatttttacaatgaaacttcggaccacaactctcgacgacttgcgccagtcaatgtgttctttgctgctcaaagaaggcgtcctccaaaatgtttgtttttggttatttgactgactttattattagggcttatatttattgttgtgtatttgctacaacaataaaaatgtttggtttttaaccaaaacaaatgttgtccaataaataaataaataatttattaaacaaataaatgaggaggaggacagcaggaaataaataataataaaataaaataatgaaatggtggaatgaatgggagaatgcccggagtgagggaaagggagacatatttatggggctggtcaaggggcggggcgagagacaataagagagggagtgaaagggaaaatataatcaatagggttgttcccttatccaacacctcccttctttggaaaaatccctctgcgcgagatcatggccggaatacatcgtacttccgcttcgacgggtccatgttcagctgctgaggtgccctcttggcgcgtgttgatcttcgcggcgcattttgattttggccaattggagatttggctttttcaatctccttaatgggggtccgatttggttggttcccagccaaaatatttccatttgcttggccaatttgcgatgtctccatttccattgggaaacgacggcgaatttggttggcatgacgatgtactgcgcgacggagcgtctgaacgtcgactcgataagtcggagagttgccaactctctcgataatcgtcgccggcaaccaatttgccttattgcctttcaaattccaaatgaaaactggctctccattttggaaagtgatgggcttggcgccgtatttgtcgttgaattgccgttccatattttggtgtttctgttgaaatttaccaaaatttttgaaattgactgccggcattttctgatgcttcattggcaccgaattggtgatttgcgaagaatttggaaacataagttccttcggaatgatttccaactcttcgatccaaggcatgccgagcaaatcctgatggatttcgtcgctgacgtacgcaatcagtttcgctgttcgtccgttgtacgaaacttggcaattgaattttcctttaattgcgaatgccttttcgttgcagtttttgactgcgatggtggtcttgcccagctttggcttgccaagcttttgccacgaatcagttgtgatcaccgtgatttgtgcagcggtgtcgacattcattgggttttccatcccattgatttcggtgacaattctccaccatttgttactacttccttcaatagccttacatgttggctgaagtaaaacggtgtgaatgtgcatgtcattcccagaatttgtggccacggcacgaacacgtcgggtttctgtgccgtttttgcatctttttgcgatatggccaattcgtccgcacttttcgcacgtcgaatttttgaaccaacagtctttttgccaatgatttttgcctccacatgaatagcagggctgatcaggcaggtccacttccttttcaatagccgttgaattattcggctggaaatgtcctttctggctttgctgtggccttgatttggacttctgcttgtcccggatttgctgcggtttggctcggatggcactggtgctgcagggatttgagccgagggagagcgcgctttcctttagaatttggtatttgcgacactcttctcctagctcttgcagtgaggttgaccgtccgctcgttcgactgtcttccaaacgctgaaggcatttttgcctcagatcggtgaattcgtcgcgcaatgcaatgatgagaatcatgcatttgagctcctctttgctcagcgaaagatctgcgttttcgcaggacgagttgatttgtgcaatcaaacttggaacgtcctgttgcgcttcttgacgaatttggaagcaatcaaagcgacggagaaacaatgatcgggtttctccaaacaattttttcaattttgcggtcgtctcatcccaattgaagtcgttctgcgtctttggtgcgatgctgtcgcagtaccgcttgtattccgcttcgcccaatttgccaatcaatagctgcactttggactggtcgctgagtgcgtgtccgtcctgggcgatgatctggccgtagcgcttgagccaaacgtcgaatgtatgccctaactcagggtcatactcaaatgttgaaaggcgagcatcgattgatgtcgctaatgcagcagaactgttgttttgttccgctgatgctttcaaaacagcctccaaaatcagtttaagctgattggggtccatcaaatttggtgattagccaaccggcttttgtcgaatttgtcgagccgactcggcttttgttgtattttgtcgagccgtcccggctttagaagaataagcagtttcttttcactgcgttatgacgaaattgacgagccacccggcttttgacgaatttttgctgagccgacccggcttttgacgaattttgatgagccgacccggctttagacgaattcggagcgccgacccggcttttggtgtctagcagtttctttgactgctttttgaagaatttgccaaataggctttaaaacaattcacagccagtcccggcttttcggtgaatttgttttgccgtctcggctttgtgtcctgaaaacaaaatttgatgccttttctcacccaaagatgtagagcaggtcctttgctgactgcgccaaattgttgtgtatttactacaacaataaaaatgtttggtttttaaccaaagcaaatgttgtccaataaataaataaataatttattaaacaaaattatggagaaggacagcaggaaataaataataataaaataaaataatgaaatggtggaatgaatgggagaatgcccggagtgagggaaagggagacatatttatggggctggtcaaggggcggggcgagagacaataagagagggagtgaaagggaaaatataatcaataatcggtgtggtcccttatccaacaataacatagggatttataaaataaaacttgcagaaatttcatttaaactttggattaattgtccttcgtaattttccatattcaatgtgaaaatcgtgcaattaaagaaaaaataaaattgaaaaaaattccgaatttcattagaatatgtgcaattttcaatatttaaaatctagtgaattaccaaataaaacttgcacaaatttcatataacctttagattaattgcccttcgtaattttccatattcaatgtgatagtactttgaattaaaganaagataaaattgaatggctttaaaagataaagtcaattttattagcctttaaataaatatattgagatgttttttgttctttatttaaatgcgtaaattattatgtgattccaacgcaataataataataaaaattccgaatttcattagaatatgtgcaaattatcaatatttaaaatctagtggaataccaaataaaactttgcacaaatttcatataacc

SEQ ID NO: 381 - DNA, 1758 bp, Heterodera glycines
aacaactaaaagggtcaaatatcagcagaagtcgaattaggaaatgtctttgtatgggccgaccgaattcgaccgatttttcctcgtcaattctttcggcactgcctttggcactttgcattcgtaattgggacaattgctgctgactttgctgctgcttccccgtctcggtttcatcaatggccacttttccgtcgccgactgattgatgagtgaattcagcggcacactgagtgaagcttaaagcttaagaggataatcatttttaataaacaatttttaaagaataatttttgcttgcatttgtctaatgacatttcgtcgtcgtctgaattgttttccgattttttcatattttagagaagaaattcagagaagttatctaaaaatgtaaaggttggtgattttcaagtcatttcttagcattgaccaagtaaaaagtaatgccctaagactgaggatggtcattaatgggacgcctaaaaatcaattgaacgcctaaagtgaaataaaatgtgacgacggggattaaatatttaatatttttctgtatattcgttttgatgagtaatacacaaaaaaaaacgttttttaagccaaaaattcgtttcacatatataaaaaaaatattttaaatttacccggcggcgtctgaatggcccatttttgaactaacaatacatcagtaaatacctagtttcaccaaaaaacgcttaagaatggttattgaaaaggcttctggacaagtcagctaaagacaactcagccgaggacaactcagctgatgggacaattcggctgatggacaattgaagctttttcaattcggtctacgcttgtacaacatctcatacgaaaacgacccccctgctgtacgaaaacgaccctgaccgtaatatatataataccgtatttgctctaattatcccccatgggggattatttttcaaccttcccagaagggggggggataattttttgccattagagtaaaaaaagctcttccggtcccttctgggcattttttactattgattcactatgggtcaagcctagggctaatattctaagttttttttgccatttttttcaatagctcccagtgacctgacacgaaataacattttttttttgttgtttaagctacttttcgagttattagtgcctattttctagatttttatttttagagcctaaaaaggttaaaaaaaactttgaaaaaaactatttttgcctaaatctgaattctttaaaattttcatttttttgagcacaagaatttagactaatttttggaaattcataatacacttcagggtggaataacgcttaagaaataaagaaaaaccatgagaagttttgtattttatttggtttttataaattaaagatgaaaaattttccagaattctggaaactttcgattttcaaaaaaaatcagaactccgtctgaaagggagttttcacaaattaaacacaagaaaaagccgcaattttttgcattacaaggggtattttattttatattttatcatagttttaaagtaagttttaaaaataaaactcattttggaattcggaccaaacgggggtgggtgtacatcagggctggccgtgatcacggatcacggatatccgtgattgggaaattcaatatggctaccctggggtacatagtttttcaagtggataattttttttacaaaaatggttcgggaatcaggtgaaagtaaattaatttttccctaattatttttt

SEQ ID NO: 382 - DNA, 5999 bp, Heterodera glycines
  misc_feature (25)..(25): n is a, c, g, or t
  misc_feature (87)..(87): n is a, c, g, or t
tgctgtacgaaaacgaccctgacgntaatatatataataccgtatttgctctaattatcccccatgggggattatttttcaacttcnccagaaggggggggggataattttttgccattagagtaaaaaaagctcttccggtcccttctgggcattttttactattgattcactatgggtcaagcctagggctaatattctaagttttttttgccatttttttcaatagctcccagtgacctgacacgaaataacatttttttttgttgttgtttaagctacttttcgagttattagtgcctattttctagatttttatttttagagcctaaaaacttttaaaaaaactatttttgcctaaatctgaattctttaaaattttcatttttttgagcacaagaatttagactaatttttggaaattcataatacacttcagggtggaataacgcttaagaaataaagaaaaaccatgagaagttttgtattttatttggtttttataaattaaagatgaaaaattttccagaattctggaaactttcgattttcaaaaaaaatcaaatcagaactccgtctgaaagggagttttcacaaattaaaacacaagaaaaagccgcaattttttgcattacaaggggtattttattttatattttatcatagttttaaagtaagttttaaaaataaaactcattttggaattcggaccaaacgggggtgggtgtacatcagggctggccgtgatcacggatcacggatatccgtgattggaaattcaatatggctaccctggtgtacatagttttcaagtggataattttttttacaaaaatggttcggaatcaggtgaagtaaattatttttccgtattattttttcatgttgattaaacatttaaacgagttgtaatttagaattacctaattgctttttattaaaagtaaaaaaattttttgaaaaattccatttgtctcccagggggataaatggagactgggggattatttttcaaacccctcctagactgggggataattgaagattgggggattaatggagattggggataattagagaaaaaacggtatacaatacaaattcgatgacgtcagtattctattcttcacttttaccgggtgaaaaaggtaatcccagaagaaaatattaaaaaagaatttctggacttctctgctaagattttcctttttatatttattttggcaatttccttaacgaataaaatggctggaaaagtgaattgtctctttgattattgatatttattatttttacatggtgatttggttttattgatgattggcctcattcttatatttaattttgttgtgaatccttatttttgtttaatccatattactcgaggacgacttaatctatgacatgtccacagaataagtggattactcccttttgtggactttttcttttttttgcataaataaatgtcatcgttcatttttaacataacataaagctttctctcttcatggaaaacattttcaaatttaaactttctgcttaattactaaaagtactgctgaaatgagaaaattgtgaattatggaaataaactaaaagaaattgcacaaatacgacagaaacaaacattgaatgatgacggatgcttgtgcttgtgggctaacggaaaaacattcaaaagttcggttactttgccgctggaattgcactgtgaagtatgtcctattttcttcaaattggcttttgcctaattaaatgctaatcactagagatcgacctggacctggatccaggcctggatttttcctggatccaggtccaggtcattttttggcaacctggatttttcctggacctggattttcctggatttttgtccaggaaatccaggtcaaatgtgaaaaaaaatccaggtccaggcaaaacacgaaaaacctggattttcctggacaaaattttagaatttattatttcaagtgaccgatgtttttttcacgttttcaaaaagtgattaaataaattcaaaactcattattattgtaaattagaaaatgaataaatacgaagaaatgccgtttttttttcctcgtcaatttctcttcggaaaatgccaatccaagaatttatttatccaaccccaagtcccggggtcattaataaggctttgtggtattttccgaaataccaacccaaacgttgtcctttatttgtgaaaatgatccgccgactggccaaattaacgccacatccgaccacgtccccacgagcaaatttgcaagtgcctttctcccagtagccgttgatcaaaaagttgccggtgcttgcgtatgcgtaagtgccagaacggttcaaaagggacagcaaaggtttgtgtttgtcggcaaatccgaaaagcgcgaggctaacattggggaaaagcaaacaaatcattaaatcattatggtaattaagaataaattaaatacaaaagcacacactaaccgttttaactctttgagcgaaatttcaaagtaaaaaacgcctgagagattgtttttccatgaaatcggatgtttcgtgaagacggtgcgccaccctttcgaaaaattgtaattaaatacaataaataaattttaatttagcaaacagttcataaatataaaaaaaccaattaattgcgctgttcgagagtctcgagactccgcaaatttgggtatcggaagcactttaaattagcatatggcttacagtcgccttttccacatagtctgacaatcaaagattcgtccccactgatttggagatcattgtgacagaaagtgacgtcccaacaattttgaagcgaaattgaaacaatctttaaataaaatttaaaaatatattttatatttgaatttttatagcacccgttttcaacttttcacctcaacattagccaagtcgaaggtgaattttggcccaaaatttgccacaattttatcacatgagcaagccaaagaaacgaaaggaaataattggtgatcggaagaagaagcgaacaaatggatggtgtctaagtgttttaaaatttaaaattttcaaaaatttaaaacccaaatgttggccattctttgtgaaaatcagtttcaggttggccaagtcaacgccaaacccaacaacatcatcggcaccataaatgtattcggcgtttcttattttcaatgagccactaagccaaaaagtgccatcgctttcgtatgcataagtgccggtccgattgcaaattcgttctcccaattcgctcgactgtttggggcaaattccgatggtagcccagctgaaaattgtgaaaaatttaaacattttcggaaacctgcaaaaaaaaaattcatttattttgaaattttagagctattagaaaagacggattttatcaaattaatgtacaaaaaaccaaaaaaaaaaacatttttagccggaatttattttaagtccattaattgtcattgtatattataattttggatttatcgaccaccaaaataatgacgcaaatggtgttgttttgcaactatttttgacactatttaaacagtttatcactttagctctttttttttgctacttttcgtcatttttacttagggtgtcaactaagttttgaccctcgaaattattttcgagattttattatttttttaattgaacaaaacacaatcatgattcgaaataatccccttattatcaataatgagttgccatttttcaggcaaaagatcaatagaaatggaaaagttaattaggagctagagttgattaagtaaaaatgctcattttcggggtaggtatttttgaaggctgatttaaagaaaatgaaaatagatacagaggcagagaaaacttgagtgtatagagcaaagttaggactataaaaatacaataaagaaaaattttaattttaggtaaaataaatttacaaaataacgaatccttttcattttccaaaagccctgtaaaaaaatgcattaaccataagaacagctttttgctcaaccaatgctagatacaattcgttctttattcgaacctctcgtctctatagacttttacctaaagagacgagattactaaatccaaatgagtttgccaaacttcttgaaagatctgatctgaatttgttgatttctttgccaccccagctccaaaagtgaccatttgtttgttttatttgatattgtttcattatttctttatttttcggcgtcacgcttttgcgtataaatgattgattgacaagcaatgccaaagtttgccttaattttgtcgcccgatcacacaatgaaacgcatggaaagaacggaagatgatcagcagaagaggcagaagtaggggcaacgaacaggtttaatccatcgaatggccaaatggacgcccattccgacgaaatcgccgtgcgaaaatttggcattttcattcacccagcgggaactattcccccaaaaatagctgtcgcttgccagattcactgttcggcttgcgcattctgcgaagacagagcgaaaatcttgaaaatattttattatttcgaacgaaataatttatattgatagacattatttataattaattacaatttccaatttataatggactgacaaacattcggagccaacgatttcgagatcactgtgacaggcatttgaatcccaacgattttgttgttgcataattggaaatatctgaaaacattcattttttattattataaaataaattaaatatatatatatatatatataatttattatttgaattaacagttcacctcgtcaaagttcagaagatcacttggataaagaacaccctctgaatgaagaaaaaatttaaaaaaaaatttaaattattccaaaaagtaatttaacattatttttatttacaatttccgcaccgctccttcaaaatgtcgtaaaattttccaacactgcaaatttcgccatttctgttcctccaaagttgtgatttgtgcctgcatgtccttcatttgttgacccaattgaaaaattcaaatattttgataagtaatcattttcaaaaaattgtcgtatgctaatgatccgctaaattacctcattaactttttaacaatgttccgccgtctgttgttcgttatgctgttgcaaaaggcgaccaaaaattatctgcagacaattttgtaggtctgtgaattgatcgacagaaactaaattgatacatcaatcgctaactttacataatgaattttaaatatattaaaattaaatttcaatgtcaattttatttttgatttctcaacataacaagtgatttttgattattttgccaaatcagtaccgtatttttcgctttgatccgccgtttgtttccttttgtccgattcactgaacagtttcaaaattgcctcaaattgctcccacaaactgaaaacacaaatttgcactaactgacagttttccttaaatgagaatacagtagtcatgggtaaattaacgtaaaagaaaatttaattccttttcctaccatgtttctccctttgctgttagttttgcccgcaatgcatcgcgttcagccactaatttttgtggttcaatttaagtgcactctgaatgggtgccaaattgaatttttaaaaaattaattgtcgccgtgattagagcttaattaattgcttgaaattcttatagatgacaaaatccttcccctttcccacgttctcgtttcgcttctgatgagtgatgatgtccaacaaatgtttaaccctcgtcagttccatttccgccttctcagtctcttcacgcaaaagctataaaaagggatttgtcagctaatgaatcatcacatttttagcaaatggtattcgcacacacctgctgaaaaaaccgatctgaaaattggtgtgaaaattattataaaattaaaataaagttttttgaataatttttatatgttttgctacctaaaatgcgttaataaaaatttttttgactatttttgtgcctatt

SEQ ID NO: 383 - DNA, 3666 bp, Heterodera glycines
ttaagaaaatgcattgtattttgtacttgtaattttaataccggaaaacatgtattttcgctttttccagcatgtttaaaaatgtgatttaataaatgaaaacattcctcagcgtcggattgtggaaaaagattattttttctcaaaaatttaactcaaaatttcaaaatttggtaattttttggtgtaaatctgttaacaaatcacacacaaattttcaaaaattttccccggcggcgcctatcggcaccgccggacctcgccccccctgtacctcaatttttttttgaaaaaatgcgccattaaaaaagttttttgaaaagcaaacaaggtcgatttacatggcgacataattctaagctaaaataaaaaaagtaaaatttttttaaaattttattaatcaaaattccaaaaattttgaaaaaagcccgggcccggcgggcgcccggcaaaaattttagaccgggcacgggacgcccggtaaaacggtttttttttgaccgggcggcccgggcccggccaattgtcgaagcccgagctagggcccggtcccggcattttcaaaattccgggctctactatttaatgcctattttgcgattttttgtgcctaaaaatggaagccctaatcataatacataatgttatagcttttttagagataatattggactatatttaacgaaaatttgaattaatgtaaaaattgaacattcttaaaattccaggaaaaaaacagggcgcaaaacgaataatcgcttgaagagttgcagcgggctaattgaataaaacaaaaagggaaattgttatgaaaaagaggaattaataggtaggtcaattaatttaaaagatttgcggctaattaatgtgtcaaaacagtaaaggaggagcgaggacaaagaaaatttagtcgaacgaaatgtcaagtcattcatcatttttaaacaaatgcaaaaaaaatcactgaactttcaatttgggttgtccagggctaaaaagtgaaatggaatgaattagcaaaagattcgattcaaaaatgattggatatgtctttttgccactcgtcgactaataatcatcaagggtatgatttttagagagggaaaacgcaaaataattaattaaatagtggagaaattgggaaaaataaaaataataaaattggtaaaattttaaaataagtattatttctacaaaagaattaaattatgtaacaattttttcactagtttcaataggaaaagaataaaatttactcgtttttgcataaaacgcaattttttttcttagatcgaaaaggcgcttcttcaaatgcttttcattatcaaagtctttttttttgtcacaaaacacttgaaaatttttgaaaaaatttcaaatgaccgtccttgttaatttttttaatgtttaaagcccaaaatagcgacttaatatttaaattttattccgattccaacaagctttatttgactagaaaagttcatatacaaatagagtaaaagtatatgacaaagagaaacagagaagcgaaagaaaagagataaagggaaggaagataaatgatttcagcgaagaagaataaacagaattattaaattattattgaaaattttaaattctgaaattaaacagagcggtgggcgcctcttttttgagtaagataatgaaaatttgagttagccaaagatgaattaagaatccaatttgcaacgattcgaaacttgaataaaaaaaaattttaaaacattaaaaactgtcagaaatattgaatttgaatttatctgcatgcccaaaaacaataaaatatttgccaaaaattgaaccatttattatttatcaatgaacggatgatagctctttgtttggagtatactctaattaattaattgttcgaattattttaccaaagtcctttgatattaacaaataattgctttcagttaaatgtgcatattttatttgtatttttgttataaatagttcatagaaaaattatttaaaaatgcgtcaaaaagaaggtatagaaattttgaagcgtttagcatgccatttgggttggataagaaattgataaaatgaattaaatgggcaaaaaatctcattaattacttttggatatttaaatattttgattttttgtttttgctttaatcttttataaaaaatgaaaaacaatagaaaagtttaattttttacttgaaaaaattaatttaattaaatgttgttttttccaagttggtcctcccagttccaggtccccaggcttctggccccggcaaatccctgttctggtaactgttagtactcaatccgtcctaattatttcaatttttgttcaattacaaaatgcttctaccacaaataagctcattaacataaatatatttcgcacaaaaataaataattgtccgtcgctgatttcgccactgcttcatcacattgcttctcacttcaccaatttatgtagtacatcaatggaaattgacaaaatcacttttttattccaataaatagtgcttatttttgttaaattacaaaatgcttctaccacaaataagttcattaacataaatatatttcgcacaaaaataaataattgtccgtcgctgatttcgccactgcttcatcacattgcttctcacttcaccaatttatgtagtacatcaatggaaattgacaaaatcacttttttattccaataaatagtgcttagttttgttaaattacaaaatgcttctaccacaaataagctcattagcataaatatttttgcacaaaaatatgtgtccttcgctgatatctcagttggttcatcacattccttctcacttccccaattgatgtagtgcatcaatgggaagtgagaaatcactttttattccaaaaatatatttttttctttttaaaaattgtttggaaaatgttatagcggcccaacgacaaattatcccatggatctaaatcccgtaagtacaggatagagtcatcagcaccgccgaaattcccttaactcaaaagtttttttaagagaatggtaatatgcggacatgaatgttctcatattattggaaactgtctgggctctgatggatttgaatttgatagtgtgcgtttgactttgaataacttacgataaattttttttattttctgccaataagtaagagtgccgagttatgacgtgccaaacttttttagttaataaataaattaaatatttatttgcatttactttgagtgcccagtggtgtagcggtattgcgccagtaggcgtcttttaatccccaggttcggttcccccacatgcattcttttttttttttttgctttttggtccaagtaaattatcaaattagtttataatacaagattttatttttaattttttaaattcatttttatacataaaatactcaataaaaatattagacaaaaattttttttcaatcgacatgatatttgtgcatttattgcatctttatgtttaattacattttttaattttaattaacaaaattaaaaaagattttgttttataaaaaatatatttaataatctactttgcataaaaagcaaaaataaaattgtaaaatgtattagcatgtaaaggattcgaacctgagacccaaaaaaagatttgactaacgcactacccctacaccaata

SEQ ID NO: 384 - DNA, 7087 bp, Heterodera glycines
  misc_feature (177)..(177): n is a, c, g, or t
  misc_feature (6979)..(6979): n is a, c, g, or t
aattatgtaacaattttttcactagtttcaatagaaaagaataaaatttactcgtttttgcataaaacgcaattttttttcttagatcgaaaaggcgcttcttcaaatgcttttcattatcaaagtcttttttttgtcacaaaacacttgaaaattttgaaaaatttcaaatgacgntccttgttaatttttttaatgtttaaagcccaaaatagcgacttaatatttaaattttattacgattccaacaagctttatttgactagaaaagttcatatacaaatagagtaaaagtatatgacaaagagaaacagagaagcgaaagaaaagagataaagggaaggaagataaatgatttcagcgaagaagaataaacagaattattaaattattattgaaaattttaaattctgaaattaaacagagcggtgggcgcctcttttttgagtaagataatgaaaatttgagttagccaaagatgaattaagaatccaatttgcaacgattcgaaacttgaataaaaaaaaattttaaaacattaaaaactgtcagaaatattgaatttgaatttatctgcatgcccaaaaacaataaaatatttgccaaaaattgaaccatttattatttatcaatgaacggatgatagctctttgtttggagtatactctaactaattaattgttcgaattattttaccaaagtcctttgatattaacaaataattgctttcagttaaatgtgcatattttatttgtatttttgttataaatagttcatagaaaaattatttaaaaatgcgtcaaaaagaaggtatagaaattttgaagcgtttagcatgccatttgggttggataagaaattgataaaatgaattaaatgggcaaaaaatctcattaattacttttggatatttaaatattttgattttttgtttttgctttaatcttttataaaaaatgaaaaacaatagaaaagtttaattttttacttgaaaaaattaatttaattaaatgttgttttttccaagttggtcctcccagttccaggtccccaggcttctggccccggcaaatccctgttctggtaactgttagtactcaatccgtcctaattatttcaatttttgttcaattacaaaatgcttctaccacaaataagctcattaacataaatatatttcgcacaaaaaataaataattgttgtccgtcgctgatttcgccactgcttcatcacattgcttctcacttcaccaattgatgtagtacatcaatggaaattgacaaaatcacttttttattccaataaatagtgcttatttttgttaaattacaaaatgcttctaccacaaataagctcattagcataaatatttttgcacaaaaatatgtgtccttcgctgatatctcagttggttcatcacattccttctcacttccccaattgatgtagtgcatcaatgggaagtgagaaatcactttttattccaaaaatatattttttttctttttaaaaattgtttggaaaatgttatagcggcccaacgacaaattatcccatggatctaaatcccgtaagtacaggatagagtcatcagcaccgccgaaattcccttaactcaaaagtttttttaagagaatggtaatatgcggacatgaatgttctcatattattggaaactgtctgggctctgatggatttgaatttgatagtgtgcgtttgactttgaataacttacgataaatttttttattttctgccaataagtaagagtgccgagttatgacgtgccaaacttttttagttaataaataaattaaatatttatttgcatttactttgagtgcccagtggtgtagcggtattgcgccagtaggcgtcttttaatccccaggttcggttcccccacatgcattcttttttttttttgctttttggtcaaagtaaattatcaaattagtttataatacaagattttatttttaattttttaattcatttttatacataaaatactcaataaaaatattagacaaaaattttttttcaatcgacatgatatttgtgcatttattgcatctttatgtttaattacattttttaattttaattaacaaaattaaaaaagattttgttttataaaaaatatatttaataatctactttgcataaaaagcaaaaataaaaattgtaaaatgtattagcatgtaaaggattcgaacctgagacccaaaaaaagatttgactaacgcactacccctacaccaataaattcataatgcaaagaaataattatttcttttctttaattataaaaagatgaaaagtttggcatgtcataacttggcactcgtgcttatttggcagaaaataaaaacatttttcttaagaacccatgggtgctatatccacccaccaagtctcattcggaaatcccacggacacctggggacctttctttgtgagtatatttccgagtttttggggatgatgatcacgaattgacatattttttgcaaaatacagttaaaaattgggaaaattaacctaaaaggcattcctgaaataaaaaaggccaaaaaatttatttgacactgcaatacttgtttcttttaggcatatgtgatcgatgccaacaactcggctgccgtccattggataccaaatgtcctcactgtacaacagttgtggtcgtacatggatcaaactgagagggtttctcagacgggcttttcgtaataactttatttaaaggattggatacaaatataattttttaaatattaatgttaaaatgagacttttagagattttcaaattttttcaacgagagctttttgaattagagaaaaatgccctgtttttcaatccctcggtaccagtgagctcttccgggcattatttaaatttggcctccctgttcgttagtagaatctgccaaaagttaaaaaaatgattaaattagtaattgtaataaaaaaaaattagtttcgcgctagctttgcttacgtcagtcattggtattcaatatgatgccacatttttctttgttaatgtcttcatcccctatttgcgcgtatttcatttatgggcatggcattttttataaaaatatttttttatttatgccattatatatctatttttacatcagatcattattaacacataaaaatttttaaattttccatagtaagaaactgctttcagcaccaatgcatgggtttggcctttttctgtcgctactggcggcaataaatttgtcgagaggtcaaattggtccaaaggatgaaagcaaaaaaggtttgaacaatattttcaataaaattttaaatattattttgttttgttttaggtctttttttgatggccaacgaatttctcgagacagggaaaatgcttctcgacgaattcccaggaaacaaacaggcggagaataaatctgatgatggactcaattcacaaaaagcgaatggaaaggcattggaagagaaaagtgacaatttccagcaaaaagcctttgagtttttgtgtggaatcgaaatgaaagcaaaaaatgatgagaaaggaaatgacaaaacaaagaaagatgacaatttgttagcttttaaagaattagaagaaaagcgactcaatttttgtcaaaattggaaaaatggcaaaagcatttggaaaggatggaaagaggcagggatttcaatagtaacatcagtgaacaatttgaaactgaatcagcaaatatacggagaaagtcttcgaacattggcgaaaatggaaattttcaacagcaaaaacaaagaagaatttggaaattttacgaaatttggcatcgatttgctaatgaaagtaactgaaattcttaaaggtaaccaattaagttattctaaacaaagaattttattccaaatggggtaattaaacatttaattgaagatgcgagaattagttcactggctctggctgatcagtctgatcatgaccaacggaaaggcaacaacacatcacgacgaaggaaaagggcttttcatgggatttttcgccgagagtttagcttggaaaagtgttttctgtacttgctgttgacttgcatgtccgccggccttggcactgacatggtcgttcgtctcgcccagcacaaagtgcgggtcgtttcatttggcaattcggcgcctccgcctcccttttctaccgaaggccatcacacaaccccgcttgaaggatttgagattttcgtagctattttttgctttcttaccactttttagttttccaatgacactcaataaatttttacgggaatttttaaataatttacaaaagaatgccaaataaaaaagtgttttttcatttcaataaaaatgttaaaatgaaagacaattaattaattatatgtttttaccaagaatagtccaaaaaactgagaaattatttattataatagcacggcatcaatgatcaccaaataattttctcatttaattctatgtaatgaccacatacagtgcccccaaaaaatcttgaaaaatgtaataaaatatgtgcaaaaaaccaaaaaaaaggcaaaataagaaaatgcaagaaattgatttttaggggtgtatttttcaattttcttgttttttctttatagattttccaaaaaatgccaaaagaggtgctaaaattccaaaatcgcccaaatgtgtgcgagcgccaaaaatgtgtttttatgtatttataagtcgctctaaatcaaaaaattgttcgttgaaaatgttattttttggcttctctcgccaaactaagccgaaaaaaaagtaaaaacataaaatccggtctctactgatgaaagatatctgtttattttaacataatgaaaaattacagttccataacgattgttaatgctgttcaatgagtgggttccattcagcatgtgaatttttcaaaatttttaagctgaaaaaaattcaaatataatatacgttgttaattacaattgtactttattgaatatttattgaaaaactctcatattctaatggggggattaaacgaaataaaaatgaaagacataagtttagctagccactaggataaacacaaattttatttatttgctttaaaataattaatttttttcaattgtcctttattccaacgggaccgggacctgagaggaccggtaacacgaagaaattctgctaaaatgaaatgtgattttatttcgctgataattgaagttttaatggaaatttttttaaaaaaatgagataaggataataactagggcccggatttatatgctggacatccaaaatatggacgaaatatggaccaaaacgttgaaatatggacaaaaaatacgaaaaaatggacaaaaaattctgaaaataggtttgaatttttgaaaaaaaaattctaaacccataaaatttctgtcaagaaaaaaattttaaaacaggaatatagaattagataattgagacctcttatttcttaagtacggagaaaaaattgacgtaatttttgtaaaaaaaaaaaaaaaaaaaaaaattttttttcgcgatattttctcaaaaattttcctaatttttggtatttatttcaaaaatttttgattttaaggacgttccaaaaatttccatcgttaggagttcctttttcgaattttttgtggaaattcctaaataatgaagtaaaatatggaaatatgaacaaaatatgaaagatggaaaaatatggaaataaaaagacatccaatgcatcaaatcaagctaaaaatactatttacttcatttttaggccgaaataagttgaaaaagaatatggatatacataaaaatccgtgccctaataataaccaaagtttaaaaaaataaacccatacaatacaatttaaaatgaaattacattaatatttttatttgatcgctttttcataaatttcaataatcagaagattccgtccaaaactttggttgttcgccgatcgtttcgcgagtcaactttttttccattctcaaatcggcatcgtcgtcccctttattcatcggcaaatgttcctccccaatttgcacatcgtccatcacgtgccaagggtggcgctctcgtgccactttcggcttttcctgttaaatttatttatatattttttaaataatatttaattaattatttactttttgttgttcggctggcgattgtttaccctttaattgcattttcaattctccaggttttatgtggccattacaatgcggacacaccaaatgttcttctttctgttttccttgatcagcagtttctgcggcatctgcaaatttaaaaataataataaatttcgctttaatttattaaaaaatcaaattgtttactcttcatcggttgtcccacaataaaatcactgagaaaaagtgcaaaaaatggaagtaaaatgcatggcaatttaaacattttttgaactctttaaaaatttgtaaaatttttatttggtaatgatttatgcagaaaaaatattcaccccaacaatttaactgtttttacgacgattttcctcctcttttagatgatatctgctggatactgacgggccggaaattaatcccaacgcatttccggccttggaaaattaattattcatttataaaaataaataaataaataaagatatgcaaattatgaaataattacatcatcaaatattgtttttatacgtttttattattattaacgaattcttgaaatcaaaaatcgggggatccatttttggaacactttttgccatgtaacttttttatagagcaagaataaatttgtccaaaaacttcatgctatttgggtcttcgtctagcaatttcgaacagaataaaactgcgcccattaacataaaagacccgacaaatcaaaaaacgttccatttacattgacattttagtgatggatatgggggcggctcccggacttttcgacagtaaacataaaaacaaataattcttattnaaataaattatattgcttgtcgttttttctaaatttcttttaaattaacatactaatatgtattgctaaatcagaattactagcgatacgtttattacgttttttacc

SEQ ID NO: 385 - DNA, 2607 bp, Heterodera glycines
tccttcgttaatttttcaccaaaccaaaagggtccaattcctgcccaatcaaatcgcccgaactatattttttgaattcttcgtcaaatgtagattcggtttgcactttaaattttgtatgtgttataagaaaaatcctttaaaaattccaaaagatttgcttgttgaggccatttctgacaaggaatcaagtaatgtacggcgttgtttgggaggaggaggaactataaaaagcgacgcagttttcaatgtcttcaccccaacccccgtctgtataaaaataaacaacgaaatctttttgattaaatctattttttacaacgaattcatttagcaaaattttcgaaatttaaaatttttgtggcttttcgtgatttttaaaatccctcatcgaaaaccaatccgggtcatatttatttccctaatttataaaaaataattaatgcatcctctttttgatatttaattttaaaaatatttttcactgtaataattttatttatttaattttaatcttttccattttttcacattaataatccatgcataatctaagcgtgaccggaaaatcggtcagtggaaaatgcgtcagtagaaaatgcgtcagtgatgcaaatattttaaaataaaattctatggcattagtattgtaatatagaagtaaacttctataagaaaatcattctcaattgcgaaccccggacccaaactcgaacaaaaaatcgaaagtcaaaattttcgaaattagtgtttttcttcaaatcggtttaaatacacagaaacaaactgaaatacatcaatcctgcaataggagatcatttatgccgtttttgaacaaaaaatgcttaattcgaaaatttagacttgcaacttttttgttcgaattcgcgtccggggttcagaattggccgaaatggataccagattcgtggtaagtgcccccgaaaacgcaaggaacttgtttttatgacaataaaattttcactgacgcattttccactgacgcattttccactgacgcattttccactgacgcattttccgggcgcctttttatttgatcgctttttcataaatttcaataatcagaagattccgtccaaaactttggttgttcgccgatcgtttcgcgagtcaactttttttccattctcaaatcggcatcgtcgtcccctttattcatcggcaaatgttcctcctccccaatttgcacatcgtccatcacgtgccaagggtggcgctctcgtgccactttcggcttttcctgttaaatttatttatattttttaaaaataatatttaattaattattcactttttgttgttcggctggcgattgtttaccctttaattgcattttcaattctccaggttttatgtggccattacaatgcggacacaccaaatgttcttctttctgttttccttgatcagcagtttctgcggcatctgaaaatttaaaaataataataaatttcgctttaatttattaaaaaatcaaattgtttactcttcatcggttgtcccacaataaaatcactgagaaaaagtgcaaaaaatggaagtaaaatgcatggcaatttaaacattttttgaactctttaaaaatttgtaaaatttttatttggtaatgatttatgcagaaaaaatattcaccccaacaatttaactgtttttacgacgattttcctcctcttttagatgatatctgctggatactgacgggccggaaattaatcccaacgcatttccggccttggaaaattaattattcatttttttcaacgaattattttttataatggaaaatattttaatttaaactcaaaaatgtcaatttcgaccagttcaacaaatggtgatttcacaccatcaataggtggaggaggtaatgaaatgggaaaaggttgaaaataaatggatttttttggggaagggagtaaataaatattataattaaatcagggaattaaatttataaattttcagaagttaatgacgattcaattagtttggatgaagattggcaatttgatagaaaaaatgaaactgttgctgatcggcaacaattgctgatggtgggcaatgaaagaagcttcaatgaggcatttacatatatttttcgacaaaattatttatttttattggaatttcatgaaagttatgctaagaataaggtggaaattgaattcaaaattaccaaacttgtacttgagaaggtaagttttacaaagaaaagttaaaaaatccccatttaacgagcagcagaaaaaccattgattttaagcgggacaaaatacttcgctttttggagctttgcttatgattagggttataagttgtatgcattaaaaaatgccaaatatgcgcataaaatatgcattaaaaatcccccagatatgccctaaaaacccgaaaaatgcccaaatatgcactaaaatatgccttaaaaaactgccaaaaatggctttgaatcctcaaaaaaatgccaaaaattatgtaaaaaattcagaattgactttaaaaaaccaaaacaatgactaaggagcgtttttagacaattgcaaaattttttttaggatatcaacaattttttttcaaaagttc

SEQ ID NO: 386 - DNA, 1832 bp, Heterodera glycines
catgctgatttcgtgctgaatttagcattttttgatgctgaattaagtgcttaatcatcattttttggtgatgaaaaatccggtctttaaatattagtaaaaaatattttatttgaatttttgcttaaaattttgaatttaaataattaagtgattaaaaataatcattttaaattagttttaatgagcatacatacaatttttgcgaaacttgagaacttttttaaaaatttttaaaggacggcggtgccgatgggcgtcgtcgggaaaaacttagtaaattttaactaagaaaaatttcaatttcaaaattttcgtcggcgaccctcccccccccccctgccctacctcttttacaccggcctttttctcattttccaaaaatttttttcgttttgcattcatttttgttacaacaaaatgatagattttattttttaaagcatccaatttttatctcttttttcaaaccacaaaactctctctctctctacgctgtagggattaaaatgtgtgccaattgttgtacagcaaaatgtgcacttttctgaacaaagagtgccgtgccggcacggcacacgacacccctcggggggagggaggagcttttttgtcggcactcaataaaaaatgatgatgagatttttgagtttagaggggaaaacggggaggaaaaattgttgtcctgctaatggatgatgatgatgtgaagaatgggaaaagcattcaattgacacacttttagtgggaatatttttttcgtgaaatgcgattttttgccgcgtttttgactaattttttacaaattttcattttttctatcattcgatagcccttaatgttttttactagcatgtaaaatatcaaaaattacgttaaatttccaaaaagttatgccctaaattgctcaaaaaacttggttttttagagttttctggccataacttttctgaaagtcaatgaaattttttaaattttgcaggtgaataaagacacttcttaaggctatcaaataaaaaaagataaaaatttgattactttttgagcaaagctaaattattttttgtctcaacttttgaccattaatcatttttcaataacgcccattttgatagttttggttattaaataacgtgacccggcaccagggctgggcgtaattacggattacggaaaacacggcgtttttggaccccccataatttacggattccgaatttccataattaaaacctccagttaatcccaggcttgtccagcaccgctgtgttttagggggtggggcggtggagtctttgccctccggcgtgttttgcaggcagcggtgacggctggcacaattccccccctgccgccgtcgttgccgtggggggggggggagggggtaattactgccagccgtcctgccgggggcagcttttttcttctgttgtgcttcttccaccaccagacacactatcatttttcgccgtcgttttagcaacgcttttgccgtcccccgcccctccggtggtgtaagtgagtgaaataagtgagtgagtggctcagctcatctccatctcatcattcattcattgccgctctctttttcccccggggggaaaatcgtcaaaacgccaaacccgcggccattcttttgtttttttttgtttcatttttaacttatttgtaagaaatgttccagttttgggtactgaccagaatttgttcatgtaaaaattaactatatgtcatctctgggccccaaatcccatttcccataaatttggctgaaaatccacaaattggacaaaatatgtaaataaataaattttaattaaattttgaaaaaa

SEQ ID NO: 387 - DNA, 1633 bp, Heterodera glycines
gccgggggcagctttttcttctgttgtgcttcttccaccaccagacacactatcatttttcgccgtcgttttagcaacgcttttgccgtcccccgcccctccggtggtgtaagtgagtgaaataagtgagtgagtggctcagctcatctccatctcatcattcatcattcattgccgctctctttttcccccggggggaaaatcgtcaaaacgccaaacctgcggccattcttttgttttttttgtttcatttttaacttatttgtaagaaatgttccggttttggggtactgaccagaatttgttcaggtaaaaattaactatatgtcatctctaggccccaaatcccatttcccataaatttggctgcaaatccacaaattggacaaaatatgtaaataaataaattttaattaaattttgaaaaaactgcaaaatagatgttaattttttgattaaatcgtatttaaattttttatctcaaaatcttattttagggctgccttattttgaaaccatcagatacattctaaatatcttttaattactggccaaattatccccgaaacgccggggatttaatctcagagaacggggaaaaatccccgaccaaattatcgaggattgtggcttgtagaaattaaaaatgtcaggagaaacaatttaacgctaaattaattatttttttttttttttgggatgtgtgccaatggcgaattaattgcttttcattcttttaatgaaagggcaaattcagccgtttttgctaaatttgggcggcattggcattttcgtaagatgttaaattagtttttttactttaaaatgttttaaggggactggaaaatctgtttaaaattatttattttaaattttattttaaaattcaattaaatctattccacattaaaatgataattaaattataactattttcctcttaattagcatttttccgcaccgttaattccaatttttgtgccattttcagcccattgaatttgtttaatttaaatcctataaattattttagaaataaattgtaaaaaatggagcaccacgccaacacatccatcgacgacgcactgctcgtggatgacaatgaaaagcagaaaaggctgttcagtgagttttatgggaaaatttgatcagatcagagggaaatagggaagagacagagagaataaatattagcaaaaatcgggagtctcgagccggaaaatcccggtagaaaaggcctagaaaatttggaaatttttcacaaaaatgtataaaatgcgtcaaagttagtcacctttttcgtgtccggcactgatttattatgtcaactgatcagtaaagataaagatgctttcttcaattattacacatcattaaataagttagtctgaacaaattccatagatatgatcggaacaaccaatgaaaagactgactgttctgatcatttatcagtaaaaaatggagaaaattgtgaaagtgatagctgatcgagacaatttctatttcccattttgagaaaatttgtgtaaaaattttctatttttttcagtgctcggcctgttcatattgttttgttgggtgggcgtcataattttgtgtgcttatccccaggttaataaaattaaaaatt

SEQ ID NO: 388 - DNA, 7071 bp, Heterodera glycines
tagagtccggcgggatcgggactcccgcggggattttacgggagttccccgtccccccccggcccccttttttcggtgaacgggatttttaacgggagcgggatttttacgggattcccgttcgggactcccgtcccggaaaattttaactcccgatcccgctcccggaaattttttttaccggactctagtattgaggtacataattttttaaaattaaaaagattagtaaaaacatgtaaaaattgaaaaaaaattaatataaaagcggctgctcctccgccatttttcattattcattcgccattttcgtctcttcaatttttctccctgacaatgccttcaaaaatgacactttgtacattttgtgcatttcttcttggctttttcccttttccttctcattttttagtcggttcgttgtgccaatgtttgtcgggtgttgtgccattctttggctttattgggaccgcttcaaaaaatcaccaaaacaactaggcgatcaaaataagaaatttaaaaaaaatgggatttaatttttcagttgcatctccggcgaaaagagcaagttttaacgacttacatattacacaaaaatttgcaaataaataggacccttataatgggaatctgctaatttcaccaacattttcaaatgcttaaatttttctgttttgctaagctaattgaaatccgtcaaaaactgtgcttaataatttgccacaacaaaatgtcagacaaccgaaaagaggcggaggaaaagatggcaaaagcaatgtaaaattaaaaatgccaatttttcaatttgaattttaaattttgttttccttttttcagcttcatctccggtgattgttggctttgtgtcttcgatttgctgccaccttctcaacttggccttggaattgcgctgatcagccaccgatttgacttttacgtggacgaacacttcaaaacgcgcaaatggacgctgaaacatattcaaattggaagcaaaattggaaagaatggcacaaatgaaatggaaattgtcaattctgattggaaatcgatgccaattccgcaaaatccgttgccaaagaaaatcgtcggattcgaacgcatcgacatcttgtaaaataggcgattatgcaaaaagttcggtaacacttcccattcattttcagattcatcgaccgaaatgccatcgcttttttccaccattttcgtccaatttttccaatcaatttggccatccggtcgatcatgaacaataaacgcaatatggaattgattttgcgcaacatttggccaatactcggaaaaaacatttatggcatggaattgtccgccttcattttccaccgtttgcgcaaattcgtcccgtcttttctcaacgattgtccatcacctcgttttgtctctttcaaccatggcggtctcttcaccaagtttccggccgatgacagtgccatggcgtcggatggacaagcattggccaaatggcttttgactccccactcaacaaatttgccaaaggtgttgaaatgcatggtggacagggatgatccgaatttggcgtcgaagattgaagcgttcaaagcggtgctttcatttatcattgcgtctttcttaatcaatttttcaatgttttaggcatttgccaattcttcgtctcctaccaatttcatcatttccgtttggtttccgcgaccttttgctgactccgttgtgccatttgatctgacaaatgaattgactcgggaacaattggcgttcaaaagaacaaacatcagccttcattttctgctgatccgttgtccaattgcgcgagaggcgagcaaatggacgaaatgggaggaggaagcgattggctggcgcattgatgatcaatggaactttattaaaattcatgttgatgctgataatgacattggggatgggtcagtgaatgaatgctttattcaaaaaagcaaaatttattgccttgcctttcactttttaggcttctcaacgcaatgatcggcccgagtgatcagcagcagaagtgaatgaatgaattgcaaagaagtgatcgatcaatttgaatcttggagttgaaaaagtgaaaatctattttgacgtgctctttaaatattctttttttttttgtttaatgaccaacttggatttgttttgtttttttgtaataaaaatgagttgactgctggtgaataaaatgtagcggaaacagtcaaagaaaaatgtcgccagattttaacgatttttgcattatttttgggttaaaagcgcctatggtaaggtagggggcggggtaatttcagtctgagcgcccattaacaagaacattaagtgccgatttaatgcagattttgcaattttatttcggtaatatttttgtttgtacccctatttttcgaaaaaatttaaaaaattgtaaaacgcttttcctgggcttttcaaggtcgctgatcacgaatctaaccgcgtcaggatcagtcagctgacagacaactcagctgttgggacaattcggttgatggacaactcagctttacgagaatttacaaaaggcaactcgtacaatggcttaggctacgaagcgggtcagttccgtctcgccagttccgtcttagtagtaaaagagccggttccgtctcaaatatttttggacccaaatttttttaaatttcagaatgtaaacagaaagttgagatataattaatagtgctgccaaaaatatgcacgaaaagtagccaaaatatgcatatgcacaaaaatctcgaaatatgcaaaatatgcaaataaaaataccgatttttctacgcaaacaaaaaaaaaacgtgtttttcctattatttatagcatggaaaaggcaggaaaaaaatacatttgcatgtttttggcagccctgatatttaatatgcctaatatttttgggtgttaaaaactaaaaactgccaaaatatttaggttttcggttctaaaaacctcaaaataggtgttaaagtttcaatttaggggtataaaataacaaaatttttagaggaaatttttcattctcaggggtgtatttttgaaaattagacgaaatttatgtaaattaatctttatattcgggttcggggtccaaaatgggtgccggattcgctgcaaaagtgctggacacattaaggctgctaaatttcccgacacgaggaccaagactgagaatcccgagcagaattactggacatttgcaatgttaaattcatttcaaaaaatttttattttcgaatatacttttaattaaccacaacttttaaaaaaccaggtatatttaggctgcggtaggctgcgtagtaaaagaatttttactttttttctaaattagttattgattttaaaaaatttgagtctaaaaatatttgagacggaaccggccctttgagtactaagacggaactggccagacggaactggccagacggaactggccagacggaactggccagacggaactggccagacggaactggccagacgggaactgacccctactgtactgatttggcctaattattttactttttgaatggtgctatactttttcgtcagtaagcattttcgtcagtgaacgatttcgtcagtgattttcgtcagcggataatttcgtcagtgaacattttcgtcagtgtactatttttatttattttgctgttttccatttttttcgtcagtgttccaattcgtcagtgaacattttcgtcagtgactatttcaggctcaatttttatatatattactttctttgtatatttttaatagctgagaatttattttattcaaaaatgggcttaagcaccataatatataaaatttgattatttttcaccacaaaaaacttaaatatttaaatgcctatttactttcaaatgaattcgacagtggtaatttcgtcagtgaatttgtgtttttaaaaaatgattaattcaatttaaaagtgcaaatggtaagcacaggcccgaagatattcaagcggatcacggtttccaatgtcctggaaaagagcatttaaattgttgtcttgtctgacatatttcccctttcttgctgcgtgcggcccccttattccatcagcaggcgcaatctgataatcaataattcgctgagaccacatctcatcttcttcaatcattttccggacaaaaccgctgagtcgctgatttcctttaagatgggcattccaaatggcatgccagccttcaaggctgttattcgtgcgtgaaagtccaagtgccaaacggtctgtcatgttccacaattgtattggaaaaagtgcatcccggtgtgccaaattcaatgcttcaattcgttcacggatccaaccgtcggcagccgcacccatattaccgcccgcgtgatcgacaagcggttcttcgttttcaatgacatggcgagggccaatccatgtcattagaaaataaagaatcaattctaagcgaaaaaataaatgaaaacaaagaaaaatagggaaattttgcaggagttcatcataattagggatcggattcttaagggtgaaaaatcgcaaaaataaggacaaaaaagtacaaatttgggggtataattttttaaattgctttttaataagaaacaatttcaaattatggcaaccaatcttattcattgttacagttgcaaataatttatatttgaaatttagaaaaataaataaaaacttaaaaatccgatccatattcataaattataaaatttaattcgacaaaaaaataaccctgtagctcagctgttggattgagggttgacaccacaatgcaaaagtagttataaacgaggccaataggaacaaatgccaatgcttgcaatgacctacggtgaaataaggctactcataaacaaacaaattttacaagcgaatttttcccatttttataacagtgtttttgactatttataatattgtcctagccctgacctaatgcttcgttggaactcaatttcctgaaggtattgggtgtgtaggttttggagcctttggatgcggcggtaaattgcctgcccaaagtgaaaaaggcagccatttcggattgcatttggaaaaacaattcgagcagaatgaatggctgccgattcaaagtcactcattagcctttgcggcgaccaattgttgccaatgctgtctctgattgcctcaaagaaacgtacatatgttgccccctccttatttggcaatagcccataaacgcatgggactgaacaatggtcgatgattgcgctcattgtgtacaactgagcaaatccccgcgggcatgactttaacggttaaaaaacagtaattaaagaaaatggtaatatttttacttcaaatgtgccatcaatggcacattcggtattgtattgacgtaggatttcgagagcatgcgctgagcagaagacaatcatccgatgtccatttaaaatttggttgaaaatgacccgattttgaagagcattgggaatcacaatattttcaattggcaaagcatcaagaccaacatcaccgaccttttaattttagttattaaatttagttatttaaaaaatttttatttaaaccatttacactaaaatacacctcttcgtgatgctttctctttgctatgttgaatttatttcgcatgtttacggcgcttggtgcgtttacacgcacatcgaccggaagttcagcccgaacatttcggacaatgtttcgactggttgtcggaaaatcacttcgagcctcttggcgaatttgctcatttgcctgtcttatctataccaaaaatagatggtttgcttttttggcttacattgagttggccaaaaactgcggcatggttgtggtcggctgacatgcgacccatcttgtaacgacttccatttgcatcgacgtgccacgccatttgaacacaagctcgcccaggacagtaagggggacgttttgggcatttccagtattcccagccttgctcgattcgagagtcgctctcataagcatattcgaacccaagacgagaaaggagaattttgccacggttggatttcgcttcttcaaatcgaacaagagccatttttggttgcagtaaacgaatgaattttcatatcgttcatttttatgcattgcaaaaactagataaggactaaacaaatatgcaaataggcaggcactcgagaacgcatgggaacgatggcgagataagaagtttgagaagtaaatttactaataatattcaacagttttaaagtacaatttcttttatgtaaatcatttattaaagtacaaataatcacttattttatctagagttaccatacgcaaaaagcgataaatactgtattaaagaagttgataaaaatgaaaaatttttaattttatgcatccactgacgaaaatgttcactgacgaattggaacactgacgaaaaaaatggaaaacagcaaaataaataaaaatagtacactgacgaaaatgttcactgacgaaattatccgctgacgaaaatcactgacgaaatcgttcactgacgaaaatgcttactgacgaaaatattaaccacgtctgttgatgttctgctgctgattgttgttaaattgtacaacagttgtaccaatattattcgcttgaaggaaagcaaattgtgagcgaaatgcgcaacgatattgggcactgaaatattaattatataattcttaatgggttgattaaacagcgacccaacattattttaaatattttatctttatttttggttcatcttagctctggcttgaagacttttcgttatattaatgaatattttttaaaccaattaaaaaatccagacccaggcctaaaagcataggcatgtctggggttttcctggattttgtccagaaaaaaacaggtccagccagggctaggagttttcttggattttcaggggaaaaaacaggtccagccatgggtaggcatgaatttctgatccaaacttttttgaaaaacttttattttcgtgtgttttgcacttgcaaaagtaaagcactggtgcgctgcttccgtatgccaacgtttggaaaaaacactgatcggaa

SEQ ID NO: 389 - DNA, 2943 bp, Heterodera glycines
ccagccttgctcgattcgagagtcgctctcataagcatattcgaacccaagacgagaaaggagaattttgccacggttggatttcgcttcttcaaatcgaacaagagccatttttggttgcagtaaacgaatgaattttcatatcgttcatttttatgcattgcaaaaactagataaggactaaacaaatatgcaaataggcaggcactcgagaacgcatgggaacgatggcgagataagaagtttgagaagtaaatttactaataatattcaacagttttaaagtacaatttcttttatgtaaatcatttattaaagtacaaataatcacttattttatctagagttaccatacgcaaaaagcgataaatactgtattaaagaagttgataaaaatgaaaaatttttaattttatgcatccactgacgaaaatgttcactgacgaaattatccgctgacgaaaatcactgacgaaatcgttcactgacgaaaatgcttactgacgaaaatattaaccacgtctgttgatgttctgctgctgattgttgttaaattgtacaacagttgtaccaatattattcgcttgaaggaaagcaaattgtgagcgaaatgcgcaacgatattgggcactgaaatattaattatataattcttaatgggttgattaaacagcgacccaacattattttaagtattttatctttatttttggttcatcttagctctggcttgaagacttttcgttatattaatgaatattttttaaaccaattaaaaaatccagacccaggcataaaagcataggcatgtctggggttttcctgcattttgtccagaaaaaacaggtccagcaagggctaggagttttcttggattttcagaaataacaggtccagccagggctaggagttttcttggattttcagaaaaaaggcccagccagggctaggagttttattggattttcagaaaaaacagtccagccagggctaggagttttattggattttcagaaaaaataggcccagccagggctaggagttttcttggattttcagaaaaacaggcccagccattgctagtggttttattggatattcagaaaaaaataggtccagacaggactatgagttttcttggatttgcagaaaaaaaggtccagccagggctaggagttttcttagattttcagaaaaaacaggtccagccacggctaggagttttattggattttaggaaaaaaataggtccagccagggctaggagttttcttggatattcagaaaaaacaggtccagacatgggtaggagttttattggattttaggaaaaaaattaggtccagccagggctaggagttttattggattttcagaaaaaacagtccagccagggctaggagttttcttggattttcagaaaaaaataggtccagccagggttttcagaaaaaacagtccagccagggctaggagttttcttcgattttcagaaaaaacagtccagccaaggctatgagttttattggattttcagaaaaaaacagtccagccagggctaggagttttcttggattttcagaaaaaaataggtccagccagggctaggagttttcttcgattttcagaaaaaaacaggtccagccagggctaggagttttcttggattttcagaaaaaacaggtccagccagggctaggagttttattggattttcagaaaaaataggcccagccagggctaggagttttcttggattttcagaaaaaacagtccagccagggctaggagttttcttgggttttcagaaaaaacagtcaagccatgggtaggagttttattggattttagcaaaaaataggtccagccagggctaggagttttcttggatattcagaaaaaacagtccagccaaggctaggagttttattggattttcagaaaaaacagtccagccagggctaggagttttcttggattttcagaaaaaaataggtccagccagggctaggagttttcttggattttcagaaaaaaacaggtccagccagggctaggagttttcttggattttcagaaaaaacaggtccagccagggctaggagttttattggattttcagaaaaaataggcccagccagggctaggagttttcttggattttcagaaaaaacaggtccagccagggctaggagttttcttggattttcagaaaaaacagtccagccagggctaggagttttcttgggttttcagaaaaaacagtcaagccagggctaggagttttcttggatttcagaaaaaacagtccagccagggccaggagttttcttgggttttcagaaaaaacagtccagccagggctaggagttttattggattttcagaaaaaaaaataggtccagccagggctaggagttttcttggatattcagaaaaaacaggtccagccagggctaggagttttattggattttcagaaaaaataggcccagccagggctaggagttttcttcgattttcagaaaaaacaggtccagccagggctaggagttttattggattttcagaaaaaataggcccagccagggctaggagttttcttcgattttcagaaaaaacaggtccagccagggctaggagttttcttggattttcagaaaaaaaaataggtccagccagggctaggagttttcttggatattcagaaaaaacaggtccagccagggctaggagttttattggattttcagaaaaaataggcccagccagggctaggagttttcttcgattttcagaaaaaacaggtccagccagggctaggagttttattggattttcagaaaaaataggcccagccagggctaggagttttcttgggttttcagaaaaaacagccccgccagggctaggagtttttttggattttcagaaaaaaaaata

SEQ ID NO: 390 - DNA, 4432 bp, Heterodera glycines
  misc_feature (46)..(46): n is a, c, g, or t
tggaacataaaaaagaaaaatagctaacaaataagactataataantgagaaagaccaacaacaatgttaacaaactaaccagtgtcattgcctgatatttaaatttataaacgaaataacaaaataaatttctgaaaaatgaatttatataagaaaattaaatttattttattaagaaaatttgggcaaaaatccagattcattcatcaaacattaacaaataatttccaacaaataaattcttattcatttttttgtgaataatattaataatactttttaaaattttgaaaataaattttaattttgtgagtaataatctaataaatataaacaaattaaatttatgtgtgaaaataaataaattttagtcaaagtcaaaacggcatcattaagcaagtaattataaatcagaaattggcataaataaatcgtgatcagtgacccgaaaaattatacattgttattttcagaaaagtttttttttaatttaattcatatttaagttttcgcgcaaattcttatatttgtcattgcttcatccatcagccgtaagtgtcagaaaatatctatttaaatggattataatcaataaaaaagtaaagccatgataaagaaagtaaagagaaaattaaaataatttactttaaaaaaattacaacagccagaataatggaaacataaattaaatatgtaaagcataatagcacagcataaaatttaatgttatttatttgaacattttgtcaagatttattaataaaatgaaataattacaattatttgtgtttattatttttgtcatacatatttttcaaataaaaataacaccgaaacacatgttaatgatataccatacattttaattttatttgcgagcaaaagtctaaaattgagctaataaataaaataagaaaaaaggtttattctgaaaaaaaagataaaaataataaaaaaataataatttttttataataatttaatttaaatatgatatgaatgaacaataaaaaaacgaatgaaacataacttttttgaaatttaagagattgttttaatttttttgtttattagagaaatattggggtgttgtataagttctgtcaccccgaccaaaaatttcattcaaaaatttataaaaaatcaaataataactcaaaattaatcaaaatatgcaccatcattcccgatcatattctgccatttttgagattttaaaaatgatctatcgattaaattcaagatagttagactcaaataaactgatgggtctacttaaaaaagtggacaaattcaaccactgatttcttggccaagaaaaggataaaggtacaaaacaaattatggttttgtagagcaaagttgggactatctgacaagctgaaaaagagtcaccaagaccgacgggttatttttttaaattgtcctgtctgaaaatgggtgctcaaaagtgccaagattcagcacccactttgtacaacattgttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaattcagagatcaaatctgaggccagatttggattctccggacttgatttggccacaaaaactgcttttaataaatttccaactgatcaaagcaaagttttgacccgtacaataaaagtgatcggatttgggatttagggtgctccattgggataattttaaaaaatcaatttgaatggggaagaacgaaaaatggcttttaaccgaagcaaaaatgtctgctctttcctataggacagaaattgatcggctgtcacttgcggttaacggtgcaaaaaattccgattagcatagcataagaagggtgacagaacttatacaacaccccaatataagagctatcttatggtaccaatgcaaagttcccagtattttttttcaaaataagacaaaatggctcaaaaaccaagattcgaacccaaaaaataagattttttctaaaactaatatcagggggggtccggcggtgccgatatgcgccgccggggaattttcttttttaatttgaagcaatttgttaacagattttgaccaaaaattatcaaaattttgtgattttttagctaaaaaattcagaaaatcgtaaaattgtgactgttctttaaggaattttgggcaattacagtatttgttaacagattttcaccaaaaaataaaaaattttacgattttgagccattttttaagaaaaaaaagttttgtggggccgggggccgcggtgccgataggcgccgccgggaaaaattttttcaaaattagtaattttggtagaatttatatcagcgaattaaatcattaagcacaaaaatttgaaaagtttggggaagcctgaaaataaagggcaaatcttagaaaaaaggtatagccaaaagtacaaaaggtaccaagttttcacacatttttggtcataaacttttttttaaacctaatgaaattttttgaaatttaccagactaatagaggacacttgttaatatatacgttatattaagatccctttatttagactgttctaataatggtccgttaagttaatgaaaaaacgacgtctagagaatttatatttcgccgagatcatgttctccgttctatgcgacaaacgggaggagacctcagtgttccggagattgacgatgagcataagtgtgatgaaatgaatgctgtgacacggaaacatccatctccacgagatcctgcctccttctcctctaaagtcgcagcgtgcctaccagtttccgcgggctaagtcaggggcttcacgaacttcatccgcgcaacgttttgctggaccatcagaacggactgctgccggacgaccggttgtccatcatgtgcgaagtttccgtcctcggttcagactgtccgctttgccaccgtcagccttaaattttcattttcagacagcacagcgccgtccgttggtcagccgatcacaatggcgacaagaagtgcgagtgcagccgcttacccggtggccacgcctcaactgatcgtgggcacggcgggtgccggcggtggtggcaaaatgccgaacgccgccgtaaccgcgaaacaaatacagcagcaacggcactggcaaagacagcagcaagagcagatgcaggtgagggggtcaattcgagggcgaaacaacgggggggaagggcgacgacctgctccgctaaaattttgttcaataaactatgtttttagaatttgacttttttagagatttttcccagtttggagaatgttgtttttaagcaattgtttttactagcacttgttttggaaggggaatcgaacttttcccgagtgagagtgtgtgtgcgtgtcctaatgtttttccgtttgcagcaccaccatcctccgggcaacatgctgtcaacgacgcttcaccaacagcagcaacagttcagtgccggaagtgacggaggcccattcataagaccatcacaccaacagcaacacacgccatggtgccgcatgctgtcgctgcaattggccagcagtactgcggcgccaacgcggggttcgaatacccgccaatgatggcatatacgcgtcaaaataattcaactacaattttcccatggacaaatgtgctgaaatttttaccaagcattaaattgtgaaaataaattgaagtattgaaaaatccattaaattaaatttaaataaaattaaatatttgaagtaattcttattgactatcagaaaaggaagtcaatacctttaccaaagtattctaaaaagtacattataccaagggaaaatggaaaaaattgatcattttttgggtcgtcggtttttaagcttaatttcatccgcggacatcgtagagccctatcaaccaaaggttcttttgaagcaaattttctgctctttctgtcagtcaaaaagttttccacgaaaaaacttttccgaccctcctaggaattttttcgacaccaacccctgcgtttacggcattttaacagtgaaaatgtcaatgtaattgaattttgttagatttatcgtgttataggatgtcttttcatgatgttcattgctttattgctctttctttttccaaaaatcttttttcattaaaaaataatgtaaaattttttattttcattattttcaatacctaaaaactttacggtgaagcacaaataatcagcttgcgaaatttatgaattaacaaataaaataagttttcagatgaatgcgagtatttttctgctgttcgcagtttgctgttcttttctggcccattattcccaaggaatgttttctggtctcaaaaatacatttaaaaaggaagag

SEQ ID NO: 391 - DNA, 3356 bp, Heterodera glycines
ttgctattattcgatagccctatgtgtcctctactagccttggaaaatatcaaaaaatttcattaggtttaaaaaatgttatgaccaaaaatgtgtgaaaacttggtaactttcgtacttttggctataactttgtaaaacttgaccaaattttttgaaattttgatgaacttgtagagaacacttattgctatacaatgataccaaaaatgtctaatttggttgatattgacaaaagttatggacagttttttgttgaaatttccatttgataacggactcaacaccatctaattgatgcttatgagagaagttaagaagtttttaacatttaaattttttaaattaattttaattcttaaataataatatagttgaatttattttcacaattataatcttcattcatatttatttttccaaaaaattttcataatatataccaaaaataaaataaataaaatagcattctcaacatatctaaaatctaaaagcacaaagtcaaccgttatgatcaatagaattagagaaaaacccagcaattttattaggtagaataaattttttaagtaaacaaaataaatccaataaataaaacaaattccttaatttaaaaattatgtaatagaattttaataaaatagcccatcgaacaacataatctgaactaaacgaccaattatgattatttatttttatttcccataattaatgtattttgatttctgatcccttctttgagcaccccctccccccgtaattctccttttccccggggggcaattcaaattgtaaatagccccgcgtcttctgccgtcctttgttaaaaatcccatttctgccagttgggtttgcccctttgtcccattttgcaccatcccttcacaaaaattcaaattcctttcttcagccggctcaactccggccaattttgtgcaaaaaattttgcagaaaatttctcacaaaatttttcttttattcaattcgttggctaatttgcatttttttgttcgtccatttttgtgcaaatttttgtcccattttgccagatgcgcttatttgtgcccgcacctcgcaaaaatttttcctatttaagcgcccccggccaaggggtcgctcattttcacttttctgctgctcctctgtattccctcttcctcctctctccatcttctcctccccctctcttcctaattaactttctctctctctttctttcttcccctcccttttctctcgctccgcttctcttttttgtctctctcgtccttcctcccttttctctctcttttttcacttccccctcccatttcccctttttacctctcaactttccttcttttttcctctccctccttttccccctcgaaaatatttatttttttttgcagttttctattgtttataaaaattgaaaatgggcttcgaactcttggttactgagaccaataaccaagactgctggtatgtgccggagcaggaaacagatagaattgtgaaagttagaggcattgcggcaggactgatgggcaccacgggggagaatgtgcgtctccttttgaatggtaggtctatttctggtggcatctattgatgataaagcgtatccccatttaggacgaccaatggatctacaacgcacggtcgcacagtatggactccaccaaaaaagcaaagtcactgttgagcgcttggggggcgccgggtcgtctgcatcggggaatccgaaaagcccaagatgattttgacgatgacctattgcgatgatttttgtaacatgcatgaatgtgtgaccatgaaataggacacctgtggtgagtgcctattaaactttcccctaatattgaccaaattatgaacaattaaggaattgtccaccccttatcaaaggggctatggtgcagcacagcggggagcgggcgttggtgacgtgtttcgaggactttgacgcttctttctgcccattttacgtcgtgttggcaccacagtagggtcagaggcgttgagcactgggaaacgagtgctggagcgcgttgggaacgatggaataccgattaaggaggcgctggtcaccgagggaaagcgaggaatagacaccgtgctggacaaaggaggactgcctaaacagtttggtactggacagaagggtataaaaagaagacgaatacgtgcgccaagtcatcaaacaataattggcggacccccaatcgccgtaaagcagacaacaagaaagcgtgttcggtcggacgcctttggactctactgattagcagcaaccagcaggatgacatttcataaaatcgacaatgactccgtgaactcaatcaccaatgcgctggactttttccgcattccgccgacaaatgtcagcgtctcttcatcaaaggtgtttgaactgcttcccagcaaccctctgacggacaccccctaccatttcaaacttcattcaagtcaaaattacattgacctctccaaatgctatttgctcaccgagttccgaatccggaaggaaaatgcgaatggtcaacttatggacctgaccattgacgacgaaaacattgcgccaatccagatgattgggcaaacattcatccgaaacatcaaaatgagcatcaacgggcgtgaagtgttcaacgcaaatgcactgatggcctacaaaacctatttttcacatgaactctcctactcaacaactgcaaaggactcgcacttgaatgctgcaggctattaccgggatacgggcgagacactggagacggggccgggctgcattcaacgcagggatttgtttgccgaaagcaaaacagcccaatttattgccaaaattgataccgacctattcaaccagccgctgtacttgattaacttttgtgaattggatgtcgaaattttgccaaatgacaacgattttgtgctaattgcacccgccatcggcggtgttgttcctcgttaccgtttcgaggtgatggggctcaaaatgtatgtgaagaaggtgtcattaatggacggattagcgctggacattgcgcgaaagcttgagataaagcctgcacgttatgcagtaaggaaaactatgatgaaatcgatgttcatcagtcagggtcggttcgagtttaccgccaatctgttcatggaccaaattccccgccgcatcacaatggggcttgtttcaaatgccgactattcgggcacaatcacgcggagcccgttcaattttcaaccgtttaatgtgcgggaaattgcgatcatcgccaacggccgttcctacccccaggccccttacgatttggactacccgcatggcaaatatgtgcgcaatgtcaacgatatgaatgaggcggtcgggttcgcaaact

SEQ ID NO: 392 - DNA, 3766 bp, Heterodera glycines
atccagatgattggcaaacattcatcggaaacatcaaaatgagcatcaaagggcgtgaagtgttcaacgcaaatgcactgatgccctacaaaacctatttttcacatgactctcctactcacaaacagcaaaggactcgcacttgaatgctgcaggctattactgggatacgggcgagacattggagacggggccgggatgcattcaacgcagggatttgtttgccgaaagcaaaacagcccaatttattgccaaaattgataccgacctattcaaccagccgctgtacttgattaacttttgtgaattggatgtcgaaattttgccaaatgacaacgattttgtgctaattgcacccgccatcggcggtgttgttcctcgttaccgtttcgaggtgatgggactcaaaatgtatgtgaagaaggtgtcattaatggacggattagcgctggacattgagcgaaagcttgagataaagcctgcacgttatgcaggaaggaaaactatgatgaaatcgatgttcatcagtcaggatcggttcgagtttaccgccaatctgttcatggaccaaattacccgtcgcatcacaatggggcttgtttcaaatgccgactactcgggcacaatcacgcggagcccgttcaattttcaactgtttaatgtgcgggaaattgcgatcatcgccaacggccgttcctacccccaggccccttacgatttggactacccgcatggtattttaccactctttgtgaaaggcatagggaatgattgattattttattataccacggcgcacgttgcgcgcgctgttggtgcctgccgcatatatacagcgagctcacgcgggaaaggctcacttttttcgcaaaaataaattaaatatattaataaataataataatgtcgttggaagaccacaattattgcggcgagttgggcggtaacgaaacgcccacaaagagaagaaggagaaatgacgatgatgatggggagggagaaccgaaatttcaaaaaaactgcattcgcacactgagcgccgacaaacagtacaaccaaaaattcaaaatgcagagcgtaaagtcgacttttgtcatcgaaaatttgcccgccaaccctgagtcaatgctgcgcacattgttcgctcactgcatgtcaaccgccttggacgagtcccagcagaacggaatcacaccggatcaattgggcgctacaatctcttcagatctgctaaatccgagcatatggattcctatacgccgcatttccgacaacaccgccgactcaatcatgaaccgcttccttgaggtggcacagtcaaaatcgcgggagggctctctgtggggctcgccgttcactgtgaccatcacaacgcttgatgttgcgcagctacctcagcggcaacaggtgcgtggcagtgggaaaaggaccgtagattcagtgcaacatgtcgtcaaagaaagtgctcttctgcgaatcaacaacatcgatgatgcttattgtcttttttacgctttggaggcaagcaggaagtaccacatcaaagagatgagccgaagaaatttctgttattatattaaccatccgaacgagcgacgactggaagacgtgtttggactgatgagcagcgtaaacattcgcacagatttgagagaatatgatgcggttgtctatgtgccgattgtcgtggactattggaatcggaaatacgcaacaacaaaccagcgatttaaggtgttcatttttggcgtcacaggcagctatcgaccaaaatttcaatatgggccggacaattacaacatcgaaatgccgctctaccatcacaacggccaattcgacggaattcgatgtggggtgggcaaagcggtatttgggcgtgactactactgcttttcgtgtgagtgcccctacgataatgctaatggtcacacgctacaatgtaaagcaaagtgcataaattgtggccgcataggagtggggcgaccgtgccgagcggatgacaacaacgacagttattacagagaatgcacagcatgtggcaaggatttcatgagccaagactgcttcagtcatcatttgtcgagcaatgtgtgtcaacagttcaagaaatgcaaacagtgcggagttgtgtggaatgtcagacaaaaccgacgaaaaggacgcagcggtcacgtttgcggtgagaaattctgctacacttgcaaatgttaccataaaccggagcggggctgcttcatacagcagttgaaggcgcgccgccccaaaaagtacagactgatcgccttcgactgtgaaacaacacagaacacgcgaattgagggcgaccgcagacttcattctgtcaacttcatctcatgctatgtcgtctgcaccaactgtataaatgaaaatttgtggcgaaattctctacaagcgccatgctgcatttgtgggcggcagcgcaccgtcacattctcccaccgtgcctatgaacgcacccaaaccgatgcccaattcatcactccgtgtccaatggcggcctttgctcaatggctgctcagcgaattcgatccgcgctatcccacaatgctcttcgcccatttcgggggtcgctttgacaacattatgctgtttcggcagttcttcctcaacgggttttgtccacagatgatccgtcggggtaacaaattatacgaaatgaaaattgcgaggggcgaaaaaaacccggaaatcatcgtaagagacagctggaaccttatgccggtgccgctcggcgctctgcccggagcgtttggactcaatgtgcaggataaggagttcttcctcatttggcgaatgttgagacgaattatgggcacattctgcagtcgctaccgccaaaagctgactacttatacggtggaatgacgcccgaccggcagcgcagattttaccagtgctacgcggaacaccgccatcagcagttcgacctgtgtgaacagctcgcagcctactgcatcaacgacacgcacatactaattgaggcgttggtcgcatttcgaacggagttcttgacgattattgacccacttgagcgacatggatgcttggatgacgacaacgacgacgaagaggaggaggaggtggaggaagaagacaaagacaatgcatttgaagtgatcggcgatggcattgacataacgtgggagccgatgaccatcgccagtgcctcaatgagacattttcgactcaatcacctgaagcgagaacagctcgccattgtgcccgagtgcggctacgacacgacaaacacgcaaagccttgtagcgctcaaattcatggactggtacgccaaaaagaacggggtgagcatccagacggcacactcgcccgacggagagaaaaaaattggccagtacactgtggacggatacatcgcggcgaccgacaccgtgattgaggtcaacggctgccactggcatgcacacgaccatccacgtcaccgttttcagccccaaacagtgatggcgaatgggaaaacggcgcagcggatacgggaggacgatgcgcgacggctggccttcatcacatctcaggtgcaacaagtgctcgtattttgggagtgtgaaatcaacgctgagaagcgctacaacgacgaaatgaaacgctcctttgcgcagtacaaggacagcggccctatccatttgaaggactgctaccatggaggacgtgtgggtccgcaacgactacactacgaggtggcggatgaaatattacgacgttcgttcgctctacccccacacgaatg

SEQ ID NO: 393 - DNA, 1550 bp, Heterodera glycines
tgttagaaatgttttataaaaaataaataaataattaaacatttcaagttacattaaattttaatattaaaaaattggaaaatatatatttttttgtttttttagggaataataattaaaatcatgataaattaaatattaaaaagagaactaatggcctaaatgtaatactttctaggaagcgagatgatggaaaataaagtaaatatttaaaaataagccgactatacattacgaatttataaaagcttcaatttaaaagagaataaatatattttggaaaattattgcaaaataagtaaaaataaataaattaaaattacaatatgagaaaatatataactaaaaaatgtgaagttgttgtatccgcagcaatcaaaatttatattttgtgcataatgtaaattgccctactttccccgacccaatggctccttcgttcactgcgacacccacacgaatggctccctgaaaatgcgacaccagaaaatccgacaccggcggaaaatgcgacaccgtaaatttttttttaaaaaacagaaaatgcgacacccggaaaatacgacaccaaaattagatttttaaaaattatttttaattttaaaaatgaaaaataaatcaattattattcctaaagaggttcttagttacgttttaaaaactataaacatgaaaaatcattgatttttgtcctaaagaggttctgccattcggttggaaattgcgcgcaaatattgcagaggatggcgattgtttcgcgtgacgtataactcattaagattcatgtcttggtccacataattttgcttgcgtttcattcccttgccacgtattccatttgctgggttgtttgcaaagtctttaacttgctgacgccaatggctttcttcttgccgaactttccgaagaaaaatgcttagacgtggcgatggtgaacggaataacgcgttcagatttctgtgccaagcttcaacactgttattggttctgtagaggtcgccttccaccctatcatttacaaaattcagttacttattatttggtttttttaccgatctcacatgttccacaattccatcggaaacaaagctgcccgattttggtttgctgataatcgacaggagaatgggtggggggtatgcaaaaatcgacgggagaatgggtgggtgggtaaatattttgagggaattaattgccgatgatgaaaattctcgtccatatgcaaatcggaaactgataagaattttttgtattatctgctgtccactttactaaagggtcatgagaattgtcttgaactaatcatagttcattttatattatattacttaaatcattttaaattatttttatagctcaatgttcgattttaaggaaaataagtagttcattttcattttttaaattaaaaataattttaaaaatttaatttaggtgtcgtattttcccggtgtcggattttccgttttttaaaaaaattctacggtgtcgcattttccgccggtgtcggattttctggtgtcggattttcttggtgtcgcattttctgg

SEQ ID NO: 394 - DNA, 971 bp, Heterodera glycines
tccttcctcgccccattccgtaaagggcgaacccacaaagcaccaccaacaaaaccttaactcaaaaaaattaacgatttatcattgtatttgagaccttagattttcgaaactttaatcaaaatttcaaatctaaggtctcaaaaaaaccagacaatgataaaataaatcatttttgcaaatctgatatcatattcgtgatcagaagggccgaaaatcccgggttgtttttccacaacttaaaaattaccaacaaaagtgttttttagggattaggggttgaccaaacgaaaaaacaaaacctgaagagcctcaatgaacgcctcagttccgggtttgtggttgttgacgaggtcggctttgttcggcacgattttgatgaagagctctttgccactctccatctgagaagggtcggtcagagcctggtagtggatcttgtccagagcgtcagatgagtcggagatcagctcgcggaggaagatttcctaaaccagattaagattttaaaaactgattagattagactttacgggttaattagactcccagagcatttcccattttaaaaccttgttcgagtaggtgttgatgatcaggggcatctccgcttggaacgaaaaggtttcgccggattgtccagacaaaatggcaaacatgatgaaaagcactggtgtagcaatgcagtgggaaaaagtcattttgggatatctaaaaataaaacatttaaataatatatattacattcctaaaaataaacaatttaaattatataaataattctaaattagataaaaacacatatttaaaatagataaatatatttaaaatagcattaaataagccttacaccctacggcccaaccccagcaagcgtccctccacccacagagtattgacgcgaaaattcaaatttgaatttagcgccaaaaattgtaacaaaagtacacgggtcactactcatgagaatt

SEQ ID NO: 395 - DNA, 8516 bp, Heterodera glycines
  misc_feature (37)..(37): n is a, c, g, or t
ggaattaaagtcaaatgactttttttgctgactccanaatgacccttaaaatgacttcaaaggggggtctacactttgtttgaagcttctaacatacatttttttgtgactttttttgacttttttacactttttgggatttttatgccttttttgcgtttttgtgacttttttcatgacttttttgttaaattcccatccctaataataaaattatttattcaatcattttgattcaatttatccaatattattaaaaatatgtcccagagagattcaaaatttgcatctttgaattgatgagaaataaaatttttgctgttcatttcagaaatttcggtatttttcaaaaatcctatgaataagagggatgcgtcggtgcctaaaggcaccactggaaaaatggaatttttaatgagatttgttaacagagtccaaaaatagctaagtttgtgtctatgaaaaagtgcaaaaaaattcaaaatatgttgaaaattctaaatataaaattttatttaaatatttaatttgatttaaaagggtaaaaagatgaggtgaaatccacagaagtgtgttcgaagtaaaagattctgtccaaaactccacaaatttcggaatttttagccaatttttgtaagaaaaaattggagttttagtgcaattacataattaattttgtctaaaaagttcaaaatttgacagtttttaaaagagttttagagagtagacctgggaaatttctggaaattatggagtatttaatgcgatttgttaataagaattttttgcgggtttttcctaagaaacgacaaaagcctcaaattagtaacctaaccctgttttgatactaaaaattaaaaaatcattttaataatgagaaaataaaaataaaatcgattatttgatgccttaattgttttttctacgaaaaaaaaattatttcattgagaaaaataattggcaaagaaaatttattaaaaactttgaatatgaaacgcatggaaaatttctaactttttcataaatttccatattggaatttttaaaattagcacaagtcttaggaatacgcacaacgcgacctctgatttttaaatttacgaattattattattatttatttattaattacctccgttttgtctcctgcattttcttccttcttcgttggctcctgaaaagtgacctttttctgcttcttttgctgcttcaattcatctcttttgtgcttattcggcaattgttggttcattttatcgttccttctcagcggctatgaaaaatgatgagaaaatttgttaaaaattaattttcgataacaaaaagaaatcgtaaaagattcaaaacttattgtagggatgaaaaagtaaaaacttttgaaagaaagttttaactgctaatatttctcattttgttaatattatatagcatttttgattaaccatgagcgaaatattaaccttaataatgagaaaggacttaatcagcaacagaatcaatcagaaaaattagattcaaatgctttgctgtccaatttttattatttttattaatatgtagattgggttaattatatgattaaccagaataaaagaagatacacaagtttatattaatatattataatattttattgaactctcttcatacataagcttaatattaaatttaatttaatttgaattaaaaataaaattcataatattttcccagtaaatatgcaaaagttttctaatttattaaatatcggattattacactttaaatttctctctgaaaattgccgctgtcaaaaagagttaattggcattggtactgaaatatttcgtgccgactgtgcttgcgttttgtgccaatggcactcaaatacaatactcagttgaccgcgaataagtgacaaatcaatgagcacaaagccaacattttatgtttcaatgcctggagggcattgactaactgaagaaatgggcctttgtgccgagtgttttgcttctcggcattgaccattcgcaagctgctaatgagcgaggagcaccaagagttcattcttcaagttagttaattttttaatgaaattaattgtgatttattattcctttaattaatttttatttttcttgaaaaaagaagcgaatattttttggaaatttaattatttttcatttgtccctaaaggccattgcttttgacaatgctgaactgctcgccgagcttttggctgcgcggcctctgctggccaattgccatgacgcggacggaaggatgccgctgcaccacgcggcggctggcggacacgcgaaatgcgctgagattttgctcgggtccggaggtgatttaaaatttttaaattatttttaaacttaatccccctttttctgaattcattttttccagctgacgtcgatgccgttgccggtccgcaggacacagtcaaaactccgctgggattggcctccgccatgggccattgtacggttgttcatctgctggcagaaaatggtgctgaccttttttatgtggactcggatggccattccgcgctccaattggcccaaatgggtggccatgaccaagtggccacgctgttaattggcataattgaacgaatttatgccgaggcggaacggaaaaatcaggcaaaaattgggaagcaaataaaaatggggggggggggaaattttcacttccatcggcaccgccggccccttgtccctaaaaattatctggaaaaagcgatcgcaaaaaaagtggcttaatggaggactttgtaaatgtttgatctccccccccctcgtctgggcaatttactgataatttgaaaaatcattttgcaaatttgtcggttttatataaattgtgccttttcagaggctttgtgctgcttgtgttgatggcgaggtgggccccgtgttggacattttgtccgatttgggcccgaaaagcattaggaaacaaattttgaatgggcgatatccgggcgaacaaaagtcggcactgtttttggcggccgaaaacggcagggcggaaattgtgcgcgcattgctcaccgtacagtaccattccatcatttttgagcccagcggagacacggtatggacataaatgtgaatttattactatatttggaaaaggctattaattttgcttcataaaattctttttttatgtttaccaaaaatttttcatttcggttggccttaggccttttatttttttgaaaagtttccagtcataaaatcctttccattgttagcttcttcatgccgcaattgcctctcagaatgtggcaactgttgagcagattttgcacaaattcccatttttgatggatgccgtaaatgaggaaaagaatttgccattgcattgggcatgccggtaaagcaaataaattaattaataaaagcatctaaataaatggttagtttctctcatttccgatgcggaaatgcgcgcgtcgttcaggcacttttgagcgctgaatatcccgcggaggaattgaaatttttcgcgtttcggcatgaccgcgccaattgttcctttggcaatggcactgggacaaacgaacggtgtgaggatggctatttgtttgtctgtgatctgaatgctgttgatcgggaggggagaagcgcgtaagtgacagaagaaaacaatggaggaatcactgatcggagggggaggagagggaagtgatcagaaagggggataagtgatcacaccattgatcagagtgggagaagtcagtccgttcgaaatttatttgaataatatagaggtttgaaataaaaaaatggagaaaaactggcagagaatttgagccaattcatacaatgcaacaattcaattttaacaggttctttttggccgtaatggaaggccattctgaagttgttcaactgctcgctaaggttgtcaaataaaataaatataataaacaaagaaaacataatttaatcttaaactcattaacaaaaatttgaaatcttttgagttttactaattttataaataaagcaatgaattccataaaatgatttcattttctattaaagttcaaattgccaatttccaacggcacgcgccaccgcagagaaatgctcagaattgaggagaagcaaaatctgatggaacatccaattttgtttgatggacgagtaaatggcaaaactccactaatggtacaaaaaaagccattttgaaaatgtttatttttaatttccctctaatcttaaaaggttgcttgtgccaatggttccactgaaattgtcaggtattttcagtttattaattaattccctttctgtttatttttaaaatatttgcttgacaaattcaattaaattgccaatttttcatttacatgaggccaaatttgatcagaatttgtcagaggaacgtttaattgttaaagtgggaaatgaatcagaacacaaataaactagcaaataataatttccttgcagttgacaattttgtcgtaattaattggccattcaaaagaaaaataacaatttcacgtcaatagcttatgttttctgctcagaattttggtcgaacaatgccatgtcgacgtgaattattctccgccaatgagcggcggtgccggagaaagtggcggcggtgctttggccgaagctgcaaacagtggccatttggaggtgctccaagcactgttccaccaaggggcttttgactacggtaaccgtactctgagagggcggttggccaacgatagtgggcacagtaacgcggcggaaatggtcggccttttcctgcaacaattggtccatcatgacaacgaaaactgtgtgaacagtgcaaggagtccacggcaaaagaaggaacatgggcaacaacagcagcaggtgaagaagatgaataaatggtcattggctaattatcttttgcatttcaaggaccattctctagcactgccctttgtcgagagtttgttgaatgcctccaacaaagtgccattgtcggaccatttgccgtcaacaaaaggctgccaattgaattggcaatccaccggcattcgagagcttcgctcagaatggatggtcgatgcagcgcttaaactgaacccgcaaattccgcgccatttaaggtcgccgggttaataaatgccatggcattggcactttctccgctttaaaaaacaaaatttataatttagtaaatcattggcacttaatgccatctcacgcatcgatctgtcctccaatcagttgtgctctgtgccccatattctattcacccatttgtcctcgctccgttcattggacctctccaaaaattgcattccgcgctttgaaataccgccggatggtgcgaattggcaaatgccgagtctggacagactttgcctggacgaaaaccaattggaggaactgcccaaacaggtggacaccaacactggcatttgggcatttagctaagagccatttcaaagtttaatcccttcaatttaaattgtctgttgctctcagctgttctcttctgtccactttcctcgcctttgctttctctccgccactttcaatcgcttgcgccgattgcctccgtccgtttggacagcgccgcgtctcctcgagttgcacttggccaacaatttgatcagcgaactgagtgcggctgctctttctcagcaggaattgcgcaggggaagccatttgtacaggggcacgggcaccggaggcgcgtcggcggcacgcatttcacggcaaaaacagcgtgaggcggtggacggaaggtcagcaagggaaaccgagtcaagactgggccgaaaatccgagggtcacgagtggcaattaagacgcgtctcgaacaatcaaaatttgagtgttaatttggctgctgatcagtgtcaaatttggttagcttagatcgaccgaaatggacgaagaaaatcagcgacaaagtcggacaatggcgaaacggagggaatccccgacacagcaccaacagagcagcagcagaagggagtcaaggggagtcgcagctggcgaacagcaaacgacgagcaaaagccaatcgacggacacggaggaggacaacgcaagcgcaactccgaggggagcggcgacaaacgcagcaacggtcgtggagatggacatccacaggtgggcgagaggcgagagtcagtctcgaccaaattcattcccacaaaggcaacattcacaaaactgtgagtgccattcattcaccagcgaactatggctgttttatcgcaaataaaaaaatttacaatttcggtatttctgaccaaaaaccgtaaaaaaaagcataataattaaggttaaaaatattaagaaagaaatattaaaaagcataaaaatttaaaacaaaaataaagcaaatcccatatttttcgaaattacattaattttaaaaaatggaaataaatatctgacagattggtcgacaatttttaaattttagggtgaatatttggcaagagaaaatccacctgtccaacattgacgaagatgggccgacggtggcgaacgaagaagcgaccggcgatgaattagcggcacagaaaggcaatggcagtggcacaacgcgcagtcaaagccaactccaacttctgaacctggcacaaaacaaagtcatttaaaggcactaaaaccctaaaaaattagcgttcgttcagtttggccgaatgcccacctgcttggcctgctgctgtccccgtcttgccaagttggacctttcctccaattcgttgtcctccctcggccccgtcggctgtttgccgtcggcactgcgccacttggatgtgtccaaaaaccagctggtccgtctttttgggggtgaaaatccggctcagctgaggcaaaagctgcgcttttgcgaggctcagtccgaatttggaattgccggtgcgaaaatggacggcggtggcggtggaataacggcgggcaatatgccaatgccaaggcattcgagtgagtgccgaaaagacaccttaacatttgtgacattgctctcttaaggaagtcgctccaaatccgtggccagaagccaacgttcgttgagcgttgtgcgaaagagcggcggcggcgttggccgtgctgaacagcttcaaaatgagcaggaattgttgctgagctgctgcgtgcacaaatcacactgccgttttgaggcacttaaaacgctgaatttggcacaaaattcattggaatttgtggacattttgctgccaatgggcggaggttgaaattaatttggagaattttccgaatttattttttaattgattgaaaactcaaaaatgaaaatttagttttaatgccaggaaacaacacattgttttccggcactgtttcaggtgatggtgagaagctgttcaattggagagaaaattccgaattggtaattaattacattttttaattaactcaaacacattttgaaatttctgatcaaatgatgtttgataatcttgcttagtttattttacagaataattaccttttgtaacttattaatctattttttctctcttgtttttgtctaaaattaagcgcttttaattacaagattcatctcttttgttgtcgtttatcaattttaattgttattaaaaatttcagcttaagccatatgtgctgtttccttcgttgaccaattttgacctgtcgttgaatcgaattcgtcaacttccgaccacaatttcattgctcggctccttggccatgctcaacttggccaataacgtggagctggacagtctcgtgcccgaactcggccttttggagcgcctgtggaccatcggcctcagcgggtgccaactccgagcggaggaacccacgctgcaagcgatggtccaagcaggaagctacaaaacgggcgaagtgttagcgcaactccgacaacggcttgaaaagtgatgacattgccgggggtaataagtgtgataaattgtggcacatatttaaaaatggaaattccaaggcgattttcatgctgccccatttctctaatgtcctgatgatagctgtggcaatttcgagttagttttttcgtttagttcgatgccgtacccaatgctcaagctgatgttgcttggtgcctcgtctgtcggaaagagcacacttttgcaacaaattcgccttgaggggacactgtcgaagaagcgcggctctcaaaacgatgttcttaaacagcagcattttcactaactaatcacacctaattaattaattgttttggcatccaattattatccttcccccctcccctttccttcactatagagttggcaacgtcgtcggcactcgccgatcactcctccggcaaccgtttcttcttcctctgcaggacgtggcaacaggacacgcttcaccagccaacatcgtcctccatcggcctcaacttccgctggcactttgtcctcctccatttgtccgcttgatgtgttggaatgggtgtacgaaccggcaaaagtgtcgtcgtccaccacaacaaaaagcacgacctcctctcacactcagcactgctgcagatgcttttca

SEQ ID NO: 396 - DNA, 1696 bp, Heterodera glycines
  misc_feature (8)..(8): n is a, c, g, or t
tcagcacntgctgcagatgctttcaggaccgatcacattccggggtctgggactttgacggcataaaacaggtgcttgagaaggaaagcattcaaaatttattggatatgttgacggaatgggcggagtttgtggaaaaagacgaaaaaattgggacaaagaaatggactgcaaaatgggatacaaagatgtagaacaaaaacttttaaatggcaatgcctttgcccatttcagcgcgagtaccaatccgtccagcggtgtttcttcacccggcgctgtcttttcctgctgttgtggaaagtgacggacggtgacattgcgttggccgacctgcacgactttctgctggccattcaggcacaggcgccgaacagttacgtgctaattgtcggcacacattcggactttgtgcgggagcaacctcatcgtttccccagtgactatttgagccaaatggacaagcaaatccaggtaaattgagcagagagataataaatgattagaaaatcagggggaaggcctctgatcagtaaaatgattggaaaactataagaaatgatcaatcaagataattgataactgctgttgaaataaaaccaccaaacactcgaccacaaattcaataaaatattcatctgtcgcttaggctgttaggacaaaggggcgggcaaaggatgaccacagaaatttgggctaagaatggacaaaaggagcagagggaacggcaccgaatatgggcagggtgaagaagggcgagacgaatatccaatttaaatatttatttcaaatgaaaggcacaaaagtgagtgatgatttagggattttggtccccttttatagcagaaaagaaacgtgggaggagcacttttggggaacaataagtgggaggaggcgtgggtggagtactttttttaggaaaagaggaaagaacatgatgaataattggacagaaaaacagaaaggacagagaattaccaaaaaaaccacaaattcaacaatctcacaaaatcgatcaaaggccaattagccaattcaattttttccgtcggccactgtgccgacatcatccaaaaatagcggtgaaaatttctcactgcttttcctttttgagcaacgcttcattttgggtgccgatccggagaagaacggcgttccacgagtgcttggatctctttacatttcgtgttgctcgcgcgaggatgtcagatcgttgtgtgccctcatttacacttgtgccacagaaattcggcaattttcacggggtggaggcccggcacggcagcgccttttggcacagaaagttccggcttcgtttgtattgctggaacatattgtggccgcaatggtcagaggacaaactccgttttttgccagttttgctttaaaatacttttgattcagtcagacgaatttcgtgccgttggcaaagagccaataatgcatttcaacgaattttggagtttggccactgatcggttggctcagttggaagaacaaaaggagcagcagcaggacaaaaagactagcaccacgaagcctgcctctggcactttgcactttcgtggtgcccaggactttcgtcaggcgtgtctgttcctgcacgagaacggtccgacttacccgtaggatactgtacataccgtattatggttgaaagaccacaatagaagcttagcttcaatttgtgaacgaaaat

SEQ ID NO: 397 - DNA, 6583 bp, Heterodera glycines
aggtgtgatttgctattatgacgacacctttctccgtgatttgtcttcttggacccgacatggctttgtgcaagtgagtttattgttgttccgttgtttatgaactgtttcctctttaatcgttttatttttatatttttaatttgtcctctctgtcagatctttttggcattttgtcattcgcggcacttcgtcactgctctttcggctctgccggggatgctgcttcgtcaccaccatttgtcactgtgacttcgctctcccaaatgcaccaaaattcggtcatcgagtccgtcgagctgtacaccgcactcaaacgggcagttcgccacaacttggcggtgactttcggttaattttaaataaatttgctcccacataagcttctcctctcttccggcatttctcggccctctgtcgaagtgtccttcaattcccacttccgtctcttccgccagtgtgtcatgaatttgctgcgaaagttcgaattggccatgccatttcaatatggtcgaatgagtcttttggcttcttgtctgcctgatgaatatgtgcttcgtgccgattacccgggctcaaaagttttggtaaaaaatctcttttttttaatatctatttaaatgctttgttatttcgctaaagatccgaaataaatttgacaaattgcgcattcggtggaactccgaaaaagaaacgacaaaagcaacggaattagtgccgataaaatcgacacgaccaatgcctataaaaatgtcgccaattcgcaattatttgcagcacaggcgactgtcccgcgcagtggcgacgtcaattgacaatttgaacagcacaaaattgacggaaaacaacggaacgggcgaaaatgaggagaaaaatgctgatctgatcaagattttggcagttgatcagtgcaaagaggtgaggaaaagccaagagcaaaagctgattatgggtgatgaattagtgaccaattaatagcaaaagcctaatctaatcattagtagtatccattgacaaatatgatcaatcaaacgacacttaatggtacaataaaagctgttagaaaaagctaatcattactgatcatttgataagttgtagatagttttttttattagcaatcacagtaatgaaagttttaatgacaataaactaataattatgatcactttatcattactcgcaaaaaatacggatactataggcttttcttctctaggagtgtcttcgtcgtctttacgttatgcattacattccgcccggcttttgggcccgtctcaccactcggctgctcgatgacgaacgcgttggcaatgtgttgaccaaaatgttgctcatttcccgtgcttctcctctaccgcagcagcagcatatgatgtcgatgacggagactgatcagcaacaaaaacaaccattggcggcactttggagcacagaggcaattgttgcggcattcggacgagcattgaacgcgggacgaatggtcaatttggcacagcgaccatcgatcagacggtgattattcgaatcacaaaggattaaaaaaatttcgataaaattcggactgagtgaattaccattttgaagagacgcttccgccgccgatgaaatggaaaatgtgccggaggaagagacttcgtttattgttgtgaattcggcggaggaaatgactgaggagttcgccttcaactccaataacaaaggcaacccgtcatcgtcgtcgtcgtcgggcgggacggtggtggtcaaatgctgcgagcgcggcgtggaggcgacggacgaacgttgccgcggcacaggcggaggcatcggaaaagttggggaagaactgggcaatgtgctcgaatggatgttgtggcgaagcggtgttgaggtgggcgaggcattttgggcagggtagagtgagtgaggtagggggcaaaatctaaaaatcatacggtagaataccaacatactgtaaaaacatttcgtgattagacccgatattttgctgattcgcttttcttaagattcgctgttttggcacttttttgctgtccttgcgccaatttcttccgttggcttccgtgtcggacgtgaattacgcctcccacgagttgcgacgtcgttttgaggagggacaatgggccacactgagcacaccaacaacgacggaccaaccgaatcagcatgtttcaccttcaccgctgagtcacatgatcgaactgttaataccgaaggttctacaggcggacaattgcttttatttttaaaatgattttgcttcatttctaattaactaattattacttgggattattttccgatttaacttttaaatccaacactatttttctcgcacagctgatttgctgatttctttggagcatttaattatcgctttcagattcgcgtccgctttctttggcacgacgtcgcctggcagttggagacggactcgcgcatggccgcccgactgttgtcgctgctgaccggcgcggtggacgacctgctggaggacgcgtacccgcagttgggcacccgcttcatcctttcgccccaaggccgtccgcttgtcgaccgactgattccgtgcgatcgctgcgcaattgaggccatccgcgaggaggagcggtattggctgcgagaaaacatcaacaggtgctgaaaaaaacaaatgccaaaaatgcagtcaatgaaaggcattcacttctttaaacagaaacccggcagggagaggagggggccaagcagagttgccgccccgtctggccaagtcaaagtccactaaatttaaaaacaacaacaattcgccaaagaaagcaagccgagtgccaaaatcgaaatcgtccacagaaacgccgttgagtcaaacatttggcaaatcagacgataaaacaacggcagaaaattccggaaatcgtgcgaaaagcaacagcgaaagccgcattaaaacaacggcatctcagcccatttatttgttcggcgttgaggaatgcattttggaagcgcggagagtgctgaaaaatgttggagaaaacggtaggagagttactataccaaggttttttaaattttacgttccagaaaaaaatgctgctggaagtgggcacaaagaactaaagcaccagcgattggaatgtccccgccatggcattgttcgttgggatagaaataatcggcaaactgaggaatacgcagcgtcggcaccatcatcatcttcattagttgtgcccgatttgtccaaaatggggccggatttgctgtttgttgaccttgaacatgaatggtccgcttgataactctgttaatccaatcactcgtctactcattccaatctccccagcagggctgtcccttcggttagcattcagcgagggaaattggtcggccgtggtgcgtttggcttcgttttcaccggaaggttggcatttgtgccaccgtcttcgccgtccgcattcagaaaaatgacaaccaacgaagctggaacattgagttcgtatagggaggatattatttaattgggaaattgagactttaaacggattgattgctatcgcaaattaacagacaatgaagcagcagcggtcgttgcgctgaagcaattcgaaccggtggacccgaacaacgaggacaacgaccacgggttggccatgtgcggggccagcgaacaagcggcgatccgcgcatttgcgctcaaatggcaaaacgacgcattggagcaggtcacgcgggcttattgtactgcccgacaggtgccgtgttcagcaaattgacaatggcatttctaaatcattggtccaaccgattcaaggagttgtgcatgttgtccgaacttcggcactcccactgcacgtcaatggtcgcattttgtccatctccgatgactttgctgatggaattggcaccgcatggatcgctgaacaaattgttggccgattatcgacaaaatggccaaaagctgcacttggacactgtgcagatgagctgtctgcaaattgcacgtgcgttggagtatttacatgtccaacagcacatcatttaccgggtgggcaattttcggatatttctgaatttttattttcaatttttcgattcctttcaaatttataggatttaaaaagtgaaaatgtgctcgtctggcgctttccgcctccctcagaattctccggtcgatctgccaaaaagccatccccgagggatgtgttggttaagcttggcgattacggcatttcgcgcttttcccatccgtttggcatgtgtaagggatacggtgggactgaggtgaaaagagaggaaggaattctggccaaaaaattgtgtgatttttaattccccttttaagggatttatggcaccggagataatgcgctacaacggcgagcaagaatactccgagaaggcggactgcttctcattcggcatgttaatctacgaactgctgacactgaaacagccgtacgagggacagcccgtgcaacagatgaaagaacgcattttggaggcgcaacggcccgcaatcggcgagaaggagctgctgttcggcacgaacatgtggggcgctttcctttgactcatttctctctccccttccctaattccttcggtttcgaaccctaataaaatattgctctaatttaaggcttgatttgatgatctcctgttgggaggagagggcggaacgacggccaagctccagtcaattagttgaaattgtaagtcaattgcccatttttcgtaaatcccgcttaagccgtaagcaaagggtggacaaaaattgtccattaaattcgcaaaatatttaatattttttaatttctgacgttttaatctcttttcccattttcctcttctgttcagtgttctgctcccgagttttcccaccttttggacgttgcgctgctccgagaagacgaaaatgggtccctttgtttggccatgccgtcaaattccggcgccgccttaaattatgccaatgaatggtcattttggattccaattgagagggacaatagcgacgaaaaacagccgcaaaaggggcaacaacaatcggacagcaaaaggcggactaattttgcccttctcaaatgcaacgaatttggatggacagagaaaaaggcgaggaccgattttaaattatataaaatgaatatagaaatttttaatttatatttaaacatatatatattactgcaaacaacaaagtccaaaaatataattaaaggaaaattttaaataaagtggaaaaaatatttaatgctttaataaactttaaatgctagtaaaatgaaattattaatataattttatctaaaagcatgaaaaataaaaaatatatatttatttaaataaacataaatattggacttgtgttttttacagcacattagcttccaaaacggtcaaacagaacaattttcaccctccaaaaaacaacgaatttttcaacaacagcagcaaagcccacggaagaagaacattacggtgcccaaaattacagtaatcgcacaaatttatgacgaatttgtgtggacgggcgacgaattgggcacactgagtatttttgagcaggatgaacaccaattgttgatggtcgaatttgaatttaataataaaattcattaaaatttaaaccatttagacgaattctgccgcccctctttataaaattgacaccatcgaaatgctggaagaaagcagtcaatcgaaaacagaaaaagtcggaaataaatggaaaatttaaaaaatatagaacaaaatgaaaattcaatgctttgtgtttaaggaaataccaaaaaatgcaatttttgccaattaaataattaatattcgtaatcccttcaggcttttgttcatccgccattaagtcgcttaatcacaattgcttcttccttgtcgtcatcttctgctgtccgtcacatcgtcgccttccgcgagcgtcggctgatcattgtcggactcactgtggcggtgcttttgtgccgttggcacgggcgggaaagtgtgccgcaactcatctgctgcatccctctaaatccaagtaggctgacccgaccatccgggtcatatgccctaaatgcttctccctcattcagtttttcgagactcttgtttatcctaataatatctccttttatcatttgtcaatctttctccgtctttctcgagactcccgactttcttaatcccaaaaatgcttttccccgccccgttcagttccatccctcggtgcttctgatgccagtgctgtacatttgttctccatggccgttctgcgctcgttgtccgactggcagttgtggaccgggcacgcggccggacacattttcatgcatttcatttcgtcagccaccgatcggctgaccttttccacctcggccaatcattatgccatggccgagaatgaggacttttaccaacagcagcagcagattaaaaagcatcaaactgcggcaccaccgatgagcagaagcaatgtggcatttctggcggcaagcaactgcacaaaggtgcaacaaatttgaggggggaggggtgattttgaaaaaataaaaaatatatttattgtgttttgtttttagaatttggtttggtctgccttgga

SEQ ID NO: 398 - DNA, 4274 bp, Heterodera glycines
  misc_feature (4231)..(4231): n is a, c, g, or t
ttcattactgcgttggaagtgatggacttgagtactttcggcactgataaagaaagatggaggaacgaaaagggcgacgagggggaggaagaggagcaattattggttggcacaagcaacggagtggtgctaattgtacgcggaattgaggtaattgggttgatgattgttggattggcatgatccaactctgatgattagcgcattctcttctcagatgtctccgatcagtgcttttcgtcccttttgctccgttcagcggatcatttgctgtcctccgccatttggccaatcgtccagcagctgtcgcattctccaaaaggagctgcttcattcgtcaaccaaaaaagcgcccttgtcaacatcccaatcaaatgtaatatttaataaatgtgccattttgaaaatttaaattttattttccatgttcattcttaaatacaaatgctttaacaggagatgatatcgcctcattcaccgcccaacactgaaaggcattcctccaagaagcgatcactgctgatcgaaaaatcccgttcaataatgctcaaagcaactggtggtgctgtagccggaactgctgcaggaaacggcgaatgccaaggccaacggccaaaaatgagtgcttcaattccagcggaagaaggaaagcagcagcagcagcaggtgaagcaatagttaaacaattgagaagatgaatttataaaattatatgactagattttgtaatttttcagttaaaaaattattattttgctaatgaatgctttttcttgcaaattttaaattaatttgaaaaattattagctgatttttcgtataggtggctttcgatttactaaacgcgtcagtttcggcggtagacgaactgtgcgaaacggtgcggagcggaatgcgcggcatttttacgtccagtgaaagtgccgaagtgcgtggcacagtcgccgataaaggaggaggaggagaagcatatttcattagcattggcaaaggatataggtgagtaattaagcaaattttttaaatgattttttgattctattgaaacaatttctgaaaatatcgtttcttgtgaatgaagtttaatttaattatttcaaattgtgtttaaggcctcttctgagtcgatttgtaagctctgctgaactaaaagcattgccaaataaacacagcgaagaaaactgtgccattttctttcggtcaacgacagaatggacaacggatcagcagaagaactgattgaaaatgatgcttttcaaaaaagagcttgtaaataaatattattcaatatctcaacagatgctttttgcgcatatgtaaataaaagctaattaactgcgaaattaaatataataaatatatttatttttgttaagacaaaaaacacaaaaagaaaaccattcattaacaaggcaaatttttaaaaccgtcaagaggcttaaaaatgtcaaaaaaggcaacaaaatggcgaacataaacctaaaatggcaccgcgccgacccacatacctgcttaacttttattaattaactcagattcgtagttttttggccaatttgctaagaaattggggcaaaattaataaaaaatttatagttaattttttattgccaaaaaatttgggacagtccaaatttttgaattgaagtttttctcttatttttttttgcttgacttttcataaaattagttacattttttagtttttcgttgctggcgtctgtgccaaccaaccaaaagaagaagcagaagagccgtggtacatcaccatgatgagaggcagtaaagcgagaaagtgccagcgaatgaaaagcggctgatgtcgctgctggcaaatcacattcaaaaaaaatttttttttacgatttttggtcataacttttttgaaaagcaataaaattttcttgcattttgcagatagataaagaaggttaaatgctctcgaatgataccaagaatgttaaatttggtcgactttaacaaaagttatgacgattttttgtcgaaaaacagtacgagttggcctactacgagttgggtttcgtccgacagaaatatccatttccagcgagactcaagtgcccactgccaaaaagggaaataaattattcggcgctatacagtgtgttcaattagaataaggacgccctatttttgggagtttgaccacttcacatgaaccgatcgagctgaatttttaattatacgtagcaattctgaaaatattaagatcagggatggaatccgtccttgaatggcaaggacgtccttgaaaatgagcatttggaaaagtttaaaaaaaatcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggacccccctatcctcaaaaaattttttaaaaagcgcgccgtaaaaaaacccattttataaacaaaaaaagtcgttgcatggcttaaaatcgcaaaaattaggcagtttttggtgaaaatctgttaacaaattgcattcaaattttcaaaatttccccccccctctgtcccacaaaatttttggaaaaaatattccctatgaccaacggctccaattttttaaattagctactcttgaaaaacgaagaaaaatttttgacctcctaactacttacaaaattttacatggttttacacatttggacccaaattctgtttaaaagaactaacctaaatactcgaaataagtcatttttccggttaaatgttaaattacaatctaaaaaatcttccaaatcttttgttaacagatcagtcaaggcctggaatgcccttgataaaacgttaatgtctagctccttaaacacctttaaaaaattattagaattgactcttgattctcaaagcaccaatgtataaagcaattattaacttttgaggcatttttttttttttgactttgacttccattttattttttcattattgtttgttttaacctgtgatctcactcgatatttattcacttactctgagactattttattgtgatcagtcatcagagtaagtggtctccgcccttctgatggcaatttttctttatcgataaataaataaataaaaaacaattccggtgaaaaatacaagccatttgaataaatattaaccattttgcattgcatataataaaaattttaaatgtccttgaatttcatgaattttccccactatgtccttgcaaatcggcatacccgtccttggaaacggagcatggacgatggcaaccctgtttaaaccattttggatcaaaaatctgaaactcgaaaaatttggattttcgaatttttgttcgaattcagatccggggttcgaaattcgtcgaaatagatgccggattcgtgatcagcggcgacaccgaaaaccctgggaaacttgctttcatgtcttttgaaaacaaaaaaaaattcttcaaaaaaggggggggtaccatcgaatgtattaccaaattctctacaaattcgagtttattggtcctttttagccaaaatgcaacaaggtctcaattgggcaacacgacaaattttgcgacacctcagcagagcctcacaatgactttttcaacgccgcagaacaacaacaatttcaacaatgagataaacacacagtgggaaacacgacgaacacacaacacttacaaatgtccgttttcagaaccgtcgtgaagaggacgaggacgcggcagcagacagtcacaatggaaagcagcagccaagtggcgactgaagttgacgcggtgttcagccaagtgctgaatgtaagcgaatgccgtgaaagatggcaccgcttttctgacaatgagggggtttcaattcgtatttttccaggccaccccccccccaccagaaaaccaaagaattgtacacctttcacgttttagatccctcacatggacaacccgatcgaggagctgaaacgacaaatgcagaaattattcattcaaaaagagtcggaatgggccttcaaattgaacgaggtgaaaaattgcaaaaattcattgaaaaaatttacaaggtaaaattgtcttttagtcgagagagaaagtttccganagaataggccctttgcaaaatcaaactgaactcaacgcaagcg

SEQ ID NO: 399 - DNA, 1831 bp, Heterodera glycines
ttattcctccttgacctcgatttctcctctctcgctcagccaattccatttcgatcagcgtgaatatcaatcgaacgaaaaatgaatgactgatggggaggcaaaggggtaaactaccatcgtcagcagcagaattggagccaccgctcttttccctatgcattcattgcctgtcaccctgctcattcacattccaccgctgattaggcattgagattgggaaagaatacataaaagagagtttcaccttttatttctttggcttttaatttaatattttataaatttataatatttctagtaatatccaacagtttattgcttttagaaaatccataagcaaaaaattctataattaacaacttccgacagtaaaacaattgatcgcaattgcaatttctaaatggcttcgaaagccgatattactcagctggtaagcgtacaaaatttttaaaaatctttggccaaaaattcagcctacgacatcgtccactgtccaatcgcctgctgcgcttccctccgccgagggtagtgtcaatccacgtcatgcttcgccttcctcacaaacgagattcgccgccaggaagaccaacaaattaaataaatccaataatggcgccaattcatcgcggcgacctcatcaacttgaaaatcaaaacacatccgagtcactggcattgtccgcgttcgtacagtcatcgtcatgttctgcgaatgaccaagataacaatttggatggtaggaacagcctgcatgaaaattacgacaactacgactctccatcagttggagcacctggaaatcgaatactaagcgaagtaacttgagacatccaatattcttctgttgtatatataacttttactccagaccaatctgtacattagaggactcgatgaggaatgcacggatgagagactgcggcagatgtgttcaagatttgggaaggtaaagatttacttaatgttgtctaactttccaaaaaccagaattttttctgggtctatcaaaaactccgggtttacttcctgacaaacgattcctgttttctttctttttacagattgtgtctacaaaagcaattctcgacaaagccaccaaaaaatgcaaaggctatggcttcgtcgattttgagtcttcagcttcggcacgagacgccatcgaagggctcgagaaagagggaatcagcgcacaaatggccaaggtggcgtacacacatctttcctgaacttatatacattttagcaacaagagcaagacccaaccaatttatatattgccaatttaccacctgaatataatgaagacaagcttactgatttgttgaaagaattcggcatggtgatcagttcacgggttctcaggtcacaaaatttaaaaaaaaattttacttaaatcaaatgttttagacacccagacgggtccagcaggggggtcggcttttgtcggatgggctgtaccgactcatgtgattctataattgcggtcagtttcttccgtgggagcctttagtaaaaagaaaagttttaccttaagaaatacaacggtcggaaattgcctaatgcacaagctcatttgatcgtcaaatttgcggacagcagcagtcggaaatttaagcggtctacgccctctttgaggtccgtctactcggagtcgtgctataaacccaaagggggtgttcctccgctgttgacaacaccgttcattgaaccggtaaacccacaaattcgaattttatatgttaactccgtttttagacctttaaccagactgggtaccaattcggtggaactctgccgaacccttctgctcactatggaccttcgtttta

SEQ ID NO: 400 - DNA, 2165 bp, Heterodera glycines
  misc_feature (2120)..(2120): n is a, c, g, or t
atctaatctaattctcaacttattccaagctcttgctctcgaaagagccacatacaactgtccatgactaaaaacttcttttctcaaatcaacaccaacatgctcaagtgtttggccttgagccttgttgatcgtcattgcaaatgctaacaccaatgggaattgatgcctatgcaagtcaaatgggtactcctcggaacagcaaaatgtgatccgagggatatacaccacctgaccagccttatctccagtcaaaatcttacacacaaccaaattcggctgcatttcttccactttcattctcgaaccattacaaagacccatgtctatattcaaatttctcattaacaaaactatagcatttttctttaatctcaacttatgccgtggaaaccccgaagggtttaaggcattcaaatactcatccaaatactcatctactctttgcctattctcatcttgagctatatctatacttgtataaacgacttcttctccaggcaacatatccaaaactctattattcatttcactaacatcaacattatttggtgctaaaatggcactttttgccatttcattccaattctcagaaacgatgcaattgccgaagatctcttctgataaatctccattacaaatacaattctcgggcaaaatcaattcatcattttcattgttcaaatttccacatctaatttctaataaatctctcgcaaattcttgctctgatgcgagagctctcatgttctttgtcaatctatatctcttggctaatctccaatactcacttctttttatcggtcgaattgaccaactcagctctggtggcatcgtttctgaattggatgggtttgacgaaagtctcccgtccaaagcataactttgccgccaaaagcaattccattattcataatctctctcaatttctcatccaaagttcttagcgcccgtttattaatcataggcgcctcatcacaaataaacaaatctgtttctttcaattcttgcaaagctttggatcttggaccaatacttgaattactcatatctaatgtcaatccaaatctattgtgcaatgtcctcccggtaggcaacaaagttgccgctataccggtaaaagccattgtacaaacttttttcttctgacctctaagcatgtgtacaatagtgttgttcacatgcgtctttcctgttccgcccggtccacttagaaagtaaaacgcgggttcattgacagggttccaaattcttcgcataacatcatcagtaacttttctctgttcatcatacatcatagcataacttctttgtcctaaatctaattcttctgctaaatcaaacacttgttcaacgtcatcttcaacatttatctgttccatggttggaaaatcggcaagcgtttttccagccctcataatacaaagcacaatttctctataagctttggcatatgcaatttcttgcctaaatctccggctaaaatcttctgataatgcatctttaaacacgttccaaagttcctccggcttggccgggttacaatggactaaaatcaaagcaaaaaattctctcaatttccatggcatttcaaaagtctccgcttcttccaatgctcttttccattcttcatcatttctaatcaagcctctttccaaacaggcagctgaaaaactttcacaatctttaacagtgccattcaaatctataactattttcaaatgatcataggagcatgctcctctcacatttaacaacaatagcctcaggtggtatcgttccggctcagccggcgacactttcaccattctaccaattgtgttaaaatgtgtctttctctcagtccattttcctttcttgaaacaaaacttctctggtatctggtgatacaacagagtctttgctagggcatttgtcttattcagttcaaaataagccattaactcagaaccgtttgcaagacgttctctaatctcttcttcttccatattctcatcaaaatagcaaatctgttcaccttgcaagtgcacaggcaaagacataatgctatggcttcggtcatacatatgcaattcaaaaattctccatactgcttccctgcggcaaacataccgcgcatncataaattctttacttcatcatggtcatttttctctctaattcca

SEQ ID NO: 401 - DNA, 2296 bp, Heterodera glycines
ccttttggctcgcacaacatgggcatgcggtgagcaggcggcccgtcagttgcttcaatccgccaacctgccgctggatcggcccagctacggggtggcggaagctcaacgactccagcacacactcgactcgcggctcggcgcgcagcaagtgcgactggtcatcttcgagcgggagcacggctgtcgcgtgctgtggaaggccccgaatcgggcacacttcaacatttgcctgctgctgcaacggagtgcccactacggatacattcagcgtccacaacaactttttcgggtaaaaaattttctcatttcattttgtaaagaaacgaaacgcaaagcaacaaaacgcaatgaaaaaattcaaagaaagaacgatccgctaagaaacgaacaattaattaattaaatacgaaaagcaattcaacgcaaagtaaaaatttaaaaaataaacgatagtaaagccgcagtgggacatttgcggacggacatttgcggacggacatttgcggacggacatttgcggacggacatttgcggacggacatttgcggacggacatttgcggacggacatttgcggacggacatttgcggacaattcctgagaaaaaattaaatgaaaaaaattttttttgttataaaaatttctaatggaagagtgggcctcgtcagtgcggtgctcttccaaaagaaaacaaaaaataagaaaaaaagtgtgtttcggccctaccgcagacacacaaaactaaagaagcacacatcaacaaattaaaaaatacaagccaaaatatttttttaaaagccaaaacaaattaattcgtaattatttaaattttttattaggcttgctgaaggccccaacaacagcctatttttacaattatacaaaataattggcatgaactaaatgctaatatggcaaagagcataggatgttgcacttaaaaacagttcttctgtttgctgtgatagcatttgcacgtactacatccattgaatttgttctcagaagcatcataattgcaccgtcttcgtcttcaaagacatggactgataaaaatatatattttttaagtacttatataccagcatagcagcaagcaaatccactccgaccagatgattgttccattaaatcaaaaaattggtgtaagtcgccatcactattaaattcttcttcggtcagggtgaattcagatttcggccccttttaaaaatagtattaacaatttttatttaataaataaggatttgtttttagtcaaaaaaatcaggtaataattttttgaaacaactccaaatcaagcaaaaatgcgtttaggcatttgcctaataaatgaactcctattaataaaatacaaatatgagagtataaatgagcaaaattcaccttcactgttacaggataataggtcgggctagaaccatcgcttttaaataaattaacggccgtttccgcagcggcacccccaaccgccccgccgactaactgcgcaccaagagtttttgcagaacttttaactgtctgtcctagcgttttttttgctaccgctttcccgacatgtgaactagcaactgcaatttgtgctttttgaacagaatatctcccagttcttgcaaaaatgtgccgaaataatgccaaaatggaccgcaatatattggtgtcagaagaacttgtagcaatcagtatgaataataagaagaaacacaacttcattttttgattgtaaaaaagaatgaaaattgcctgattgaatttccttcgaaattgtttgtcagataagacaactgctcatacataacaaaatgaatttgcacctattgtctgacggaacacctgtcctctctcaaaattgttagcagatcacaagtctcagccaaagtgcaatatttcccacgaagcaatagccgataaaaattttaaaatattaaccagtaaagtatttttacttctaacaaaaccaacattaagaaaatgattttattattattgctattatagttcattcattaatgctgtcagaacgaccaaggggaaagatttaatcttttttgatggctttgaataccgcaaaaaaggaacatcggctgacggggaaaccaaattttggagctgtgtacaaaaaacatgtccaggccgtgcacatggtcccattaattctgaaattatatccaaaattgttacacaacacactcatcctcgtgtcatcactcaaaacacggtttttgtcatatagaaaatcgattaaaatacataaagtaattttataacccattccggattcctgaggtatagg

SEQ ID NO: 402 - DNA, 5197 bp, Heterodera glycines
attaataaaatacaaatatggagagtataaatgagcaaaattccaccttcactgggttacaggataataggtcgggctagaaccatcgtttttaaataaattaacggccgtttccgcagcggcacccccaaccgccccgccgactaactgcgcaccaagagtttttgcagaacttttaactgtctgtcctagcgttttttttgctaccgctttcccgacatgtgaactagcaactgcaatttgtgctttttgaacagaatatctcccagttcttgcaaaaatgtgccgaaataatgccaaaatggaccgcaatatattggtgtcagaagaacttgtagcaatcagtatgaataataagaagaaacacaacttcattttttgattgtaaaaaagaatgaaaattgcctgattgaatttccttcgaaattgtttgtcagataagacaactgctcatacataacaaaatgaatttgcacctattgtctgacggaacacctgtcctctctcaaaattgttagcagatcacaagtctcagccaaagtgcaatatttcccacgaagcaatagccgataaaattttaaaatattaaccagtaaagtatttttacttctaacaaaaccaacattaagaaaatgattttattattatttttattattattgccgcatagttcattcattaatgctgtcagaacgaccaaggggaaagatttaatcttttttgatggctttgataccgcaaaaaaggaacatcggctgacggggaaacccaattttggagctgtgtacaaaaaacatgtccaggccgtgcacatggtcccattaattctgaaattatatccaaaattgttacacaacacactcatcctcgtgtcatcactcaaaacacggtttttgtcatatagaaaatcgattaaaatacataaattaattttataacccattccggattcctgaggtataggatgtgaatttaattcaaaaatttttttacttttgtttacttttcatgatttttttagcatttttaatgactttttggcgtttttatgacttttatgtgagttttttgagatttttacgacttaaattcccatccatactggtcaattacgagcgaaaatttttttaaataggtccgagaaaaaactgagatgcttaaacacttatctgtgtcaaacccggttacccccgcacgtgaaattaatgttatcgctcgacaaggactaacagacgaacagttaatggccatgccaagtggtagctcagtccaacgtcaagtttctcgtcaaagagaaataccagaaagaaaaaatgttgatgcaagagctattcatgaaatagtgattgatgtaagcaagttttatttccaaatcaattagatgcggttctgattgctttgggattttagggggaatttgcaattgattatactggccaacgatttttattatatgactcacgtgttcatcaacccgatgaggtcgttttttttatatttgccacagaactgggactacaacgtctctcacactatcatcattggtcatcagatggaacatttaagttagactaataatgtacataaaaagttaaaaattttggggtcgtaccttcttccttcctgcaactttataccattaatatattgattgaacattcatcaatggcatgtgcctatattcttatggcaaacaaagctatgcaaacatatgagcgggcgttaactgtcctgctgacgcacattactcatagtccaagcagtattatgattgactttgaaagaagtttaatgaattattaaatgacatttattatgtttaatatcaggtgccaaaaatgcgttcattaatgtttggcctgatgtacaaatcagaatgtgcctttttcacttatcacaatcagtactacgattcgttcaagtaattaaaaacaaaagtaaattatgtatgtacaatttagaaaaatgggcatattcattcatatgaaaatgatgaaaattttcgtaaattcgtcagatctttaacggctttatcttttgttcggccaaatgaagtcgagggtttttacgatattttatttgcaagggcaccattagaagcctatccgatttttgagtattttcgaaggtaaatctaaaccagggctcggatctgtccttatttgtaagatttgtccttatttcggactattgttcttattttgttcttatttcttaaatatattcataattttgaaattttatggcagaatttcaatattttataaagaaaatataagattttttggccttgatgttcttactttgaaaaattttcgatccgagccctgatctaaacccatctttcatgcagaatccccggaaatgaaaaatttagaacctatataatcagagataatggtggggaagctttatttccagtcgacacctggaatcaccatcagtctgttatcgataatatgtgtaggacgaataatgcgcaggtaaaaaataggtttctgtatttaattgaactaaaacttgtacataaaaaaaaaaattaaatttaaggaggcatttcatctgaatttacgtcgaaaatttcatacaatgcatcctgcattgtccaagtaattcttatgaaattttgtcttaaaaatttcttaggctactacttgtcctgaaagaagaggaaagaattgcgcaagaccgactacgatcttatcatcttgacccaacattgggtttaagtatgcgtccaagaagcaaaacgtacaaaaataacgatgcggctattcgggctttagtagtgcaatttgatttagtacctaacccaacgccagagcaagtgattaatcacttaagggccctacaataccgattagcatctaatgggtttgatcagtggaattagctcatgccaattattttgtagaattgtaaaaataggctgttgttggggccttcagcaagcctaataaaaaatttaaataattacgaattaatttgttttggcttttaaaaaaatattttggcttgtattttttaatttgttgatgtgtgcttctttagttttgtgtgtctgcggtagggccgaaacacactttttttcttattttttgttttcttttggaagagcaccgcactgacgaggcccactcttccattagaaatttttataacaaaaaaaatttttttcatttaattttttctcaggaattgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtcccactgcgccgagggataatcacacttcgggaggcgcgaatccgtctcccatcaccaccgccaccacccacttcagcgccagcacagcaaatgcttgttcttaccttaacttacctccccggaggtcgggagtaggggtgggggggggggtgatttgtggggggccaacaagctgatggacaaataaatatacacacaccctctccaccacaaatggagtgcaatttgtaatagattttgtccaaaaaggcgaccaaattttgatatttttagccaatttcttgaatttttattaacaaattttcagtaaaaaacaataattaataataaaatttatgacatagaaaatgaaattaaatgagtacaccagggaaattgaatgggacgtttgagcaccgccggcaatgggaagagattgtgtgctgtttgagtaccggagtgaaatgtgccattttgctgggactgattggatatgtacgaactataaatataccagggggaaaattgtactaccgaatgtgtcaaatacagtaaacaaagatataaactcactcgcaatctcagtccccacaacccaattgacaaggaattatttagtacggaattagcggacacatgtttgagttagctttcgccgctggacactgtaacggccaaagcttcttgacaaaaaattaggcaccaatcccagccggaggggacggtgtaaaaaaaagagacttaaggcgctgggggaagagggtgcaaaatgcacaatccatctccaacatatagcttaatcagtatgtcctccaacaacccttcctcatcctcttagttgttagtcttctctctctctctctctctctcacttttctcccgcgtccgtcaaaaagtcaagcagcataaaccaacaaatacatcataaacttagttgggtccgtaagcacttcggcttatcccctcttctccctccccttctgcatttggtggtgttcggtgagtcgcgcggattacctccctcgaaaatcccctctccgccgccgcttccctgccggaggggccaaattcgctccccaatcgcctcagccaatcccatttatccattcacagagtcattcacctgggatttggattaggatttctgcccgtgtggtggtggtggaggagttaagcgatgaatgccccaccgccccctcctccacccaatcgccaaatcagccaccgaattttttttgtttgactgactgatcttgtcagttcgtcatttatttggactgctttctgctgatcacttagctcccatcgtcagcggtatccaatcacagtcactcaaccattattcattcattgatcattcattcattcgcccaagaaaatttggcagtcggccccgcaggcgcgtttcacaaccgcgacgccgttaatgcgatttgcgaccgattaatgctcactccgccccgccctacccctctaatgggcccgcccgcatggcacaaccacttcactctccgcgtctcatcgcccgttgtcgctgctatcgcgtccccttattcagttgcgccccctgtccgccccgcccacccaaatactcctttatgcccgccgcccactgtctcgcacccacaaattaccgtatgcattatgcacataaaatttttgaaactaaaattttccttttgccaaaacccaaatttatggcaattgactttttaaatcttattttttgcctaaatttgccataaatttatgccaatttatgaatggaataatgcgcaattgagcgcctaaaattgtatgcaaaaaaaaaaatcggctttagcaaaaaataaatcgattaattaccattttttgtttttatggcattttaagtttttgaacagttttttgagg

SEQ ID NO: 403 - DNA, 1515 bp, Heterodera glycines
  misc_feature (63)..(64): n is a, c, g, or t
  misc_feature (99)..(99): n is a, c, g, or t
ttttcctaaactttcgaaaatatacttttcttcatgaaaaattgaaaagcgtccttcttccannggattgtccttggaaaccggtaaagtttcaaaaanaatttctccggcagcttttatcgtttctgccgaccatcctttggctttttaattttttaaagccctttttgaaattatattcagttgaaatccgtttaatctatttccatttgttattattttaaattttatattttaaaatacttatttgatttcaaaaatgtagttcattttatgaattgtttggttcatttatctttttgtctttttccatttttaatttctttatttatttattttttgtattttacttcgtttttattttttatatccaaaaaatttgcttttaaactttaacaatttttcttttttacatgtttttaaatgtttaaaataaaattttaggtttttactttatcatagagcttggtcatttttataatttttttaattttcatttttgatatttttttttattctgccaatttttagacgattttcaaaagcgactttgaatttatagtttaaagcatttctcattttttcactgcctttctcccaattttcgaaattgtgaaatttcattccaaaaacttcttaaattgcaagaaaatgaacaatattagaatactgccaaagttaggatagacagaagcagcctaattgcattcaaaatatttcgggtgggtggcccataattgaggccaaaaaattatacagataagcgtgaccggcgagggaatggtctgctggagccatacggatttgaatgggaaatttattattactattattttttttataattattaagtcgcaaaaatatttggcaccaaatttgtccaacatttttccgtgcgcttatatcctttttgccctcgagcagtttttgtttggttgagtgtttatgcgtccttctattggtcttttttgcgctcaagaaatttaatttttgttatgaaattttcaatctctttcaattggtttagaaaggatggggtccgcttttgcttatgtcaacttccgcccccttaacagaaaaatattgtaattttttttgaaattaaatggtactttttttaaaaatgattattcaataaacatgcttagtttttatacctcgtgaaaaaaattcattggtcaatttttggaaaaaaccttttccaggctagaattttacgtactttctcgctctcccaatttagcctgactaattttggcagcattgatgatcgttggcacacaatattttctctctttggcattttggcgatagggaggggtggaccaccggaaccgtcagttgggcccccaagtttgggccccagcatgtttttttggctataacttttttctttgttaaaaaaagcttctaaacatgttaagctttcgaatgatacaaactatgttggagttggatggaaaagaaaaaagttattgtcaaaaaattggctggggcccaactgacgtagaccgt

SEQ ID NO: 404 - DNA, 982 bp, Heterodera glycines
ttatttcgaatgtttgtactcctataattgtactcctatagtatttcctcatgatcactttttttcattgcctacagtaatcgttaacattttcatttctcattaactaattaaatttgtcacatttatttgctttggatcgcatgaatttacaatatttgtgtaattgtactcctacagtatttcctcatcatcacttttttcattgcctacagtaatcgttaacattttcatttctcattaactaaataatttgccgtctttatttgaccacactgtaacccataaaaaatgtttgccatctttatttgatcaaacagtatcccataaaaaatgaattttcatgaacaaatcccaaatttcgaccgttttgatttattgaaggcaaaaaataataaaaaatgaaaataaatgtgaaaatgcataaaaaataaataaatgaaaatgcataaaaataaatgtgaaaatgcaaaaaaaaattattgttgttgtgatggtggagggggaggaggcgggaaggggaaattgaaaggcatcatcatgggaaatggcatcatcatcatcatcggaaacggcatattcagtgaagtaggcacagggtttgctgtagcagcaggtggtcgtggatgagtagcagatcgctccttcgctctgcgtttggctgcccccgaacgcggtttatgaaaaaaatttttttattaaaagattaatgcacaacagagcctacagccgtgcgcccaatcagggctccaaaagacaaaaggggcccaaacatgggcccacaccccaagggtgagcccacacctcaggggtaggcccaatcaggggcccgaaaacaaaaggggggccaacatgagcccacaccccaagggtgagcccaatctgggcccacacctcaggggtgagcccaatcagagcccaaaaaacaaaagggggcccaacataagcccacaccccagggggagcccaatttgggcccaca

SEQ ID NO: 405 - DNA, 2993 bp, Heterodera glycines
gagaaagaggaaaaaaagttgataataagcgatcggtgcaattggtgcttagagataggccaagtgttattcggagttaggggatgcggacatgtgtttagctgtccaccgtgctctattgcgataatggccgttgatgagccaaaatgtttgatttgtttccaaaaagtaactgatttgaaatacttaggatcataaatgtgtaccggatatttgatctggatcctaagtatttacaacatttgaactcctataattgtactccacattaatatatcattcatcttcttttttttacattgcctactgtaatcgttaatatttctctaatttcgttaaccaatgccacatttatttgctttggatcctaagtatttacattatttgtgtaattgtactccaacagtaatacctcatcatcagttttttttcattgcctacactaatcgttaatattttcatttctcattaaccaatcaaatttgccatctttatttgatcacagtatcccataaaaaatgaattttcctgaacaaatcccaaatttcgaccgttttgatttattgaaggcaaaaaataataaaaaatgaaaatgcataaaaataaatgtgaaaatgcataaaaaaataaacgtgaaaatacataaaaaataaatgtgaaatgcataaaataaattattgttgttgttgtgatggtggaagaggtggagggggaaatgggaaattgaacattggcatcatcattggcggcatcatcatcggaaacggcatgttcagtgaagtaggcacaggatttgcagtagcatcaggtggtcttggatgagcagcagatcgctccttggctcttcgctttgctgcccccgatctcggtttatgaaaaaaaaatttttatttaaggattaatgcacagcagggctcacagcccaaaaaaaagttgcgccccaaacatgggcccacaccctaagagagagcccaatctgggcccacacctcaggggtgggcccaatctggaccccaaaaaacaaaaggggcccaacatgggcccacaccccaagggtgagccaaatctgggcccacacctcaggggtgagcccaatcagggcccaaaaaacaaaagggggcccaacatgggcccacaccccaagggtgagcccaatctgggcccacacctcaggggtgagcccaaccagagcccaaaaaccaatggtgggccaatatgggcccacactccacaatcactcatcctgaactcaccctctttctctgttgctggttggcatttgcaccgtttgtcccattgtcggcattgccctccaatccgttgttctgtgccgtcgcagccttagatcaaaatgggaaaatgattaaaatttaaaaatttaattacaattgcttaccgtttcggtatttgtcccattgttggcatttgcaccgtttgtcccattgtcggcattgccctccaatccgttgttctgtgccgtcgccgccttagatcaaaatgggaaaatgattaaaatttaaaaatttaattacaattgcttaccgtttcggcatttgtcccattgttggcattggcaccgccgtcgctcatccccgctgctgccttaaatcaaaggggaaaattaatcaaaatttagaaattaatcacaattacttaccccttgacaattggtttcattgttggcattggcatcgccgtcgttcaccgccactgccaccttaaatcaaaatgggaaaattttttaaattcaaaacattaatcacaattacttaccgtttcggtatttgtcccagtgtcggcactggcacccccgtcgttcaccgccactgccaccttaaatcaaaatgggaaaattttttaaatttgaaaatttaaacaattacttaccccttcaccattggtccgattgttggcattggcgttggcactgatgttgatcacattgtccaattcctcaaaaaaaaaaaaaaaaaaaatttaattttgaatttaaaaaaaatttcaaaaaaaaaacccacttcgttggctgttcgatcagcttcattcatttcaacattgcctttcagcttgaacaccttaaatgtgagcgggaaattattaaaaatttaaaaaaaaaagaagaaaaaatacccttcgtttttgtcctcgtcgagcatttgctgccgctgttgtttctgtgcctcccggtgtataaaactgtaaaaaagcgaaattgaaagaaattttgaactaaaaaaaagttacattttttacaaggtggatggccacccgcgcagccattcttttttgatggcaaggcgcgccacctgtacgcctcgcaaagtttggcatgtcaaaaaaaaaacaatttagaaaaaaaaaaaagttaagcaattgatgggggggggggaggaaagtttgcattaaacggcaaatgcagaaggaatgtggtgcccgttgacccttgcaatgaaaacagtgcaagggaagggcttgggaatggattgacatatcgactcactcctccccaattttctctgcctgtctgctattctcatctcttcccctctctttcacactctccatctctctccgacccactcctccccaattttctctgcctgtctgctgtctcatctcttcccctccctttcgcactctccatctctctccctctcacactctctcttattttccactgtctgcctctctctctctcatttatctctgcctctctctttcatttattctctctccctctcactctcttttattttccactgtctgcctctccctctcttttattctcttctctcattttgttctttgcctgcataatatatgcacggccggcatcatcattcgccgctgacgccccccttccttcaacacacgcacacccccccccccatcatcaccaaattctgatcaacactctgatcaatgatcaacccccctcccccttgtactgatcaccccatcacccaccccctcaccgctcctcccaatttcgc

SEQ ID NO: 406 - DNA, 6143 bp, Heterodera glycines
tggctttttagcttgtataattcgtggctaatgaaaaattcttaattttaaacatttaccgaatttatattttttagggttttcccagttatagtttttagggaagccaattcttaaaagttatacaaaagcaaaagggaaatttaacaaaaatttttgaatttcaagataaaattattcttgaacattaaaatgaaatcaattattcactcattaaaagatgacaattttctataaagacaaaatttatgaagaaaaaaaaacataaacaaaatgctaagagaaaagtaaaatattgattcaaattagaaaatgaaaaacaaataatattttaaataatttgctaatcacaaaataatttatacatgcagaaaattcaaaattaatttcttttcgaaatattttggcctcaaaaaatgctgcaaattaattttgtgacatttttcttcatatttctaatcctattaagcatacaccgttaaggatcgactttttaggaattagtcatcggggtctaccttaatagtgtatatttttactttaatagaatagctttctacctttatatagttctatttttctttttttttctagaatgtgtttttgcaaatcataccgatgaacagggcagggcgcacatttaagagctagtttttagcacataaataaagaattttttagggtttgcatatatatatatatatatatatattgaaatccgtgaaaaaatgaaaataattagcaagtactcagttttttaatgcattaataatatctaattgccgatagtaaattaaccaaatttatataatgaatattaggacctaggaatgatttactgataaatagagaaatcgtgaaaaggttatttgccgaatttcttaatcaatctatagttttaagactatttttttaatttttcaacaattttttcgtttatccaacaattggtttcctttttcatttttaatattaaaatttttggctttatgtctcccattccctaagattattttgttgtaagaattgttattcaccatttttctttgtataattattctcgccactgtttttaaaagttgaaagaaataaatcaatttaaaaaatcatacgcagaaacagaagatgtcaaaatagaaaaaataattatataggcataatttttgctaaaatcaaattgattttggctttttttaataaatatttattattaaagaattttattgtataaattacatttttacgtttttacgaaatttttgctcaataattttatggaatatagaggcttttgcgcaaaagtgtgaagtttttggcaaaataatcttcattttgacaattctctttagattttggcaaaattaattttataactttttctttaattgatttataatttttagaaaatgctgaagcttaatttcataattattttcttcaacattttattatttataagcattttggcggttgatgatttagatttccttgatgatttattgaatgacctcaagacaacgacgacacaaaatttgttaaaaaaacaaaaatttgaagaaaataatggagggttcccatcagaacaaggattcaaagtacgtacttcgatttgagcttccgtgcttacaaattctaggtgtatttatttccaagaatgtatttgcaaaatcagtttaccgatgaacagggcagggcccagatttcagagatagtttttcaacacattaatttttttttttaaacctttgactgataaaatatattttgtgttttgcaaatataagggcgattttttaaaaaaaaattcattctttttttgtgaaaaaaattttctgtagagtgcagcggaaccgggaattttgggcataaccgggaccgggaccttttaaaaaaaccgggaatttttggctgggaaaaccgggacttcggtacccagttgtactcagctgtccgtgtttaggtcccggtcccgctgcactctagttttttggcattacaaattcttgtgtggtacttaattgaccttttgacttcttttatgttttgaattataattattattggcgttttgttatcttttttatggaccttaaaatattagtgagtcttttactttgctgttcggttttgtttttggttttttatcttgtcttctctggaattgttttgaatttcttttgatgctgacttcttctcaattgattgttgtggtctcgtctttttaattattattgttgcggtttaaaatttatcgtcgtaaattattttgttttgtttatttattaaagtgtttgcgaattcgttttgaaacaggtgctgacaagccgacagataattgtgtttgatccatttctgaaaagagacaacccatccccatccaaatttgttgattttgtacaacttggcgctcctggcgacaaaggtttggcttagttgcgactattcattaaaggataatatcggccataaaatttttgtgaaatcaagtgaacaaagtgatttctataccctcgtgttgggtttaaagcatcattcggcgtatttttgccgaccttacaactttctgctcgccgattaaaagcactcgtgttgtgctttacgaattaacgaattttgttaaaagctcgtgttgttttaaaactgatctttattgttttatctcgtgttgataaattctgatgattttccgctcaccaccactgacaaggcaaaggctcagaatgcaacaagccgctccagtccagcatctccaaaatgacagaaatgaacaaccacaaaatatagaaaatcggccgattaacaccgctaacactggggttgccgaaaattctgtaaacgatggcgaaattttagcacacaccatgaactccgaccaaattcttcacgccgttttgaatgttgggtcagcaaaccgacaaagtggacatggacaagatgaagaaaatgtggaaaatcaagatttggcaattcatccgaatttgacacagcaacatggaggtttgagaatgcgtttcagacgcttgccaaatttggaagaaaacagtgaaagggaattgtggcaagctgggaacgaaaacaatagtggtcatcacagtcatcacattctaaatcgaaattttctgcgcacatcaacgcctaataacgagcacattattcatgagttgcatattcagcacccgcgccaaaaccctcccaacattcaagcaaatcctaattttgtgcggcaaaatttgcaaaaaactgtgactgctaaccagcgccaggccaacccaaacgttctcattcctccacctcaagttattcaacaaccaattgcggtatatccgccagttcagccaccaattccggaaacttattggggatatcccgcaccttactatccacatcccccaccacctatgggttacccaaatcagcaaatgtttggaaatgcgaacactaaggtgccgcaaccgacccaaattcgacaaccatacaatcaccaaattccaactcaaataaatgcccagcaaacagctcttaacggcctcgaatgcgttttaattctggacaaattgccggacattaagggcaatgaaggaaatgacagcattaaatcttttttcaaaaaattttcacagtataccagcgattggccgaataaaaagcgcattgattccttggaatcgaaactcagtgggcgcgcagagcgagcatttaattcggctttggccaatgaaccgtttatatttgaaaacataaaaagacacattctccaacaacttgaggcgacggattgtcatgaaatggcagcatttgatgaattaatgcaaggcattcgccgaaagccaagagaagggctggatgatttggccgaccgaattgtgagcctggtgcgaagggcttatccgggactgacgcgaaatttggcggacgagtattcgattaaacacctaatccgcagtttcgataatgccgaacttgccttgagtttggagctaaatcgtcggccaggaatgagttttgatgagtttgtagctctagctgctcgtgccgaaacgacccaaaatgcggcgagaagggccaattcggacagaacgcaacaaaattttggccgtagccagccacacagacaatatgatggaccgatggccaaacaaagcacaaacgcatttgagccgaacaaattccagcgattcaatgaaaatcgaatcacgtgccaaagttgtggaagagagggacatgtggcgagaaattgttttaagcgttttgcagatcaggatcagcgtcgatattttggccaaaatcaaaatgcgaccggtgccaatagagcacaaatgccgacacattcaaatccgaatgtcagccaaaaatccgaacaaaatcagtttggacagcgccagcaacaccagcaatcacgaaattttctaaaacaaaatttcctggtcgaacagaacgaaaagcaagttgagtcttccaatgttcagtgtgccggtgttatcagcaatacacctgaaatgttggatttttttcgaaaattttggacaaaatgcaatgaaacggtggatgacggacaaaaagaagcatttccaatcggcaaaataatggcaataaaggtcaaaatctacgaccaatcagctgattcaatgatggatagcggggcccaaatttcgcttgtacaggcgagttttgtcaaacacctcctagagaactcaacactgcaagtcgaaaatctcaaaattttctccaaaacgcgaaatgtcgtggacatcaatggaaaaatcgttgagtgctatggcataatcatcctcccaatcactaggaaaggatgtgaagcagttgatgtcccatttcacataactgatgcaccgattggcctgccaatactttttggtaccaatgccatgggactgttgggttttaaactttttgactcacaaaatggtgagctgatcgaatttgaatgcgccgataataaatcggattatgtacgcattgtctacagtacactgatcgaacctcactcaacaaaatttgttgaactttctgtttcaccaaaatttagcggcaaagactttatcctttctccaaacgatgaaagaaacgacttaagggtcgaaccgtcgctaaacaaagagaggcgcggaaaaacaattgcagccataacaaatttttctcaaaatgcgttgacattaaaggagaatgaagaggttgcggttgtggaagcaattgaagatgttgctgatgtggaaaactgcttgggggattcatggcttttctcagaacccagtgaggttaaaatggagaaaccaaagcccgaaaatgaggagacaaatgcaaaatttggccttttgagcaaagagaattcggaaattcttgaaaatttgctaaataatttttcgagaatttttgcatttcatgactatgaattgacgcaaacagagatggtaaaacaccagattgacaccggcgaagcaataccggtcaaacaaaggatgaggccagtcccatatgcctatagagaaaaggttgccgcaatgatccaagaatatttgggaagaggaatcattcgacactcaatttcgccatgggctagccccattgtaattgtgcccaaaaaagacggatctttgcgcttttgtgttgattacagagggctaaatgcaatcacaagaaaggattgttttcctctcccaaatatagaacgtactcttctaatgctaggaggacgaaagttcttctcaactttggattttctctctggctattggcaaattaaaatggccaaaaattcaattgaaaaaacggcattttcaaccgaatttggcttacatgaatttactgtaatgccttttggtctatgcaacgcagtcgcaacgtttcaacgcttcatgtcacaattgtttgggagtaaattaaatgattttgtgtttgtgtacatcgatgatgtactagtggcttctgaatcttttgaacagcatttgatacatcttaaatttgtctttgaacaaatccaggaggctggattaaaaatcaaaatttcaaagtgtcagttttgcgctgaagaactcaaatttttgggacatattttgacgcgaaatggcataaaaatggacgcggaaaaacgaagccaattttggaattgccggtgccgaaatcgaaga

SEQ ID NO: 407 - DNA, 7569 bp, Heterodera glycines
  misc_feature (25)..(25): n is a, c, g, or t
cgatggacaaacaaagcacaaaccncatttgtgccaaacatatttcagcgactcaatgaaaatcgaatcacgtgccaaaactgtggaagagaaggacatgtggcgagaaattgctttaagcgttttggagatcagaatcagcagcgatattttggccaaaaccaaaatgcgaccggtgccaatagagcacaaatgccgacacattcaaatccgaatgtcagccaaaaatccgaacaaaatcagtttggacagcgccagcaacaccagcaatcacgaaattttctaaaacaaaatttcctggtcgaacagaacgaaaagcaagttgagtcttccgatgttcagtgtgccggtgttatcagcaatacacctgaaatgttggattttttccgaaaattttggacaaaatgcaatgaaacggtggatgacggacaaaaagaagcatttccaatcggcaaaataatggcaataaaggtcaaaatctacgaccaatcagctgattcaatgatggatagcggggcccaaatttcgcttgtacaggcgagttttgtcaaacacctcctagagaactcaacactgcaagtcgaaaatctcaaaattttctccaaaacgcgaaatgtcgtggacatcaatggaaaaatcgttgagtgctatggcataatcatcctcccaatcactaggaaaggatgtgaagcagttgatgtcccatttcacataactgatgcaccgattggcctgccaatactttttggtaccaatgccatgggactgttgggttttaaactttttgactgacaaaatggtgagctgatcgaatttgaatgcgccgataataaacggattatgtacgcattgtctacagtacactgatcgaacctcactcaacaatttgttgaactttctgtttcaccaaaatttagcggcaaagactttatcctttctccaaacgatgaaagaaacgacttaagggtcgaaccgtcgctaaacaaagagaggcgcggaaaaacaattgcagccataacaaatttttctcaaaatgcgttgacattaaaggagaatgaagaggttgcggttgtggaagcaattgaagatgttgctgatgtggaaaactgcttgggggaatcatggcttttctcagaacccagtgaggttaaaatggagaaaccaaagcccgaaaatgaggaggcaaatgcaaaatttggccctttgagcaaagagaattcggaaattcttgaaaatttgctaaataatttttcgagaatttttgcatttcatgactatgaattgacgcaaacagagatggtcaaacaccaaattgacaccggtgaagcaataccggtcaaacaaaggatgaggccagtcccatatgcctatagagaaaaggttgccgcaatgatccaagactatttgggaagaggaatcattcgacactcaatttcgccatgggctagccccattgtaattgtgcccaaaaaagacggatctttgcgcttttgtgttgattacagagggctaaatgcaatcacaagaaaggattgttttcctctcccaaatatagaacgtactcttctaatgctaggaggacgaaagttcttctcaactttggattttctctctggctattggcaaattaaaatggccaaaaattcaattgaaaaaacggcattttcaaccgaatttggcttacatgaatttactgtaatgccttttggtctatgcaacgcagtcgcaacgtttcaacgcttcatgtcacaattgtttgggagtaaattgaatgattttgtgtttgtgtacatcgatgatgtacttgtggcttctgaatcttttgaacagcatttgatacatcttaaatttgtctttgaacaaatccaggaggctggattaaaaatcaaaatttcaaagtgtcagttttgcgctgaagaactcaaatttttgggacatattttgacgcgaaatggcataaaaatggacgcggaaaaaacgaagccaattttggaattgccggtgccgaaatcgaagaaagatcttcattctttccttggatttatgacatattatagaaaattcatatattcatttggttctgttgctgccccattgttcaaactcctaaaaaaggatgtgaaattccaaatgggagaggcagaaactcaggcagtttctacattgaaggaaaaaattttgtcagaagtcgtcctttatttccctgatttcaaagccgcaatggaaaatccatcgagaaaatttattataatgacagacgcatgtaaaacggggatttctgccgttctctgtcaatcggacaatgaaaatcggatccgtcccatatattttgcttctcgacagtgcaataattttgaatctcggtactgcccgacagaattagaagcattagctgtgagattcggcgtcaaaaaattttcacaatacataacaatgattcccaccaaagttctaaccgatcataaagcgttggttccgatgtttaaaagcaaaagtgaaaccggaaacgcacgtgtcgataaatggataatggaattgagtgcacgttttattttggaaattgagtataacccaggaaaggcaaacataattgcggatgtgctttcacgttctggcgcactgaagccacgtgaattggcggagaaaatttttagagttgagcaagtcgatggaaatataagtgcttctgtgccaaaaatggaaatgattgagtgggtcaacgcaattaaggaaagtgagctcggaaacctttaccaattcctggaaaaaaggaaattgcctgaagataagcgggaatgtcagcgactttttgacaccattcataaattcacactgattgagggattactgtatttccatgattcgaattacggtaatcttcgacttttcgtgccacaaaaattccgcaataaactgatcgaagaaaggcacgaaggcaaatgtgcgggacatttaagcggcaaaaagattttcgggcaattagcagaaagatatttttggccaaacatgcgggcggattgtgtaaatgcggtgttgaaatgtcggatctgcgcacacacccgaaatccaagggcaaatgcgccagaattaagaccagtgattacggcggaaccttttgagctaatatgcatggacattttatcaattggaatgtcagaacggggaaatcgatatgttttagtaatggtggaccattttacaaaatatttgatcactgcagcaattcccgataagagcgttgaatcagtcgcaaaggcttttgtcgaacaattggtgcttgtatttggcaagccaaaacgtattcattccgacaagggcgctgaatttgtgaataaaacaatggaagaaatcagccaaattcttggagttgaaaagagtacaacggcagggtacgacccaaatgccaacggacaagcagaacgggccaatcaaactattttaaatatgcttaaaaggtcaactgattcaaattggtcctgggatgaccggctgccttttgtcacatttgcttttaacattactccctctgaaaccaccggattttcgccttacaatttactctttggccggccagtaaattttccgtcgtctgataatgttaattttactgtaaatccttcttacacaatcgatgaagaaagttatctgcagctctttcgtgaaaatttgttaaaaattttggaaaatgcaaaaaataattcggacaaatcaagagaacgaatggagaaatggtttaattcgcagccaaaagtgactttgcagaagtaccaaaaaggcgaacgcgttatggttatttttccgggagctaacaaacgctcaacacataagaaattaaagtggaatatctttggaccctaccaaatcctcgaaatttccaaatcctcggcaaaagtaacgcctgctgataagaaaaatgctgatccaatttgcgtcccattagaacgtctgatcagagcaccggatggacttcctaatatttcaacaactccgcgcggcaaaaatgcttataaaaatgtgttaaatgtgatgactattttgatctttgaagaaaaaagcatggaatttgaacaggaaaattttttgggaaaaacaaaaacttcatcagggacgatgaatttttcagaggaggaggaaaatatggacattgccgaagcggagattaagtggacgatgacatgtgaaggcggcggacatgtgttgtgcaaaaaattgttggccggcgatctcgaccccgtgctcagcaaaacacaaggaatcggtgctatggttgtgcagactccattacaaggactcatcacactattcattttgcggtccaatgtttcaatgtctgcgtcgaaagatttgctgaaggtcgcaaaccaattggaaaaactgggtggaattgctaaattgcaggccattttgacttcggaccctgatttcgaactcttaaaatatgtcgaagaacgtggtgatgctgtgcgttcgggaagatgcccgggaatcgaagaagtcgaaatcatttggaaaaattgggtcagcgagttgcgcatctgcacacgaagcattgaaacgcacgggatttggccaaatatgcttagaagcaccaatttcgctttctgagctgccggaagccgacagaattggatgggaaaaagtctttaatgctggcacatgggcattggagaaagtccgcgcaaccgttgtttttggcaaaacaacattggtccatcagccgagagtgatcattggagactcaagtgctgcgcaactttgtggcgaagcaaataatcaaattgttgctcacttcatcggcaccgtacaagggacattgggcgacgtgatccgcgcattggacaaatcagtactgacatcaaaagtcacgtcggcactgatcatccttggaagagatgcactgatcaaagggcaaaccgtagcacaaattatggaagaatgtgaacgcatcaaatcaatttgcggacaatttgaacacgttcgatttgtgtagcgtgaaaagcacgcacagtacaacgaattgattcctggattggagcacattgccgcagaatggttcattgcgctgaccgagaatggcaggagtttgattgagatgtggagattcggagacactttcgacatgacacgggtgcgtgctgacggaaagattctgcctgaaggactgaaatgcctcagggcatggatattcactcaaatttctgtttttcccgatgacaatttccttggcattcgtcgttcttctcgctcactccattctgtacccgctcaattttccgaattgtcaattcatcgtcctcatcaattttctcggggtcatcgggtccatccatattctctccagccaagctcgagccgcaacactcaaagccgcagtgatggaaaagcgtacagtagccgcagccgtcgccattaagccataaatacctttgaccccgcctttcttttctcaattttcatatttattgttctaagacgaggggaccgtcttcttcagaggatggggatgtggtacttaattgaccttttgacttctttttatgttttgaattataattatttgttggcgttttgttttccttttttttatggaccttaaaatatttgtgagttttttactgttcggttcttgttttgttttcttgtcttctcttgaattgctttgaatttcttttgatgctgacttcttctcaattgattgttgtggtctcgtctttttaattattattgttgcggtttaaaatttatcgccgtaacttattttgttttgtttatttattaaagtgtttgcgaattcgttttgaaacaggtgctgacaagccgacagataattgtgtttgatccatttctgaaaagagacaacccatccccatccaaatttgttggttttgttcaactgcttccgtccaattggcagcaccctccagaggaattaattgattgactgaacgctcaaactctttaccattgctcagctttacttttgcgctgcgcggcttattagggggaaacagagagagaattcgcccgaggggccagtggttccgtgggagatccccctgttcaataaggacaatatctccaatttttggaggttcgggcgcaaaaactcttgggccggcatgggtgtctttggtcctacttcttaacagtaaaaggtaatccgtggtccaaattttccaaaatcgacggagcgattcgttggtggtataccacagatgggccaacttttcggatgaggatggctgaaagggttttcctggttcatccggctcgactatggcattttgagaatggggggaaaggaaatccactgggcgtagggggagaggaccgtctcccaaatcggaaacgaaggtaattggacggctgttcaaaatggcctcaatttcacaagttagtgtaaccaattgtacccatgttggggttagccttcccaaacttcggcggaacgctgttttgacaagccccaccattctttcgtatactcccccggcccacggactgtaggggggattaacttccactccaccggaaaatcgtagtaagccataagaatttgcctcccaaggaccaattgtgttccattgtcggaccagactcgttttgggggtgccctccgggacacaaagcggcggaaagccgagagaaaatcagtggtgctcagagagccccactatttcaaatgcaccgctctacaactaagacagctgaagagtaagacccaagcctttttgtgtccctccgggggattaaacaaagtgggacctaagtaatccaaccccattaaatgtgaacggcgggcttgggttggtccgtgcgtgagggagcgggggcatagacgggagggagaattaatggctttgtcctttttacaaactacacactccctcagaatgcctttgatcaagcggcgcgcccgaatgcaccaaaattcacccaaaaatttggccattgtgtagtctaccccggcatgtgctagtgaactatgagccttcagaatgagtagccgagtaacccacgaatcgcggggaagcactatcgggtttttaaaatcgaccgattgatgagcataagtgagacgggtgcggaggcggattagcccgtcatttcccacataagtgtcacccccaggggacatggatgcctattccctttctatgatccaattttttgccactgttctggccgctaatgacgacggctcggccccctcaagtttagaaaaaagtaaaatttttgcttagctgcttcacttttaccaaaaaacttaaacaagagaaataaaacaaaagttgtggacgctaaaaactttgaccagctcccaaagtcccggggattaagaacggaaggacccctgggtggctctaaaatggggacggcaatttggacaagttcggtctcctcgttcgtggtctcctcgggtggcagaattatttcccggtactcgtttggccattccctttctgggcgtttaagccattctggaccatagtgccacaaatcacagtgattcagttcactgggagagagcccccgggttcccaagtcggcagggttatccgtagacct

SEQ ID NO: 408 - DNA, 1779 bp, Heterodera glycines
taaaaactggtgcctggcaattgacgagcccgtcaatgtcccgccgcagatgggtgatggaattgttggacaagttcaggctggacaaccgagtgaggttgacaaacgatttgggaaaactcgaaaaaagaaaattcactttaaaaaacggcgaaaattttggaaaaaacggaggcctacccggtcacaatgtttgtgcttatgtccaaataggcaccgatttcttcaggcacttcgacaatttctggggaaaaaaggattgggataaattagagagaaaaattgggataaattagtggatggatttttgaaaaaattgaattttaggaaaataaaagcctcctagaggaggggtcagagttttacgtttgaccaattttctgtttttttggtgaaaataagcacaaacttagaaataagtgttcacattttggggaaactggaatatgccaagttcgtgacgatttgaaaaaagatttggcccaaaattattcaatttttaacggatattttatttgattttacgatataagaaaattcactaatttaccattatacataaacctaaaaaaacatgttggctatgacattttagaatgtgataaaaatagttgaaaaatgaaaaatgctaaaaaatgaaaattaattccaaattatttaccgtatcaaatatttaaaaaaatgcttaaaaattaaaattttttccaatttttttaccgtgtcaaatatttaaaaaaattgaaattattttccgtaataaatagtctaaaaaaattcttaaaaatgaaatattatttccgcatttggcactaattagccaattaattaattgcccacattcaatttgccaatttccattggcaactcgctgagaatttcttaaaaaataaatattattttataaatgtaaagcaaaaaattttaaatattattataggtatatggggaaaaaaagaaaaagaaatatttggaaaaataaaataaaaaatggcgtgcgttcgagcggactcgaacttaatgtatttaattgagagcagcaacgctaacgactgcgttatgcacgacaacagcaaacgatttaatttccttttcaatattccaaaaaaacttttgtatatggaatttgagagaaaacaaaggactaaaatcgactaattggattggcgccgaaaagtctcgatattgcgccgagaaaggtttacggggtgtgatcttcgagctctgagggccaaaaaaatgtaaaatttgaagtcatgaaaccgacattggaatttttgaaagaaaaataaaatacaaaattcaatatttgaatattgatactcgagagtctcgaccctcgtgatgtctttttctctatgattatgtgccacgccatacaaatgttccctctcaatctctcaataaacacacacactcgtcatgtctttgtttctctgtccatcaaatataatttggtatatctcacatatctttgtttctctgtttacataaactctagcactctctatatcttctttttgcgtccctctcctgtctggtgccattgaatttagtagaaaatgagcagatgaggggagagggcaaaaaagatgtttggaaagcgggcacggtcgattttggccatttggctggagggggggggcaaagggtgatgaatgtgagtagaaatatgttggcacaaaatgccagaatggacgcggaacatttattggagacagaatgtgaatggcactcggtggcgatgttcgtttcccgtcagcggcccggcaaaatgagagg

SEQ ID NO: 409 - DNA, 1051 bp, Heterodera glycines
acgactgcgctatgcacgacaaaaggtaaagatttattatttccttttcaatattccaaaaaaagttttgtacatggaatttgagagaaaacaaaggactaaaatcgactaattggattggcgccgaaaagtctcgatattgcgccgagaaaggtttacggggtatgaccttcgagctctgagggccaaaaaatgtaaaaatttgaagtcttgaaaccgacattggaatttttgaaagaaaaataaaatacaaaattcaatatttgaatattgatactcgagagtctcgaccctcgtgatgtctttttctctatgattatgtgccacgccatacaaatgttccctatcaatctctcaataaacacacacactcgtcatgtctttgtttctctgtccatcaacataatttggtatatctcacatatctttgtttctctgtttacataaactctagcactctctatatctctctttttgcgtccctctcctgtctggtgccattgaatttagtagaaaatgagcagatgaggagagggcaaaaaagatgtttggaaagcgggcgcggtcgattttggccatttggccggaggggagggggggcaaagggtgatgaatgtgagtagaaatatgttggcacaaaatgccagaatggacgcggaacatttattggagacagaatgtgaatggcactcggtggcgatgttcgtttcccgtcagcggccacggcaaaatgagagggcggagggggggggggatgtatattttaaatgaatttttgaacattgaaattttaaataaaaagtttaaaacaaaaaataaatacatataataattttttttataaattctattaaattttgtattaataataattttggaagaaatctgaaatatttttattaattaaacagacaaatgcattaaaaaaagaatccctcactggacgcaactttgaatatatattttccgggattaaattacagaattcataatgatttatattcacgtaaaacatatatatagccctacaaaatctgctctttcaaatgta

SEQ ID NO: 410 - DNA, 1689 bp, Heterodera glycines
gggggggggcacagcactcaaaccaacacacttttggctgtttctgtttctgttggtggtgggggatgaggccaaagttagtgacgacgacaacgccggcgggcaagggggaaaggagagaaagtgcgtgcgatgatatatttgtggaaaatgcaattacgcctctcttctgctggaggagaagggggaaaaagtgggggaaagaaagaggagagagagagagaagagagagagagagagagagagaagagagagagagggagaaaagaggcggaaaagaggagagagagaaaggggagagagagagaaaaaggggagagagagagagaataagaaaaagagtaaacatggaagatttacttatttattaaagacataggaaaaaatgtattacaaagaaaaaaaaaatgaaggagaaatgaacgaaccttatgctgtcgcggaataggtcaataattaatgttaatgaggggggggggcataaaataattaacggcaaaacgatgacccaaccaaaagaaatataacagacacatttttgaattgaattttttcatttctaatgttttttatttgggaaaaaaattctggcacaggaaaataatttttgcaataaaattggcaaatgctccactcccgggccaagaaaacaaaataaatttctgttttggttagtgctgctttgtaatgatttaccccctccccctgctgttcatcagcttttccaattttccgcttgtccataaataggcaaccgaaaagcccacaaaatcactcattttgcaaaaaacattcgggtcaaaactttgtgaaccggagcaagagaatcctgaaacccaggatttttaatcccgaaaaccggtccgggtcaaaattttcttatacttatccggaagtttcaaaagtccgggctctcctcaactgcgatataatccaaatttttaataaaataaattatatttcaattgagaattcaaaaaaggatcgatcatttctcaaataattcattccgctgatcactgcttggcaccgctgggctcgagaacagtttttcgttgcttttattggtctgagacaatggcctaatttaattacaatttaatttggtgaaaaggaaaatttagggttcttatcctttttgtccccccgttgaatttttttttttaaataattttttctagactaattttatacgctgaacacgaatctagcaatcgttttggccgattccgaaccctgacccgaactcgaacaaaagtcgaaattcaaatttttaaaaatttacttttatgttagaatctgtacagaataaccagtattgatgtttcaatgaattgtgactaatttatatctagtattaatcaattttcgagcaatggtgaaaaattttaaaaatttgaattttcaactttttcttcgaattcgggttcggaattaatatgaatggatgtcagattcgtgatcagcgacctctaaaaaccccagggaatgtgtcttcatgattttttaaatttttattatttttttcgaaaaatggggggggggacaaagtacattttttaccgacgaaattctgtagttgactaaaataaacgtcatatatgtgttcagcgcataaaatttccctagaaaaaattatttttaaaaaaaattcaagggggggggtaacaaaagggataagaaccaaat

SEQ ID NO: 411 - DNA, 3001 bp, Heterodera glycines
  misc_feature (93)..(93): n is a, c, g, or t
  misc_feature (109)..(110): n is a, c, g, or t
  misc_feature (251)..(251): n is a, c, g, or t
aatttgaataaatagcttttttatatgcatttacctccttttcttttgcccctcctctttttctttccccatttttttgggtcatcattttgncgtccatcccacagannaatcgaggaggaggagatgacaaaataaataaatgtgggtcatttcgtttcaccattttatgttcagcagaacttttattagacaaattacggaacattttatttattttttaaataaaaattggaaaataaataaatttntaagcctattcttaaaaatcataaaatttgaaaaccttggtggaattcccggattaaaaagagaattttcgcaaaaaaaaagcatattttagagaaattttgccaaaattttaaaaaatttaatattttaaatgatttaaccttgattagagttaattaacacagattttaaactatttttaatatttaaatatgcagaagtttaaactgaaaaaatattgcatattttaaattaaaaaatgtcatcatcatcttctgattcggattcatcaaatgaagcttttacaccagcagcagataaagatcagggtaataaaaaataaataaaaattaaatttggcaaatggcagaaaatttaatggcaactttctaatattgaaaaaggcatttatgtagtagatttagggggccggcaaaaataaatttacaaaaaaattttcttcatcaaagccatctaaaaaggtgtaaatttaatgaacgaaatgaaaaaatttgaaattttttaaaattcataagaaattaccaacaaaaaacttatgacaaatttttagaaatgagtgatgacgaaatcattgttcttgacaagaatggacctgctaaagcgactcggcaacagtttaaggtgaaaaaagctgaatagaaacaacgaaaattgacatttaaaatttggaaaaaaaattttgtttgaaatttaattaaaattatttatagagttttcatgaaaatttcattatttttcattaaatttccaatgtttttctatagaattttcgtgaaagatttatcaaaatggagatggagctgaaggagacaaagaatctgcacatgatcaccaagctggagcttgagaatgtgagtttggcttaattactaaaaaaataaaatttacaaaaataaaaaataaagatttaaaataaaaaatatatatttttaatttaattattttttcaatttttaggtggcacttcgagaaaggatgaagcaccagaaaatcatggtcaaactgaacacactgcaggcgaagatgctcaaaatggagcaggacaaacagcaaacggaaatggagaaaaatggtagggaaattttaaaaaaaaaattaaattaattatgcattcaaaaatttttaataatttttggtgggtttagaattattttttttcaataattcggaaaaatttgaatttttattttctcaacttttacatttctccggggatccatccttaaaaagttgaaaaatgttttaatttttttcctgtgcttttggtcaatgtaattttcgattttttgacaccttcgttatatatggaaaaaattttaatttaaataaaaataattaaattaaattttgttttaatgtttaagcttcggtcgaccaaatcaaaaagttgaacactgagcagcaaaggcttttccagaggatcagcacattggagaagattaatcagcaacaaaatgtgaataaatttatggggaggggggaggagaaaaatttttcgtaaattttttaaaattttataaaaattacgcacacattttcaaaccaggttaaaaaaaaattgtgtcataacaattattgggttcaattacagaaatccttagcccataattacgcatttccataaatgacatttatttacggcagagttcccaagtttttttttttcaaaataagacaaaatggcctaaaaactaagattctgaccccaaaaataagatttttctaaaactaatatttgcgtgaaggaaacgcaataaaaacatgaaaaattgacttaaaacaatattttattagcgtaaaaacgaaggcctgtcaactgaaaattttgtaaatcagcattttgaaaaattttattcaaaatttaaaaactaataatgtttttgcggcgtgctttttccaaaaaacttttgggaattggggggccggcggtgccgataggcgccgccgggaaaatttttgaaattttgtatgtgatttgttaacagaatttcaccaaaaaaatgaacaattttgagattttgagcccatttttatgaaaaaatatgcagacgacacaaagggcaaattcttcgccttttcgactttgctttatatgccggaattcttttgcgtagctttccaaataaacatgtttacgttttggtggcattttgtgaatttcactcaaaaaatgaaataaaatgtaattttttttaaatcaaattaattcaaatattcgcttcagaaaaaaatgaaaaatcaaaatagtcattcaaatttttcattttttattttcaaatccaaaaataagcacaaaataagcacgtaacgctgaaataagcacaaatcttagaaataagcacatttttactttctaagatccgacccctcaaaataagcacaaatcttagaaataagcacatttttactttctaagatccgacccctcaaaataagcacaaatcttagaaataagcacatttttactttctaagatccgacccctcaaaataagcacaaatcttagaaataagcacatttttactttctaagatccgacccctcaaaataagcacaaatcttagaaataagcacatttttactttctaagatccgacccctcaaaataagcacaaatcttagaaataagcacatttttactttctaagatccgacccctcaaaataagcacaaatcttagaaataagcacatttttactttctaagatccgacccctcaaaataagcacaaatcttagaaataagcaca

SEQ ID NO: 412 - DNA, 5858 bp, Heterodera glycines
  misc_feature (215)..(215): n is a, c, g, or t
  misc_feature (247)..(247): n is a, c, g, or t
gaaaaaaaatttgttgaaatttattaaaatattatagagtttcatgaaatttcattattttcatttaattttcaatgtttttctatagaattttcgtgaaagatttatcaaaatggagatggagctgaaggagacaaagaatctgcacatgatcaccaagctggagcttgagaatgtgagttgggcttaattactaaaaaaataaattacaaaanataaagatttaaaataaaaatatatattttanatttaattattttttcaatttttaggtggcacttcgagaaaggatgaagcaccagaaaatcatggtcaaactgaacacactgcaggcgaagatgctcaaaatggagcaggacaaacagcaaacggaaatggagaaaaacggtagggaaaaattttcgaaaaaaattaatgatgcatttttctatttttttcaaaaattcggaaattcgaatttttatttgctcaacttttacatttctccgggggtccatccttaaaaagttgaaaaatgttttaatttttttcctgtgcttttggtcaatgtaattttcgattttttgacaccttcgttatatatggaaaaaattttaatttaaataaaaataattaaattaaattttgttttaatgtttaagcttcggtcgaccaaatcaaaaagttgaacactgagcagcaaaggcttttccagaggatcagcacattggagaagattaatcagcaacaaaatgtgaataaatttatggggaggggggaggagaaaaatttttcgtaaattttttaaaattttataaaaattacgcacacattttcaaaccaggttaaaaaaaaattgtgtcataacaattattgggttcaattacagaaatccttagcccataattacgcatttccataaatgacatttatttacggaaatgcgtaattacgggagtcaaaaaggcagtcattaacccgtaattagtaattgcttcctgccttaaccacaacaacgcacacagaagtgtattatattttttttaacttgaatttcaccataaaaattccaattttttttttttgtattttcgaaacttttttaaaaactaaaaaaatttccacccattaactcttagaaattgtcataaaatttaatggaaatttttggaatttttcattttaatgaaaatttcaatcttttttcaacttctcattaaaaaattataatttatcaatattattaaaaatttcagttgttttacaatttccaacaaaattattgggatgccaattcgtgtaacggtggtcagctcgcaattacggatgacaattgtttgacagtgcattacaataaatatgacatatgtaaaattttaaaaataatattttatatgcctcaaaaaattatttatgtaaaatttaaaaaataatattttatatgccaaaaaaattatttatgtaaaatttaaaaaataatattttatatgccaaaaaaattatttatgtaaaattaaaaaaaatatatttaatttatttacctcaaaaaaattttttgttttgtttttctccacagatttccgttccatcttcgcaaaatatccggttttgctgaacatcggatccaccgacactttttactttgaaatttcgatcataaacatggaacggtatgggtgggcttttttaattatttgaaattttccgttttttttaaatttatttcgagaaactctttttttggatgtttttttaattctcggcttcggctccctgtttccattttcgactctcgggctcaattaaagtttcttcatgagtgtcggtctcgagtctgtcgcatttttactagggtattgaaggctcaatccccggcttggcagaagattctcgaattccctggctcaattataagctcccgagtctgatcagttctacatctcgatttccgggtcaatggcttagccagcagggaggggacccgaaattgaaaagttggaaatttttgaaaaagtataccattttccttagaaattatacgcccttgtccggggtcaaattctcggtctcgaatctctggcaccgattcttggctcagctggtcaattaacgcttccgagtctcgattaattaattctccgtctcctcttcctgatccagaaaaactcgattctcgagtatctcaattttactaatttttaaaaatatttagctatgccgatttcggctttgccgtcaaccaatcggatggcgcaattcgaatgcgcaagggcacttacgcatactcaaacagtggcgctttttgcattaacaatgtgttgaaactcagttatgcaaaatatgcatacggtgctggtgatacggtgggatgtggcgtcgatttggccagccgacgcatttttctcacaaaaaatggcacatttttgggttcgtaaaatattcgtgagacgtattttgaaacatttagggccagccagaatttggtaattgcacgcctcgaccgggttttagagtttaaaaccctgccctttttggaccctgtctggttgagattagagatcggaattttacgattgtacggatcatggatggcattccgatgcctcaaaaattttcggaaatcggaattccgagtgctcaaaaaatttatcggaattaattaggttttatatcggtcaagagtcgagaatttctctgcctttttagaaggggtcttgaaatttcggagcgccgtttctcagtgataaatttttggtatttttttggcccgagaattgctttggggttttcgggacactgaataaagctcgatttataaaagtaatttatgatttttttaaagaatccttcgatttggttcttccttctaatgatcttccgctgatcccattcgtcactttgtggagctatgatgacaaaattgaggccaattttggaccgaaatttgaattcaatttggccactctctgacgcacatttttttgttcattgtttttttatgtttttaatttttgactttttcattgatttaaaatgtcgttaaaatgttctcagttatgtttttttgttttttgggtccaaacatttaggcacgaaaaattttcaaataggcactaaaaaattggaaaaaacaacaaatttccgcttcaattaacaaattccaatggatataattaaaacttcgaattccgttgtgaaatccatcaaatctaattatttatttatgggaatttctgctttaactgacatgagacgtctgatcatattatcggtccaatgcttgcaattgctgacaattaaattgtagtccttccacatgccatcaaacacgcgctgaatgccatcaaaatccgtggtgcgaatgccaacgatgggctcatctccgtacgttgtcatgtaacggccccatctgtcactcgtttcgtcttcacacacaatttcgtaagttttgtaggcaatttcgagacaaagtatgcattcgtagtgcacctccaaagcggtgtgggtaatgtctgtgatgaaggaaggaacagtggatgaacgaacagcaatggataaagcaaatccattttcaaaatgccaatttttttttatcaaaatttcgacttaaaatcttggagtaaaattgttccctttatgaaatcgaaccatttatttatacagtactttgatctcaccatatatgatcattgatcaatttgacaattattgcctaaggacaaaaaagtccgctaatttaaaaaaattgccgagactttcccttataaaaaggaagagccgatctcgagttaaaaactagacagctaaaaaataaactgtgattcgatcaaggtgatcaaaatatgggcctatgcaaaatttcaagaaaattaaacaataggaaaaatttttttacaatagcaaaaattttacaaaatggcattcattttcaaggttgcatagaatgacttatttttgctgttaaaattgcctgtgatttttttcaattagttttaatcaattttagaagaaaagtgcgaaatcgaaaatttgaaaaatgcgaaaattggcttaattcttttcgttattaagtagggctaacactagttcacgcatggaatggaatcaaagcacgtacttaaaacccaagtgcagaaaaaaaattgatgggatgaaggaatggagggattcggggatggcacggcaccactcggggactgggaacaggggtgtgtgaaaatcataaaaaaaaaattttcgaatacgaaaacaaaacgaaacgaaaatccaaaaatttaaaaaccgaaaacgaaacgaaaaacaaaattttgaaaaccgaaaccgaaaaaactttggcggacgaaaacgaaactcaaaaaggtgccgaaaatgtaggacgaaacgaaaacgaaatttcgtccagccctgacggggaatttatccccaaaaaatgctaaaatgaaacacctcatatgttctttatcattaattaattacctagtccgctgagcgcagtatccgataagaaagcatccaaaacaattttggtagtgcggtccatgaagtcacaatcaacctttaacaaaattgtgaaaaactcaatttatttgtgttcaatttgtttgtttgttttagcgaaattactcggtagaatttcttggcacgcagatacgaacaatggcaggcacatggcttctcctcatattgccaatttccgtaggtgtccgggtctttctcgtgctcgtccattgccaaaaattatcaaatacgaaaacaaaacctaaatgggggggggggggggcacaaggcctaagtaagcttcattaggcaaacggatcagtgaaatttttgtattttggtttaaatttgaaataacgtatttaatttaccgtatttcctgaattagtacccccgggggttctatttttcaacccccctcaaaaggggagttgtaattcaggaaatacggtattttgcaattaaaaataatttgtgaataaaaaattatttaaatgatgatttgattttgttttcataatatatttatgctaattaaattattctaaagcaaaaatcatttctgatcattcgtaattaattgctcgggggacggaggagaacaacgaaatgggaaaatggaaataaatgcaaaaagaatggcgggggggggggggggcggatggatcactcactcatcggcaatgtcaaaatctttaatctttgtttatgtgttgatgattggatgctacacatacctatttatgtaaaataaaataaagtcattgggaaaatggaaataaatggttagccgacatttgcggaccgacattttgtggctaaggtggctggacatttcgacaatgaccgtttcgacaataccttttcgacaatgccgtttcgacaatgaccatttacgactatatcatatcgccaaaatttaaaatatcaaattaaatataataaaatgaatataaaaaataataaattaattaaaaaaatattgatgaaatttaaagagaaaaatttaattaggtagttatattttttaaatttaatgaatgcattcattatctatcgcctattgtgtatgattattaatagtgaagaaagaagaaaaatgagacggacctataatataaatccaaaatgaaaccatttatttaacttaatgtatgtcctctttttacccaggcggcaatcctgaagaatgattgtccctaattttcattttttttaaattttgtgctcaaaaccagtttttaagagggtgctgataacggatcttaactcgggtttgcccaattccgaactccagacccgaattcgaacaaaaaaaaattgtttttttaatcaagaaaaagttttttcagggtaaaagcttctaattcattatcaactat

SEQ ID NO: 413 - DNA, 3792 bp, Heterodera glycines
ttcacctttctctctccgtctctctctctctctcttcttttcccctctctctctctcttctcgctctctctctgtctctccccctctctctcttccgctctctctctcttctctctttgccctctctctctccccctttctctttctcctctctctctctcttctctctctcttcctctctctctctctctctctctctctttcccttttctctctccctctctctccttctctctctctctcacctccttctctctctctctccctctctccccctttctctttctcctctctctctttctcctttatctctccgtctctctctctctctctcttctattcccctctctctctctctcttctctctctctcttcctctctccccctttctctttctcccctctctctttcccctctatctctctctttctctctctctccctatctctctcccttccttctctctttctcctctctctctcactctctctctctcattctcgctctctctttctctcttccccgctctcaccctctccctttcacttctctctctttgcccctctaactctctttttctttctctcaccccaactctttttccttgccctcctccactatctacttcctttctctcttctcttccctttcctttgtctgttctcactattctcttatctttttctttcctttctctctctctctctctttattctctcccaacttctctctatgttttgtgctttctttcatctcccctcacaataaaataatttcataacaaaatctttcgtgtcgataaatattccatttttccgttcaaaaaacgcaaaaattttaggaatgacatacccaaataatataatagatcataggaaaatgagggaaaatattgatgagtagggattggatttatgtttttacttattttttctgcggctttaactcgacgagaaatgcacgaaaacaattttttttttgttcgaaaattttgcgttttatcgcccttaatcgaccttaaaaatccttattttagatgttcgctcttaaaataagtttttgcctatattttaacgtttcgtccctattttcgcccttatgtcgcgatttttgaatttttttcatgtaaaatcagggttcgcaagtgtccttttttggaggggccggatctttaaaatatcctttttttaaagattgtcttttattttaggcttccacaaactttttaaattttttgtgcttaatgatatattttgctgatatttatttattttattttcgttttaatactattttctcttcctctctttccctctcaccataactttttgttttttttgtgtacacaacctattgtcagacgcttcagaaagagggagcgcttttttggtgctgaccttggcttagcaaaagtggaacagcatgcaagttaaacttattttttatgtattttacgcgaccgttttggattattcggacaaatggtttaatctctttgacgatgttagcgaagccaatcaaattctcaattcaatcccaaaggacgaattgcagaagctcaactcagaacagaaatggatgaagttatttgaagccgatttaccgcacttgtacaagttggtcagcattgtactttccgtgccggtctcaaatgcatttgtcgagtgttttcgctttgcggctcacaatggactgatgttcggaatctgttgaaagttgaaaccgtgaaggagctggttcagacgaaaataaattttgatctcacttgcccagaaatgtatcagatgctcatttccaatcacaaactgttggatcagatcggtggatgggaaaaatactttgaatgacacttttttgaaaaaaatattattttcaataataaaaccgttgtaattgtgccaattggttgtattttgcttttataaaagccaataatgcttttaactgtttttacaaggtaaaaatccattttttcaaaaaatctttattttggggtcaaaatcttagttttagcctcgtttatcctttttttgaaaaaaaaacttgcgaaccctgtgtaaaattcaccaattctttaataaaaatgcaatgaaaaattttttgacgcgatcactttttggcgacttgttcaaaaactttcaaaaaactttccacgaaatttattattttttttttggtggtcgaacatttcttcgtcaatgaacctttcgtcactaaacttttcgtcactaaaataaaataaagtattttaaaaaggaaaaaattaaaataaaaaattaataatatatgtaatatgcatttgaaaaaatataaatctaatacagggctcccattcgtccttggatgccaaggacgtccttggaaatgagcatttggaaaagtttaaaaatgaaagaaatttgataagtttttgtaattttcaacaatatttggattaaattatgcattatgtaattaaaatgcaaatttaattgcccaaaatctcaaaatttggtcatttttagacaaaatctgctaacaaacactgccggaccgcccccccctgttccccgaaattttttggaacaaagcgcgccacagcatatgcggtgaaatgaggaaaaatcagtgaaatcaaaaaaatgtagaaaaaaatccattccggtgaaaaatgcaagcctttgagtaaattattaaccatttttctttcatacatataataaaaatttaaatgtccttggttttcatgaattttccccactatgttcttgcaaatcggcatacccgtccttggaaacggagcatggacgatggtaaccctgatctaaaaaatatccattctttaaacaactagcggtagtacggttgtgccaaccctcggcatttcatcactggatctccggcatacacatacactcatcggaactctatttcagcaattcctctacatcccaatcgccgggactcaattctccggcattccaatggccgggactcaacccaccagcattccaaagcactggaactcaactctccggaaatccaatcatgttaagcgaatgtttaaagaatttttgaacgctggcacattgttgccgatcaaggacattttttattttcaagaaagagggcccaatttcaaggatgtccttgccattcaaggacgaatgagaaccctgcataatagaaagtccatttatattcagctcaacaatttgtaataaatctttgctggattaaacaaccttcgtgagaagcaagacctattgaaaatttattcaaaaaacaaaattttctaacgcccatatcttttttataactcatcaattcggttagcattttacatagaaaaagcttcttcacatcaaatcttccgaatgataccaagattttcaatctttttgccaaaaaaaacaagtttccttggcttttcgaggtcactgatcacgaatcctgcatccatttcggccaattccgaaacccggacccgaattcgaacaaaaagtggaaactttaaattttagaattttgcatttttagtctaactgattaaagatattttattgcagaattgattgttttcagtttgttttcgtatgtttaaaccgattttgaaccaaaaatgcgaaatttggaatttcgattttttgtttgaattggacccaggtttcggaattggccgaaatggatgccggatgtgataagaatgtttaatttggatgcttcttaaaaaagttatagtgaactaaagttgcgaaaaatttttgttttgtgtgaactccaatagagcccaattttcacgtatttaggctt

SEQ ID NO: 414 - DNA, 1528 bp, Heterodera glycines
caataaaagcaaaaagtgcgagggcggcgacacccaaaggaaaatcatcgccaatcatcaaaggtcaatgtgtggaagggaccaaaaattataacggaaattgaccgatgatgttgttaattcccaattaattaataattagtcgctaattactttctaattttaaatgtccgtgagtgagggagaaagaaatctacacaggttcttttaatattgttaaaaaagtaagactaggtatctctgctactgaagggctttaattgtgtgatatcttccgaaaattctcgtcctagaatatgttcatgtaattaattggaaaattacagaatgatatcatgcatattttggaagaaatgaaacgcaattatcatgtgtagtgtaagagatttttttttgcaaacagtggcaagggataataattttcacatggtaaatgttattggacgcataaaactttgattggacgcataaaaagcgattggacgcataaaagtcgattggacgcataaaaaacgattggacgcataaactggagtagagccaaaggaatcccctgacaagtgataagcaacggcggacgcgctgtactgaagaaaaaggaaaacaaaaattgaaattggcatttttaattattttacattgctttttccatcttttccgcttcttttggattgtcagacattttgttgggcaaaattattaaagacagatttcgatggattttaaatagcttagaaaaaacgaaaaattacggtctacgtcagttgggcgctcatcggttgggcgctcacgtttgtgcgccagcatgtttttccactataagtttctataacttttttctatgtcgtccaaatccaacatttttgatatcactcgaaagcataatgtatttagaagctttttctaagctattgcttcacgattagacaaataacaaaaaacgtatacatgaaaattgcgaaaaactcgaaattttgaagttttttcttaataaaaatttttccaggcttgaaaatctatccgctttttgtaaggctaatagagcatgttaagagctttcgaatgataccaagattgttggatttgaataacaaataaaaaagctaaattggaaaaacgtgctggcgcccaaccgtgagcgcccaactgacgggttccgaaaaattatgatcaaaaatgttctaaaaatcaagtttttttttcattgttttctgccataaatcataaaaatggccaaaaagtcacaataccttaaatttccatccccaatcattagattatctaaaagttatattaaaaaaacactcaatattcaaaaaacttatagagccaaaaaggtgtgaaaaagcgaatttttttatgcataaatcgtacgaatgaaagaaaataggaaagtagggagggcttttataggaccgtttagtaaaatgatgaaaaaattggcaacaaccaaaaaaattagtacatataaaagcggttgctcctccgtcacttttcgtttatccattcgccatttatccatttgaat

SEQ ID NO: 415 - DNA, 1116 bp, Heterodera glycines
accagtagtaattttttttattaatccgtaaaagtatatttaatacattttggcaaattttgaatttcgatttttttgttagtcatggattttgtataggtcgaaatgaaaattatattcgtgatcactgatcagcgaccccaaaatcccctgagagatgtttttacaaattattaacatttaaaaattttgatcaacaaagatgtggtaccactataaattttccaaactcaaatgctgtaataaaatgtatttttggctattttttttgaaagcctattaaaaattttattatttttggatttatcatcaatcgatatgtttacagcaagcaatcagcggtgcagccgatcaagcaagtgaattgttttcgcagacacccggctatcccgaacattgtcgacacccaccacattcttgtgtcgcgttctccgcatggctttacagaagggtcttcggtgtctgcgggttcatttgccgcctttttttcactcatgatcaaccgttgctttcgaatggacgacgtggccttttcgggacaaatcggactcgaaagacaagtgcagtatgtccagcaaaattgtggagaaagttgtaggcatgagtgacttcgggttacgcaaggtcatcgtgcctgacggtaatcgtgatggatccttcgccacatttgctgcttatttgccgcaacagatgtcttaaaaaagtcaatttttattacaaaaactaaaaaatttgtacgatattgaactgtgtttagttttttaaaatacacttcgttaaacctaggaaataattttttttttgtcgaatttcgttatttttttgcgaattgaattttgtttttcaatttcctaaattttaacaaaatgtcactcattttcaatctcctggctttttaaacaacaaccaaagaagcaggcttgaaaaagcttccagaatttaaatcaaaaaaatcggcttcaattaagtcgttaatctataattgaggtgtagctggacgaattcgttttcgtcgccttccccccgtacattgccgccgaagctgtgcttttaactggctcaacaagtgccgaattttatgccgccattttttataagtgagtaaaattttttttc

SEQ ID NO: 416 - DNA, 9257 bp, Heterodera glycines
tttttcaagaaagttcttggttaaataaaaaaccggacaatccattcaaaattcgccgaacagtttggcattttcagcaaacgtccgtttccgggcccgtcctccaaaatcgagttttccaaaaaaaaatcttactaaattttgaaaaaatttatttagcaactgcaaagtcggctgtgcaaacgagaggattcattttgcgcggacttggtacttttgatgacagaaaataaggaaaacatgtgaaattagttttaaaacctgaaaaattattatattttctataaaaatatttgaaaaaccaatttaattttataaaaacatctgttagttttctacactcaaaaaaccctccttttttaaggatatcctgtcgccatttgtgtcaaaatgtcaacagttgtgaacttggcccccggagaactttcattcgctgctggccaatttgacccattaacgcaggtaattttgttgatttatttattcttttttttaattaatcataagaattttttaaatttaatatgcttattcttattactttgaaccaatttcttactatttgtcatttaattcttgcaattatataaatttgacctttttaatctatttaaattttaatgttttatctattttttcaaagttttgcttcccttttcaaggtcgaccttctgtccatcaattgtcatgagcgtatgattcgtcgttcggcagcgtttggctcattggtgcggaatgctccgagtcggtgttggaacggttgaactcattgctggaaccaaaatgtgccattatgttgaccatttcgggagcgcatcaaagcgtcgacatttggcaccatgccacattggttgtggtggtggtgaaacagtgacagcggccaacgagtttccaaatgccaaccggtaatcgtaatgaaatctttcgccatgagcacggagaggacttgaggacttcagagggattggaaaaatcctttaaagtgatcgattgttgtttttttcacttgaaaatttccgttatgaatttttttctttgaaaaacatttataaatgaacatatatacttgtgccttttttaaattagatgagaaatggaagcagcagcataacatatattgaatcaataccgtattaaatttgataaaacaatgacaaaaaaacaaaacaaataattgtggaattaagagaaaataaaaagaatttatagtgataaactttagattttaaaacctaaaaaataaaaaaaacatattttgacgcgttttgctcaaaatttattaaccaaaatacaataaaaaattaaaaatacaccgttaagggcccaaagtttatagaaaaataccctaagcttatcaaaaataaacaccctaagaaatgaaaagttttctcaaaaataaatctccaaaattgtttatttattttcttgactttgaggctttttagtgcctgtttttggtgttttttatgacctaaaacctaaaagttttggctgtcttcccccccccccccgttcaaaaaaattgcaaaatttttttttcttaaattaaagtcattttaagggttttcacggtcggagaatccgattcttacatctgtttcgacccaattcgaatcttgaacccaaattcgaacaaaaagtcgaaacttcaaatttttttctagtttcgcacttttggttcaaaaccgacgtaaatacatataaagaaacaaattaaaagccatcaatgatgttttttgatgaggttttacgaaatttttgcctttattccgcctagttaaatttgttatttttaaatttttcacgtaaaatttcacgtaactcacgtaaaatacgttatagctaaaaataagtgtcagattcgtgatcagcataaaaaattaggctagaaaaaatacttagaaaaaaattttcaggggggtggcaaaacccggaagtaccataagtgattgattgagtgagtaaatcatttggtttttcattttgtttctcccatcgtcgcccctttttttattaatgtattttattaaagttagggttagtaaacaacaattttccttttttaaaaaaggacaaatgaatagtaaatcgagcagagctgtcaagctgtaatttaattttacatttattgttttaaattgattcatttgttttccatcattaggcactccgttgggccgacgaaaagtgctgtcaaaatgccatcgaatgttccgctgagaatcgtcgtgctgcgcttggcccggcactcttcaaaattcgtttccctcatcctattggttgcatttgtgaaagaaatcggtagaaattcaactattatttatcgacattaccctctttttgcagttccttctggcatttttacaaacgatgaatttgtctgcgtttatcaattcaatttctacctaattcatggtgtgccggggctttacccgttgaaatttccaattcaaaatcgaatttctttttggaacattgccaaagccaacagagggactcttgcgatggaaattgagaaattttctgaatttgcgcgagaagtgggacgaatgcaattcagcgatgccgtgggcataaatggctttcagtgggaaatatttgcaggaataaacacaaagaaaaaaagcacggagaaatgcctgggctttggccttttgttcactactgtttcggaaaaaagtgaaaacaatgttaatgtgtgtttaatatttaaattagagtgcgccgggaccgggacctggacacggacaactgagtaccaaggtcccggttttgaccgggaccgggactagtcccggttttttcccggttttcccagccaaaaattcccgggttttcaacccaaaaaggtcccggtcccggttaagcccaaaattcccggtcccggcgcactctaatttaaatggattaattaaggtgtaaaatggagttgcaaatgttcggcgacctttcaaattgtttcactaaaaagcggtacggaaaatcccgttggaaaaatttgtgatggaaattgacaaattttcagaatttgcgcaagaaatcattggtagtgaacggagcagtgaaactgtttttgtaaagggattccgttgaaaatatctgtacaaacagacactgatgaacgcaatgaaaagagtttggcctttgccctcgagtgttcccctcaaaatgaatttcatttttgtcgaatgcattcttttcatttttcgtttaattataatttttttttaattttgacagtgaaaatttatttatagagtttaatattataatattaaagcaataataagaattttaatgaatatttaactttaaattttctttaaaaatcagtaaaacagtgagataattaactttaaattttcatttccttatgctatagtaacaagtgactcaaaatgtacggtaatgttggtgccctgtcagttcccatcactttttttatcgcttttgctattggcggcattttgccattctgaggaccgtacctttggtggtgaagagcctgaggaaaatcaaaacaattttaaatgcgttttccgtataaaatttgtgtaaaatttccgccggtgtgtcacaatgtttgttgataaatcctcctttgaaatgagaggaaagagaattttaaacagctaagcgcagcacggcgatttccagaggaacaatcgatgccattttgacggcatttttcgtcggcccaatggagtgccaaaaaacagaaacaaatagcaaataaatttgccacgcaattacttttattgtataaaatttccaaaaaaataaaaccaaaacaaaatgagtgattagattatgtgcttattcatcggttagtttgcgctttgtccatttttttcttccaccgtaaaatcaatggccaatgtcactttatccttatctttgtcatacaatgctaagctttgatccatcagattttttataaattatgggcactcaattatgaaaagatttttttaaattttcactaacagcttacaaaagccttgatattttttggcgctaaaaataagttttctcatcaaatttatgcgtaaagtcctccgttccactcttttgtgtaaagaatgcgaggtgttgcagaacattcgcagctccaattcgggtctaaaaatggtaaaacaataattttatattatctttttatttttgcacctttttgaggggaacactcaagggcaaaggccaaactcttttcattacgttcatcagtgtctgtttgtaccagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaattttaagattgtgatgcaaaaataaaagtttgtccacattctcaggcaataaacgttttctcagatctgtcacaatcaacccagcggtggagaaaagccgttcgctttcagttgatgtagctggggctgagaaatatttttttgatagcttagtcaaaagaggccatttcaattcgtttgcgccagaccaataagaaattggatcttcattgatatttatttttttggctcggagatattcattgacttcaacctgtataaaaaatagtttgttatttaatttctggtttatttagttcgcctctgatttttgtcgggcgttcaaaacggcgggacttggaattggcgaggccaacaaaaaattatccaaattcatttcttgttcaaattcagtgaacaaattgtttgatctggatccaaatagtttgacaatttgaaccgcgggtccaaaatggttggtaatacaaggtctttgttgttatgccacgcggttctcttcacagtcccatttgcatcaaccttatctcccatttttttttcaacccatctattattgaaattctgacatttcttaggtcttcccccttttctaaggcaaaaatgatgacacggaacactggaattgttactgaaactttggtagtccttttttggagttgatttgtagcatgaaaaatgggcgccaaaatcttaagacacagataattcaattaacatgcattcggtactacttgtttcaatgctgaaattatacgccaatcatccgctgagaaattcggaaacgaaatgtcctctgcacacagaagcccaacaactgttttgttttgcaaaaaacgatcaagcatttggaaggtggatgaccaacgcacctgataggaaaattgcaattaattcttaggggtgtaataatcggatttcaaggcaaaatccgattacgattatccgattccaattatggcccaaaatccgattaattgcgattccgattacgattacgattccgattcggcacatccctggtgcaggccatctgagcgccagctgttgggtgcctgtcagggccatctgagcgccaggccaactgaggctaattttttttttttattattttaaattattttacttttattaattttttgtttttttattaagaataattctgccgcaggcaggcggactcgaatttttggtctgccaccaacccaacacactaccactcggccatgcgaccaattgccataaaaaggataattgtcaactatatattgcaaagatgatgacgtcattactgcgaggggttatctttggttttctttaccacaaccattccccagcctaatgttcctattatcactcccaatgtaaccctcggatttctgcccctccagccgtttttcgctttcacatcgcctttcgccctgcaacgatgaatttcccttatcgtcgaacgttcagcttttccccgtccccctccttttttatcatgtgaatatgtgtgtccagttatgattatgtgccaatccctttgaattccgttttttccttttactcccatcttcgcccttatcgagaagcaaatcgtcaaataaagttgttgtgttattctcttggttgaatttgagtaataaaggaagttcaaatttggaagggaagaacaggaaagaaaaaatctggggaaaaacaatcatttcaattcgcgtttgtcccattattcggttccaaagtgaaaggaaaggaggtgcgagttgcgacacaacggccgggaaacgaacttcctatcgtatccctgttgtcctaactattttttcaattaattttcattccttcttttattatgtctgcacattttctagttcaaattaaattggcatttgacgttttgagagtcaattgtgaattgttacacaatttttgatcggtaaatgacatttttggcgatttttatggcaaatttagtgcatatttgggcattttatgggtttttaggtttgtttagatcaattttatttaaaaaaagtatttttttattaaagattttttaaattatttttaaatacattatttttaattaaattttccaattttataagatttgcataattctattgatgatctaacaagttttaggaataactcctttagtaataaaataaaggaggttcttccaactttttattttttgcactctgagaaattacccatttattttcataaagatatttgcatattttttacggttttatgggaaattttacgattttatgtgcatgtaataaacatctactactagctatgaataaataaagaaatccaaaaacgatgaacaatgatgattggaaaatcaattaaaacgtattgtttatcgatttataatattttatttctccggcaatagcaaataataatttcacatttttattaaaaatattataatatattcatattactctttgcttaagaattatcattaaaattatattattactttctaagtaaaattaataaaaaaaaaattattttgacaagatataattaattttctgagcacaattagcatttttttttaaatgacaaatatttttttaaattagaagaaggaaaatttttctagtttttattttatttttgacatacaaaaaattattttcattaatttccaacgaccaaaaataaaatgattaaataattctttctttttaagacattgcccaaaaaatcaaatattttttttcttttaaatgaaaattttttaaaaaattgtattaaatttccgaaattttcggagggtccttctggcaaacacgggtgctaacttttacatttgtttgtcttaatttttggttttctaaattaaagaccaacaattttattttactcagattttttccaaaatccctggacgacacattaaaagtgcaaaaaccaaaactcacttttcccattacacaatcttggtatcatacgatagcccttgaatttcgttattagcttgttaaatttcaaaaaattttattcactttttcaaaagttatgacaatttttccagctttttggcttaaacttttgaaaaacttaataaaattttttgaaatttagtaagataataatgcaattcaagggctattcgtatgatatcaaccaatattgtgcaatttagtttcgtctaagaaaagttatgagttgatttagtcaaatagcaaattttgcactttttgccccttgacatagcaccttgtgttcatagcagtgtattttaagtgccatactattttaaaatttgaattaacaaatattgaactacaggtctcaagaccattttgcgcataataaatttgaagaaaaaagcctaagcctagacttagccaggcaaacctaagcgttgctctaatttcttattttttaatatttatataaagaaaacaagattaagaaaattatattgttgatcaatgtcatcattttaaattattgcatcattatttaatataatataaaaactacattaaactaataagggatgttggataattcaattgatgtcactaatttaaatttttataaggctgcatgattttcaatttttaattttaattataattttacttaaattgacaatactttttttataaaaatagaaaatagaattttaattaatttcttaataaaaaattgtttttaattaattttttatgtaaaaatattaaataataatcaatgtgcatttatgcttcattaaatcattcaatttatttaatttaagaaaacataatgttttgttctttttcgaaaactccttttcatattatcattcatttttttctaattcaaatttcgaatgcaatttcatcagtgagttaattaacagttaattaattggtcgaatcattttttaattagggagacgacaaaatgctaattgcatttgtgagaaatgagcagaaaatgcaaatcagtgaatattcaatggaaaaatatgagatacactttggcattttgtattatatgagaaagaattggaaatgttcaaaaatttcggaggaatttgaagaatacgaatggacagaatgccaaaaatatcgcaaatattttgacattttatacgaatatttgtgcagagaatacgttggaattcccacagtaaagccaaagtttgtatttgaagaccgaattgaaattgaagggccaataatttatgcggtgaattgtttggccagaatttcgcgattttattttaattcggatgagttttataaattaaacagattattcaaatgggtttataattttgaaccaaaattgttaaatgaggagagattgaattttggaataaaattggaaaatgaaccaaaattgccaattaatgaaatgattttgcaattggcaattgacacagcgaatgaatggcaaacaaatgaaagtttagaaggaataattcgacaaaattttgacaataaattggaggaaatgtacaaaaaagcggaagaaagggcaaaagaatacggtccttggggtgccaatgaaataaatgatgataagcatatgataattgcgtattcgaaattcgatgatcaaaggacatgggtaagacttaacgttcaatgataatttaataaattcaaaatttagactgatgatgctttcttttcggaatttgtcaaaggattaacgacaaattcaaagaaattttttaaaatggcaaaagaatattcgaattatttacgtctaaagaaagagaaaggaaattatattttaactgatgaaagaccaatgattctttgggttaaaggaattgagaacagaaaaagtatttgatgcaaaaatat

SEQ ID NO: 417 - DNA, 8482 bp, Heterodera glycines
tttacattggcttcacattgttgccaattatttttgatcatataaacgtaaccaagataatattcatattgttgcatcaaatgctccgctttaactttttcaaaaatgtcgtttcctttgattaatttaataaatttcgcaaaatctatcgcagcatatcctttcacgaattcaaaaaataatgcgtcatcaatctaaataagcataaattaatataaaatgcatttaaaattaaaaatttttttctcagatttcacccaaatcgatgaatcatcgaattccgcagcattaattattgtatttaaatcataatattcttcttcttttccattttcgtccacttttttaaacatttcttctaatttattttcaaaattttgttttattattccttcggcactttcatttatttgccatccattcgctgtgtcaattgccaattgcaaaatcatttcattaattggcaatttactttttaatttaaattcataattcaatctgttctcattcaacaattttggttgaaaaagccgatcaatcgaattgaacaatttgtttaatttatattcattaaactcactctcttccgaattaaaataaaattgcgaaattttggccagacaattcaccgcataaattattggtccttcaatttcaattctttggattcattttccaatttcaaaattcataatttaatctcttttcattcaacaattttggtggtttaaaacgatgagaaaaatttgtttaatttatatttgtaataattactcgaaaatgaattaaaataaaagtacgaaatattgatcagacaattcaccacataaattattggcccattaatttcaattttgtttttaaatacaaattttggcttcactgttggaattccgacgtactctctgaacaaatattcgtacaaaatgtccaaatatttgcgatatttttggcattctgtccgttcatattcttcaaattcattcgcaattttctcacattgccaattcattctcataaaatgcataatgccaagatgaacttcgtatttctgcttcgaatattcactaatttgaatttcttgctgacctttcgcaaaatcaattagcattttgtcatcagcctaattaaaatagattttaataaataaaattttaaaaagtcaaaattcaccgatggattttcatttgaaattgaaaatgaaaaatggaggaaaataattataaagaatatagcagaaactgggttgaacattctcttatttttcataaatattaaaaaatttatgagagaataataatatatccgacaatttttgctgttttattgtcgctaataatatagttcgcattaaaatatatgatttgtctagtatcaaatatttggatattaaaaatgaaaatttatatgcattttgtagtttgtatcaaatatttgtttaaaataaaaaatttattatacatattcaaaatatacaattaaaaaaaataattatttttaatattttatacaaactacaaagtgccaataaaatataatatttgatacaaataattagtggcaataaaatataataaattttcatttttaatatcacaaatattttaatacaacttcacaagtgccatgttgtataataaagtgaatttgttttaaagaaaaattgaaataatttaattttaagtaatttaattgcatcgttttttaattacaatttgaaataaccgtttgcaccgaacacttcgccataggaaaacttgttctaactactttataaattagtgaaaaaatttaaatttaaaacaagaccagtagtaacccccccgtgaccttcgccgcttgacgctaattagatgtgacagctggcggggaggggtgtcaattagtcactaattgactgaccggggtactaattggtcagcggtcaagagggcactaattggtcagccgtagggtgtggggtagcaattaattaattaattggggggacccaaacctattgaacggtttcaaattgtcttgtacttttttttgacataaaatttgattgatttaaaaagtgacagccgagggggaggggtgaaattttttgattgatttaaaaagtgacagccgatgggggaggggtgaaattttttgattgatttaaaaagtgacagatgaggggaaattggaatttgattggtcagcgaagtgacagatgagggatgaaattcaaatttctgatgggcggggggacgggaattttgattggtcaacgaagtgacagtttttgatattattaaattattcaaatgaagtgaaataatttgttttgcactcggtctttatcaaacttgttatgaatgtgcaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacactttcccttgtttacccaaaatggcaccacgtgatgactccagtaacaataccaatggtcagccagtcattcaatttgatcaacaaattcgccaggaccctggactaaatgccgtttttgactttgttcgggaacagggcgcgcgggtaatttgtcacaacaaattaattttttcatttttttgattttgtttagcatggctttttcaacacgcccgccgaaatcgtcaatgttcttcagcaaatggcacagcatcgactgaatgagcgcagagcggggaataattgagagaatgaagttgagagaaaatgaagagcgaaagttgagaacaaattgatgaaacaatacaaagatgatggaaattctgaattattttttttttcttacatgacttaatttgttagcaatgctaaaacaataaataaaaatggaaaataaattgacaaattggtttaatgttagttgactccggtcccctcctcttccccctttgtatttttctctggttgtctcccttgttgacgcactatttcactgcccccaaagtgtataaatagcgcgagttttcgtctgccaccctcacttttcaaatcattcgaaaaaatttcaacaaaaaatggcgctcaatatgcaggacaaaaagggtctcctccaccaaattcttggcgaagcagacatcacggtgactacgagcggcatcacgatcagcggtccccatctctcctccccccgttttattccctttgatgaggccggccgctgccgctcatgtcgtggcaccgaggtggaactggacacaatggtcaccaaggagggcatcaccatttggtgtacacgtatcgaccgggtgcaatttgtccctttcgacatcatttacgacttgcccggtcactgcttcttccgggtgaagaacaaggcccgcgtgttcaacattccctacggggacctgcctgccatcacattcccaaaccatcaagaacaacagcagcagctgcaacagcaacaacaacagaacgatttgcgccaaaaagctaacacggcgatggatttggtggagagtggactgctagctgattcgttgcgtgaagaaggcgtgcagagggctgagctaaagcggaaggcgaaagtcgcgctcgatctgattgatgccggtttgaccggcgatgcactgcatgaggagggacaacgttggaagaaggccaaaactgcactcagcgttctcggaaacatgttgttggccgattcgttgccggaaaagaagactgcggagctcccgcttccgccagccgaaaaaattgaatcactgccacttccaccactcgaaaaaatgaaaacacccccacttccacctgccgacaaaatgccttcgccgctcccaccatcatcaaaagtggaaagtgatgagcaacaattctacgacagcatttctgcggctaccactatgatggacagcgcctcaatgcagcagcaggcgccgctgaagagaaaacagctgactccaaaaggcaaaagcaacaatggtatgaagaaggcagctgagccgcagcatcatcacaatgtgggggacatggacaagactcttgacgaattctttgagagcgttagcgcagcgacgaccaatttgtctatataaattgttgtttcatgcaattgtattgaattttaattaatttattaacacgaaatgcttaattctttctccaataaagatatttgctttaaattaccatttggactaattatttccggtccctcctcctccggtaaaacccaattcctattgaaatttgttgccgaatgcgatgaactaattacaccaaaacccgtctccaccctttactgttttggtgaaatgaatcccgctgtacccattctccaaaagtcgggggttgatgtttattcgggtgttcctccggaagagctgatcaaacgcatgccaaagccccttttgctgatcctcgacgacttgatgctgtccattgatgagcactatttgtccgacttgttcaccaaaaagtcccaccaccaccaatttgctgtcgtgttcgttacgcagaatttgtttgagcgaaagatcaaagtggcccgtctgtccgcccagtacctggtactgatgcgggcacccaactcgctgttgtccatccgtaacattggcgtacagcttttcccgcgtcaactcgacttctttcttgacgcctatcgtaaagcgaccgctcgcccatacggctatttactaattgacatgcacgcctcatctgaccccgtgctgcgcctacgcacaaatatatttaaggacgagcaagaggaggatcaaggcttagttgtgtttgtaccaaagaatggagtccaatagtcaggaggaacaagttaaaattagtcaactcatccacgacaattccaaatggctttgtgcgctggccagaacgaggtccgcgaaaaagtgttgcaagctgatacggaaagcgaacgctgatcaactgctagcgctggtggaaatttgtttgaacattgtcgcatctcgatttcgcttgaacaaacgtcagaagaacaggctgatgccctacgcagattttgttcgctgcctgagcagagtgagaagtgaacgaggcgcgagacgtatgattgttcagaaaggagcaggggttggcggactgttcgctgcactcctaacacccgtgttaattgaagttgccaaatcatttgtgagcaaaaatgtataaataccgtaaaaaaattgttgttatttcattcatttgtttcataaaatggcaaataaatttgtgcttgtaccacaagaaatttaccggggtctcacctctgcggcggacacgggtgacatcaatttggatgctgtacgacacgatttgacgcgtgccagggctgaacgaacaaacccttcagctaaaaatgtcagctacaatcaacagcttaggcgctacttgcaaatgagacgggaagtcgcggacaaaccagcacgggttgagctagtcaagggattgagtgttctgatgaggcgaggcggtgcggatgatgaagcagaagttgtagatacaccaccccgccctcctcgtcctcctcctccaccaccgcctcctggtcagcatcctcctcgtcgtccaccaagccctccaggcccaggtccgtccccgccggggagtcctccgccgcgtccacagcgtcctccgagaccacctagagctgctgcgccgccctctcggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcggattcgctctgccagcaccatcacaatattatggcgatttgcccgttctgcctgacaacgcggacgcaattgaggagatggacactgcacagcacaggattgcaaccagaagaaagttaaagaaagcagatgacgatgatggcgatgacgattttcatcgcaaaaaataccgggtctattatcctcctcccccttctcgcccacccccgtctcgtccacagccaaaaattgaaacacctcgacctccaccgcgtcctagcctcaagaaagaaccacaaccactgctcgatcctcggccatccacatcacaacaagttgatcgcaaacctaaaagggagccaaagttcgatctggatccgcgaccatccacatcacggcaagccgggtacaacccccctgcggaaccaaaacatgagcagaaaccgtcaaaaaagccacctcctcgcgccacaccctatcatattccgaaaagagagccaaaaattgaagaaacactgccgcggcagcaaccttctcctgctgccccacaagtgccgcctgttccgccacctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgaagaacaacaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgctcaaccattggtgcgaagcaatttgcgaacggccatcaggtatataattgacagaagagcgggtcgacctaccattagaccaccgggagcggaccaattggaggagcggcttaggcaggacccaattttgtattcattgacggctccaccaaagagaccatcgcagagcacaagcagcaggacgtcaataaagaaggaatttcagccgaaaaaatggaaatgatcaacaccactcttgacaagctgtacaacgatccatcctctcctgctgcgtttgccggtgttagtacactgtggaaggaggcgcggaaaaagctaaagcatttacgcaaaaaggatgtacaacactatttggagggacaccgcacgtacaccctgatgcgccccaggcgggtacgatttccgagagcaaaaactgttgcagctggcttcatgaccgacgtccaagtggatttggctgactttcaagcgctttctcgtcacaatcgcggtcaccgatacctgctggttgcggttgatgttctctcaaaatgcctgtttgtcgttccactcaaaaataagaaggccgaggagatgctggatgcattcaaagagcttgtcaagcaaatgccaatggtcccacaccgcattttctccgacaaaggcactgaattcaaaaacaaattgctgaaggaattctttgtggagcaggagattgagaaacatgagcccgtgcattcgtcagtgaaagcgtcagttgctgagcgggcaatccgaaatgtgaagcagcgactgtacagatactttgccgaaagggagacgctgaattgggttgatgttgtacaacaaatagtggatggaattaacagcactccgtcacgggttcacggaatgcgaccaattgatgtcaattttgaaaatgctcagaaggtgtggaagcgaatttatgaatcaccgcaaaaacgcaagaagccacgtttccgtaaagatgaatttgtacgcatgagcagagagaagggacagttcgagaaggggtattactacaatgtacgagtactttgattatcgatttttttcaatccatattttcggaccccccccccgccccatacctattggatgatctttgatcccttcaaccgaaacctattggatggacttgtgcgcgagaatttaattaatttaaattaaaattaattaatttaaatgagcgagagctgcgcgactttttccgataaattgtggaaaatcaaaaacatggtcgcggtctcgaaccgttgagagtggaagcgaggagcttaaccacttggccacaggggcagttgaaaggtatgggataattgttgactttatgatgaaaattccgaaaaattgtgaaaaatcaaaaacatggtagtggactcgaaccgttgagagtggaagcgaggagcttaaccacttggccccccccccccccgcccttcaaaattttgaaaaataaataaaataataggagactcagaattttgaaaattttttataaaaactgatgacaagctaatgtgataaaacaggttaattcttttcctttcagtatccctgcaaagtttggggcgcttctgataagtttctgaaaaaaaagataagcctaaactttttggcctgtttaaaaaggaattaaaaatttttaaaaatttattcatctccctttttgatagaaaaagcatcagagtgcctaaactagcatgtaaataaaatggggtgcgtttcagagcattttgtgaaaaaaatatttatgaattaa

SEQ ID NO: 418 - DNA, 2871 bp, Heterodera glycines
  misc_feature (69)..(69): n is a, c, g, or t
agccctgctcactacactgtagtgcttctcgagagtctcgagtcctaactcgagaaaagtcattgtttntggtctcggtctcttgagcttggtaaattttcgatctaaagcagtactataaccacagtggcaaatgagtccaaccctcgtccctttgtggtttttgagttttccaacatgaaaattattgtgacaaattttttgtccgataacaatatgggaaaccttggatttgtttttttccaaaattaatccctttccgccatctaatttttgaaattgggacgggagcagccgtttccacgccgccgtttctcctctcctgaaaattaaaaaaactttttcaaaccgaaatttttcgagaaaaaaccttatgttaggaattttttaaaagaaaattcagaaaaaatattaaaaaaatttttaaagctttttcaaattttatgttgaattactaagttttttgtttcaatttccacaaaacggctaaatttagaattttttattaaaaattttctaagattttttcttggaaaatttatgggtagtgaacgatacgagggggggggggggcgggggatggcatacccgcggcactccccaaaactatcgttgaatttgtttggcttccaataatcatcaacctattaattaaaaacatattcccaaaagatggttggacggttcgctccccgcggattggaaattccattggctgccctttggtgggctcggcccgcgccattgtgttggccttccgctggccaaccaagtgatggaaatggcaatttcccaactgtttcgccgcttccacttcacctcggcaactgacacttcgacagaggtgcccttaggcatatttaattgcgcttaattgcctcataatttaaaaaggaaattcgtttggtcggttcggacgttttgtggccggaggaagtgctgattcgtgcagaaagcgttaatgattagtcatcagtcagcaaacagacaaaatcactaagtgacacttttttggcaattaacattttaaacaattaaaacagagaaagaccgaccggacaataatcagtcgggcggggtcattaaaataatgattaaaaccggacaagaacaagtataattgacatgtttccgaggatgggatttggcttaaaccacggttttagcgaaaaatcttttaagatttagagggatcaattaaattgagctattaaaaaactgattcaactcgctgttctctgcgcattgaccggtcgatctgtctctgtgattaatcacttttatttacaccccatgttcctccttccatccatattggattttcctattcatgggtttttacttactgtatattctttcttactgtattttttcttatttgttagtcactattgtatccgaatgtgcttgaattgttcataatttactcccccatattcccttcggcctttcattttctggcaaatgttttgcctaattatcaaccattattaaataccaaccattataaagccaaattctcgagcagataaagccgagccaaaacaaaaatcaaagtttatgtaattttaggcttagtaaggtacataaataaaacttcatttagtccatttaaattatgaatgcactaaaaacgggatgacaatgctaaatctaaactcaatatagcaatttaagctcctggggcgtcataaaatcgttttcagtttttcgatttttgaaaaagaaagttgcattgaacggttttcccgggatgtacacacaaatgatgatgatgatgataataatgatgacgatgatgatggtgagtagtgaattttagccctgtgttgtgttgccagatttgggggggggggggggtaagccgggtcctcctcgcctttaaataatttaaaaaagcattttttggaattatatttatcaaaaattatcggaattattcacacaaaaaatttatgaattggattggaagcacaaaaaatttgataatattcactaaaacaggcaattaattacatgttttttttggagctatacctgatgaacttttttctcgttttcactaaaaatgtgtaattttttggaattttgcaagaattgttggaaactctctaaagttacaactcaaaaaaacaaatgaaaatataattgaatgcttccaaaccaatattgtggtttctcggctttattaggtcatgagtcataacagacaaaaaaagcatttttttacatataatatgaccccatggaataagaatatttaaatttttgatttattaattattccaaataattaaacaaataaggtaaattaaaataaacgaagccaatgcttctttcctaaagcagtgaaagcccccacttggcacattgccgttttgtacgcctcgcgctgccgcagccgtttcattgccgggtcgacagcggtgcagaacagagaagaacggcgacgactaaatgtggcaaaccgaattaattaattaattaagattaattaggttttaacttactttgcgaggacaggattgatgtattgggtgaggtcattggttgacgcgttcttggccaaaagcgaacgtttggccatggaaaatggttgcgcctgaggcgtcgagagcggaaactacacacaaaagggtaattaattaattaggtagtaattaccatttcgggaaagtttgcctccgggaatgattcgttgtatttttttctgaaaaaacagaaaacaattgttttttggcattttaacaaagtgtgaaaatgaaaatgccattacattaaagcagcagtggccgccgcttccttactctgctcataattttgaatggaattattgtcaattttttctttgcatttttttattcttttttt

SEQ ID NO: 419 - DNA, 3585 bp, Heterodera glycines
cccccccccccctaaaatccgatccaattttgacagctttcaaatttcacaaaatgaaacaatctctcgtaagccgcccaaaaaaaactaatttacccattgcatttgggtacagccaaaaaagcctttccttcggtgaacaattctatttgataattaaaattattttattttgttttaaaatgattaattttttatttattaatttttgttcatttcgaaatcctttatcactcgagaaattatttttcttaaagttttgtttaattgtaataatttttttcaattctttattactattttttaaaattatattttcattaaactataaaacgaagggttaaatcgattaagaaataatttacgtgaatattagaaattaataaatgcagttgtttgtgcttcttgtgagaaagtgcatctcctcaacaatgagtgaatgaatgactttggcacgtggtccaattttaaatgccaaaaaggaaaatgtgccgttgtttgattttgtggggtttgaataatttcgcccttttaatgcccttttgtgcttattgtaaattcatttttggcaaaatcatttgctcattgtcagcctaggctttgccgaatgttttgcccaaatgaatgtgggcaaatcggagagtgccatttctgtacaacgaaaaatgcataataatattaaacaattgtatcatttaattgcgaaatattcctgctcaaataatttttttacgaaataattagaataaaattatatttcaaatttaacttttatttttttaattatatttaacgatatttaaactttaaattattaattaggagaagattatttttaatttctaaattcttttaacaaaattcgcgcactctgcgccttcccaaatcaattttatggtggtataataaaaaaaagggaaacataaaattgccattaaatttttgagttgacaagaataaatgaattgttttgctcattttcagtttattttatcggaaaagagacaattaccaaagcattatattttttaggcttttttacattattaaaaatttaattaaattttccaaaattcaataaaattcattaagccattcatactgatgtgagtgacttctgcggtgcgttcttatttttattttttaggcttttttacattattaaaaatataattaaatttaccaaaattcaataaaattcattaagccattcgtactgatgtgacttttgcggtccatttttcctctggccccccccaacctaagcgaccattaattacttaattgaccaccagctcttttctctcacgcaaatattaatgccatcaataattttgcactcctcctggcttcccccattttggcattgattgtttcgccatttttttcattttttcaaatccgttgccacggcaaatgcgcaaagaaatgccgcagcaggggaggagaaggtttaagaaatatgatgaatgccatttgtgatggctttaagtggcatcacaacgccaagcaaatgcagagaaaaaacaattggggcaaaatttgaaattggcacattcaaaaaattatggtggcattgatgccaccgttgaaaattgagtccatcacattcatttaattttcccatctgccagtggttttcagtgtctgtcttcataatataagtgtgaattctaactgtttaaattgaatgtcagttttaagtatgtaatgtaacaatgatttatatacatcatttattttttcatataatgaaaattgaggtaccactaatgggtgatatgtttagacaaaatatttgccaatatgcctaatgaggtacaaaagtgagtaaaaatacagtaagttaaaagccatgaatagttaaacaaaaacccatgaataggaaaatcgacaaatatatggaaggattatggggtgtataaaagtgattaattaatccacagagacagagagcgaccggcccatgcagagaacagcgacttgagtcagtttctaattgcttatttgaatgtaagctctttaaatctcaatgattcttcgagatgaaccgtggtttaagcgtgtcataaacataaatttctgaccccgcccgactaattagtgcccggtcggtctttctctgttgaattgtttaaacagtgaattaccaatgccacaattagtggttgcctgtttgctgctgatggccaacgtgttcatcttcatattcatcaacaatttctgcacgaatcagcacttcctccggccacaaaacatccgaaccgaccagacgaatttcctttttttaaattagggcataattaagcgtaattaattatgcctaagggcacctctgtcgaagtgtcagctgccgaggtgaagtggaggcggcgaaaaagctttgaaattgccgtttccaatactttgttggcgagcggaaggccaacacaatggcgcgggccaaacccaccaaagggcagccaattcaattgccaatccgcggggagggaaccgtcgtccaaccatctttcgggaatatggttttaattagtaattaaaattgttgcaagccaaacaaattcagcgacagttttggggagtgtcgcggggtcgcccccccggggcactacgttcccctcgccccgccccccgccccggtatccttcaccacccacaccaaaaaatttcaaacccagaaattttccaataaaaagtcttaaattttttaagaaaatttcaagaaaaaaaattggaaaaattttgcggttttgttggatgaaaaaaaaatttagaaatcatcataaaacttgaaatctttaaaacaaattttaaattaaaatttctgaattttctttcaaaaaaattttttttagatggcggaaagggattatattttgaagaaaaaaaatccaaatgtttcccaagtggaccttaccggcctcagtggattttttacacagggacgagggaatggggaggtccgttggactcatttgtcagtgtggtcaagccgaaaagcacaataagtaaacagcaggtaaagcagggaatcggtcgttttggcgccgccgttttggcgccagcctcagtttttttattataactttttttcttgttgaccaaatctaacaatcttggtatcattcgaaagccattcacaaactctattagccttgcaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaacatgttaagctttcgaatgataccaagatgactagatttgccaatcaattatatgcacatgcatatttttttcctggactctgagaggcctgaaacgcacgaaaaacatgtttttagcttgttttgaagcttctaggatgacttttcatatgcatatttgcatattttggcatttcgtgcatattatatgtgcatattttggcatttttccaaaaaacctctaatagaacgtcccccaacagacaaattggcttttttgacctcaaaaaccggaaaattttccaaa

SEQ ID NO: 420 - DNA, 1592 bp, Heterodera glycines
tagcgtgcaaaatttaaaaaaaaaattttaattctcaaaaaagttaaggccaaaaatgttcgaaaaatcaagtttgtctaggtttttaggccttaatttttttgagaattaacaatttttttttaaatttgcagacaaatataggatacttagggctttcgaatgctattaaattcattcattttggacaactatgaaatatagttataccccaaaatcagggctcgagcccagttggttggcgcccagtcgacccccataagcctaagcctaagcctataccggtaagagcaaaataaaaataaaataaaattgtattatgcgcacaatgaaacaattgggcacaaacgaagcgtctccttgatgacggccttcaccagcttcacatcatcaccgacaacactcgccgtcagctcttcgcggagtcggtgctgaacagacggacgatgggccatgaaatggacgacgagcgcaagacaatggccaattgtgtcaatgctaatgatgggagagaaataataattaagaattttcggcactgaccccacacttttcatggcattttccaaaaagaagtttcccaaagtgcaagcaaacagatggcaatcctcatcataagcatcatcatcaccagggctgttgttctgctcaaaaaatgttttgtgaattatcggactttttaattaattattggattttatttttattaaatattttttattaaattaattaattagtattgttaattaattacgtgcgctatctatcattacgttttgctgttgctgcttctgtccgtccttcttctgcatttccagctccaaaatctgcttgtacagctccgtgaacacgtcgaagttggcgccgttttgcccaattttcgccggaggcaatgcgcgagaaaggcgcgctttttccttcagcagcaacaactgctcggcataggcggtgtacgtgtcgcaaaactgtgccgtatgatcaagctgatgggcacggcaaaatgcgatgcgtgccaaaatggcggcgaccaaatgcagcgaagtgctaaaaagttgggggggggggaagaaacaatcgactcaactattcttagctggattaaattcgtggtaagccaaagtgacaaaagtatctatgcggggtgattggaagagaggggtcgttttagtacggaaaattattttaataaataataatttaattgataatttattaatatatttatgcatttggctctattgcggtttaaataaccataaaaaaagacacaaccataaaataatttgacaatattaatgtgcacataacagcatccaaattacacataggattcgataaatagcctcaagagttctctattagactacaagatttcaacaaatttcggtgtgtggccagaaaacttcaaaaattgttttctaaacatttctggccataattttttttttaaaaaacataatgaaaaataaatgaaattttttgaaatttgtagtctaatagaggactcttgagtctgtcgaatggttatgaaattatcaattaaaataattcatttatttgttaaaaattttccgaactgaaccccccccccc

SEQ ID NO: 421 - DNA, 6178 bp, Heterodera glycines
agcaaaaattaaaaaattaaatttttgcgcacaatgaaacaattgggcacaaacgaagcgtctccttgatgacggccttcaccagcttcacatcatcaccgacaacactcgccgtcagctcttcgcggagtcggtgctgaacagacggacgatgggccatgaaatggacgacgagcgcaaggcaatggccaattgtgtcgatgctaatgatgggagggaaattgaaatcagaatttaataatttcggcactgaccccacactcttcatggcattttccaaaaagaagttccccaaagtgcaagcaaacagatggcaatcctcatcataagcatcatcatcaccggggctgttgttttgctcaagaaaattaaaattttttaaaataattagttattggacttattttactattaatcaatcaattaattactattattaattaattacgtgttccatcattccgtttttctgttgcttcttctgttcgtgattcttctgcaattccatcctcaaaatgtgcttgtacagctccgtgaacatgtcgaagttggcgccgttttgttgctgcgcattttgcccaattttcgccgagggcaatgcgcgaaaaaggcgcgcattttccttcagcagtagcaactgctcggcgtaagcggtgtacgtgtcgcaaaactgtgccggatgatcacgctgatggacacagcaaaatgcgatgcgtgccaaaatggccgcgaccaaatgcagcgaagtgctaatgatagggagaaaaaaagtaaatcgactaattatggccggattaattagtgaacttcaaggaaatgatggaagaaatggacaaaaaggtttggtctcgaatggaatcgaacccacgcctccacccacagtcgagggcaacgattaaccactgagctaacaaataagcgggcattcactactttccgcattatacctactcatagcttttttccttacatttatttcaggaaaatgcgagaaaatctcgagtttgagaagagtcgcataacattagatatgtaatttaaaaaaaaaatgcgactcacttgtgaaaatcaattgctttgccctcattcgctgcaattgtgcgcagcattgagtccacggcagcatttagcaacggagtgagctgagaagaaaacgccatctttcaatttatatttgtgcactaattactcccccccccctccctttattatgtgccgctctccaaaaaatccacgccccttttgagtgaaaagaatgtctacggtagccccattagagcaattacgataactgtgtaacggagaaaaaactcaccgccttcacttttgtgtttgagaagacggacacgttgtgcctcaacttcttccaatggtcgccggaagcgatgaacacgtggccagttttggaagaaaagtccttaaattcgacaattttttaaaaatgatcaaaaaataataaaaaaatccttttcgttttttacctttctgtcgctaaaattttgaaattttgccacgaatatttcgttggccactgccgggtccgatgtgacgaattgcgtgccgccctcaccatttttcggtgccaacgtaaaaaatttgccaaattctgcagacatttgttgaagttcaatgtggcgaacatgttgagagacggacaatgtgatcggttcgaagaggctactgaaaatgaaaatggggcaaaatttgggccaattggcccgaaaatttaaatgaattgcttagaaaattttgatttagttgaaagtgatttgttaaatattttaaattaatgtaatttcattttaattactttgatttttgctatttttttttcgaattttacatatttctcaccgttggccttttttaaagtgtcggataatgagaaagacgagagcaaaaagcataatgaacaaggcaacaatcatattgaattgacgattgaataaattaaaaaaaattgtcagtaaatcaaattaaaattatcctttttatataaaatacggaatagtttccgattgttcgacacccccctcccccatccaccaaaaacaaatttaatcaaaaaatgtggacaaaaattcagggatatgcttttgtcgccacatatgtattaccgtatttgtgtaatagagcacccggggcttatttttcaaccccggggggggctttatttcggggagggcagctctattcagggggggggctttatttcggggagagcagctctattcagggggggggctttatttcgtggagggcagctctattcagggggggggggctttatttcggggagggcagctctattcagggggggggggctttatttcgtggagggcagctctattcagggggggggctttatttcggggagggcagctctattcaggggggggggctatattcataaatactttgtatatgtaaagtatgaagcagatatcatgatcatacatagatagatcactttaaattgccttataataaatgagattttggaggaaatgtcgcaacaaaaaaaaaccaaaatgattatgcagaagtgctcatcacattcggctttttgcaaatatgtttgtacatgatgatgatgatgatgatgatgttgttttgctcccaaatacataacaaaacaaattgtaaaattataagtaaataaatgactaaaaaaacatgccccgcggggatgcggcgactttcgccgaacggcgcgcacaattggcccatgtcaaggacaaacgaaccgacagggaaaattgctggaaaagggtggggggacagcagcctaaactgatgacaacaacaatttggcaatatgtagtatcaacaaaaacaatgatgggacagaagaagaagcaaaggatgacaacaacaaatgtccttaaaactaatgactgatgagtagggctatacattgtatggattaacatattttttctgtgcatatgctatgaagaaaggggctcaaaaatagcatttctatgttaaaattttttgatttggtgaaggtttttggtgcatataaaagcatattttgggggttttcgagaaaaatgcatatttggccatttttgggcttttagagcatattttggtcatttttggcaaatttcataagaaaaatgcgaaaaaagcgaaaaatacacccctaaggatgacttttttgaaattaaaaaaaaatacacccttataaatcgaaaaatttaaatttttgtaagaacttttggaaaaaaaatttatttatataaaatgtaatttgttttagcatataataaaaatttaaaaatttggaaattcaatatatttgaaaattgtctaaaaatgctcattagcccttgttttggtgttttcaaagtcaattcttaatttatagacaatttttggcatttttttgagggttaaagccatttttgacagtttttaaggcatatttgggcattttttgggtttttagggcatatttggcggatttttttgtgcatattttatgcgcatatttggcattttttagtgcatacaacttcgaaccctactgatgaatgatggcgttcaacagattttggaaatcattttgtgaaagcggaagtcgtccagcagggacgtgtcgaacagagacattcaattaagtaccgtatatgctctttttatccgccatatccactaatcacccactctccaattataccccagtctcggtgggcgttgaaaaataatcccccagtctccatttatccctgaggcgaataaatgaaatttttattttttcgaaaaaataatttatttttaaaattttaataaacattaattattccaattatgaaactcgttaaatgtttgataaatagggttataaatcaattatgcactaaaaatccccaaatatgccctaaaatatgccataaaaactgaaaaaatgtcttttaacctcaaaaaaaaaatgctaaaatgtgtaaaaatacagaacttaaaaacaccaaaacaatggctaaggagcattttttagacaatttcaaaaaatttaggtttccaaaatctgtttatgcaatttctaatttttaaatttttatcatggcaattaacatttttttaaaattttctctgaggaggttgaaaaataatccccatgggggataaaaagagcatatacggcattattcgaacaatggacatttcgacagacatttggacagtgtaagtcatttggacagaagagggcgcaataaaaatgagggtttttatgtactatgaccacaatttaaatgaaaaaatttaataacaattaattatcaatgttagacgttcataggcggaactggcaaatccatgccggatgttacgggatccaaatccacaatcctgcatttttaaggtgggggggcgggatttgattggacaagaatttcgaatttcaactctaggaaatggacccgcaaatatggtttttttgggggcttcggcttaattcacgatgtttttatgaaaattgcaaggaaattatgccatattaaacccatttatatgggttattagcagtttaaaaggatcggtgtgaaattacggactcctctttttagacatttgccagtgcgtcttcttctttcaatggcatattattaaaaacaaaagaattgttgaataataatatttaataattattttaacaaaaaaatgtgaaataaaatagaagaatatcacttaagagcattttcatagatcattcatatccccatggttaacacttcacataggttattgtagcatctaaaatgattaagatgaaaattaatgccaattttgtttttgctttttcacttttcgccactcccaccgatccgccgcccggctccaaccaattgaacgcctcctccgacaaatccacgtggtctttcgcgcactcggaacatttgttgttgatcggaacagtcaaactaattaagccaaattgagtcaattgaacaattaattaaaccccaaatttcaatgtttacgtgttccctttgtattcgattttgacgcatcggttaatgcacaccaaatcgttgagcaagtaacgcgcgtccggcaaacacgactcaacccacgcggcgtcggagttgaaaagtgtgccggagccagcggcagattttgtgggctaaaattgggcggaaaattcaaatttgtgacctttccaatgttaaaattgatgtacttttgaagaaataaattataagcaccaattgtttctatgtaattgcattaattaagcaaaaaggcacgtaaagtttgctaattacggtaataattgtcaaatttgttgccccaaatgcctgtctctgatcacttttcggtgtctatttttgatcagtcaattcacaattttgtccgatcatcgtccataccgtggcaatgtccaacccgcacgcgccttgtccgccgattccgtaaaaagtgaattggcccccgctgatcggtttgttcagctgcgcactgatcgaatcgctggcactcgactcggaaaggcacgtgtctttggtggtgtaagcgggagcaacagaaagcgaagcggagaaggagcagggcaaaaaggagagcaattggacggagaggaggaggaaaagcattggcagaaaagaaggcattttgtaattcggaaaacagagaaaattaaattattttgaatgaatttccatttttggcatgccttttaaagggcttttttacggagaaaattcgcttaatcagcacaaataatcaatcatttgaatggaatctttggccttttagcacaattaccgtaatttgtgggccgataaaagtcaaatgccatttaattacccaaataatttgcaaatgatcacatgcgtttccgatttgtgaccttcactaatcacttttattaacacagtttttccgcacgaagcaaattcaattgggcatcaatctttgaccattttatttacacaaaatcatcaaaaatattttaaaaaatcttatcagtttaaccaaatttattctagtcagaaggtttggaacatcaaagtatttttgttaaatgtttgcttacttttattaagcacatttcagcagttttggttacttttttttgtcagtgtttaattaattaattgggccaaatgagcaaaaatagaaaattagaaacaataaattaattaattttaatttggccaaatcccaa

SEQ ID NO: 422 - DNA, 2663 bp, Heterodera glycines
acttggcaaggtgtgctttttgctgtttcgatgtcctcggggaggaattcggcacaaattgggcctaagcccaaagaaggaaaaaattacggcgggagaaaaggaagcgaagaaaagagagtcgatcgatggataaattttgtgaaagaccgcctcggggggcgggggggctaatggaatgaacgggcggacgccggggggggggggggggagcgacggagtttggaaagactgatcacagattgtaaaatagttttgatgattttgcggaggagtaatggtctccgtttgctgaccgattgaatcagctaccagcctcagaactgtgttaataaaagtgattagtgtggggcatccatcggacacgcatgtgttcgtttgcaaattatttgggtatttagctggcatttgtcttttatcgcgccacaaattacggtaattgtgttaaaaggccaaagattccattctaatgagtgattatctgtgctgattaaccgaattttctccgtaaaaaagtcctttaaatggcatgccaaaaatggaaattcattccaaataatgtaattttctctggtttccgaattacaaaatgccttcttttctgccaatgcttatcctcctcctctccgtccaattgctctcctttttgccctgctccttctccgcttcgctttctgttgctcccgcttacaccaccaaagacacgtgcctttccgagtcgagtgccagcgattcgatcagtgcgcagctgaacaaaccgatcagcgggggccaattcactttttacggaatcggcggccgaggcgcgtgcgggttggacattgccacggtatggacgacgatcggacaaaattgtgaattgactgatcaaaaatagacaccgaaaagtgatcagagacaggcatttggggcaacaaatttgacaattattaccgtaattagcaaactttacgtgcctttttgcttaattaatgcaattacatagaaacaattggtgcttataatttatttcttcaaaagtacatcaattttaacattggaaaggtcacaaatttgaattttccgcccaattttagcccacaaaatctgccgctggctccggcacacttttcaactccgacgccgcgtgggttgagtcgtgtttgccggacgcgcgttacttgctcaacgatttggtgtgcattaaccgatgcgtcaaaatcgaatacaaagggaacacgtaaacattgaaatttggggtttaattaattgttcaattaactcaatttggcttaattagtttgactgttccgatcaacaacaaatgttccgagtgcgcgaaagaccacgtggatttgtcggaggaggcgttcaattggttggagccgggcggcggatcggtgggagtggcgaaaagtgaaaaagcaaaaacaaaattggcattaattttcatcttaatcattttagatgctacaataacctatgtgaagtgttaaccatggggatatgaatgatctatgaaaatgctcttaagtgatattcttctattttatttcacatttttttgttaaaataattattaaatattattattcaacaattttcttatttttattataattgcttaatttaattatgaatggttagttagtcttttttttagtcttttatttattcgtgaataaaaagtcatcagaagggcaaaaaccacttactctgacgactgttcagatagtatgtcgtagagtaagtgatataatatatatggatgatcaaaaaataaaatcaaaatatatgaataaaatgaggtcaaagtcaattgagatcgataacacaaatgtcaaatcacttaaaaaattaattctgtttttgcttttccggttattaccctaatgaatttttaagttttgttttaaattgatttaaagaatttgtttttattagttctttatcaagttgattccataattttgttaccctcccggcaaagggaatgaattttttgcctattttatattttgtgttaaatctgtaaaaggggatgttaaagcgtgtcgatggattaaaaattgaaaatagtttcagatctgttcggccataaacaattttatgcgccatgaacagatcaaatagctttcgcctattctcaagtgtcggcagttgcaggtattctaatcgattttggtatggaattggtggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttattttgtttacatgatcggaaaattgtaatttattatcaatgtttactcctaaatccctaattgtatccacagcatttattgtatttccatcaaatttatatgtttcttttgggttttttgaacccaaatataatacaaaagttttttgaactgaaactcttatttgccatttatttgcccattcgaataaattatgcaatgctttatgcataatttctgtatctgctcttgctttatagcatatatacaatttaacatcatcagcatataatt

SEQ ID NO: 423 - DNA, 4931 bp, Heterodera glycines
tcttttggtcctttggcgtaccgcagaaccgctcgcttgaacgtatcaaaatgtagaagacgacatgcgtcgccgctaatatgccgcgcactttgaccaccgtctgctccttaccagtttgacggtggcgcattctcagtgcatattgtttacacccccctgacacgaattcgagcagctcattatccggccattcatctgacaagtctccaaggtggggtccaatatccagcggacacccgtcctcttcccgatgggcaaaacagacactgtccgtgtctgtgtatatcagctctgtgttttctgcacgcacaactcgttgcatcaattttagaagatggaggcgtgctgccgatgttgtccataaggagagaacaatgttggagcaatcgtgctcatcggtccattcctttttagcggtgtatgtaatcagcacacactgttcatttaatgggtccacagagctaacttccagctgaggattgtcgaggtacgcacgtagttctgatggcgaatcagtaaccacagtctttgatagaccgttacgtagtgagaaccgtccccaaagggaattgttgcatagcttggctatagtccgcttcgccttattgtgttgcatgcgcgccgggtcaatgaccataccaaagcgctcctcacactctgtgatgaatttttcgcgttcctcctccccatttcccacctcttccggaaacccgctagcatgtgttttcattgtcataaattctgcaacgtaaccgcgaaaaacacgctcactccattgttcctgtgtccattctatggatcgataataggcggtgcagcggtacccattgcgtaatgcctctgccagttcgatcgatgtaaccgtagaaacccaaccgcgctgctcatcgctgtgcgtgcatcgataagaagcggagacgcctccctctggatgaaggcgtgcgcatgttccgcaaagtgggaacagcaaacgctgatcaaatttaaccggtagaactggcacatccacttgtcgtggtggtaccacaaatacctttagaataccgcgaaccggaatctgttctggatgtcgccagtccactgcgcggttcgcaccctccatgatgtccacacagcgggggtgaccagtcgggtattccgttatggcattagtgtacggataaagtgaacggacgtcaaagtatcgcatacgccacccttccgggacctgatagtgaaggcgttgcggaccaactcgaccaccatgatagcaatcccttagattaataggtccgctgtttcgataggaagagaacgcctgccgcatgtcgggttcccgtcttagccgttcctcaatatcacattcccagaatatactaacagttccacgaatttgtgagcgaatgaaagccattcttcgcgcatcgtcctcccgaattctagcagctgtctttccgctcggcattacagtgtcagctttaaatcggtgtcgttggtggtcatgcgcatgccagcagcacccgttcacctcaattacgctatccgtctcatgtatataaccgtccactgtatagcggccaatgcggtgctctccgcccgaggaatgggcggtctgaatttgcagcccattctcctctgcgtaccattccatgaatttgagcgcgagcaagctctgattgtttgccgtgtcatatccgctctctgggacgattgcgagctgatcactccgtaaatgattgaggcggaagtgtttcattgatgcgctcgcaatggtcagcgcgtcccaagtgatgtcgatccctccgtttccgtcatctccaagctcaattcctccagcgtcttcctcttcctcctcctctacctctccttcatcctccgtcagacggtgttgttcatccgggttcgtgaccatcaaaaattcggttctgaaggcgactagcgcctcaataagtatgcgactgtcatttacacagtatgatgccaattgctcgcacaaattgaaaggttcgtgctggtgcgctgcgtaccactcatcgaatcgtcgctgtcgctccggaatcattcctccatataggtactgttcccgaggcggtagcgagggcagcactctgtcatagttgtcttccacattggccaaatgagggaaaaattctttgtcctgcactctgagtccaaatgcaccgggaagcgctcctaacggaacaggcattaggttccaactgtcgcgcactttaatctccggattgtctttagcgcgcagcaccttcatctcataaagtttattaccccgtctgatcattttcggacacagtcccctgttgaaaaattgtcggaacagaatcacattgtcgaaccgaccaccaaaatgtgcgaatacattaataggatatttaatgtgtggttttattttactgttgctttcattgttgttattgatggtgttgttgtttctgttgttatgcgatcctaagagcaaccagtcagtgaacgccgacataggatcatcgcatacatgttgaaaatccacttctgttcctgtgaagggtcgatgagagaaagttagggtgcgatatgggccacatatttcacacgagggaactacattcagcagggagttgcgccatgcgccaatttgaatgcattttgtacaagtaacgaatgcggacacaaagttcactatgtgtacccgccgttgctgagcctctggcgcaccgattacatgacaattctgcgttgtctcacaatcgtatactaccaatcgataagttttagggcgccgcggtttgagttgccgaataaagcatccacgttcacggttatgaaaggcaccacatgttctgcaaaagcgctcgtcgcacacatgcccagctcgtcccttccctttgttatttctcacgttccatatcaccccacattttttacatttatgcgatttgtggcaaaagttgctcgacaagtgatgatggtaacagtcaacgttcatgaatgttttgtcacatcccacgcactcacacttaaatccatcatccctgcatggccgccccgcaccaattcgaccacattccttacaattcagaatgcatgaacttttgtgagtgtccgcatttttaaagggcaattcgcatgcaaagcagtagtagtcgcgaccaaaaattgctgttccaactccacaacggatgccatcaaaatgatcgttgttgtaatagagcgatattggtgtcaggaattcttctggtccatatttatatttaggtctgtactgacccgttgtgccgaagatgaatactttaaattttagctccgggtatactgcgttccaatggtccactacacgtggtacccacacttcggcgtcatacctttcttggtttagtggaattcctgcatcgagcattaggcgctcagcgtcttgttgttgttgtgaatgcattttgttaatataattactgaaagtttgttttggcatcaccatgcagtgatagattctgctgatctccaacgcgtagaataggcaataggaattattattattacgaatcctcagcagatttttctcttttatgatgtgatgcgctccttttagcgttcggtgttcggatccgcgaccagtaattgtgtcccgctgcggtagattgacagtgtccagagtggttactattacactgaagggtgcaccccacagtgaaccttcccgcgactttgattgtgccacatctaagaagcgattcaaaattgtgtccactgtgtttggagttatctgacggatcggaatccaaatgtcagggtccaataactgtgaagtaattgttgccccaagtcgactcggttcaattccacgtctctgagcttcatctaatgacgattgtatgcaatgtccaaaaatgactcgcaaaagcgactcaggatttgatggtagagtctggatcatgaatgtacttttagcattcattagtctgaattttttgttgaacgctacgtcggtgttcagcgcgcgtacatagtgccgaaaattgcgtcttttgccattgttgttgttgttgttgttgttgcttccacttttgaggatgtttggcattcttcggcgcttcggtgggctaggttcattgtttgatcgattgctcatgatgatttttggaattggccaataaatgaggttgtattgaatttttcacttaatttataccccgtactagcagtaatttccataaaattatgaatgaatcgtttcgatactcaatacctctctttttacgatactcaatgcctctttttctctaataaattaaggactaaaatgctagacagctgacgcatcaaaatgagatagacacaggagaaatgtgtcagctgacgccttttgaccccaatgcccagagactggcactagctggtatatttttaaatcatgattcggaatcatccacctttactaattgaaggctccccccaagaagataaaacaaaattttattcacgtagtttttaattgcaatgtcacaattataatccacacaatacaatttcagttgtttcaaaatttcatcatataacattccggttgaagccaaataaataaaaaatatgcaatagtgcccacaaacgtctgaggtgggagattgaaatgccattttgtttttactgacatgagggaagtgggacagaaatttctgtacgttaaaagcaacaggaagggccaaactatcaaaataccatatggtgttcaaacgcggaatatacagtgcaacccaatgcgcaccctcttggcgagcctcatccgtgttgatgatcagagatgcgggaaagggtcggtgacgctgttgtaattctatcattttggggatccgatccacgggaaaacatcctctgaagcactctcttgttgtctgacaagtggaaagcatcctctctatttggatgttgttcatttccgttattattgttgttgttgt

SEQ ID NO: 424 - DNA, 8098 bp, Heterodera glycines
  misc_feature (8077)..(8077): n is a, c, g, or t
gtcactgtataacaactgaatggttggtttcacggtatttgtagactgtcctaatattgcagacaacgatgaccttgatatagatgtagtcgttggagaagaagaggaggcggaggctaaccgtctcatatactctttaaactcgagtagggtggtaggagtgattgtaacggtagtgaaatcggtttcataatcatcatcatcagtgtcaagagaatgaatgtcaataaacattttattaagcaaaaagtttttcaataaagcgaatgtaaaatgaacaatctaagcaaagaagtgtctttttatacttgaacatctgtagcgaccgaacgattcttgtacagcataataagtgaatcgatttctgccattgctattagcactattcctcgtgcaggcactggtgtgttgaaagaaattcgtatcgcggttgtgccttttcggataaggtcgaacgtatcagcggaactctccgccgatggtgttagattgaatacgaaaaagcattggcccccctcagcgtaacgcttcaccgaaattccattgctttccaccgtaccagcatatccgatagcctcatgcatgtcgtgataggcgcgagcaaatcgtccattgggaaagtccaatgaatagggcgcttgggggtagttccgtccgtttgcgcaaatgctgatgtcgcgcacatcgaagggttggaagttgaacggagaggtgccaatggtgcccacgtagctttcattggatacaagtccgagcaccacacgcttgggaacctgatctgaccaaaggttggcagtgaactctgtacggttttcactgatgaacagcgccttcaaagacgtctttcgcagaggatagcgtgctggacggagctccaaacgcttgctgatgtcaagcgccaggctgtccatcacctcggccttcttcacatacagcttacagctgattacctccagatgataacgacgaacctggtccggtggcgcttgtggagcattcggtgccagtagaacaaattgagaggagttgggcagaagttcgatgtccacttcgcattgattaacgatatagcgcggctgattgcaggggtcaacgtccagtcgagccatgaactgagcggtgcggctcaacgccaacagttgacgccgggcagtgtagccgtcgcctgccaactggctattttcatcgtctgcgtagtaaccggcaacgttcagataggagcgcttcacagtgtcagggtaggtcagctcatagtccatcacgctcttgtatgccatcaaatcgtttccctcgaacacttgagtgccgttgattgacatgcgacagttcttccatagagtatgtccgatcaactggcaacagctgacatcatctgctgcaagcagattcttcatttctccgccctgttcttttcgaatgcgtaactcggtaaacacataacacttgctgagatctatgtagtcggaacttgcgtgtattttgaagtgatagggcgtgatgttcaccgggttgagcgttaggcactctaccacagaggaatgcgatagactgacatcagtgtccgggatttcgaagaacgctaatgctgaggatactgcattacccgagtctcggtcgattttatggaatggagcagcttgcattagtagaatccgaatgtgtcagatcgtttgcgtcgtttctttgagttctgatgtaatgatgatggtggtggtagtggcgggactcttcctatcagggtttgatgagattccaatggtgatgctgataatgatggtttgcgcttgctatctgatggtgttgtttcaatcttaggatgaaagcgtactcgttttctcatcctatttatattgatgtttccgctcccaaattgtttaggtagtccatgcttctccagcatcgaatcaattgaccgtttcccctcactaatggttgcctgcttcaaattctctccctgttgtaccttgtccagtatgcgttcaccggtctcaagagcttgtcgcccaacagatgttcctgctcttctcactactgggagaagaagacgccaaagaccacgtagcacgtctcctatgccagcacctcgctgaaagggtctacctccatagcccctttggtagggtggagcgccgcggaaatagtgctggaaatgctgtgacccttcaccgttgctaccatcgctcgttgttccaaagtctcctcccccggcaccgtattggtgtggtaaatgttcagcgtatcccactgttcgagtgtcgaacggaatgtgtaccatttgctattttggtcgtatatgaatagtttattcaataaaaggatatatatatatatatattcttacactaatagtaaaaataaaataaaaacaataaacgagggaattcggggaatcaaaagttgatcacttttttaaatacaagcgtcacaagtacggtaccataatcgaattgaaccagttgtccattcatcatacgtaattcgacttgaagttcgttgatctctcttgggtgtacagggatgaacatcggattatcataaatacgctccaccacctgtccatactcgccctcggtagatacaatgcggaggagcgagcttagcgaattccccaaaatcacactgcgtgtaagtcccgtggcataaacggcaaagctagtaaaacccccacgtaggtccaccccatatttcgcggtctcgccctgcaccacgcgttccttgttcggaaaccctagcacataggcaatctgtgagctcatgctcaaatagtcgatttccgggtcggagatcatcagatggaaacgatcaatgtcagtcctatagttaaagtggacgtcagcaggagcggacagcgctgtacgctcattttgtatttcttttattctatcggtcagcacttttccatgtgtcctcgcctctgtcaatcgtttctccgtctcttccattttttttcgactttcttccaataacttggccaatgcatccccgtgtgtcttctctacctttagttgcttgtccttttgcccgctttcctcgcgtattttttctatctgagccctcagcgtatcccctttcgttttggtcacacttagctcttgttctcttttctcgccttcctgacgtatcttctttaattcctcacgtagcaaatccccgtgggtcttcgcttcatgcagctgcctttcgttttgcattctttcatcttgtaccacttccacacgtgaacgaagctgctctccatgcgtccttgcggactgtggttctctgtcactttgctcctttggccttattgtgggttctattgatgtttgaccatcgtttgaggaggatttttgcagtggggcttgtatgcttacatctccgtgtattgtagaaagacggtcttttaacacatctgcgtgcgttttcgattggtccttagcatcactgaactgagtctgagcttccaatgattcgtttactggtgatttttgttgagattgaacttcattttcagtttttcttaatcgctgccccagctgttcgccacgtgtaagagcttgggctcgaggttcatcgtgttgttgttgtcgttgtgctgaggggtttgatgggggtgttatttctgaatttttcaatgttgtatcagatgctgatgtttttgtatctatgactgcttctccatctttgccatcatttttattatcgttttccgtaacaatcggctttatgcgcttacacttggtcagccttcctatcttacggcactctaccgcattattgtcttgatgcactctttcaccttcatcattagatgaatcgtcatctttatgtaggtccttactgctactctcttgattctgttcttcctcaggtgcaattggtgtaatccgcttgcatttggtcagcttcccaatctttatactctactccacggttatcttgtggtactctttcgccttcatcatttatctccatagtaccagttttgctttctttttccgtctcttcgcgtgattgctgttttccttgatccacgcttcttttggaccgtttaatggaaggagtttgaccatcttcagtgcttttgcggcttagagcggtcgttagtgtaccgttcaaatggcgctgtagtccttctgtgttctgttgtgatgattttggtagatgaagacgtagcaatcttccatcaatgtaatgaatgtcaatccattgatcctccacagttccgattgtagaagcccatgagtgagggtactgtattgagtacagtccacagacccatgagccacggaattgaactggtttcggtaggtgcacacgatattttgacgtggtgttgtccacgtaatcagtaacattgctaggcaatacaacaaagaagtagttgttgttagagtcatcagccatttttaatatgcagtttattgttccgtgaaaagtaaaactgataatatacaaatttgtgaaaaggtggtctatttatacaaattctgtctcatcaatccaacggggtttttctgggtcatcgaggtattttacataatatctcttcgtcccatccttctgtctcttagtgcgtaacacgtgtacgcgatatgtcgtttttgcgtctttgcgcacgcgtgccaaatccggttcatagaaacatccctcaaacatctcaccgtgctcgtctttcaccttatagcgaacaggcgttgtgttgggtttcacctctgcaatttgtagaatttcgtccgaccatgagggaaggtacccgcgtgcgaacgtccctttgtttttgctcatcctcacaaaatctccctcacgaaagcgtggtgctctacgtccctcgtcatccgcatatagttccgggtgtatgaatcgttccgccaaaaaaatatgtgcggacggatttttgcggacggacatttgcggacggacatttgcggacggacttttgcggacggacatttgcggacggtttctgaataaaaaaaattatttttttagaaaattttttggaagagtgggcctcgtcagtacggtctcttccggttaaaaagcaactaattacgtgtgtttcggcccaaccgtagacacactaacttaaaaagcgcacaccaacaaacaaaaaaaagcaaagcaaataaattttttgattaattaatattttaaatttattaatcgataaaatcttttttaaagaaaatgaattttataaatgaataaatttttttcctctgctcataattcgttattatttcctgggaataaatattaattttgtttaacaaaaattaaattaatccttatgaaataataagtcctttgtgataaacaaaaaatgctttctctaattattttcatctccataattaacattaaattactcttctaccaaacataattaaagttgctgttgtccatattgtgtggtggtgccattccccacataattcattcattcattcattcattgtgccatcccccgccaccctccgccccacgccgagccgccgctttccggcacacggaattggaattaatatttgcacacaaaaggcactcactcactcattccacgcgggaaagggtggcgcgtgggtggatgatgaaaagtcaaaaaattccattagcagcaaaatgagagggagaggaaaagggtcaaccgaagcgaacccaacccaattttgaggagaaaagcgaagcatttccttatgaataaatgcacattcaaatctgatatgaattttcaaaaataatttaagtaaaacagaagcaaacaaaaaaaattaataaataggctaaaaatattaatcataaggctaaaataataatataattgagctaaaaatattaattattaggctaaattttttattacgtaattttaaaattttttgaatattaatttaattcttaactgtttactcatttccacaacattttttttttgattactttaaattttgttatcatttcatacaatcaaatctaaacaaatttattattatcttcagtccttttttcctttttgattttttttgtctcaaatatttttctgttttttttatttttgccaatattttttatttttgcattaattatttgattgttttcctctatttttaagggatttctgtcggaaaaggttcttccgtcggcatttctgggaacagtgattgcgtcaacagcaccaattgtcagcagccgttgtcgagcggcggacgtcggccaaaactttcggagaaaatgaaatcattgtcattggactgcgcagaaatgccggacccggtgcaaaatgggatggccaacagacagcagcaatacagtaagagttttgggaaattttcaaaacttacagtaagaaaattgggaaatttattttgccaaaaattttcatgctcaacttttttttttgaatgttttaaaactctcttctattcatttttgttttattcactatttaaattatatgccaaaacattttcacaattttatgtgattttgctgagttttgagtcatttcagatgcataggaaattatattgaattaaataaaaaatatttttgtttttatttatttgtttattttataatttttcagagtctaagcccattcggtcggcgcgtggaggtcttgcatcggtgcaacaaagttttgacaaaagtgcatcgccaaatggtcgacaacaaactgggccattgggagcaattcagttagcggtaagtaaaaagattatggcacaaaattggtagttttttataatgtcatcgcttaaggtgcataaatttcgggctaagtgggcgggggaggatttttggataattgggttcgggctaactgatttttttattccaatttgttaatagatttacaccgaagagcaccaattttatgggttcatagagtatcttactttaaaaattaacgaaatttgaggcctgatattgcttgaatgaaaagcagaagaaggaaataagcctcgcagacgctttaaaatttgtaaaataatttgcatctaaaatatttgtttggtttgaagttagtcttcgcttaaattttgcttaattaaaacaaattgggttttgtttaagccccataaacaacggcgccttccgccggtgccgtccgctgcgccgcaacagcaagcagtgattgtgccgcaacaacaacagcataacaacaataacagcaacatcatgcatatcatcatccacgagtacagctcggccgactgtgtgcttcgtccgggcgaccgtgtggtggtggtggacaacggtgacccggactggaagcatggcttcaaggtggggaattgtcgggtgctggtccaatcgaagggccccgtttttggataaatttcattcaaacatttttttagaaaaaacaggagagttaaaagcagaaaataccaattgcttccactcctctcgtaaaaaataattgtcaatttttggaaatattcattaagataaaccaaattattaaaattaattaaaattctaacaaacaaaatccactaaaataattgaaactttttatagaaatgaatgttatttaattaaagaaattaagtaagaatttttttaaatttcagtttaatgattgtctggagcatttgctgacattcccgagcagttgtgtggctgcctatcacatggaggaacagccgatgaaactgttgcaaagctgcaatttggtggagcaaaaaattcgtctctacagggaccaggtaaaaaacacggaattttaaaataaaaaaatttatctttcaaatttttaattctcatacttatttttaaaaagtgcattttattgagtcgattaatattaaattatctgcctcatttatcacttatcagcattatccattttcggtaatatccccgtcaaaccccaattttttaaacttctgactgatttctcgtctcagattgtattcgcgcaaccgaatggcctcagcgaagacggtcgtctgttgttggtccgaaatgaacacagcaaattggcacactgtccacttcatttcctgactttaacatgaacaagtttccaatttgttcctctttttgtaatttcaattatagaaaggttacgaattattatctcganttttgcttttctgaaaagaat

SEQ ID NO: 425 - DNA, 1059 bp, Heterodera glycines
tttttcttccttgatggggtctagattagaaataaatttatttgttttgaatttaggtgtattttccattgtgtttgcgtcgtccattagttgtacttgtgacagatccattttgtctgtccgtatcatcccatctgttgctttctctcccacatttaattcatccgtccgattggtaagttctgctttctcatcttcgccatttttcgtagtaatgtcgcgcgagtctgagtcaaatctcgcttttttccgctcaacattgtcgatgagagggttttcagtcgttgatgtaacagttgacgacattgccttttctagtggagaatccgagaaaatatagggtactttaaatattcggcgcgaccgtacgcgaaacgcacaaaaacgcggcaggtcatacactcgatcgaatggtacaaatttttcggtgccttttagtcggctcgaatgaatgtagacgccatccttactgatcagatagtccaaatccatattatatcggcattgtctgcaaatggtaccatcatcattgaaaaacactacacgcggagtgtccaatcggtcactgtgaacagtcactccctgagttgtgaccaaaaaattgactgtaggaagtagttgacttgtgagagttttattctccattttttgggtcaatactttagaaatgatccattaaaatgacgagaatctaacattatactgtccctaataatgggcggggcttaaatacataatttacacactcgtagtatcatcattatttaaatttagtgcactcatatacatccgatgcacactgacgaggttctgtctgacgacggcactgaatcatatacatttcgctctctgatttactacgaaaagaaacaatgctccaaatgtaagaagcttcgtaagtggtacatcgtggaatttcacatgccaaatccgatcattacaaattggggactgtgtcgctatttaatagacgaagcctgtttagacaatgtatgaaacatttaaaaagtaatataaattctcatattacagtccggattcgctcttggaatttatggg

SEQ ID NO: 426 - DNA, 10843 bp, Heterodera glycines
accacgcgcagctggtggatgcccagtgtgatgctctgtgtgtgttggatgcgccgcaaaacgcgtgccgccattttatttgcgctgtttgggtggggtactccggtgaggaccacacgcgccgattggaagaccagagcagccacagttttgcccgttgttgtacggattcgcatgatgatagcgtggaagcgccgtgcgttgtactccgtgtttgcgccacgttgcgcaattgccaaaaattgctctcgagttaagggttcaacatttattttaaaaacaacagtacaattggaaattgaacacatctacaaaacaatggacaaaatttcaagagggaaaaaagttttgtgatctccgcctccaaattcaacgacacacggtaaattagggtggcgcaagcggatgccgtgttttatgtagtagtgcatcctaacctttaaattgcttggtaccgacaaacaaaacaaatttaaaaaaccgttatgccgaggtagcctcggtaagctggggcggagtgggtgtccaggatggacaggtcattacagcggaccggaaaattgcgcactgacgggcggaggtgtgcagtgcgtaactgaacggagcgcaaatgctccacaatgtcccggcgtttctctaggcttttgaaaagcacatgcagctcgtgggcgctgcatttgaaccgtttgcagaggtggtcgacgagcgggacggggcgacggcgttcggcgcaaccacatttttttggagtgcctaatttaaaattgtaatgtcaaatgaaaaccaaaagcaaaacttgttgatggtgcctcctcaccaattggagcgagtggctcgcgcttcatctcctcatcaatgaggctgatccagctgggatcctccgcctcctcctcttgctttttcgttggctctttgttctctttgttggcgtcctgtaagtccatttcgggataagcgttgtttatccaatcggtggcaagaattaaatccatttaaaatctatgaaaatgaaaaactataaataaaaagaaaattccattaaaaaaaagtaaaatggacgctttccaacaatttaaaagggaggatggacaatttcgtcatccattcacaatgattgtgtctgggagcacaggcagtgggaagtcagagtggataatgcgtctgttgcgaaatgtggataaaatgatctctacccctgttgaacgcgttatttatagctatggggagctgaacagaaatgtgatgaatctgcagcgcgccggcaaaattggcaatgtgccagtcactgtccatagcggtgttccacgcgcagagcaagttcgggagtgcgccaaaaaagaaaaaaccttgctggtgctggatgatttggtggtgggtatgagtcaacaatatttggacgcactcttcacccgtggctcacacaattggggcgtcagcgtaattttggtgactcagcacctgttcagcaaagagttgcgtgtggcgcgcactaattctcactatttagttttaatgcgtaatcctgcgggggcgttgcagatacgcaccatcgccacccacctcttcccgtcaaggactgcccattttattgagacctatcgtgacgcatgcgcaaaaaattttggctaccttctcgtggacatgcacccagagagtccggaagagattcgccttagaacaaatatatatgaacaaaaacaaatagtttacctaccaaaatgaaagggtcacaattagtttcaagaaacgaatcctttttggagacattgtgtaatgccaaaaaggcgaatgcccttattcgagatgcatcagatgagcaacttttgtgcctcgtcgaaatctgcctaaacattctaaagtgccgagtccctttgcgtccccggcatttgaataagctaaaagctcatgcacaggtgcttcgccgtctcgcccgcacccgctgctcgcgctctgccaaaaaggttttgctacaacacggagatggccttcccgctattgtggggctcattgcgtcaattgctcttccgcttattgcggatgtcattgaaaaatataaatagtttccaaaaaattaaaaacaagaaaaaatgcagcatacaaagcgctatttgcttgtccccgaagaaatttatcagagtttggcagcaccgccaccggctgacggaacatcaattgggctggtacgtaacagaattaaacaaatcaaaaacgatgacggcataaatgaggcggaacgggcaatcaaatatgagcaggaacttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgtcgccatcttaaaattgggcgtgcgcgaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggggaagggcaagttttgagagccggtgggcgtccatttataaccagcagtgttgatgacattgttagtcacctgttgaacaaggacaagcgtggccaaaataaagagccaacggcattcaaagaatttgttgaaagggcaaagcagaatccgctcttgagtaggcatttatttcccgaaggccaatccggcaaaggaatttataaaaacaccacacttaagtttaagccatcattatggatttgaaaaagcttcgcttgctcgagtttttgtacaaggacctaagttcgcctgtcacattcacgagcgttgaaccgctgctgagagaggcgcggaaaagtcaaccaaaaatcaatcgaaacgatgtccaaaattatttgaccagccaacgtacatacacactgcatcgccagtcgaagcggcgctaccgccgattgccaacattggcgcccggcttgcatactgaatggcaggccgatttagctatttttgaccgacttggtaaacaaaatcgtggcttcaagtacttattagtctgtattgatacccttagtcgacaggtgtttgttgagcccgtaaagaccaagacgagcactaacatgatcattgcctttgatcgtatattcaaaagatcaaaatatatcccgtggaaggtgttaacagatcagggaaaggaattcactgcccgggcagtacagcagttcttccgcacaaaagacgttgaacacttttgtatgctcacttctccccaatttcatgccggaatggcagaacgtgcgaatcgtagcatcaaagagcgcctttaccgctacttcacggagcgcaacacgtacaaatggattgatgttgtgcaagacattgtttgcgcaattaaccactcgacaaattcgagcattggaatgcgcccagtagacgtgaactttaaaaacgcagaagcattgcgacaaaaattacatgatgcagctgaaaatgttgtacgacgcaagcaaaaataccgcgtgggagatcgcgtgcgcattgaaaagtacaagcacgtgttccaaaagggttacctcccacgcttcaccaatgaacttttcacggtggcagaggtacactctgagcgttcgccagttgtttatcggttacgtgatgacaataatgaaattattagtggttggttttacgcaaatgatttatgcaaaacgctagaagacaaacagcaaaaaatgtatgaaattgaaaagattttgaagaaaaagaggcagaacggtgtggattatgcgtatgtgaaatggaaagggtattgcactcgctttaatagttggattcccgtaaattcaattagcgagaaaaatatataaaaagcactatttgtcaaaatttaacaaaaatgccttcaaattctttttatgttgttcttccgtcaaacactaatattgaaggaaataggacaaattctttccgagtgcgtttaccgcgcaaattgcaattcaattcggaatgggaggtgggtcttgccgttattgtatacccccactcttggccttccataggcaccgtggagcaacaatttgttcagattgagtggcagacggggaatacggtacgtatcgaagttccaccatcaaatgtcacaaacccccatgagcttagcaaaaatttatacaggctactgggtgagggaagtgatccgttggcaaaaaaggtacgatcaacacagaattctttcatgcttttgataaacaaggctcggcgatgggccagagaagaatacattaagcgaaagactaaagaaaaacggagcgtccgtgacgaagagctgctcctacaggccatgttgacagatactggaacattggttgatctcaacagcgtagcccaaggctttctgacacgtgaaaagagtgctgcaacgagtaatgtaccgttgagaatgccagctgatgataccaattcgtaccaagaaaaattgtatgagtacttttcaaaattaagtgacaaaaatttgaacatttttgatgaattgggcatgacaaaattgaacgccgaaatcaaaaatttaacagaagaggaacgcgtgatccttgaagccacaaaggaaatgggaacggaagcatggattcaggcgtaccgtgagatacgtcttgtttgccaatttaactatgacgtccatagaaatcgttttgtcctgaacatcgacccacggtacgttaaaaaggtcaaagtctcgcttcaactcgcttacattctcggtttcaacaacacggagtttattcaatctgaaaacgaggcaagattcatgccggacatgagcggtggtgtgtcatcattccacgtttacacgccggatcttattgaaccaatgatgattggagatgtcacggccccagtgttgcgcatagtgaccatacgcggaaaccccgaccaagtagttgaagaacaattttttgccatacagtatcataaacttttattaaaggagttttctgaaattctgattgagatacgtaccaatagcggcatcttgatgccattccaatacggaacatgtacattaacattacactttagaaaaatgtcctatttttaaatgatgaacacgttggaaattgacaaaacattgacaagaaacaacgtgactcgccactactatattggctgttttgcagcagatcaaatacccgccggtgcaattgtcaaatttccccactgtatggtggttaatcttgaccccagcacatcacatggttctcattgggtgggcatatattgcgcttctcctttgcatttggagtattatgactcattggggttgtggccaccgcccagtgttcacattgtgaatcatttgtcacgctacaaacaaattgaatataattctcttccacttcagtctcccaactcaagtgcgtgtggtcgacatgtcattttctttttgtactgtcgatgtgttggaatgacctttgaaaaaattgtcagctttttacactttggaaagctgcaacctgataagctcgtaaacaattttataaaaagcataattttcaaagaatataaataataacaaacagcgaaagtatcaattaaagatgcatgttgattttgatccaatacaagtggattggtccacattctcgtccgagtgtgtgcaatttggtggatacaacatttatcgggggttgccctatcagcgtggagcgggagttggcgcagtgttcagaagtcttatgagatatttgctgccgattggaaagcaaattggctccgcaattggacgtcagggaatggaaagcggaaatcgagtactcaccaatgtgctggagggaaaagacctcagagagtctctcgttagtgagagtaaggcaggactaaagaatcttctcgaaaaagcagccaacaaacataaacactcagaagggtcaaggttttgattttaagcgatacaaaaaagactcggctccaaaaattggaaaaataaggcgaaaaaatataaataaacttcaatcgtcaatcggtccaccaatggttgatgagaccaaaaataaacgtctgcgtgttgactcattaggaacctattaaaaatgacttgcctacaaaaaatcagcgacagcagtcctctagcaattaacagtggcctaaacattttctcagttccaccgaccaatgtgtccgttgttcgctcattctttcgtcaggtgcttccactcgcaacaataacgcaagaatcgccttatctatttcgtctttacagtgacaatttgtggactgatttgtctcgggtttatctttatctcgaagtgtccattgaaaaaccaggagcaaacgataaatgggttgcgatagaggacggggatactcatgtctctgccattcaagggattggtcaaacatttgtccagcaactaaaagttacggttggcaacacggaagtatacgatagcggaaacctatacccattcaaggcctatatcaccaatgagttaagctttccaataaatgccaagaaaaattttcttggttcaacagggtattatcacaccgtaaaccaagatgactcaacagacgaggggttcaaagagcgttgtaaaatttttaagggtggaaaaaatgcgcaattcctctcccgtctcgactttgatttgggaaaccaagagctttatctcttaaataatttggacttgctcttcacaatttacaaggccaaagatgtctttcttttgcaaacattaaaagcaaatgattccaccaaatatcgtttgacagttcacgatgtcaagatttatgccaaaatggttgaggtccaaccctcactaaacatgagcctttacaaaacccttgaaaaacaacccgccacatacgcagtacgcaagaccgaaatcaagtcttcattcatcagtgttggtcgatacgaatttgagtacaatgtattcagcgcaaccattcctcgacgtgtgacaatagcgttggttggcaattcagcatttcatggtgactacaaactgagtcccttcatgtttgaaccgtttgatttgcgtgagatttcggtacatgctggtggcgtagtttacccagctgttccttataaactaaatttttcaaatgatcactttgtcacagcctttgttgacatgtatgaggcactcggaatggctaactctgaacgttcatttgacatttcaatggcccagttcaaaaaagggtggaccttttttgtcattccaatgacatccacgcttgacgacagctgtggatttgagctgttgagaagcggtacgacaaacgtacgagcaacattcaattcaccaattccgcttggtggtgtagagatgattgtcttgggtgaattcgaccaaatgattatggttgattataaccggcacattgttaccgattcaaagcttggataaattataaataaataaaaatattattgtgtaatgttaaaatgaataacaccaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgactcatgctgatggagcattctcaaagctactcattctttttcatcattcattttacaaaaatgtctccaaatgaatgttctgaccgtccctttcaacaacccgacaatgtacaacagccgcatcaacaaccagatgaagacgccgagttgcgcgcacaaattgaagacgcggaagaggatttgctcttgaattggtggcgtgaagatccgacaattgtaagcttgtttttcaatttagcatttttaatttcttcacgtttcagattcgttttctttttggacatggtcgagcccctgccatagaagccgcgcttcttcaacgcgccgaacgtgaggcagaaattttgcgccaatatgccgagaatcaacaacaatgagaaggggccattcagatatcatgtcgtatgttatttttcttattttttttttattatgatgataaaaaattttacaatgcagaactgcggaggagaatggaaatggatgatgggggggggggggactaaaactcgcgcacccttgaccgatttacttcaaattttactagccgtcaactcacacccccttaagctgaacggcgaaagaatttcgcctctagcacaattttgagcagtactttcccgacgccccgcccctcccccatcccgagacttgcgcagcaaaactgtggtggtaagaggaagttcatgccgttgaagaggaggtccgcggcgacggagagaggggggtccgcggcgacggagagagggggtccgcggaagagagggggccccgatccgacggagagagggggtccacggcgatggtgagagggggtccgcggcaatggaaagagaggtccgcggaagataggggggtccgatccgacggagagagggggtccgcggcgatggtgagagggggtccgtagaaaagagggggtccgcggaagagagggggtccgcgctgcccaacgaaatggcggaggcgaccagcggggaggcggccgagctatttaacgcaaaatatcgctggtggccgactggttaacgcgtcgacccaccaccatctcgggttcaatcccgcgcggcgaaactcccgcgcatttaacacccacagcccaaaatctcgcgcaaaccccatcccacacccccaaatcccgaccccacaccgtcccgcgcaccaaccaccatcccgaacccacatttcccgacacccccccccaccccctccccgcgcaccacacgtcagagacgcagacacaaccacccattaggcacgggcacgcccgctcatactctctgcgctcagcggagaaaatcaatcgatatttaaagtaggcaccctatgtagtaatcgggaaaattcgcacgtcggcaaagagagggtggccatcatcccccaccttggctacgagaagcgtgggaagcagagtgccatcgcacgaaaatacctcaagtggcgtgccgaggaagagatgcgcgacaacggatggactcttcgccatgtggaaagccctggcggcgagtacaaacatggcaacttcctcttggacggcatgctcgagaggatcggcgaggacatgaatttggcgattgaagtgaacgggtaaagaaacacttgccaaacttatgctaatttttctcccttcaggtgttattggcacgcgtgcccgcactgtttccctgaagacgacgcaattgttggcggcggagagacggccggtgccattcgagcgagggatgagaagaggatccggcaaattgcgcgggacttcgaggtggagatcgtgtgggagtgccagctcggccgaatgctggaagtggacccaccgatgaaggcattctcgacaacacgcccgactccggcccgattgacttccatgacgcctttttcggaggtcatttcccccaattttggttaaaatatgcaaaatttgtttacaggtcggactggccccgagtggctcggagcatccatcatcccggacaaagaaggacaggctgggcggaccattaaagtgaaggacttcaacagtctgtacccgtccaggtagaaaataaattaaataatcacaaataatcaataattaaggaacatgttcaccaactaccccgtcggtcatccaaaggtcatccaaatggacaaggacgtcaactggactgcgaaggaacacattgtggacgacgacggcgtgaaaatggagggcatcatcaagtgcttcgttgtcccgcctcggcactgcctctacgacattccggtcatcccaatgcggcgtaacaacaggaccctcttcccactctgccggaaatgcgcggagatgtacccaaagggtctggtcgaccctgagtacaactgccctcactttgaggacgctgagaggggtaaccaatggctttattttccaatgattttatttttccttcgcaggattctcaacgaccatcccacacatcgagctcgaggcggcgctgcgatccggctacagagttacccatgtctaccgggcgtacgtttggccgctgtattgtgattggagcaacggcctcttccactcctacctcaacaaattcctgcgcataaaatttgagggtaattttatcagcaatcaaaactaaattaatcaataataatttagcgagtggattccctgctgattgtgccgttgatgacattgacgaggaggagagggaacgccgaaagcagcagtacattgacaacccatggaagggctgtacggtgcggctcgacgccaacaacatcaagccgaatcccggcatgcggtacctttcgaagctgtgcctcaactcgctgtggggccgctttgccttgcgcaatcggcttacgaagacggagatcatcgactgccacgctgatttggccaagcttctgaacgacgtcaaaatcgacatcagcagcatcgaccaactgacggagaaattctggatggtgtgctacaaggcgaaagatgagcacgtggtggagcacgacaccagcaacgtcgccattgccctatggactacggcagcggcccgtgtgcacttgctcaactcactgcaatt

SEQ ID NO: 427 - DNA, 1724 bp, Heterodera glycines
ataagtttcgtcgattttcagctgggcccagggcttacgcttttgggctgtgtaacaacgcatccggcgaggacgagtacaagctgaagctgcgaggcatcatgctggactcgaacgcctgcacgcgcatcaactttgagaagatgaaagaaatggtgctggagaagtggggcacgcccggcaaccatgtgcggttcgactaccctacgaagaacttccgcatcacgaagcagggcgacattctgacggtgcccatcaccaagcagttcaatcccaccgtgaataaaggggtgctccgggaccgtggacttaaggttgtcccctttgggtatagctcatgggagtactgtaaggcccataacccctacgattgtttctgtaagcgcgaataatttattcattttgtacttttatttttcaaaatcctcatctgtgacccaatatttttccggaaatccgataaatttcaccaatatttccttttttccatccctcattcgttctttgtattttttctcgatcctatacattgtgttttcgtccacttgtacttttgttagctctggcaaataaaactttctattcatttttgtgccataatagtccttgagcaaatagtgctggggtttggttgcgcgtgccgcatcaacggtgtacacatggtcagaatagttgggaatatagccttaagcacaagaaaaatacagaaaaaaatggaggagtcactgtacccttctcgaatatgtgcttgggctcggggattctgacagtctcccccgctttgatctttggtctcttctccgctggtacaagtccttcgccatagaccctcttccacacctctctcgcattgacgtcactgatttcgtttggcctaagtcccgttgcgcggcacacagaattgttaatcgcagacaaaaacttgggcaacacatccacccacgcagaggtgtttttggcagagaaatatttgtacagccgagtcttcagcgtacggatggctctctctgcgacggcagccttcttctttgagctggtctcatacttcttaatgccattctcagcgaagaactccttcatgggcttggccacaaactccagcccacggtccgtgtacagtgtttccggaagctttggcatttggccaaacacctcctcaaatgcccttttaacgtccgccggcctcttactctttacgggtgagccgaacatacgccgcgacaacacatccaccgccaacagtaggtaccgatagtttttgtttctggttccgtgtcaaacagaaggacccgttcagaaggtttaggcaaatctccaccagagccaacagctcttcacaacctgcactgctcaacaaatgacgcctcttcttgtgagatgtcgtcctcccaagggacttcagatactcgtagttgtccaacacccgctgtccaaccatttgcttcttaaccatttttgggtacaaagacaatcttttcttcgtcgtctgggaaaatgtttgtcctcagtcgtaagaggttgtctgtgtttgcgtgtagtgtcaccaacagatacccgtacggatcggcacacgcctgcttgtacgcgtccatcagaaatccttgctcgcgaggaaacatttggctggacaaattacgaatgctcagcatatcgctgggcgcacgcatcaggaaaatgtactgcgcattggaccttggcactctcatcgcctttcgaacaggttt

SEQ ID NO: 428 - DNA, 4691 bp, Heterodera glycines
gtttccggcaccggtgcgccgcgagcggcggggacgaacgtgcggagcgcaaggtgcgcgggctggagctcacctacaccgccagccaactgctcccgttcgagcgcatgcgtcagctggtgctcaacttcttcggccggtgagcacgagggggtgggtgggataacaatggaatgtgtgtgtgtgtgtgtgtgtatgctacccccgatcaggatgcctgacgcggagcagcgagtgcccgtcccctgcacccgcttcgtgcgtacgaagcgtgccgaggtgttcacgcgccgcggcaccaagctgtaccagcccgtgtacaccaaagggctggtcgttgcgcttgacgagagggaggctggcggcggcgccggaaatgcctacttcaccagaccgtttggctggtacgacgacgacgacgacgctgaccgtgacgatgctgaggaggaggaagccgaagatggggaactcttggacgaaagcgacactgatgatgatgatgatgatgatgatgttgattttttggtacttggatgattttttaaatgtatgcgcaaaaatatatgtgaaagtgtggtcgcactttatggggggaaggggtggaagatttcgactatcgcctgtaagtgcttctgttgaccatcgtctccatgttctgtaaggcctcgtcgatgtgctccactctccgtacgccggtcacaatcagctggccgttgacaaacagcagaaaagtgacggcgatcggcggagccacgctctgcggttgttgttgttgtcctcgcaaacgtgactctgaaagtgccatgctgagcgtgcaacgtagcgctgggaaggcacagaagtccagacggcagctgcgcacgccgacaaattgggtgtcggcgagaacattgtcgtcgtggttttggtcaattgccgagtgtcggctcatcaacgagttgtacaaacgttcaatgtgcactcggaagggcaagcgtacgctgctcaccagattccgcactctcacttcccctatgcgtaaggctcgtgcagcggttgagagtccagccccacggagcgccgccccaacccggcggcgcacccgatgggccatcacgttgactgtcgagcaaagaccgcacgcgggagcgcgcacacctgtcatgacgacacgtccgctgcgaaacagcagagctgtggccactccattgggctcaacggcgtcgtcaccgctgttgtagcctctaatgcgtaacacgatggcagggaagcgtcgcggcgcgtactccgtacagatgccatgcgttgccatcgcacggaattcggtgtgcgagaaagcagttggccgattgttttggcaaaatgtaaatgtgaccgtactgtttcggatagtattcaacatctacaaatccatgggcttgcaaatttattttaaaaaaagtgcacaaacactataacagcacaataagtcacgtgatcacgcgcgcaaatctacaatgaccatgtctctcaaaaagctagttgttagcgcatcgacagcaacagcggcaacaatgtcgttccggcattgccatcgactttgtcggagccatgtcgccggattcacgacggtatggctcttcttgcttcaccgtctcctcctgtttagcgcgcttcgtacgctccagcacgacatggacgagctccaggctgaaggcgttaacgctcacttcccccatttttgcgtacccccccccccccgcttacgggtagtaggaggcgtgcgtgccgcccccgaactcgatcatgcacggcatgtacgggtgcttcagctttagcccgtgtttggcgaagaagtattgtcgaacctggacagaaggccgcaccatgactgcttctacacactcaccgacttacggtaagctccagatagccaccgcaggcgaacgtccggttcgcgttttgcacgctgaggtcgtgacagtggagcgcaatgttacgctccgccggtttcagatacgcggtatgaagtcggcagtgttgttgcaggtgcgacaccatacgctgtcgcgcgtggacactgtggaagaggagttgaagctccttcattgaacagtcgttgaacgcgcacaggtagttgagcagcggcattcgaacaggctacaaacagtggtggggggggggggggtagaaaattagctggcctccacctacctcctcttcctctcccccgccgagcagttttgcgccttcgcttccaccgccaccgcccgtaccgttcgtcatgtcgctgtgctcactggagcgctgctccacccctttaacagtgtcggaggagtcatccacaacggttgccgtcgcggccgagggggagtctgtggcgacgggggtgtcttcaatgtcctcatcctcctcctcctcctcctccccatcatcggattcgatgaacagcagtgcgccgtggccgccgctgccctcttcagcaccgtccttctcggaggagggggcttctttttccagtctaaactcggcggtggtaggtgtggtgacagtagctgtgtcactgtggaccaactttgctgtcccgttttcctcctcttcgtactccattgagcccacagcagtgcctgtcgtctgagccgttggtcgcagaatccaggcgacatttccgaatgaatccattttgggggtgagggtttagtagaatagaggaagaaattttttatctacatatttatatatatatgtgtgtgtgtgtgtgtgtgtgtgtgtgtgcaaatacagagggacacaaaaaaccgaagaagggaaaatgttcaagcacccgttcaccatgtgcgtcgccggatgcaccggtagcgggaaatcgcagtgggtggaccgccttctttctcacattgacctgatggtcagtgaaggccctatcactggcgtgctctactgttatggggaagtgaacgacaatgtgctccggctacaacgtatggagaacaccgccaccacttcaagtgacagcaacaccacggagggaaaacattcgatcagaatgtgccatggagcgcccgaggagagggatgtggagcgggaagcacgcgctacgggcggacggctcctgttggtgttggacgacctgatgtccggcggtctacgctgcagctttctggacacggtgttcacccgtggctcccacaactggggcgtcagcgtggtgctcatcacgcagcatctgttcactcgtgagcttcggatagcgcgcaacaactgtcactatatggttttgatgcggaacccggccggcgcacttcagatccgcaacctcggcgcacaactgtttccgggcggggcgctacgctacttcttggaagcgtacgaggacgcaacggccgaaccgtttggctacctgttggtcgacatgcacccaaccacggagcaacagttgcgcctgaaaacgcatatatacccgggggaaatgtgcgtggtgtacatgccacgagcgcgcgcgaattttaatgcaaacgcttagcgcaattagcaaacagcagtcgacaccgaaaaaaattgaaaggggcggagccaacaacaacaacacattgaagaagaggacagaagggtctggcgaggaaagacgacccagcagccgcaagctcgccccgtctcgccccccagtgctgagcgaacacgtgaggcgccacattgatttcttccgacaactaaaggcagcacgcagctctcctacccgctgccaagcgctggtcgccggagccagcagcgagcagcttctctgccttgtggagagcgcactgaacatcttacgagcacgtgtgcccatccaacggcgtcatctggaccgcctcaggcagcgtgcgagcgacgtccgcacactgagcagggtgcgtagcacacgctccgcccgtcgccttctgctcaacgcccacgcaccgtcaacagcgcaaactggtcgtggcataccgcctctggtcgggttgctcgccagcgtgctggtgcccgtgctcgtccaacgcgtattcgagacaaccagcagtagtagctgaaaggcacccacacgcacgcttgcccacgaagaaacaatgacgttgaagcacactgttcgcatgctactcatccccgaggatgtttatcgacgtctgatggacaaccccagtgcagcggcggcgacgtcttctacaacgtgcatgaacaagttgcccacgcccgcaactcccattgagcacacggcacgcaaaatggtggcggcatcgagcaagcacacgaacgacgacgaacgcctcatccactaccaacaggagttcaaacgctaccagaaattgctggaagaggaggcggaacgaccgctcaacgtacagctatcgcaacgggcaacaaacgcactgcgtgacactgtgctgcagaaggcttcgccggcaacagcgacgccgccgccagctcgcccccaacggaccacacctctgtccagacgacgtggcttacagcatcaaaaacaagtgccgagcgcatcttcctcttcttcgacaaggccaacaaaaagtagcagcagcagtgacgagcaacaacaaccgctcccccagcagactgttgctccacaaaaaattggcggtctgcctaagcaagctgagccgcgtatgcatgccgcgatggcgtacgcgcaacagaacccaggcttgcttggcgtcgacggtgaagacggtcagcaaattttgcacctgcccagggcg

SEQ ID NO: 429 - DNA, 7679 bp, Heterodera glycines
  misc_feature (28)..(28): n is a, c, g, or t
cagaagggtctggcgaggaaagacgacncagcagccgcaagctcgccacttctcgccccccccagtgctgagcgaacacgtgaggcgccacattgatttcttccaacaactgaaggcagcacgcggatcgcctcccccgttgccaagcgctggtcgccggagccagcagcgagcagcttctctgccttgtggagagtgcactgaacattttacgcgcgcgtgtgcccatccaacggcgtcatctggcccgcctcagacagcgtgcgagcgagcgacgtccgcacactgagcagggtgcgtagcacacgctccgcccgtcgccttctgctcaacgcccacgtaccgtcaacagcgcaaactggtcgtggcataccgcctctggtcgggttgctcgccagcgtgctggtgcccgtgctcgtccaacgcgtattcgagacaaccagcaatagtagctgaaaggcacccacacgcacgcttgcccacgaagaaacaatgacgttgaagcacactgtacgcatgctactcatccccgaggatgtttatcgacgtctgatggacaaccccagtgcagcggcggcgacgtcttctaccacgtgcatgaacaagttgcccacgcccgcaactcccattgagcacacggcacgcaaaatggtggcggcatcgagcaagcacacgaacgacgacgaacgcctcatccactaccaacaggagttcaaacgctaccagaaattgctggaagatgaggcggaacgaccgctcaacgtacagctatcgcaacggacaacaaacgcactgcgtgacactgtgctgcagaaggcttcgccggcaacagcgacgccgccgccagctcgcccccaacggaccacacctctgtccagacgacggggcttacagcatcaaaaccaagcgccgagcgcgtcttcctcttcttcgacaaggccagcaaaaagtagcagcagtaacgagcaacaacaaccgctcccccagcagactgctgctccacaaaaaattggcgatctgcctaagcaagctgagccgcgtatacatgccgcgatggcgtacgcgcaacagaacccaggcttgcttggcgtcggcggtgaagacggtcagcaaattttgcaccttgcccagggcgcttatcgccccatccggggcagcaaccttgacacgctgctccgctaccactttgtgggtcgtcatcagcagcagcagccgcggtcctccactaccacccccaccgccagtgtcgctaaggcaccaccgggctacaaaaccttcgtcaacaatgcgcgtgacgatcttcaaatgtggcgtctgctgtttccggatgaaagggcggcggcggcgggcagtgattcagcgtcaacagtgggcggacaacctcggcgccaccaacctctgcgcggacagaagaaaactggcgcgggccgcttttccctgagccgcctactacagcctaatcatcatcatgcacataaatctgttcaaaaaagtgcgacgagcaagaggaagcccaacactgtggagcattccactgccaaacgttttaagcctcaattatggtgattggaagcaacgccgtccgctcactgacggtggaaagtcttttggacccgatttacaaggacgaacggtcgccagcatgcttcaccagcgtagagcccctgctgcgggaggcgaagcgccggcacccggacgcccgtcttacgcgcgctgagatcagccgctacttggcgagccaacgtgtctacactcttcaccgacaagtgcgacgacgcttccgccgtctgccgactctggcctccggtctacacaccgactggcaggccgacctggccgatttccaacgtctccgcgcgcaaaaccgtgggtacgcctacctgttggtgtgcatagacacgctgagcaggcaagtgtatgtgaagccggtcaagagcaagcgctcggacgacatgatcgcagcgctcaagcgcacctttgcccgctgtggctacacgccgtggcgtctgttgacggacaagggccgtgagttcaccgcctccgctgtccaacgctacttgcgcgacgaggcggaggtgcgtcaccactgcatggaaacatcgccactgtggcacgctgggatggcggagcgtgcaaaccgcagcatcaaagagcgcctgtaccgttacttcacgcaccgtggcacccaatgctggacgcgggtgatccaacgcattgtcagctccctgaacgcgtcgccgaacagcagcatctttggcatgcgccctaatgaagtgtgcttcgacaatgcggagtcgctgcgccagcggatcgccgaccgtgcggaggcggagcgcggtggacgtgcctctcaacatgcgcggttccgccccggtgaccatgtgcgtattgagcgtgcgaggggcgcctttcgcaaaggctacctgcctcggttcactgacgaggtgttcaccgtggatcgggtgtgcacaggcagacgacccatcacctacaagctacgggacatggacggtgaacccatcaccggcttgttctacgccaacgacatgtgtctggtactggttccaccctcgctggacgacagcagcatcagaagcagaggcagcattgataagcgtaaaacgcggaagcgtctacctggtggcatcgacaacaacaacaaggtgtacgccattgaacgcattctggagcgacggtaccggaaggacggcaccgagtgctgcctcgtcaagtggaagggctacagcacgcgtcacaacagctggattccggcccacacaatcatataaaatgggtcaacagcaaacacatgcctttcatcatcaaaggaaatgtcaactgccgcattcacctcctcctccttctacgtggtgctgccgtcaaacacgccggtggacgggaaccggaccaactcattccgtgtccatttaccacgcaaactgcagttcaacgcgcagtggagcgtcggcctggccgtgctcgtctacccccactcgtggccctccctgggcaccagcgagccccagtttgtacgcgtcgagtggcagaccggcgagcacattcgcatcccggtgccggcggccaacattcggaacccagctcagctcctggacagccttcaccacgcgttgggcgaaggcagtgaacagttggcggaccagctgcgcaccattcactccgagtaccagcgctgtgtgaagggggcagaacaacgagcctccaaggaggcggaccgtcagcgggctacagaggaggcggccgagcgcgagagacaaaacaaaacgggcccccgcaacgtcaccgtgccacccccgcccacaacaacaaaaacgccaataagtggggcgcaaaccccccataccaccatccccgcggtccctggcggagcgagcgtacagccgcacgctacccaacgacatcaggaattgtacaaacaactatttgccactatgttggaggaaagcctggcgcaagcattgacggaacgcgaccgcgcaatgctgaacgcacatttgcccgtcggcctggagctgtggacccattcctaccggcgggctcgcatggcctgccaattcaactttgacgaacatctgcaacgctttcgcctgaagctggacaagcggcgcatacgcctggtggagttgtccgcccagttggcctacatactcggcttcggcacctccacgctgtccgacccagtcaacgtgtcagcgtacccgccggacatgaagggcggcgtctccaccttctacgtctacgctccgggactcatcgagccgttgatcatcggcgacgttgtggcgcccgtgcttcgcgttgtcaacatccgtgggatgccggatgagattgttgaagaatgctacaccgctgtccaataccagaagctgatggtgaaggagatttcggatattctgatcgagatacggaccccgtccggtgcattgatgccattccagtatggaacctgtacactgactttacatttcaaaaagactccctacttctgaatttgtattccgtttatagagacacttacgcgcataaaagttccatttcccaacattgtgagagagagagacaaatgaatagcttacaaataaataagatattgaggcgctgtgccttgacccgcgagcgcttcctcggctgttttccggccgaccaaatcccagccccccgctcatcgtatccctattgcatggtgttgaacacggacacggcgctggagccaggcacgcattgggtggccgtctacattatgtcgtccaccactgttgactactttgactcgttcgcggactggccaccgacaagtgaaggcattcgcaccttcttacaccgttttgcacatgtcaaccgctgccccatgagtgttcagtcggaccggtcgagcgcgtgcggaaaacatgttatctacttcttgtaccgtcgctgccagggctggacccttgcccaaattgttgggcatttgacaaactgcaaaacgccaccggaccgtctggtggcagcgttcacacgccaattcatttttaacgatgctgacgctgccgagactatataaaacagcaacacaccagtacacgctttgacggaaaaaaacacatcgtctgataagcggtggctaacatgcacgtagactttgatccgctcggagtcgactggacccccatgttcacatgcgcccaaaacgacgcaatcgtgcactcgggccccgccgacgcgggccacggactcaacagcatcacgacacctatgggaaccgccgaggccgcagcagcagcacacaactatcttatgattggtggtggccatactacctaccccgtgttctccggcctaccgtaccagcgcggcgccgggcttggctccatgttcagaagcttcctccgcttcctgttgccaattggtcgacaggctggcgccgcaattgggcgccaagggctcgagtccggcgcacgcgttctctccaacgtgctcgacggacagaacttgaaggagtcgctggtcagcgagggccgcgtcggcctcaaaaatctgctagacaaagcggcggacaccgtggccaagagtcgacagaacggtggcggcaacttcgacttcaaacgatacagacagaatgcagccgaacccaaagagggcataaaaagtggaaagaaaggcctcttttccacaatgggtccgccaacggcacctgctaagcaacacaaaaaggagcttcaaactctggaacgcatactccgccgacaacaaccgggctcaacaccccgcaagcgctcccgcaccgtgacgccctcgaacagcgacgacaagaagcgaacgcgacgtgcgccccgctttgacacactcggcacctattgagagccccccaaaaaaccccatacgcgcacacaatgacttgtgcgaagcgcatcagtcagcagagtgcgttagcgttcaacagtgcgctcaacatttttgcggtaccacccaccaacgtgtcggtggcgcgctcattttttcgcgaactccttccattgtcaacgatcagccaggagggaccgtacctattccgcatgtacaatgatagcctgtgggccgacctgtcccgtgtgtacctgtacctcgaactgtccgttgagaaggcaaatgcgcagggcatcatggagccaattgacagtgtggtggacaaggaagtcggcgtatgccagagcatcggtcaaacatttgtacaacaactaaaggtgggtaacagcagaagccctcgcagacgcacacatcagtattcaggttgaagtgcaaaacacggagctgtacgacagcgggacactgtacccgttcaaagcgtacatctccaacgagctgtcatttcccgcaaatgcaaagagccatttcatggcttccaacggctactacgtaagccggacacacgatgacgccaatgatgatgggttcaagaaacggtgtgcacgattttcgggcggttgtaaggcggagtttatctcgcgcctcgactttgacttgggcaaccaagaactgtacctgctcaacaacatggacgtcctgttcaccatctaccgttccaaggacgcattcctggtccacagtctgggcgccggggctgccgccacttcgtacgcactccgagtgcacgacatcaaactgtacgtgaaggtcatcgaggtgcagccgtcgctcaacatctccatctacaagaccctcgaaaaacagccggccacctatgctgtacgacgcacggaggttcaaatcctgctttctgaccgctggtcgcacggaaatggaccacaacatattctcggcagccatcccacgccgactcaccatcgcccttgtggcgaaccgagccttcaacggcgcctacgcccacacaccgttcaacttccgtccatacgacatacgtgcaatcagtgtacatgctggtggaaacacgtatcccgccatccctcaccgtatgaacttcgtcggagctgcctacgtacgcccgtttgtcgacatgtacgaggcgttgggcatggcaaactcggaacgctccatggacatcacgctggagcagttccgagacggatggaccttctttgtcgtaccgatgacctcgacgctggacgacagctgtggctttgaactgctccgctcgggcaccacaagtgtacgccttcagttcaacagagagataccgcaaggcggcgttgaaatgatttgtcttggcgaattcgatcaactaatcatgattgattacaaccgtcatattgtgaccgattcaaaaattgcataaaaagatgagaaaatagaccctccagcatcacttttcatttgtagaggcacgaaactaaattagtataccaataccctccctctcaaaaaaaaacataaatgatcagcaacggaacaccaccggtcgctgactacttccacggtggaattcagacggccgagccgcttcagccagcggccaccgatgcttttctaaccgtgtaccagcccgacgcgtacgcatggcccgacagcgacacgttacaacgtgccgctcaagcactgatcctcgcactccactacaccgttatagtgcccatttttctcttctgcttcttcaccgccgtacgctggctacgccttcaacagcctggtttggatttggctcaccaccccccatataaccttgctggtccgcacctagcatctgttggggtgacgagcgccggtaacagcgaccatggcggtagcagcagcaataccagcgcagagcacaacgaattcgagcaccacctcaacgggataagagtcgcggcactttaccctcctcacaaattgccccaattcgtttaatttctccggtgcccatttggccgaatggtgaagcattcggatgctgacggttcgacaccgcacattgaaggctcgaccgcctttggcaaaacccctgactcatttgaacttgcaccgtcacgcaagtgaattaaagcgaaatgagtctcgtgttttgtcgaacgcggtcgtcaatgtatttttttgttactttctctcgggctgatgcatacgccttagggctcagacgcgtacgctcactcctcccgcccgctccccacccgtggcgcacgcctcccaaaggctacgttacgctacagaatcccaccgtcgaccgaaccccctcctccaactgacgaccgctcgcttccataactggg

SEQ ID NO: 430 - DNA, 3580 bp, Heterodera glycines
tggtttcctatcgacaaaatttaatccatatatatatatatatatatatatatatatatatatatatatatatatatatttcaattgacacatattttatcattttttaattaaaatcagtacaaaaagtctttttgggactcagtctcgattctcgggtcagctggagaccaaaaatttcgtctcgagcaaaaatattttccatttattattcatacttacttcctccccttcaacgaaaacaaggatgtctccgtattgtttctcaacatgaatttggattattgccgttgcagcagcttccaatgcgtcctcaaccggcgcagaaaggtactaaaaactttgtttaactgacagcctagccattttcatttttagtaaatcccttagggttggaaaaagtttctggagaaaacaaaaagatctttagaaagagcacaaaattctctataaacttaaagtcgcaagactctactactatcatggggaaataggctgaagaaaataatggatcatacagtaagaataattactatgtaaaataattgttttcaaccaaaactcagcggagaaagctagtaagtaaacaaacaaaagaggttttgtagataaatttctcttatttgttagtccttaatacgtattccgtgcccaataagtttttttcaaactcaataacaaaattttcgataaatttcccacgtaaagatttttttcttcgcgttccgattactatgaatccgaccaagtttattttaaaataatttggtttatttttaacttcttaatgccaatacttaaagtgagtctaaagatatgaccatgactgtataataattgtgtacaggcacttagccaaaaatttcggagcggggaacccgaagacctttttgctcatcggacaaaatgttttctctcgggttttgtttttcaaaattttcaacgccgggcagaaaaagtcggaatttatagtaagttttcccaaaaatgacaattttgaccaaatcatcaaaaaattctcctcctgggaaaactcataaaaaaatttgggtcaaatttattaagaaaatggaggaaattaaaaaatgcattttttgaataattttgatttggcgagagggggaattcctctccccctggctaagggcctgaatttgcgtacttactaattgttgaatagaattggttctgcattcaattcggacatctttgcaatcatttcttccgacaccacatccggaagtcaggtattgtcggaagcggtcaaagtccatagtggccgacatgaagaccacttttaagtgggcacattttgtggagatatactaaatgttataataatgcttgtattttttaattattatcaacaactttagtaaataataaaaaataattctttttaaaaacatcagctgtttttcttgcaatattttttctttttaaactttttatttaaattttgggttttaatatttaagatatcagcataagaacattttaaaatttcattttatgcacataaggcaattatatattataagtagggcgtccaaaaatatggacataaaatagccaaaatatcaaaatatagacataaaattgcaaaatatggacataaatttttccaaatttaggctataatttctcaaaatttcttcaaattcactaaatgcaaagtaaaactttcaagaatggctagatatgtattaaaaatcatctttgaagaaaaaaacacgatacattaatcaaaattttcgacaaaattttgataaaaaatgtctttttcgcaaaaattttccgatttggggtcaaaatcccaatttagctgatgggggcctttctaatagaggttttttggaaaaatcccagaatatggacataaaatatggataaaaatgccaaaataaggaaaaatatggaaatatggacataaatcgcgaaatatggaaaaatatgggaaaaatggatatggaaacccatcctagaagctttaaaccaagttaaaaacatgtttttcgtgcgtttcagacctcccacagtccaggaaaaaaatatggatttccatataattggaagccctaattataagaataaaaccaaatatttaaataattttcattttacttatctaaattttttaaaaatttctctcatattgagctcatcagtaagataaaatccataattctcgttgaaagactcttctttaaatatatgacgaaaagcagaaaaaaaatagccaagaatcttttttcaataaattttcaatactcccaaacttgaaattaatgacgttaagctgatatgtattagggctcgaaattatatggactaaaaaaggtcaaatatggacgaaaaagcttaaaaattgccaaatatggactatggactgaaaactgacaaaaattaatttttaatctctcaaaaattccaaaaaattcaatatttgcttaaacaaacttaaaaaataaacttaattaccaaaaaatttaaagcttaaaatgccaaattttaattctagcttcacaatttaatcaaataaatctcaaaatttttctaataatttcatttgttgtcagtgaaaattttcggatgtgtattttttaaaagtttctaaaaaagtcgtttctttaggggtgtattttcgattttttgaatttttcttatgaaaatttcaaaaattgggaacaaaatattgactaaaaatgcaaaaattgtgaaatatttatttattcccgaaaagacccaaaattggtaaaaaaaagttatctttatatacaatctgatcaaaattcagaaacatttttcgtgtttcacctactacccttaggctaacaaagtttaattttttaccaggcacacctcactattaacattaacaaacaaaaaaaactaaaaactttttataccttttgcttaaaaattttccaaaatttgccgttccaaaaccatagacattaaattttaaaaaccaaataactacaaatttatcaatgagaaaataaagttctaaaaaataagggattcacaattttgatgttaatcattattggtgataagcagtgactaaattttagcccgcaaatcgacatgaaaaaaaatttgggaaaaattcacatgaatttttcagattttcattcacttcaactgcataattcataaaaatcacattataaaaatttaattatgattacccaactcttcaaaaaatttgggttttttaggcaattcaacagaaatagtggtcctcaaatcttaatgatataccttgcaaagcaaatttgtaatatatttgcgtgccatcgaaccaaaataatcaattcaatttttcgctacataaacgaatggtcgagtcttgcttttccgaccaatgatcattaatcattcgagataatgttcatttttatatatttcttagaaataaaaatttaaaaataaaagtttctaataaaattgttgcttcaatcataaagcgaggcggtgcagtgaagcgtatgatcactagagaccggaaatttcaaatttgcggatcccgctgcgggattggaatccaaaattctttgcgggacgggatcccgcg

SEQ ID NO: 431 - DNA, 6549 bp, Heterodera glycines
tagtgatgcttgagagtctcgttctcgcctcgagaaaagtctcgggttcatttggtatcggtattgagtctcgggttttcagtatcggactcggtctctgagactttcgagaccgagtattctttacacccgtaatgatcggcttttgtaaagttagaaataaatatacttttggttactttatgcttcatacccttagtcatgtgcatggtgtagcgggttgtgctcttggttaagttcttcatttatgagttggatcagtacccctccaagagtaattttttcttctaatctttcaaaattattcctttttcaagggaatctaatcaatttttagcaattaaaatcataaaatattgtcatttttggactaaatttgttcacaaagtgcgcagaaagtttcaacaattttccctggcggcgcctctcgtcaccgccgcagttccaaaataccctttatttattaatccgactcttaattcccaagataagaaattactaactgggattcctcaaaatcccgcgagggatcccgtcccgcgccggtctctaatgatcacccacccctttcaacaaaaaaaggttttgttgagaaaaatattcaagaatactcgctcagaattttacgatttatgtctgacggcactctttaggcgcctgaccctaaaattccttaattttcttaaaaatacgctaccaatcagaggaaaagtggagaggaaaagacaacaatttgatagttcaaagaaatttctgttaaaattaatttattgactttttaacaagagaaaacatttattttggtaatttcactgtatttttttttgctaaatttttatggaactaaaaaagaaatttcgaaccttaagcagagcaatgagcagatcactgtttattgaccgctcgtgaatctcatccacgatgaccacagcaaatttccccaaataataatcctcccggatcatattgagcaaaattccgtcggtgcagtagaataattccgcatttttcatgccccttgaatcgaagcggacggagtagcccacattgagcgcgttgccaaattcaacagttctctgcatgccgatttcatggcgcacccttaatatatttctcactgttatgagaatgagcccctaataagtcgctgtgaaataagaatcccaaaattaaagcaattcattgtttaataagacttcccccttcaaatttgacaatttatgaccagtagttgtttctgtgaaaaacggtatttgcatttttatcgttctactgtagtggattattttgattaattttagtttccatatttaggagggtatttttggatttttttagtgaatagtaaaagtttgtgaaatagttcagtgtcgaactttctccgtgtcgaaattacttagtgtcggaaataccagccacatgttgtcttttatcgattacttttataaaatcaattaaataataaattaaatttttagcgcgcccttaaaatgcgttatattaaaaatatgtctctcaaaaatgacttttatgttaaaaacaaattttaaaaattttcccatttcccagtggaattccatttaaaattgacggaattttcgtaggggaaaaaggcgggaatatcgttcccgtttcccttccgctttttatgaattcccgttcacggaagtttttttaccggaacctaattattatattgaacttttttgttgcttaaacaaaagcttataaaaatggtttcaaagactttggtcgagaatttattttggccaatatttttccgaagcgagaaattcgactacttttcttctgtgacgacgtttcccgctgtacccgaaaattaacataattttaaaaatgcctttctgctatttactaatgtctacctgctggccaccgttgtagcggcaattcttcttggcattgtgcagacaacgtagcgtttttcgttccggtttcgtagccaattgacgcaaaatgcagggatgcgtgtagattttccacatcctgttgacccgatcacacaaacaaatttgtgtttttcgagagcagagatgaattcagatctgtgctggtcaacgggcagactttggagcaccatttttattttgaatatttttcaatttaaatactaaattaataatataaaaacacaaatttgaataaagatatcattaaggttaatattcccaataaaactgcttaaaaaattttgattaagcaaactattaaaatagacgagtggaattaattcgcattaatctggatatggtaaaatattctaaaaagtagtcgaataaaataattcaatgaggaatgaaatgctatgaaaaattcctgatttaaaattgttttatcgatgaaaaggaattaaaccaatttaattaatatgctacatcatgataataaccaccccgtcaaaaaaactgctgatgatagatttttgaaaaaagttgcatttcaaatactagggttgtaaccgagatgggtccccggctaaaccgggttcaaatgacgcttctgatttttctaaggcactctccttaatccaaattctcccataggaaaaaaataaccgagatttttcaacggtgctagtgcgtttcttaaatccgccaaagtttaaaattttatagaattttaaatgtttaggtttttgtgtcttattaagtttttcaaaatattatttgttttgctacagacaattggaaagcttttattttaataattgtaaattacaagcttttaagagaagaatttaattttataagtattaattcaacttagcattttggacaagaatttttaattccattttataaaaaatgaatttttttgccatactgtaaatcacagttacatggagccagaacgatccacattctacctgagttttctggcattttttaataaaatttaaaaaacaattcttttatttaatttcaaaataatttttattcaatggaataattctctttttggatctttaaaaactttaaataatattttttataatatatttctcccaatttaagcataaaggatttgtccattgttcttgcccaaaaggtcaacgggaatgggggagggaatgaaaatgcatcaaaatagcacaataattgagaagcatcgaaataggcaccggtgaagaggtagagagagtggaaaatggagaggggaaaagtgaggagagaaaggagagggtgacggagtgacgacgaggaggaaagcgttggcgaggaagaggggatgaggaggaaaggaagacgagaaatgaagaggaagagagtgtgccgagaagggaaatgtgtgagtcgagggggggaggacagtggcggttagagccataattgaaggtcaccggaggggcagcagatggaagcaaagcgacgggaaagagaaaataagggaccatatcttttttagcccaaaaattaacacattttccgagaaaaaatttaaaaattggtatggactaaattatataataacgagggctgggaatttggctctaggaaaatcggacaccaactttaaattttaaaaataattttttgattctttgctttaatatttaaaatacatataataaagttacagtactgaagttatccaaaataaataattttattgccataatctatctacggtaggcatatatatttatatttttttgcatgcccttttttgattatctcaaaaaaagaattaaaaaaatctctgtgatccttgggaatcgagaaaaaaaaagtgtttaacagtttttagcatatgggaggggggatgttatccattttgcatgccatgccgtcctctgttctcgaatcattcggttccagcccagcccctgagtttgtcaatgtcttccgaagagtgaaaatcatgagaattcacctggacctaatcctccccaggcaaccgaagctgatcagaccatttttcatgaaaaaattgacgcaaaacaaaacaattctctgtaaattcaattcgagaacttggtaaacctaggcagatattaactcaaacaatcaaaattatttttaaaatttaaagttggtgtcggattttccagtgtcggatcttccgcaagtgccggattttccataggtgtcggattatccgctagtgccggattttccataggtgtcggattttccggctcccgggaatttaagtcattaaaaatcttcaaaaagtcataaaaaacgcaaaaaagtcacaaaaagtgcatgttaacttggtaaatcggcactcgacttttaatacaaagagagggttttaatgaaaaaatgtaaaatattaacttactataacataagggtgaaaaatgccaaaacaaatggtaaaagttacagtgcattttttcaatgaaaaaaatcagggctaacaaatgatttcaattgaaaacgaataaattgcattttctttgaatttaagtaaaaactaaaaattgcttacattgttgaaaaaagtttttgtaattatttaagaaaaggttcgatcgccaagaactttatactttagcagaaaatttttataaattttaaaatgacttaaaaacgtgaccggaaaatcggtcagtggaaaatgcgtcagtggaaaatgcgtcattatcattttggacaagaatttttaattccattttataaaaaatgaatttttttgccatactgtaaatcacagttacatggagccagaacgatccacattctacctgagttttctggcattttttaataaaattttaaaaaacaattcttttatttaatttaaaaataatttttattcaatggaataattctctttttggatctttaaaaactttaaataatattttttatgatatatttctcccaatttaagcataaaggatttgtccattgttcttgcccaaaaggtcaacgggaatgggggagggaatgaatgcatcaaaatagcacaataattgagaagcatcgaaatagagcaccggtgaagaggtagagagagtggaaaatggagaggggaaaagtgaggagagaaaggagagggtgacggagtgacgacgaggaggaaagcgttggcgaggaagaggggatgaggaggaaaggaagacgagaaatgaagaggaagagagtgtgccgagaagggaaatgtgtgagtcgagggggggaggacagtggcggttagagccataattgaaggtcaccggaggggcagcagatggaagcaaagcgacgggaaagagaaaataagggaccatatcttttttagcccaaaaattaacacattttccgagaaaaaatttaaaaattggtatggactaaattatataataacgagggctgggaatttggctctaggaaaatcggacactggaaaatcgacaccaactttaaattttaaaaataattttttgattctttgctttaatatttaaaatacatataaatttagcataaatacacatcacaaattacctataaaaatggacaatttaaacaaatctcttgggatagggattatgctttcttaacgtaaaaatagcaattggaaaatgcgccagtaatacagtattttgtaaaaataatattctgtagcaatatgtaataaaagggtaactgtaagtcggttactgtaagtctgtttcttactgattcaaataatcttctaaatcacagtatctggttttcccaaaatatatactgtatcactggcgcattctccgatcatcagccaaattcccttacaacagttctttgtttgtcatttgatcactttccgactaatgtgttttaacagttcgtcaatgtctaaacacttcaaaagtgcatcatacacttccaattcgtttcctcatcaaaagcaaatttaattgccttaattaattggttggcctcatccaacttgtgccacattatgttagcagattcactcaaatccaccatgtcttaatgaaaaaattaaaatgtaactaaataaatcttatcatatatcatatcgaagtgaatgaaaagtcaaaaattaataaaatatgaaaaaaataaaaattaaaaatgatattcgaatcgataaaatttatttgttttacgaattaaaatagtttatgttatattttccactttttaatacattattcattaaacattaaataaatatacgaaataaacttacacttaaatattgaaatgtttttagtaaataataaactataatgaaaaaacaatttaaaaataaaaataattgtcgataaaaatgggtgacggagtgacgacgaggaggaaagcgttggcgaggaagaggggatgaggaggaaaggaagacgagaaatgaagaggaagagagtgtgccgagaagggaaatgtgtgagtcgagggggggaggacagtggcggttagagccactaattgaaggtcaccggaggggcagcagatggaagcaaagcgacgggaaagagaaaataagggaccatatcttttttagcccaaaaattaacacattttccgagaaaaaaaaattaaaaatagggagagactaaattataattacttgttaaattggcactcgact

SEQ ID NO: 432 - DNA, 8711 bp, Heterodera glycines
gcacaaaacaaaagtctgggattgtctgtaggattttaggaatctaaaaagaaatctttataaatagcaaaaatttcaggacaatttgagaaacttagtcctgcccatcaatactgggatgaactgaaatcgccgcaaaccgagcgtggccccctgaaattggcacatttcttttccgcaacggcatcacaaacattggacgcattaaaaaatgctgaacaaatgcgatcaaaaagtttgaacagttcgtcatcgtccgcttctgattttaacattggcgctttgtttaaaaaagccagatccagcagcttaggtccaataattgcattccatctttaaatttggcttttcctaaacgcttccaaaattcaatgagaaatttggcaatttgacgattttgtgaatgaaattatgattttatttttttctttaggatctacctaaaataactttaataaaattatttttgattttttataattaatttaatccaaattcgttttttacgcttacgagcttcaacatacaagcattccacttttatgtcacaacattatttaactatatcatcgctttagggaattaattaccaaaaaagttcaacaggaaaatgaaaattttaggaaaattaaaattttaagtgattaataaatatgttcggttttcccaaccaaaatttccccaaaattgtttaggcgcttcttctgccaaactgtccgatctgagcaaaaaccatgacgcaaatgcttcttcttcaaaccccaagaaaggcattttttccatcccatcgcttttggcttcaaaaaagcgaaacggctcaatgagacgatcaaaatcttcacgagtgcatagcaattcgaaaaaccatttcaatacaattcgcatccacaatttatattaatactgttactcgaaatttttgagagttgagaccagagaatttaggattcgtgaccaaagtttggccaaaagagtacaagctagggatgtgcgagagtctcgattcccgactcgggaaatttctcgggttttcgcttttcggtctcgggtttttagtctcgaaaaccgagaattttttacaaaattcattaaaaatcacaaaaaaaaatcttgtctgcgcctctcggcgccgccggccttttgaaatagtgcgacgcaaaaaaagtcgttagttcgatgttgagactcctgcgcaaaaactcaaacaatttttgattttaaaaaatacattaaattaatttcattaagattctcggttctcgattgccgagtcgagaaatttctcgggttttttgggcctcgattctcgataaatcatttctcgcgcagccctagtccaacagcatttgcaaccttggtttaagatagaaaaagtaactattcgagtaactttatacacatatttggcatgacaagcagtattttcatgggttaagaaactgaatttttattgttgttgtaatcctttcaaagtttcatgaattatgttgtttgcaaatttacaggaaaactttcgcagcaagtaccgtatttactgaaatacagtctgttccaaaaccataaggtcactaaaatttttttaattaactgcatataacatttgttaacgtcagctaaattaaacattcttggtatcattcgatagcaataagttctctgttagctcacctaaattttagaaaaaatttcgtcaagttttaaataagttattgacaaaagtacttaaggaactaattgttccgacatttttggccaaaacttagccaaattttttgaaaaactattagggctagcgaattaaataagaattaaaaattttgtagctttggagcaaaattatggataacattttattagaaattttcatttgttgtttttgtataacgacatattcagttagtttcatattttaaaagtttcgattaaattattggtttatttataagtaaaaaatcagttatttaaaaattataaaaatcaaactatttttataaaatgttttgaagtttcagtaaaaaatttaattttaagcatactccaaaatttatttagacattctttatcaaaataacactttagaatttttagaaattaaaatttaaaatttgaaattaattttgaagaatttaataaatatattttggtttttagagggcaattgtaaccaactatcctcctcgggaggaggctaaggattttcatctgcagatacactagccaataccctatcattagcattgtgaatatgcaatgaggatagagttagagatggggatttttttgctagttcagaatatggataccttatccttatcattgtgaatatggatttatctgcagctagcgaatttaaaattcaacaaaatcacagttttattataaaatccattactagtaataaaccggataaagctcattgggtttttcataaacattcatggaaacagtggaataaaaatttagaataagggtcgacaaaaaataagattaggggtcgacgaaaccattcatttgatttgcaataattttttgaagataataataattatacacattttttacggttgcttgctgatcatgaatatgctatttatttatttcattttgcttttttcttaaattttttctttttttgcaaatcaggtcattaaaagagttcagagaatttaattttattataatattgttttgcaaatattactagagatttcatgttctctgtcttattgatgtgcttaaagaatttggagaatctctgatcattttttggataaaattttcactaattttataagccttaaatacctaattatacaattacaaattcataaaaaaaatttaaaatacagaatggtgggagccttcaacattcagcgtttgatttagctgggccaagttgtcccatccgtaaaaacgtcttagcaccctaattttggcacttgccattgtcccaacttcaaagttttgtaaatttttaaataccgtacttttttttctattaaacttaactaaaactgtggcaatcatttttatattattttgaagagatggattccaaacctccggagcgtattccaataaaggcctaatataagttttatataacgtaatccaaatcttagatgatttggatttaattattcgaaacaaggaacgcatacgtaaatacgcattccttgttattttgtttacatgttcggaaaattgtaatttgttatcaatatttactcctaaatccctaattgtatccacagcatttattgtatttccatcaaatttatatgtttgcaaataaaattgccaaatatgcatcaaatatgcacaaaaatggcaaaatatgcaccaatatgcacaaaaaacttgaaaattaggggtgcaaaataatttaaaaaatttattcctcataaattttatcggttgtttttgtaattgataatcaaaaaatttctcaaggttttcggcagtgaagctcactgttgacccactcgcgcatccattcagatttggatttaatttaagtgttgtgtatcaacaatttattaataaacaccaataaaaataaatgcacaaattgatgaggtcggaggagtgcagcgacggaggagaataaaataataaaaatgtccaatgcgaatgaatggagcggagagccatgagtgagggaatgggcacccttataaagacgcggggtcagagaaatgtggaggagataggcagagagggagacaatggaaataatgtaagacagagaaagggggaggggaaaagtcaataacagtgatgaggtgtaagtgatctttgatcctatccaacacctccctccttatgtcgattgtccctcgatttgggatttaagatcggattaagccatattttggctttgtcggatccaggaccagtcgttgaggtgcttgtttggctcttcctgatcggcgcaaaagaactggttgagcaggcgattgctgacgatttgtttgcggtttgtgcgcgatcggcgattgttgcggattttgtgcctgggtttgatcattttctacaacttgatcattgtcttccaattcaattgggaaacgtcgcctgatttggttggcatgacgatgaatggctcggccaagcgtcggtgccaaaatgcgatacgtcggagatgtgccgaatttctctataatttttcccgggagccaaatggctttattgtttttcaaattccaaaaataaattggttcctcattttggaaaatggttgatttggctccatgttttttgttgaattgattttccatctttttgatgtattgcccttggaattgttgaaaattttccaaatttgttggctggagtttttgtttttcgggatggacaagtgtcattcttgtgcgcatgcgtcggccaaggaaaagttcgtctggcgaatgaccgttgagtgccgtgtttggtgtcgtgcgatacgccaaaagcactttttgaagccaatctttgccttcttgacggcactttttcattgaccttttaaaaatgtcgacaaaccgttcagcggccccattcgacattgggtggaacggcggcgtgaaggtgtgttttatgtcgaattctttacagaattgtgcaaattcggcggatcgaaattggcttccattgtcggagacaatttctttgggaattccaagccgatgcacgaatgatttcagcattgaaatggtgagttggctggatgtcctttccatttgccatacttctggccattttgagtaagcgtcgaccaaaaccaggtatgtttggccgtcagcacacgggccggcgaaatcaatgtgaattcgctcaaaaactccgtttgctgctttccatggctgaagattcgcttttgtaggatttttggctgctgagtgacattcctcgcattgcttcaccagtcgttcaatttcggagtcaattccgggccagtaaacatggttcctggcaatggctttcattcgcacaatgccgggatgcgcgaaatgcaatgatttgaggatgttgttccggagcgtcgaagggattataattcgttcaccgtaggcgagacatccttcgatttcggatatttgtgccttttttggaagaaaaggagacaatttaatgttgtcaaatttttgcggccatccttgtttggtgaaggcactgatttgttgtaaaatttcgtcttttgctgtttcatccgctattatttttgcggtgatcgggagttgctctattttggcctcaaacacaaaattaacacagcaatcagtatcgttgcagatatttgcgatgagaatgtcttctgatggccttgggtaattagcgatgagcctcgaaagtacgtcggcatttccgaatgcttttgtgttgacgtatttaatatcaaattcgtaatttgacaaaattaacgcccagcgctgaagtcggctggctgaatatattggaatgccttttgttgatccgaagatggccagtaggggcttgtgatcggtcaacagaatgaattttctgccgtagagcatgcggtgaaatttttgtaccgcaaaaaccaatcctaaagcctctttttcgatttggctgtaattttgttgcgcagccgtgaaagtgcatgatgcgtgttcaatgacacgttcacttttgtcgggaaattgatggctgattgttgcaccaattcctccttttgaagcatcagcggccacaatgatcggcaatttggggtcgaaatgcgtcagcaataaatctgaaagcataatttctttagctttttcgaaggatttttgttgatcagtttcccaattccacggtacatcctttttaagcaattcatctaatgggcttcttatttcgcgcatttgtttgatgaatttgccgtagtatgtgagtgctccaaggaaagaccgtagagttgacttgtcgtgtggcgctggcatttttcgaatagcctcggctcttgatgggtccgggcgaatgccattttcagaaattatgtggccaaggaaaatggtttctttttgtagaaaactgcacttttcctgttgaatttggaaaccaaattgtttgattttgtcaaaaactttggtaattgttttgacgtgttggtcgagagttgtgttggcgataatcacatcatcgagatagacaaatgcgccattgatgggtgtaatgattttgtccatcaaactttgaaaaattgcgggcgctgattttacgccgaacggtaaacgctggcattggaagagtccgcggtgtgtgttgattgtacacagctttttagactcatcagacaattccaattgcagataagcgtcgcgcaaatcgaggcgtgagaaatatttagagcctgcgattgcattgtaaatgtcctctggacgtggcagcggatggcggtgtagctcaagtgcgtcgtttaatcccgtggaaaaatcgatacacacgcgtgttctgccattcctttttttaactgccagaattggcgcggcccaatggctaaattcaatgggctttattgcctccattttcaatagacggtcaatttcggcatttacgtcgtccaaagcgccatgtggaactggtcttgccttgcaatagataggctttgcaccgtttttcagaatgagattggccttgaatttggtgcaatgacctaattctgggctgaagacatcggagtgggttgatttgagcgccgaaattaatgtctccgtgtctttgatttcgttggttttcgttgaaattgtattgatttttggatgaagatttggatgcataatctcttttgggatcacctccaaagcttctatccatggcatgcccaataaattatgactgatttcggggctcacatatgccaacaatttcattggtggacgatccatgtattgcactttgcacatgaattgtccattaattgcaaatgtttggtcattgcaatttttgacgcgaatatttgctgacgtcaaaggcggtttgcccatttgaatccatgtttggattgtgaacaatgtgatttgtgcgccggaatcaacatgcattggataatctgagccattcactttgattggtattttccaccattttggatggtctgctttgatttccatgcaatttaagtcgatgatgactgtgttgatttgtgcatgcctttcagttgtattcaccgtttggatgtggcgaattgaagaattgcttcggcaaactttgccgagatgtccgattttaccacattttgggcatttggcatctctgtgcccacaatcggagcgccaatgatttgtgcttccgcatgattggcatggacggtttggcaatttgtgcttgctctcatacggttttggaaccgcttttggtttggcatattgctttgttgcgtctgccttgtcctttacttgttgtggcttggcacgaatggcattggcattgtactgttttgtgctgagtgccaatgtgctttccttcaaaatttggtactttttgcattcttcgcccaattcctgtagggtgatgcttttcccattggttcgggcttcttccattcgctggagacatcgctgtttcaaatccgaaaattcgtcgcgtaaagagatgatgagaatcatgcactttagctcttctttcttcaaatccaattcggcgttttcacacgatgaattgatttgtgccaaaagactcgaaaggtcttggttttggcattggcgaatttgaaaacaatcgaaacggcggaggaagagcgacctcgtctcaccaaaaatctttttcagatttgccacggtttcgagccagttgaattgttctgtggcttttggtgcaatgctgtcaatataccgtttgtattcctcctcgtctaattttccgaccaaaagttggactttggactgctctgggagcgaagcgccgtcttgttgaacgattttgccatatcgattcagccaagcgtcgtaagtctgtccaacctctggattataattgaatttttcgaggcggacattgattgatgccgcaagtgatgccgttgtggatgaccctgggtttgggttttgattttgaatgttgagtgcggcggcaaaaacttcggctgatttttttagagccgcgtccaaaatttgctgaagttgttgtgcgtccattttgattgttgattaaaccgcacccagcggaactttacaccccccaggtgatcagtttttgttgatgagaaaccgcacccagcggaacttacaccacccaggtgatcagtttttgtcgatgtccgatgaaagccgcccaggcttttgaattgccaaaattaggcttgctgaattatgccttgatttggcttggaggttgtgcagaatatgccttgatttggcttgaagattttgcagaattagccttgatttggcttgatgatgtgcagaatttatctgctgctgctgactgcgccaaaattgttgtgtatcaacaatttattaataaacacaaataaaaataaatgcacaaattgatgaggtcggaggagtgcagcgacggaggagaataaaataataaaaatgtccaatgcgaatgaatggagcggagagccatgagtgagggaatgggcacccttataaagacgcggggtcagagaaatgtggaggagataggcagagaggaagacaatggaaataatgtaagacagagaaagggggaggggaaaagtcgataacaatgatgggaaagtgatctttgatccctatccaaca

SEQ ID NO: 433 - DNA, 1448 bp, Heterodera glycines
  misc_feature (27)..(27): n is a, c, g, or t
cagcggccacaatggattgggcaattntggggtcgaaatgcgttaacaataaatccgaaagcataatttctttggctttctcgaaggatttttgttgttcatcttcccaattccacggtacatcctttttaagcaattcatctaatgggcttctatttgccgtagtatgtgagcgctccaaggaaagaccgtagagttgacttgtcgtgcggcgctggcatttttcgaatagcctcggctcttgatgggtccgggcggatgccattttcagaaattatgtggccaaggaaaacggtttctttttgaagaaaactgcacttttccagttgaattcggagaccgaattgtttgattttgtcgaaaactttggtaatcgttttgacgtgttggtcgagagtcgtgttggcgataatcacatcatcgagatagacgaatgcgccattgatgggtgtaatgattttgtccatcaaactttgaaaaattgcgggcgctgattttacgccgaacggtaaacgctggcattggaagagtccgcggtgtgtgttgattgtacacagctttttagactcatcagacaattccaattgcagataagcgtcgcgcaaatcgaggcgtgagaaatatttagagcctgcgattgcattgtaaatgtcctctggacgtggcagcggatggcggtgtagctcaagtgcgtcgtttaatcccgtggaaaaatcgatacacacgcgtgttctgccattcctttttttaactgccagaattggcgcggcccaatggctaaattcaatgggctttattgcctccattttcaatagacggtcaatttcggcatttacgtcgtccaaagcgccatgtggaactggtcttgccttgcaatagataggctttgcaccgtttttcagaatgagattggccttgaatttggtgcaatgacctaattctgggctgaagacatcggaatgtgttgttttgagcgccgaaattaatgtctccgtgtctttgatttcgtttattttcgttgaaattgtattgatttttggatgaagatttgggtgcataatctctttcggaatcacttccaaagcttcaatccatggcatgcccaataaattatgggtaatttcggggctcacatatgccaacaatttcttgggtggacgccccatgtattcaacttcgcaccaaaattgtccttcaattgcaaatgtttggtcattgcaatttttgacgcgaatttgtgctgacttcaaaagcggtttgcccatttgaatccatgtttggattgtgaacaatgtgatttgtgcgccggaatcaacatgcattggataatctgagccattcactttgattggtattttccaccattttggatggtctgctttgatttccatgcaatttaagtcgatgatggctgtgttgatttgtgcatgcctttcagttgtattcac

SEQ ID NO: 434 - DNA, 2095 bp, Heterodera glycines
caaaaaacggcaaaaagggaagaacatgtcgtagttgaaattgtatacaaatgatatgtcattcgactcctctcggtctataatgaatgaatccgaaggaatttttcgggggtaaccatttcctgatgagttacagacccgggactcaagtgtccaaatccagcggtattcaaccatccaaagagtaaaattaaataaatttgtattaaacatttgtaaatttgacactaaatgatcattttacaagcacccgtcgcgggatcgataaagtttgctgtatagttaacccatacatgctgataagttggcattggcacgatcgagatattgactatgtggctgcgttgcggatttgcgcgcagattgacgtacattgaggcggaatcggtatggataattgatccacccgaacgtatttttggagcagcggaaatagtgttttcttgccttctgtcctcgacaaattccaaaacaccaattttttgaacattccaaagacccatcgctcagggacgatatgtccaacttgatacataacattttgacgcaaattgcgcatttttaccccgctaacaattagaatttgttgtatttcaacttataaaacaaatttgtcccttgaggtgaggaggggggggggggggggtctggggctcgagtccgtttgcctgcggtttatttttttatgctgattggtgaaaaatcatagacaaaatgatggatttagtaaaatctgaattcagattcatgatcagcgcatttttaccctaaactcattggaaaaaaatacccaaagaaaattaaaaactttgaaaaaaatcaagtacttgatgtaaaatcaaagataaatcaatgatttttcaaaatctgagttcagattcatgatcagcacatgtttttatcctagaaaaaatgtttttgaaattttactatttttttccgtcgggaccacaattctacacctttgccataagctataatgattagagatgggaattagtcgacttaaaaagttatgaaaaatcgccaaaaagtcatgaaaaagtcataaaaatgccaaagtcacatagaaatgccaaaaaagcaccaaataaatccaaaaaagttatgaaaaatagccaaatgtaatcgatctatctatctatctatgcattctactaattgcgtgctattttcgacaggaattcctttattaaataattcatgtgaagaacaaacaaacaaaaaatgttttttctccccttcgaaaagagagaaagcggcagttttaaaggcaccaagcttatggtaatatttgtgctctaaatatgaaagacccttgtggaatgaggccgccacataatcacgagcaatcccgtgtcctttttagaaattcccaaatgcgagtaagcagttttaatggcaacaagtttatggtcatatttgtgctctaaattgaaagacccttgtggaatgaggccgccacataatcacgagcaatcccgtgtcctttttagaaattcccaaatgcgagtaagcagttttaatggcaacaagtttatggtcaaatttgtgctctaaatatgaaagacccttgtggaatgaggccgccacataatcacgagcaatcccgtgtcctttttagaaattcccaaatgcgagtaagcagttttaatggcaacaagtttatggtcaaatttgtgctctaaatatgaaagacccttgtggaatgagttcgccacataatcacgagcaatcccgtgtcctttttagaaattcccaaatgcgagtaagcagttttaatggcaacaagtttatggtcaaatttgtgctctaaatatgaaagacccttgtggaatgaggccgccacataatcacgagcaatcccgtgtcctttttagaaattcccaaatgcgaataagcagttttaatggcaacaagtttatggtcaaatttgtgctctaaatatgaaagacccttgtggaatgaggccgccacataatcacgagcaatcccgtgtcctttttagaaattcccaaatgcgagtaagcagttttaatggcaacaaagttatggtcatatttgtgctctaaatttgaaagacccttgtggaatg

SEQ ID NO: 435 - DNA, 3394 bp, Heterodera glycines
  misc_feature (33)..(33): n is a, c, g, or t
tctagagtctttgtttaaatgggtttagaactnttttaaaaaaatattttatataaatgatatttattttcaacttcatcaaaactgattaaatgttgtttgatttttgcttttacttattcgcaccatttttcatgatgataaatgaatgggtatttcaactataaatatatatattttaaatgttaacccgaattttgaacttaaattctataaatttaaacgacaacatataaatatattttatatttaaattatttttttattgaaaaataattgaaaattaaaaatcgatcacctatcactcaaagaatgagttggttgcaagaaattaaaaattaataaatatcataatataatagcaatattattaaaacgcatgtagcagattaattatttgttttctgtttttgatgaaagaaacattaaagaaaagaaatgaattaattaattagaaattataatttttataaagaaatggttgtaattgaaaaacgtatatggaaataaaaatttgacaaaactggaaaaatttaattattgttaaagtggatcggattctttatataaattcacaaattatcaatttagatgtaaataaatgataattaatgttttcctttgtttttgataccatttttacaaaaaaacaaaaaattttttaattggtctaatccttaaataaaattcttacttataaatacatttaattattaaacaaatatgtgttaacaaaatagatttattttttggcgtcaaaatgaatgtgaaaaagaagctggtcagacaagagaaaattcaaattaatttataatcctaaataaattgatcagaaataataaaataagatttttacgagtgccattatttttagagaaataaattattttataaaagtattaagcaaatatacgaaaattaaaccaataaaagataaaatataattttccatgattaaaaaagttaaatatcgagcggtagaaaaaagttaataaaaataataatgaagcaagattagtaacttttattgtaaaagaagaaaatatatgaataattttaagaaagtgtgaatctatatataaaattaaaaacgattgaaatattttaaattcaattttaacaaataaatttattaatgttaaatacaaaaaaaaacacttaaaataatttataattattattgagttaataatgggacctccagctgcattttcgaatccgagccctgcactatcataaaaaatatgtcataaaaatgatctaattttaaagttttcaaaagaaataactatcttgatgacgactgcatgtgaatcctcatgtcgtgaattctcttcactttattatttattgatttcattattttaaataactttttatttttgttttagtaatcttgtaacattttttttttgattttctatattaaaatatcaaccaattttaacaattaacgcagaattgaatagataggtttttccgcgcgattgctgtggttaaataaattattattttttttattgaatataaacattaatattttttagaataaaatattagtattataaatatcaccgcgacgctgctccatttcgtttaattcctcttcattcatagttttatattttaaagaattgaattttttctttttgtttaattcttaaattttttttaatgttttttaatttgctagcatgaactaagaacaattaactagtttattgtaaatagaaaaataagtttacataaataaagacagatattctaaatattgtggtgagcagaaagtctttgtatagtggtcaacaatattacttaaaacattcaaacaattcaaataataagggtttataaccaaatttgcaggctaatagagcagcatttagaatcaaaaaaatcagatttttaacaatttttttcggcgcatttttccgaaaaattttttgggtatgggtgagggaagagagttcggcgttgccgatttgccgataggcgatgccggggaaattttttgaaaatttaatgcaatttgttaacaacttctgtcaaaaattaccaaaatttgcgatcttgggctaatttttaagaaaaaataggagtttttgggcgccggcggtgccgataggcgccgctggtggaaaattttaagaatttttaatgaattttgttaggaattagcgaaatttttcagaaatttcctcttttaaatgaaaataaggcactaccccaaatcagaacatttcttagaaataataacattttcattttcttaatttttttgacttgcaaactgactattttaatttgctttttcatttagaataatattttaactttaaatatccagtttttaaaagagaatattcagaaagaaaataaagaaataacaccgacacatattaaaataataaaaagaattcgtaaaaacgggacagttaaccaattaaatttttatatttttatttatttaaaaatttttaaacatttaaaaaaataacaaaaaaaaagataaaaatacaatgcttttacaaaattaataagaaaaactaattataaacttgtataagctcaatataaactaatttaatttaccttttgagaaagatcagaaagaatgattctgcgcaagaatttaaaaaacatattaaatcaaagaaaaatgaccaatttgcagatttttcttttcaaatagaataaaaggacattttaaattcctaaacattcttctaaacgtcataatttgtttaaatgcaacaatacatcgggatcccaaaaaatcttcgggatgaattgggatttgtactggaccccgactcgggatacatctcggttctttttccaaaatcttcgggattgggatttggtcggggtccctccaaccttagttgtccggtctctagtctctaatagaaaattactgattcatttatgaatttagcgtaaaataaataattaaagtcaaaataaactcaatcaaagaaatttagcaaaatttggataatgaaataaaaaatagataataaaatatataacaagaaatattacacatttcgaataataatggaactccagaagaaaaaaataaagtttaaattttaaaaataaatataaaaaggattattatagaaaattcaaattaaaaataaatataaattaaataaaaataacgcgagacgaatttttaataataaataccattgctaccaagattccaatcaattagtcatagtcagtccgaaagtcaagaaaattattgtgagataaaataattttataaaattgcaataatagattttcggaaaaaaaaattaaaaaatataatgctttcatttaaaataaacaaaatcttaaaaattccgattaaataaaacttcagaacacatttaagtttaat

SEQ ID NO: 436 - DNA, 1789 bp, Heterodera glycines
  misc_feature (15)..(15): n is a, c, g, or t
  misc_feature (121)..(122): n is a, c, g, or t
ttaatttttatgttnatttaatctaaagccatattcagtttcagcgtagagtttatccagactaattaattctgaaatttttcatgcatgaagtttcagctgtacaggctcattgagaacnncagagttcaaatataaataataaaaatatattaaacaaaaataatacgtccagatggaatataaattaattaaacaatataaaataaaaaatatttatttagtcaaatattttttttaaatcttaagttaaaataaaatttaaatactttttttttattaagtataatttgattttaaaaacacataaaaaagccaaatgagtgcgtgggaacatcgacagaatttgcgaaaatctacacaattgaaaatattagaaaattaatttctaacttttttaaaaatattcatgttaaaaataataaaatactttaaactaatattccaactctttgtattggacttgaatctttggaaattaactatagtttttgcgtaaatttgatttgatatgaagtaaattaaccatgttataatcaaataaacacaagacgagaatattaataaaaaataattgagtaaatttttataaactaaaattaaatataatttaaaattaaaaatgcgagtaaaattgattaaaataattaattatcatataaatatgttaagaagaaaatagcaataaataaagaattaacttaggtatgaaaggtaaagaaagaaagaaattattaaacaagaaaaaaataaaataaaaggaattatttaaattaattagtatcgaaattaaagtataaaaatttattccattcgtaatataaaataattatttattttcaaaaaactttaaaaaatcatttttttaatttttaaatgacaaataaatttaaataaatcctttgttattaaataaaatgagcatataactgggcgcatatgtttacacgagataggccacaagattaaaattataaaagaaattatcgcaaaagtgatttctttcaaggatacatttatatatgaaaataatttttaaatttaattttgtaatttaattttaagataaataataatttagaaattgaataaaatgagattaaaatattatgggtttaaattaaaaaatgggacaaagcaatgaaatcggtcagtgctcattaaattaataaaattattcgctaatgaagtataaattaaattaataattaaaagataacacataggaaaaaacaaaaaaaatagaaaaaatataatcaaattttaaaaatagaataaattataattttaaaagaatattttaaaaactaaaataaaatttaaaactgacaaataaaatgtataacaaagttgacagtgctaactgttttaatcatgatcaatcaatgactcatgatcaattaaattcaaaattttatcttaatcaaaccttttttaactcattacaaaatgataaatttaatcaattaaaaaatttattataaatcacttgaattcaaattgattttataaaatatttatacatataaacaaaaaaacgaccatggtctctacaaaaacaggacaaataaaaacttgattgaaaatattcagaaaaattaatttctgcgcttaatttaaatattcggtaaaaatagaaaataatttaatataattaatttttagactcaaatcgaaatttagcttaactacatatatatttttaatttattccattttacgtaacattataattgttgtgagtttaataaatgtattttattgtaaagtcagactctagaggtccccg

SEQ ID NO: 437 - DNA, 13066 bp, Heterodera glycines
agaaaatttttttggcctaagcgggacatttgagtctcgcccccataactcgttaggggttggttttatcgaaaaaacgcctagggcaaaattgtagagcttttaaaatgctatcgaatagtgtattatatggccggaaattttcaaaaattttcgagctaggccccctagaaattttcggatattttttttgggttgaaaaatagggtgaaaaattttttttctgggtatttttaaggtgctgagcacgaatctgatgttcattttcagtttaggaaattttagaattttttaaaaattcaaaaatatttggcaattttttgaccctctgaaatttgggcgaatattggaaaattcataacacagtgaaggattggtcaatttaagtgaacttaagctctaaaaatagagaaaaatccggagaattttatgttatttatttggattttctttcttcaaaaataaaaaagttattccagaaattctggaaaaattcggattttcagaaaaaaatttataactcgcttctgaaaaaatattcaggaaaagtaaaatgctacaaaaatccgcaatttttagctctattttataaattttatttcacatttttatcacttttttgaaaaatgttataaaaataaaactaagcccaacaaaatttaaaaacgggcgcgaagcgcccgtatgagcccaacaaaatttaaaacgggcgctaagcgcccaactgagtctcttcccccgtggttgccaacaaaattttattttgaaaacggccgtgaagcgcccgtctgaggccgcgaagcggccttaatagcccaacaaatttagaaacgggcgcgaagcgcccgtctgaggcctcgaagcggccttaatagcccaacaaatttctaaacggcgcgaagcgcccgtctgaggccgcgaagcggccttaattgcccaacatattttgaaacgggcgcgaagcgcccgactgaggccgcgaagcggcctaacaagctaaaaaacgggcgcgaagcgtccgtcttgagcctcgatgtggactaaaaacccctaataattttttaaaattcaataaaatctctccaaccaattcgatcaatttgaatcgcttcacagcctaggtagcgaagctcccaaagcgcgaagcgcttttaaaaatttcataaaattttgcatttaattgcttttaagtttttttttaaattacgcttacattagtggccaaattttttttatgatgacgtcccaacttttctgctgcttaattgaagtgcgcatctcaaaatgagtgtgcgattcaagtgcaatgtttaatgccgcgcaaaaaattgagcactgagcgatcaaggtaactgaacagggttattctttaatgaccataagcaaatacgaagcttgctgggcaattacggtggataattagacccgtctaattaagaaagggcggatgtgccttggtagctcatttgtcaatggtaaagctgcgagtggacgagtggcgttgatttccacccaccgaggcctaacattttaccatatttcttattgtgtaggtgtaattttataaactacggtagacctattaaaatgggatgctaattgttcgacatttaacacaaattgaggttgggcggcggaccctttccaattaattgagtaatttaattgaaattaaaatttgttatttgctcgctaaaacacgtaccgtatggtcatttcatggattttcttaatgcttttttgaaatgaaatgctgtccatcggcgccacttgcatttcattttcgtcaaacaaaactttttttttgcgcactttaagtacggcaccggtgccgtcctccgcgcgtcgaataaccgcatcatcaaatgtcaaatgggggacccttaagcaatatttcgattaattattcttaatttaaatatttatgcccattccctgacaatgtcatcgaaaagtgactgtccaccaacgcattgaaccgtttgctgagccgtgccatcagaaggccgagttcggcacggccgaagaattcaaaaacatcgaaccaaatgtcgttgcaaataaaactaaattttggcatacttttttaaatatccccaaaaaagcaattagaatgtatacgtttaatatatattattacattttagtcattttaaatattcaaaattcccatttgacggagcgtcagcttctgccggattttttaaaggatttctaaaacggtttacctcagttgagccggaatggttagtaaaatttccaaattttcatatttttcccaaatgaatttctggtccattttaaataatcaattgcattgaatgtcgctttctgatcaatcatttaaaaattgatcagtgataaacaaattcaatgataaagtgatcccattaaaacatttgtttgtcaaagttttgacccccggcactgattaagctttataattggtcaattagctcacctttgtctttgcgttaagctcaatgccttttcaatcactgatctgatactttcctttgtctgatcatcaaattttttccaattaatgcgcaaatcaaaaagcattaatttgtcttcgtcaatttgactatccatttaaatgcttttaaaaaattgaatattaaataaataaaactcaaagaaatcggatggacaacaaatcttctttttttattaaaataaatataaaaattattacttaaaaaaagaagtgacgccatacgcgcaacagaaaatgacttttgcccttctgttgttgggcaaaccttcgccgttttccccgacattttcccccgaggcgtttatccgactcaataaaaatgacataaaatggcgagtagtgattttggtactcaatgtatggcgctcagtcggccatatcgaaaagtgactgtccaccaacgcattgaaccgtttgctgagccgtgccatcagaaggccgagtttggcagggccgaagaactcaaaaacatcgaaccaaattttgttgcaaataaaactaaatataaatttctaaaaacgacacattctgtcggattctttaactgttagagggaaagggttgcgaaataatatccaaattttcatatttttcaaatgaattttatgtgtgcatttgagatttggataggatcaaatgttctcccattttcaattacaattgctggattatcctagtgaatcactaattgctttgaatttcattttctgatcaatcatttaaaattgatcggcgataaacaaatccagtgataaagtgattccattaaaacatttgcttatcaaagttttgaccccccggcggtgattaatgctttacaaattggtcaatgatctcacctttgtctttgtgtcaagctcaatgtcttttcaatcactgatctgatactttcctttagggttgcaaccctgaccccgccccgaccccgaaccccgacgaaagtggaagggaacggtggaccagcgaagggagaagaaagggaagaaaaaaaatcatgcggcagtctgatttgttcatgtaagtttctttaattttcaatgaatacaaaatgaatcgaaatcctttttcaccaaattaattttgtaaaaataaataaataaaattattataccgtattcccatatcccctaatagagcagctcctatgccaatgccctcccccccctcctccttaatctgtgcttctttttcataggattgctaaaagtatatttatttcttggattatcctttatgacgggttcgggctaaaaaaaaacctgaatatttggtacaattttgggcaaaaacaataaaaatattaccatatcgccatttccatcagtcgttttatcaactatttttattgccaaaaaaaaatttgggtctttaacttacgataaaaaaatttttgatccaaaaccctggatttgaagccttttatctacatgttaagcaattgatggcacattgtcctgtacccgtgccatcaatgtggacgtgatcgcctgctatgaacaacggcgccggcaacataatcgaccagcacaggcacaacaaccgacaacaactgtgccatcgattgctactgttccatggcaagggacaacgcggctggtaatttcgacactgggtaaattcgacactgagtaaattcgacactaagtattttcgacactaagtaatttcgacactacattttccgacactgaattatttctaaaactttcactgttttcctgcattttcgacactggaccatttcgacattgagtaatttcgacactatagagaatttttaaaaaatagaataatcaaaatttaaaaaaatgtaattcggtctttaatataatttttctctgttccattttcaaagtcctattatttaaaagtgaaggtgatatgaaattgcgcgaagataagcaagtggctcgcgttcgttgaactgttcgacaattgctcttatgttgttatcttgtcgaacatattttgcttttcgattttgatttggcccccttattccatccgccggcgcaacaatgtagtcagccactctgtctgcccacatattgtcctcatcacacatttttcgcgaaaatgcactcaatctttgaatgcctcgcaaatgtacattccatatgcaatgccaagcctccaaactgttattcgttctacacaagccgtgctcaactctttcaaccatattccataagggaataggaaaaagtgcaccccgatttcctgaatatttaaaccggcgctagttacaaagagtacctttttgaattctttacttttttggtctctatttaaatgatcattttgttctgatactaacataaaagcaaattttgaaaaattagagttttcgaattttgttcgaatttggtttcggggttcggaacaggcccaaataattgtaattcgtgatcagcgactacgaaaatcctttgacacttggttcaggacttttacaccgaaaaataatttgcaaatttaggcaaaaaagtaaaaaaaattcaaaaaggtactctttgtaagcgccattaaaccttttttgttgcacaataattagtaccaaaaatttatttggttttttaaatggttggttttcccattttgtgggttttgaatttttgtaatacagtaccccatcaatttttgtgtaatttacaacttaatacccaaattcaacgcttcaatacgccaacgtatccaggcatccgctcggccacccatattttgtccatctggatcaataatcggctgttcatcttcgacaatgtggcgaggaccaatccaagtgttcacaaaataaatgacaagttctttaattaaattttttgagactatgtgtaaaagcaagtatttaatcccaaccccaatttttgtaattatttttattattttggataccctgtaattcagcagttggttcaatggttgaaaaaagggcgcaaaaataattgtaaacataattttctggcacaaatgccaaagccttgattcaaatttaaaaaatattaatttattttatgagcggtaatttatacttgcaatgatcggatagacgtttgtaaatccctgttctgcaaatattgtgtgtgcaaattaggaaggcgttggacacgacggtataacgcttggccaaagtggaaaaggcatccagttctgaccgaatttggaaaaacaatgccagcagcattcatggcagccaactcaaaatcactcatgatgcgggtggggaaccaattgtttccaattcggttccggattgtttcaaaaaagctggtgtatgatcctaactccttattcggcatcaacccatagaccaccggaactgctgagtgatcaatgatgacgctcattgtgtacaattgagcaaatccccttggcgctgtctttaaaaataattaacacaaaatatactcataaaacattcaccaaaacacaattccccgccttaaatcatatcacattttaatctcttaagctcacatcaaaagtgccgtcaattgcaacttcagcattgaactgcctaagcgaatcaaggccaaaggcagacgcaaacacaatcattctgttattttcaatgggctggtttaaaataacacgattttgcaatgcagccgggatgacaatttgggcagtgggctgtgcatcgagaccaacatctcctgcctaaatcgactaagaaaagattttgtgattcaaaaacttcttcttggtgttttttcttggcgttgttgtagtttctgcgcatgttgctgggactcggtgcgtttattcggacatcgacttgcatttctgatcgaacatcacgtacaatgttacggctagtcgtaggaaagtcgctgcgcgcttcttcacgaactcgttcattcgcctcccttatctgatcagcagggatgggctatttaggcaatcccaaaaactttttggcttatacgctgaagacaaacactttgttagttttgggtcttttcgcttttaaatatcatttagtgtattgtttgacatagaaattccatcccggctaactataggataatttcgattacaaattaaatatttaatacattgtgttggccaaaaataggtggatgattatggggtgctgtcactcgccccattttgaagcggttgccgtcgggatcaatttgccaagcactttggactgttgctcttcctgggcaatatggaggacgccttgggcatctccaatactcaaagccctccgcgattcgcgcatctcgttcaaagcagtaatcaaagttgtgacatgaaatcaaacttcttccacgatttgttttagtctcattaaaacggaaaagggccattttctcgggaaaaatgcaaatgaccaatacatttcatcatttccaactacacaagataacccccatactcaaaaaagataacgagaagaacggtcaaatgcaaatatattaatgattctcgtttatcaaattttatgggaaaaacattaatttccgttatcaacatttagaatagttctccgaatgcaaatcctttggctttcgtttattcacttagaatgagtttgaatttatttaaataataggactttgaaaatggaacagagaaaaattatattaaagaccgaattgcatttttttaaattttgattattctattttttaataattctctatagtgtcgaaattactcaatgtcgaaatggtccagtgtcgaaaatgcaggaaaacagtgaaagttttagaaataattcagtgtcgaaattacttagtgacgaaaatgtagtgtcgaaattacttagtgtcgaaaatactcagtgtcgaatttacccagtgtcgaaattacatagcgccgtctgatttgttcatgtaagtttctttaattttcaatgaatacaaaatgaatcgaaatcctttttcaccaaattaattttgtaaaaataaataaataaaattattataccgtattcccatatcccctaatagagcagctcctatgccaatgccctcccccccctcctccttaatctgtgcttctttttcataggattgctaaaagtatatttatttcttggattatcctttatgacgggttcgggctaaaaaaaaacctgaatatttggtacaattttgggcaaaaacaataaaaatattaccatatcgccatttccatcagtcgttttatcaactatttttattgccaaaaaaaaatttgggtctttaacttacgataaaaaaatttttgatccaaaaccccggatttgaagccttttatctacatgttaagcaattgatggcacattgtcctgtacccgtgccatcaatgtggacgtgatcgcctgctatgaacaacggcgccggcaacataatcgaccagcacaggcacaacaaccgacaacaactgtgccatcgattgctactgttccatggcaagggacaacaaccgcagccgccaaaagccattttgacggcgccaaatttgaaacggaaacaaataccgtaacagaaacagcggcggttgaaaatgacgataaaagggcatttgcagtagaaaaagaaatgaaaatgtttatggaaagcacaacgcgccaaaccgtttgaataaatacatatatttattttgattcattgtcgatttatatatgatttgaaattatatgcaaaaaaaaaacactcgcacgatgaaaattcgtcactgatatggttttttatgattagattaatgctgtaattatcaagcattatgtattaataccatagctatataaaatttgacggttggaataccgtatttggtttttttaaacatactgtatcactgacgctttttattttaggtaaaccagacggttggaataccgtatttggtttttttaaacatactgtatcactgacgctttttattttaggtataccagacggttggaataccgtatttggtttttttaaacatactgtatcactgacgctttttattttaggtataccagacggttggaataccgtatttgttttttttaaacatactgtatcactgacgctttttattttaggtataccagacggttggaataccgtatttggtttttttaaacatactgtatcactgacgctttttattttaggtataccagacggttggaataccgtatttggttttttttaaacatactgtatcactgacgctttttattttaggtataccagacggttggaataccgtatttggtttttttaaacatactgcatcactgacgctttttattttaggtataccagacggttggaataccgtatttggtttttttaaacatactgtatcactgacgctttttattttaggtataccagacggttggaataccgtatttggtttttttaaacatactgtatcactgacgctttttattttaggtataccagacggttggaataccgtatttggttttttttaaacatactgtatcactgacgctttttattttaggtataccagacggttggaataccgtatttggtttttttaaacatactgtatcactgacaacgggaggatgaagagaacagagcaatggcgtacttcggagatgccatgccgaggacacagctcaagcaaatgggcataaaatgcaccgcacgaatcggcgccctaaaaaggcacaaaagcgcgcatcacaatacggacatttcgtatcacttctcccgaatatcgcttcaaagtcggaaatttcagtgccacgaatttttcccaggccttgaaaagttgccaatagaaacggagccaatggccaaagaccttcgtccgaagcataacttccgctgctctgatcagttcgttgtctgaaatggcgccgcccctctcagagtgctcgaaggcattggccacaaataggcgttcctcgaagtgctaattagcatttgaagcggaagccatacataaaaaaggggtcaccccaaagaattcgttcgttttgagggaaaaagacattcgctttcttttgtttaaagggttgcaagttcgaacccaacaattggcaactgaccgacaaatgcataaactcggccgccactttgccacaataaattcccctcaggcgctcaatcagtgcccccggcgtcgctttcgccccctcccccaacggctcttccaattccttctcctcccaaccgtacaaatcgggctccaactcggggaccctaaacaattgcgcctatggaaaaagtggcgagtgaatgggcgagtgacccgacaggcacagaaagaccgagggggtccaaatcggcacgcaaaaagccaaaacgacggaaggcattgaccaaagcgttgatactctttttgtcaactcggccccgtatcaaaactaagcgaaataaaatgaaaaaagggagggatcgctttttgatacccttctcagcgtcagcgtcgagtcgagaagggagtgaattatgaccacctccgaaaacatttttgtcaaccctgtaatgcctacgttgaattggcatctttttgttgggattggcccattttaaaagcaatggagaaaagccgacgaaaaaagacatccgaagaagtggcaataaacggcagaaattttggataaatattaaaaggcggcaagcagttcaaatttaaaagggattatcgaaataaaccgaatacataaaaattagctcataatcaataaaataataatttttaaaatgtgaaagaataataattgttaaaatgtgagaagtaaattagggttaagtgtgaggtgaaaggggggggggggcgtggcatagaaatttggaaattctcagtgtgtgtaagtgatgttgaagcggtacattccgttctttcccgggggtttatttgtacagaatcatcaattggtcgccaccgtttcactttggcttcttctctccctcgccaattgagtacggctccgcctctccgtccgtctgttgctgtcgaattgcgcgtgcgttttccatggccgctttttcgagcagttcccaccgtctgcggttgttctgctgcttcagttgctcctgctccttctgtttgttgaagttctgtacgcacaggtcgaacaacttctgattctcttccatgaaaagtttcaatgccttaaaaatcggtaaaatggcaaaatgagtgaccggacagaacagaacagacattgtaaatcaatccgtggatcgtcctaaaaggaatatttttatcgaatatacttgaggaccgaagcagttaaccaaatccccccgcgttgttctccacctcgaaaaatttatataaaagaaaactttctttgaaacccgaaaaatgatagattttcaataatttaagttgcaccccatgagcagtgattgattacttgctccaatgattcctggaatttttatacagcgatgggaacataattggcaaaatggtctcgacattttcactgaatatgaaaataggcactatctaaggttaaaagaccggtggaaaaagaccttatcagggcgagaatgcactcgttgttccagaaataaagcgtcctttccgcaaccttaacaaaaaagaggaatttaaaaaggggaaaaggggggggggggagaaagacgtggaaatgcggtgaagaaacgcaacgggaaagttggtaaaagagagggaccatgacatttttgaactaaaatagaactgaacaattaagcagaagcaaccaaatacaaaacacctcgatcgggtcgatgacatccaaaatctcttcgagttcagtaatgaacatcacctttaaaagcccaaaatattaaggtcgaaaaggatggggtggtgaacttctttggggctgtgcactttgggccaatatttgagtagggccaaaacgacgggcactgtcagagcggagtctttgtcgatgaattggacaatgcaatacgccaattgggggtggtacgcgctcataaactttgtctggcaaatgactcaaacggttaaagcaatgcaaaatcttttctataccttatgcaatggaagaagcacacgcattaaaaaccttaaaatcatcgtaaaaggtaaccccaaaaagaaattcctctcacgttttatgttcctcttttagcggaatcacaaaaccttaaattgtttttgggaattgctaatgccaaacaaaaaaatgaccattaatgatgcttcccagaacttcaagcagttcagcgattccgttatgcctttccgtttcataaattgatgtatagaaaatgttgttgatttgtttgcgaatgaatgaccgacggtttacaaactttccataaattcgatggcaaatcgttttcagaaactccttaagtaatttcgtttccatttgaattaattatcattattgtataactgactctttccctctgatcttcgctgtcaaagagattcaacaacttaaagaaaagcttttaaaaaagtaaatttgcaataaaacaaataattggacaaatggcaattaatcaacattattttacattgactatgaatttgtggtcgacaaatttttctgcaatgcgacagtcaaaatcagcggattcgacaaaacgcagaaggaaatcgtagacgagttgcaaatgaggccaagagggttcgagaacggggtcatcctggaaaagggggggggggggtaaagaaaagcaatggcaaaacgaaagcagcacttcttcagggtcgaactcagtgccggagtgatgcgaaggcgaaaacacacggaaggcattggccgagaactaaagggagagagagaaggtaagaaataacataacagaaagagagggagaggagacgggagagagaaagggggcagagaaagagagggaagaggggggaggaggggaacagagtaaaggaaatgagtaagcaaaagaaagcaaaagatacagaccatttcgaagactgtccgataaacatcgaaactgaatttgtcctttctgatagccaagaaatcgatgcattcattcagtgacactcttttttcctcaataaaatatgttgtatgtgagacaattggaatttgtaaatgcataaatcttaaaatttaagttttccataacagcccacaaaacccacttctttcaaccgcaattccgacaaagggtcattggcaaaatcaaaaaccacggcacactgttttagcttctcgacgagcagaagttgtgctccccgttcgtccttaacctctaaaatggctgtcttatagaagcaaaaatggggacggaccgtcgaaatttgccaaattcggcccgccttctatcgaatgaatttccttctcctggggagattcgtccgtcctttccttcgccgatttaaaaggctgacaaagtgtacctgaagaaaaaggaacggttccaccatttgcggttatttttccaaactgaaacagacttgacacggggaccccctcatctgcagaaacacagccacagccaaagtccttcccgacattttcatcgtttaattccatcggaacaaatgttatttaatagacacgtattatttggtttaaagtaaagaattcgaaatagttatctttttgcaatttggagagaataaagaaaattattttatttataattt

SEQ ID NO: 438 - DNA, 1878 bp, Heterodera glycines
  misc_feature (1802)..(1802): n is a, c, g, or t
  misc_feature (1830)..(1830): n is a, c, g, or t
ctcgactcactcaaatactcttcgtacgaataaaagagcaaaggcggtatcgatgaaaagagttcgactctttttgtgtagcgaaggccttcccccgggggcacagccattctttgtgagattataagatccaaattcatgctgcacattgcctgacacatcagagtctctgcccttaaaaaaatgaaattttgagacgaaaagcgtggagattggctgtcggatttcaacctgtgatgaagcgaccgcgctttgatgagcgaaagcgtcttgcgaaactcattgtccattttggtcttttgcagctgccttttacccgacaccttttttagctggtgaagtgaaccttaattttgattatgactaaattttatgcactgatttcgagcaattacttttgctaaagtcaattatcaaagaattgcacttttgctcgcacatattgctcaaatttttcaatacgaattccccgaaatacctaaacaaataagggcacttttatagaataggagccgacaaatatattttggaaatcaaaagggtccctttttttgttttgtcgactcctactctctaaaagtgctaaaaaaaaaacggaaaaaggccaaatattcatcaaaaacaaacaaaccaataaatgtaatggaactcataaggctggaccaaacgcatttgaaatgccatgctaaagtaatggtgcatcagagccaaaattgtttgcaaaaagaaattggagaacaaatgttgcatattaggaatttggcagtccgaattgtccacgtccaaattaattcgtgctgtttccaatacagcctcgattttgctggccttaaaatggcgacattcaatgaagtccatttgtgagatgtatcaaaaaataaacgacctcaatgattagtgcaccaaactcatcaaaaattacacgcaaaaatttgtccatttgtcttgacaaattgtgaccaaaggtctgaaaaaggttcacataagcgcgcacaacgacgacgagaaaatcattgaaaatgtcccgtaatgactcatcggaagcaaacaaaagtctaaattttccgcataattttcaaaagcaatagatgactcatactttaaaggttgatctaccgtcccgttaatccaatttgcggagctaattgagttgaggacgacgccctcaagcggagttgagccgcagatgaaatggtcattcggcattatctattcatgaattgggcttttcttattaatcgaaatatggcagaaaatcaataaaacgcacgagaagttgagtgagtgaacggatgagaacgcatgagtcatcctcaccaatttgttgaagaagctccttaaaatacatccatcagtattttatattccgctatttcttacaattattccctcgacggtaagtgacatttccggcaaattggaaacaacagacaaaattttttccaacagattattaaagtattcgcacgcgccaactctcggaagaagccttgatttacgagggaaactgggaagtccaaaatataaagacgaattggcatcaaagacgggaagccaagaaaaatcggagtcaaatccatcggaaggctgcgaaccaacacatattgtgttcgaaatcattttgttaagttgaatgcattttggtagtagcaagttggaccttaattataagcgaaggcattgtcctgccatgccaacccatccattttggttcagataatggcatccctttttcattttcaccgtttcaaatcgggcacaaatcttgtttcaatgtcattggaattcgagagaagcgattncatagatggaaaaagagcatccaaaagntcaagaagtgccgacaaatattcaaaacgatacgcaacgcatccaact

SEQ ID NO: 439 - DNA, 4044 bp, Heterodera glycines
agaaaaaatttagtcgaatttgcaaaatctagcatgttttaaaaattcattaataaaagttttaattttgttcttcgttttaaagcagccaaaaaccaaaaaattagattcttcataacttcgctaaaaagctaccaaattttataatcttgaaatcattcgatagccctatgggttttatattatcctgcaaaatttcaaaaaaattcgttaacttttaagaaaattatgagcttaaaactaaaaaaaacctaagttttttgaacatttttggtcataactttctcgaaacttgacaaaattttttgaaattttgcagcataataaaaaaacgcttagggctatcgaatgttatcaaattttaaaatttagttgtttttgagcaaagttatgtcaaaaaatattttcattagatggtttttgactaatggactggcgaagcgaaacttggcttggcactcgacgtcgaagctcaacacgaagtcgcccaatttactcgaagtttcaagcaggaagaccaaaagttttttcgaaaatttttatcccaataataatagtcatcactagggatgggatttttgcttaatatttggctgaaagttatgtcactatttgtcactttttcgcacttttggtcactattttggcattctttttatcactattttaattaactatttcgagattttcgtcactaaaagtcgtgaccctagtcataacattagacaagatgaaagcagggggggggggaatagctgaccttggcaaattattccaattcgactttcgcttaaatccaattttagttgccaattcccaaaattcagcgctgaatatcgtcgttgcttccaaaaagtctttccttggctcgccaaacaccaaaatgccgcttctaacgtggtgttcgttggcacttcgtcatcgtatttggccgtggtgagccgaagcgacaaaaatatgggtgtttgtaataattaaatttaattattattttaattttaattgctaaataatatatcataacttagcttaaactcagtcaaataatgaaatttagtactaagcgacagctccaagtatcctctactaattatgtaatttttataaacttagcaaaaatctataaaaaagttgtaaccaaaaaagatcgaaaaatttatgctcaacaattttgaccctaacttttttgcaattcgataaatttttttgaaatttaacttaataatagagaaatctttgggctatcttttcatatcaatcaagtgcggtgtgaattattgtaattgatgttggaacaattttcatgcaatttaaacgaccttacattttttgggatgaccataaaaatatgagactattaattcctttttacttttttctgaatcaaccaatttaaatgttgtttatataattagatagcccaaagatttctctattattcagttaaattccaaaaaattttattgaatttcaacaaagttagggacaaaattgttgagtcgaggaagccaacaaggacaagcaaaacaacggcgcacgttgccaattgtcagccggacattgtgactcaaaaatcagcagagagacggacaaacgagtcataccatacatctcgaaataattcgaatttcaaccatgtttttgtagtttgacccggggagtgccatagtttttgatctatttttaactaaaaaatactgaaacagcttaaaatttaaatggaataacaaattatcctgcaattcgtgcttttcaatttctttaaaattttaaaaccagctttttataactttgccaaaaacctgagaaaataatgacaaattcgttaaaaaagattgaaatatattacaacattggttgttaatttcgaaatgcttacctcctttattttattgattatttaaaaagaatgctaatatccgaatataaaaatgccaactttttaacctaaaaatatccaagtaaactccacatttccttaaatccattcattgctttgcgttaaactttatgatttacagcatggagaatccaggaaaacaaaatgtatttgcataaaattgtaaaaataatataattatagaaatatatttaggcaaagccattgacttaattttaatttaatatgcaataatttttcatttccgtattcagttatttaaaaaaagcattaaaattatttaatttttattatatatttaatcaataaattgattgcttaatgtttataaaaattttctatatatttccgaagaaaataatttttataattacaatttttattagtttttattttattataacaaattagtgatgatgacaacaaaacaatttctgttaatttatatattaatttttgtgttaacaaaacccggttttatgaaaatcatttatggtaaggctaagggggtcgggggcgttttcttacgaacacaattttttagtataactttttttctttgccaaccaaatccaacattcttggtatcattcaatagcaccaagtgtcctctataagcctgcaaaatttcgaaaaatttcgttcaggttcaataaagttacggcaaaaatttttcaaaaacctggttttgtgaattttcgggccataactttttttgaaacttacctaaatttttagaaattttgcaggctaatagaagacacttatggctttcgaatgataacaagattgttggttttggttggcaaagaaaataagttatatctaaaaacttgtgcttgtacgaaaacagcctgctcctaaggggaatgctaaacaattaattggtgaatttttcaattttttttttcaaatttttttgtctaaaaaaatagaaattttataatgattttttaaaaaagaattgcattataaattttagcaaattataccaaaacagatgcagtcatatttagatgtaagccttttgacgaaaagtttcagtcctataaaagatttattaattaattatgtgctaattaatcattagtgaatgtccccttaggcatcgacactttgcaaatggacacacattacgcggacattctgttcaacgaccatttgtcattgtccgatcggtccaatttggcctatcgaataggtggcgcaattgtacatttgaatgttgaacgaagtctcgacttaatgggaaatatgtgccataaaacgggcctgaaaattcaaaacgcttcgcttttaattgtgggattaatgagggaacaatttggccaaatgatcgaagattttggcaaggagcagctgcagaaagacattttctcgcttccacttgtgccttttgtggaaaatggagctgagtttggacaacatgaaaaaattgctgatgagcaaagcaaagctggacaaactgctggaccctgaacatttgtatgatgagccgattaattagttaaatttgcagaaataatgacgagttttttcgggtgggagtggttctgtttggtgcattagtcatagagttttgtacatttttgtaaggaatgagccagcggacggttaaaagtagggttgctccccgacccagagctccccggtccccgaccccgatccccgacatttttgggcctattccccgccccgacccccgacatgtcgccccccgccgaggtccccggcccccgacattttaccccccgaggggtcggggagcaaccctagtttataagaagaatcaggaagctaacatacgttttttggctgcccttttcaattattttcccaacttatacaccattgatagagagagcttcaatagctctacaattttactcagaggtgatctttcgctttttctattgataaaaatggtttattgttttttttttgggaaaagatttaaaaaattcaaaaaaaccgaaactgaaacggataccgaaaattttgcttcggtttttttcggtttcggttttttaaccgaaaccgaccgatcgacaaatttttgagtttttcggtttttttcggtttcggtttttttcggtttttataccgaaaccgaccgaccgaccctcttgtccgggctctaatat

SEQ ID NO: 440 - DNA, 4771 bp, Heterodera glycines
aaatcaaaaaaatcaaaattaaatctccggaagatgccttttaaaaggtacaacaaataaccgcgaaataggcacaaaaataggataggaacctagatatcggtagaaaaagcctgaaagaggttaaaatatattcataattgcatgattttgtctctgcaataaaaattctttttcttttgtccaattaacatattatttcactaattcaaaattaacttgataaaaattagctgttaaggatgtaaaaatttggagaattttttctcactgcttaattgccccatttccattttgaacccaaaggccgatttttgggattttgagccaattggcaacgaccatttttttattttccaaccgctttttcggctctttcttccaaaaaaaacttttggaggacagtgagggtcagacggcgccgataggcgctgttgggaaaattttgtagtttttaatgcaatttgttcacagattttattcaaaaaatgaccaaattttagggtttttagccaattttttaataccaaaatgtttaatttggtcgactttaacaaaaggtaagaccatattttgtcgaaaaacagtacgagttgggtttcgtccgaaaaatatgtatttacataaaaatgggcaattttttgtcaaatttttaaaagtttagtggagttttggggccccaggaaaaatatttggaatttttaagaaaattagctaataacatcattattatttttaatttacatatttttatttgctaattgtaaggttttacgaagaaaattgaattttttcgaaaaattatcgtggctttaatcccgcgggatcccgcgggattggtaaaatggtcgggagggatcccggttcgggatcccgatgaaatcccgatcccgatcaatcccgatgaatttaaaaaatcgctcgggacggatcccgaggtcgggatcccgaatttaatcccgcgggatcccgaagaaatcccgcgggatcccgatcacgtccggtctctaatataggtagaaaaagcctgaaagaggttaaaatatattcataattgcatgattttgtctctgcaataaaaattctttttcttttgtccaattaacatattatttcactaattcaaaattaacttgataaaaattagctgttaaggatgtaaaaatttggagaattttttctcactgcttaattgccccatttccattttgaacccaaaaattgtttcaaatttattaatttaatttaagttggtttatttaatataatttcatttacatttaatttaatttattaagggactcaatcaactgcgatgagctggaaaatgtgctgtcacaagcacaacggaaaggcaacaaaattgaattgccatcatgggccaaagattttggcaattatttttcggatttacatttttacgggttgcatttgtccctaaatgcggaggggaccgaaaaagggttcaaaatgtccgattggctgggccaaaacaaattggacggcgaaacgacaattgcgcattcattacggacaatgcatttgcgcggagaaatgggccgcattaaggagataaagcggcgaatggtgcgccatttgattagccattttcaattggagcggttggagatgattcacccgatcagaatggcagcaggtcagcaaaagggttgcatttgatggcattttggtgccattgagaccgaactctaattggaaagacggcaaagtgttgagagtctcgaccctggggaaaaggcattttcaatgtgtaagcgtctagaccttgacgacataaatgccctttgacttggaaaatgttgatccgcagactgggccaaaaaaaaatttgaataaatgaaaaaaaattggctaaatttaaatgcgccaaagataattataaatttgttctaagaccataaatcagtttttcgtaatgttttaagtttttcaacaaaactctgtaagaatatagtaaatttctttgcctactgatcgattaacgcttaaatttcacattaatattatctatcgtatctcatgcatactgtatcacagacgcatttcagctgtcgcattttccggtcgcattccctcggctcttcccaacgagtccacaaatatatagtttttcgaatcaaaaaacatggccaatttgcggcatttttccaggtcatgttgatgaacaaacaatgagcacatattatgagatgatgttctgccaaaacattcgtctgacagaagagttgttggaatatgccattctgtgcagccaaatttttgcctatttcctccaccaaaagggtgccaaaacggaagagaatgatgccaattggtggcaaaagtttgtacattcgacccgacaaatcattttgttcactaatgacgccggtgccacggagaaactggcaaaaaaagaggacgttttgggcactttgcacgagctttggcacaacataaaagacggagacaattttgacgagaaagcattgcgaaagggcagcaaaatgggacgggaattggtggaaaatttggcaaaatgtttggtggaaatttatgccgggaacgaagagtttaggaaatgttttggagagcaaagagaacggagaagaaagctggaacaaatgcttagaatagccgaaaaggaattgggcggaagaagtgccgtgccggaacaattttggcacatttttgagggtaaagtcaaacataaatttataaattatattgttattattaaggctgggaatttaagtcacgaaaaatatccaaaagtcgaccaaaaaagtcataaaaaatgcaaaaaacttataaaaatcccaaaaagtataaaaagcaaaaaaagtcacaaaaatgcatgttaaaagcttcaaacaaagtgtagaacactgtttaagtcattttaaggttatattcaatgatggggttctaaccgagtaaatacggtattttaattttaaaaattagacagtgaagcagagaaaacgacggagccgacgaaagagcaaaagcagcagctgcaacaggggggaacctttgctgatgattcctcaatgattctgttgaaaattaatgacatttgtcccaacaaaaaaattcccctgaaagaaatagaaactgaacatttgaacaaagaaggtgggcaaaacaatgctcggcttaaacagggttagccgaataccaggctaaactggtgctgggacgttagtcaaaaaccatcaaaatgggtgaaaaaaccatcaaatgaaaaattttgacagaaaatcattcataacttcgcctaaaattaaccaaattttagaatcttcatatcattcgatagccctaagtgttatctattatcttgcaaaatttcaataaaattcattaagttttaaaaaagttatgtcaatttggttgcttttaaaaaattgtttcatttgatggttttttgactaacgtcatagcaccgctaaaacccattttgtgactcagttggaggcttttgccaaaatacgccgagtccggcaaaccccgctttaaaatgccgacccaaacaattaaatttggacaattaaaaattgaaatcatttagagcttttttcctacactctgatgaagcagtatgttgagctgctgctggccgatcgccaatcggtggacaaagagttggaaacgatcgaaagcaaagcgatcattttttattatcgagaacgcgttagggcgctgttcagaaaggcaatcattgcgcaaccaaagatggaaaatgaacaatttatggccgtaattaacaattatttgacccaatgggagtcattaatggacgaatggcaacaaaatgccaaagggacagcaaatgggtggccccaattagtgtgcaaatgttaccaattcacttacaaattggtgacggacaaacagctgaaggaactgaacgcggaatggcacaaattggtgggaatgaatgtgaaggaatggaacggcacaatgctaacagaactgatcagcgagaatatgatgagctggtttggggtcggttgtttgctcatatgtagtgatcgagttttgttcatgggcttccaatttgttattaagcgatgacaagtttttattttaaaatttttcaaaattttaagtccccaaaaatttgaaagtttcgtggtgagccgaaatgacaaaagtatcaataatcggaatatttaagtttaataattattttaattttatttgctaaaaaatcataacttagcttaaacttagtctaattaattaaactttgtattaaaaggtagctcactacatttcctctactatattataattatttttaaatatttaaacaaccttacattttttatgagcataaaaatatgactcatttaattccttagtaacatttttcaggaaacaaccaattttaatttactttataagatagcccaatgatttctttattaattattttgtcaaatttcacaaaattttattgggttttaaaaaaagttagggtcaaaattgttcagtctaaatttttcggaagtaattaaatttaattattccggtcattgatacttttgtcacttcgtcctagcaccgctctttggtgtttttgacaaaaactcgaaagccgggctttgaagctattctttttgtttttgaatagcccaaaagatgcccctcagaaaccgtacttaaattgtactactgtatttgaaaaaagtacaaaatgccatgccaagattaatattgcttatcatgtacacagaaaagcattctgttgtcggaccaatgg

SEQ ID NO: 441 - DNA, 1050 bp, Heterodera glycines
cgatttacatggcttgatataattctaagctaaaatgaagactataacattttttcgaatttttaatcaaaatttcaaaactttttgaaaaaagtcccggtcccggcccaaaaactgggaccgggaccgggagtcccggaaaaacgggagtcccgggatcccgtcccggtcgatttgccaagtcccggtcccggtcatttcaaaattccgggctctagtaaatatccccataaaggagcttaaatggaacaaaaaaaatggtaaaataggggtggaaaacggtaaaataaggacgaaaaacggtaaaagagggacgaaacacggcaaattaggggtgcaaatttaaaatccgtccgttcatttctatgaaaacaaatcaattaatgagatatttgcaaaaaatttaatttcctctttttcagtgcaaaaaataataatcttagttgaattaataatttcataaaactaaatttacttaggagtgtttttaagtttttattaagaaatttttcaaaccaaaatagggcgccctatttaggggggaaagtcaaatataatttaaaggatgaatagaattagaaatatgtttttcaatgcatttctcatagaatttgatttgtaattgttttttcagatttgttgaccaatacgcaactgatcagtatgctaatgaatcagtttaactaccaaagtggcacagaagaagcgcaatttattgaggcgagaaatgtggcaccactgttgatcggtgaaatattggaccatgaggacaaattgatcaaaaatatgcttaaaccattgaaaaatttgccggaaattcgcgaaattttgttgcacaaaattaaggccacaaaacgggcatttctctccaaattgggcacggcaacgtacaataaaagcgtactgcgcgaagcaatttgtccaccactgtttttgtacctgaggctgaaaagcattgccatgggaatcagcaaaattaagcgggggaccgaactgagccaatggcagccgaacagcgaatgcgagacggtagagggcatccaaaggtac

SEQ ID NO: 442 - DNA, 3745 bp, Heterodera glycines
  misc_feature (3705)..(3705): n is a, c, g, or t
gtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtaccggtttttttacaattaccgattaccgctcaactctaatttttactaattttttaaaaattacataattagtagaggatacttggagctgttgcttagtactaaatttcattatttgactaagtttaagctaagttatgatatattatttagcaattaaaattaaaataataattaaatttaattattacgaacattgacacttttgtcacttcgtcctagcctagcatcaccgtatctcgggggtcaagcctttgacagaatttccgggaatttaagctctctggcagtacacttccatcaaaggatttgaaaattgatgaaattaattggaataacaaattcttttacagcgatttcaaaaatcttttccccctccccttaaggtcatttgatgaaactcgactgctgttcaaattcagaatctgtcaattttttgtcactaatccaaacgattttcgaatatttcttcaaaatttagcagaaaatccaggggcaaaaaccaaattcctaaaactgataaatgccgacgcggtaaccaaacttttgccggactcgcacggcaatccgctggtcgaagcgctatgggcggccgatgagagggcgatggacgaaggtgtgaagcaatgctttataataatttaattagctactaattaatgaaaaatgctttggacgaaatttgcctgctgaccgacgaccgcccgtttaatttatgaaaattatataaattatttttagtgttttatggcaatcttcagttgggccaccttttcctcacatttttgacaacttatgattccgtgcaatggctgtactataaaataaaagtatttttttgtagataatcagagctaactgattgtgagaaccggtagtcaaaaaaccaccaaatgaaaaatttttgacagaaaattattcataactttgcccaaaatgaaccaaattttaagctcttggtatcattcgatagccctaaaacttgtatgaaaataagtacaatttctgccataacttattttaaatttgatagttttatttgaaattttgcaagctaatagagaaaaagcttggctattgaatggtgccaagaatgtaaaatatgtttgcttttaagcaaaattatgccatgttttgtctaaaaaatcgctaaaatggcggattttacgaaacgacccagcaccgtttttgactaacgtcatagcaccttcgaaaccatcaaattatttatttttagttggatttgttcatttttgtccgatggatcgactcccaagtgaccgcccttctcattttgggcaattcgttttcggcacaacggtgcgccaaattttgggttcgatgcaaagttttgattctccaactgtacgaccgctactttgatgagcaaatggaggaaatgccaagcttacaaatattccaataccattttttgagtcatttgaatttgtattttgaaaaaattttggacagaaaaattggggcgaaaaaaagtgaaaaagcgatgaacgacgaactgagaaaaatcgtgcaaaacagccaaaaagtgtatgaggaggacaaattgatggacagttttgtgtcggaggagagggagcagtacgaacgttttgagatggtattgacggaattgcgcatcaaaacagtgaacgaattggcgaatcgaaacgaagtcttcaaagaggcattgggacattgtgagagagacagagagaaaaagagaaacttaaaataattacctaattaaattatcaataaacaaacttaatgtataattaattagggaagggattccgggatttatgtctaaaaaccccggaataagtaccgaaatttggtaaaaaccctcaaaatatgtgactaactcggacataaaagtgaaaaaatttgtttaatacgggccatttttctccaaaatggttaaattgagcttaaaaattattctattccattcaattacacaaaaaattgagtttttgtggttttgtcagaaaaaaaagttaaaattttctaccacgacaaaatttttcatttttcttaataaaatcttgtccatatgccaaaaatgtacgaactcccgaatttttggcttatgtgccaaaacttcaaaacacttatgtgaatttatgtgttaaaagaaaagtcgttaaagttcaaaaactgtttagagaaaatatattttttgggttcccctgcgataaaaattagagaaaaagataaatttgattttttaaatattttaattattaactctcacaatctctcacattgaatttctcgaaaatgactttttcgcaaacaatgtgttcatttgaatctataatttttttaaaatccttcaaaaaattgctcacaattaaaacggtttaaaatttattttaatttgtttttaaatttgtgatttttttttgcgaattggtaaaacaattattatttatattttaaacatttttatttataaaattttagtcttatcaaaaatgaaagaattgcccgattttgtgggcaaagacacaataatagaaacatggagggcaattgcatcggaacattttgaagaattgggcaaaaaattggaagaaaaatacggcaaaaaaacagcggaaacgaagccgaaaaagaaaaaggcgaaaagaacaaagaacaaaaatggaaaaaacaatgcgaaaaaagaggacggcgaaaaggaaacggaagtagcaatggatacggtatttacggaagagggaaatacagtaagcggagtggggacgaatgaagaagcgaaagaagatgctgaaatgagtactgttgatgtggatacggtaggggacaaaatggaaagtgcaaacaccgaagaagaagcattcaaaaatgaaaatgcttgcgaaatgaatggagcggaaaaagcaattaacaatggacataatgagtcattagcaccggtcggcggcgaagatcaaagaaatgaggaagacaaaagtcaacaagagaacactgatgagggcagcgaatcgactgctgttgctgatagagcgacaaagctcaaagagtttgccgacgatgactttttggcacaaaaatatgccgaatttgtgcacacttttatgatggaagaacaacaaaatggggatggcattggccaactgatcagaatgctcacaatcggagcatttgtcaacgaaatttcccatcgattggatgcgatcgaatggatgggcggtgatcagtggcaaaatgtgaagaaaaaacgcacatttttgtggtggaaaagcattttggctgatcaacaatattcagcagatttagttgatcaactttatgangttttgaaggaaatttggagtgaaagggagaaataattgg

SEQ ID NO: 443 - DNA, 3056 bp, Heterodera glycines
cgaaaagaacaaagaacaaaaatggaaaaaacaatgcgaaaaaagaggacggcgaaaaggaaatggaagtagcaatggatacggtatttacggaagagggaaatacagtaagcggagtggggacgaaagaagaagcgaaagaggatgctgaaatgagtactgttgatgtggatacggtaggggacaaaatggaaagggcaaacaccgaagaagaagcactcaaaaatgaaaatgcttgcgaaatgaatggagcggaaaatgcaattagcaacggacataatgagtcattagcaccggtcggcggcgacgatcaaagagatgaggaagacaaaagccagcaagagaacactgatgagggcagcgaatcgactgctgttgctgatagagcgtcaaagctcaaagagtttgccgacgatgactttttggcacaaaaatatgccgaatttgtgcacacttttatgatggaagaacaacaaaatggggatggcattggccaactgatcagaatgctcacaatcggagcatttgtcaacgaaatttcgcatcgattggatgcgatcgaatggatgggcggtgatcagtggcaaaatatgaagaaaaaacgcacatttttgtggtggaaaagcattttggctgatcaacaatattcagcagatttagttgaacaactttatgagtttttgagggaaatttggagtgaaaaggagcaaataattgggacaaatttggagaaattaacgggaaacaaaaaggagcaaatggaaagtgatcagagaagaggcattgagttgatcagcagacaaattcacagcagaaaatttggaagagcaatcattggaggaaaagtaaaaaattgggccaaaatgccaaaaaagcagaaggaaaaggcacttttgagcctttttggaagccacgaagatggcactaaaaatgccgaaaatggaaataatattgttggcaattttgagcgaaaattggaattgctggaaaaagcatttgcacagcaaaaattgggtaggagaagatgaattttaaaagataaatttttattattagaccaaatgttatttgaacaatacaaaaacaatgagaatttgtcactttttattgaaatgaaagacaaaataaattttaatggaaaaaatgcgcaaatatttccaaccgaaaattggcaagaattgaaatttacggaagaagaaaatgatggaaaattgaaagaaatcgaaaaagtaattttaaaatttgacaaataacaataataaaattttaagttgaaagacgcattaaaattgagagatggcgagcaaaaagttgcccaaaaactgatgattaaattgaatgaaatttttaacggatgggtaattaaatatttatttaaataaaattttaaaaaaatattcaatatttttctgatcagtcggcggaagcacaatttcaaccttcggctttacattttctgatgaactcagttgcaaaattggagccgatttgcattttgccggacggctttgatcagaaattgatttttggacaagcgacggaatgcgatcagtcgaagcgagagcagtgcagtgatcagtcactgtactgcaccctgtgcaaagttattctttattataattttaaattaagattaatcatttttcgggggggggggggagatttgtccttgaaaatggcgggaaaaggacaattgttgttgtccttatttaaaaaaagattgtttctgagcattttttccaattttgcgtaatcggattcgggattttgataaaattctgaataaatcctgaatttttacttgtaaaaagcaaatctaaatttttaaaataaatcggaacgcagcaaaaatgaaatttttaacgttattttaattttttgaaaaaaattaatttaaatttcagtaaatttttgagctaaacggtagcctaaataaaatatctcattcgaaatttaggcattaaatgtgacatttatccaaaaatatccgaaaaatgatttattcttgtgggatcggttcttaagggttattttttgtttttattgcattttggttaataaatttgggaaaacgccaaaattggacaaaaaaataatttttggctgtttaggctcgaaaaattttaaacctagaaaataggctttaataactcgaaaagtagcttaagaaccaccaaaaaaacttgcttttcgtgcgtttaggccacaggaagctgaagtaaaaatagggcaaaaacctaaaaagggtcgttggaattacaaattaatttctttaaaattttaaattaaaaaagaaattagttaattaaatttttaaaagatgccgacaaaatcaaacaatttgaccaaatcaccgagctttataatcaaagcagaacagtggcattaaagcaaagagctttggtaaaggagaggaaagaaacaattttcgttttggcaggtaaaattaaaatatattaattatataattttatttagtttttaattttattttcagattttacaatgcgtttaaaattgttggaattgttattgccaaaaaccgattatttgtcaatgttcagcaacaagcaaaataaattggacggacaatttgctgttggcattttggacaaatttcgaacaatttttgcctttttggagagatgggcacaaagtaaaaaaaaaacaacgcataaattaattttttgggagaattttagccaaaagtctacttggattccgacttttaaatctgagtctttttggcaaaaattctccaaaataaataaataaataaagataattaaaaaattgtacaaattaattttaagataattttatttactgcgaagatttgggctatttgaatggcgaaatgcttttgataatgttgaccaaagtatttcttctgttccccgactcgtcagtgtcttttcttgtcgacaaattctttctcatttactcaaaatggtaaaaaaaaaaattaattaattacattatattaatgatcttttttgcgaatcgagaccatttctaaaaaagtcggacttttttcaggcaaaattcgctgaaca

SEQ ID NO: 444 - DNA, 441 bp, Heterodera glycines
cattcccgcaacgatatgtggcggaaaaagtgaatgtatcaagcgcaaaagtggtgcaaaatgagctgaaccaaggcaagcgactgacaaaaactaatggaaaaataatcttaattaataaataaactaattaattaatcaatcgggacggagtcattatttaaaaaagcatctatatgatttgatgaaaatttatttataacttagctcaaaagcaatcaaatatttaattcttgatatcattcgatagcgcttagtgttctatataattctgcaaaatttcaaaaagtttcattaagtttcaaaaaagttatggctaaagaactaaaaaaaccccttgtttttggagcatctttggccctgacttttttgaaatttaacaaaattttttgaaattttcaagactgatagagaacacttagagctatcgaatgatatcaa

SEQ ID NO: 445 - DNA, 5259 bp, Heterodera glycines
cgcagaggccggagtcgttgaagatcggccgacacggcggcagtgggcggatggacaacggaaagtcgcggcggacaatggcaggatacgaaccgatcaatgaggtgccgaaaatagagacaaccggtcaaaaatcattcgcttcgctgttcagcttcagcccagctgttcgtctcgtccgcctgtcattgcgcttcatcccccgccgagtcggccgcgtcatcgcagcggtggaaatcccaatgccgtgctgagctcacgccgttcctccaccacacaaacgccacggcgtccgcccgtcgagcgcctcgtgtgcggtcattgcggtgcgcgcatcgagtgcttcaacgaggaaacgctgtcgctgtgctgcgtcgcgttgtgcacctttttgcaacgtgccaccgctctcgcggcaccgctccttccgcgcacagtccgtccatttgcttttttttatgctttgtctttcccctcttccacttcatttccatatttatgtgggaaaaatttagcttcgctgtgtcactcgtttcatcgattcgccgctttttccatggcacgaatccaatgtttttgtgccgggaaactcatgcagcgctgccaaacagttgatacgcgtgataatgcaccaggtgcttgatcagctgagtcctatgtaaccaaacactgacacattgtttccgtaaaacaaacgccaaattaaattccgcgccattttcagttgtcttccagtggcattgcacttcaactgttcagcatgcatatccaaacgaatgaactaaaccaattttggaatcgaattgccaatgcattggccgacttttccgaattgaaccccgtcgcatttattcagattttgcttgaggcatgcatttaattaaaatcattaattatataattcccgctcccctaaaaaggatatgctcgaggcctggccattacgagtgacgcgtattatgcacaatttggccattttcatgcaattcattccaccggacgcttttgcgaattgggcactcgtagtcggccaattggaagggctttttcgacgcttacaatctcaggcacacttaagcctaattaaacaactattgtaatgatggtcattcattttttccaaagttgtcaatcgatatgcccggacaaaatgccagcaacagttgccaaacccagcagaatttggctgccgaagtgtcctcttctgtgctggtgatgagcagagtgaagcgcgtgcaaaattttgcctccataaaaggggccgcccaattggtggaaaggtgaggcaattcacacaaaaaagggacggaaaatgcaaattaattaataaggaaagcgggaattttatgacaaattaaactgtacaaattgtttattggttgtgagacagagaaggactttccctcgaggattataatggaggagagaattgcccctaaacgatcccattattgattcagttttgccaaatggttggtcgaaatgctgcaccgatgcccggttgagttgcgcgacatgtgagtgttcgcggtttcaatgaatggcaaaataatttgtcgttaattttattcattttccaggcttttggtttgcaccgcttgtaacagagtgagaaatgcgcgcgtaacaaatgacttttaaattaattaattggtctagggaatgatcagagaaagggacaagcaaattatgacgcgtgccattgttggcgaattggtggcagcgctaaaattcaaatgcgaattggtcgagcccaaccacttggccatcgtacggctcgttctccaagactttggggaaccattggacagcgattggactgcaagtcaatgcggacaaacggtcgagacgacagaaggcaatgggctaaaagaggaaggacggagcacaaccgacggagcggaactgatcggcggaaccggcggcggcaacggaagcggcggtgatcagttcaacacgggcgcagcagaagcaattcgaccgcatgtgccggaactgctcgaattcatcgccgacttgcacgttttggccaagatgaaggtgaaatggatggcaagacaaaggaagaaacaaaatcgatttacagaagcaaacgctgagcagcagcgatcggatgggcggtgatctgaaggcgggacttgccgaactgatcgcactggaaatgagtcgcccgtcagtgcgcgactctcggacggtaagagaatttaagccgttctgcagatcaatcattttatttgtattttcattgttaaacttattccatcgttttatcagtatcactttatgttaattaccttaatgagctcctccatctgttcctttaggtgatgcgcttcattccatggctttactcgccgccttcgctttcccaggcgttgcccggcgcattcgccgaatcggtggccaatgtccgcgtgctgtcctggattttgttgggcacgttgcatgcccgtggcaatggcactgtcaacgcaatttgcagctccgtttcgggcccaaaccaatgtttgcccgtgccgatcgcttgttcgggtcagatggccgattacatccattttgtgttggccgggttcgcagatcagtcgaaagtccgccggaacttttgttcgctattggtcaatgttttgcttttctcagcaatccgtcgttcatatgtccgcccttttccatgcgtttcatttatgccaactttggacaatttactgtgaacagaccgccgccacttgtcgctcggaagagacccttcaaaggacgatgcaacaaattttggacttttgggcacgcgtcaccccggccattcttcagctgctgtcccactccaaagtggtcagttttctgcttctaattaccttcctgatcaatctttttaattccgctcattcgtttggttaatgcttttctccttttcatcctatttttggtcttattaatgcctgccttggtttcccataataatgccattttcactgcgttggtgccatggtgccattctctttttccatgcatttctctttttctatgccattctctttttccatgcattttcgcttaatatttctttctctatcgcttttttctcttttatgccaattcctcactctttcagctcgccgacatggtcaacctgcactttgtcaacactctccaggcccttcagcaggtcaattcggccgtcctctgccaactttaccccatgtgggagcccgtgctgaccgcgcaccacgcgcacatcccacgccaacttcggatgaagttggacgcagttgaagcgcaggtgaaggaggagggcaaatggggggtaataaaataatagaccaattaatgcaaatgatggctaattaatacaaatgagactccatttaatttcataaatgaccacctcacttcccttttttctgttttagctccccttggaaacgccccaaatgcgcccatggctttcaaaagttcgctacaaaatctcacaaattgaactccaaacgagcgccgcctcccctttttacaatgtttaaaagagtgctgctaattgatttttcacttttgcacatttatgtgatatttttaggtgctttttgatttttgttgtggaaatcttggatatttgttttgtaattttttctttttaattatttaataattaaaattgaatattttttgtgtttagtcaattggtaacccatcagtcggctaaacgtagaatagggacgttaaaactaagaattttcggtttaaaaatctgttattcgtgctttctcattgaattaaagccacagaagaaaatcccaaaaaacattaaaataggcattaaaaattttttattaaggatttttagggagaaaatcaagtaaaacttatccatttcgaacccggaacactattcggccataaaagaccacagttactcatataagcgaatgtgtgctcttttggcgagaattgtttaaagcaaaatatccttggcaaatgaaaggcacgaaaatcccaaaaaacattaaaataggattaaaaattttttattaaggatttttagggagaaaaacacgtaaaacttaatgaaaaaattaattttggtcatttaaatgattgataaattgtttatatttatacataaatattttttcgaataaataaaaattttaaatctaaaattttttatcaagaaaaaataaataaattctggcgatcaatttttaagaaaattttcaatcttaggggtgtattttctggaatttttttgattcatttcaggggtgtattttcccgattttattgtatttttaatggaatttttggaaaaaaacgccaataaggcaccaaaactgcaaaatgccaaaaaaggcatttaaggcacgaaaatcccaaaaaaggaaaaaaagcctaataaactcaacgtatgtagaagcttcaaagcaagtggaaaatgtgttaattatacttaatatatcgaaactagtgcgtagaaaaaaaggcatatgcctcaaaagtcggtctctagttatgattaactgataaaatttttagaattttactgctatgcttgttgattttttttcaaaaataggtgttaaaatcgaccaaattatcgcgaaattgcgtattttttattcaagtaataatttaagcattgttttgcaacaaaataaatagttattaaatgaattcgaagcttttccccagaaaaatgcatcttttgaaaaaaatttcaactttttcgttcggattcgggtccggggttcggaattgggcaaatccgagttcatattcgtgaccagcgccctcgaaaacccccggaactgatttttggcctaaatttaaaaaaaatttaaatagaaacccccattcttcaggattaccggcattgcggtgggtgaaccgcaataaattgccggtaacatgtgatttcgtcagaagtgatttcgtcagtacggggtttcgtagtaataataataattttttttacgaaaaattttaataattcataaattaaatttgttcaaaatatattaaataatatgtaaattcaaaataaagattatttgctgattatcaactattttcggccggtcacttacatataagcaaaataatttgtatttatgcctcgtctttgctacttttatctcctataagttcattctagatggtcgtcagccattatcattctgcattaacctcgaaatttcgctttcaaatttcttaactgtgttggagcgcgaccgcaggtttttctatccgcgttccacctctattcttactaag

SEQ ID NO: 446 - DNA, 3235 bp, Heterodera glycines
gggtcggtttagtctggcccgtttagtctggccgttttagtcagagggtcggtttagtctggccgttttagtcagggggtcgttttattctggttagctgtttttacccacaaattaattactttttataaatttcttttgtttgtcaatcatatacataaacataacttgaaaatgtctgtttagctacaaatcaaatggaaaactccaatcaggaaataaagacaaagcgaaacaagcagaagctggaacatgagggttcactttatgttcttcaccaactcagtgacgatggacttcggaagtactggcgatgcgagtttttcgggcctaacgacaaatgcaaaggtgtatgcaaaaataaaataaagactatttttcaaatttagggcgcattcacactgatattcatggtaatgtcctcaaaagttcatggacaattacaccggaaggccgtggttcaatggtggtttgacagtgccacggttcgcaccggaagaatggagtgtgcatcaacggacgttggatggaggagacagaaccaacaattacgcagaagcattccatagaaaacttcaacaggcatttgattgtacccatccaagtgtcttccacttcatcaacacaattcgatgtgagcaaaagtcaattgatgctgacatctcacgatgcgtcgctggtgaactccctcctctaaagaagcccaaatatcgtgccgccgatgcgagaattcttcgacttttgcagggatacaataccatcaacaataacccggctaaccaaaatgaccacaattaccatgccaatgtcaatgttaatcccgataacatcaaccatttgctcgttggtgtttctcgaaattatgaaatgcgcccgtaatttttcaatgctttgttatttttttttgttgttaacacattggataaatatgttttgataataaattaaacatttctcgaaaaaaaatcagaatataatccatgtggcacaaaaacagcttgccatactaaaacgaccccctgactaaaacgtcccctcagactaaaacggccagactaaaccggccagactaaactgacccggtccgcgattatcaacctattttcggccggtcccttacatataagcaaaataatttgtatttgtgcctcgtctttgctactttatctcctataagttcattctagatggtcgtcagcagggatggcatggaattccgagttctgacatttttggggtcggaattccgaattccgtaaaatttttgggcctcgaaattccatccatggtcgtcagccattatcattctgcattaacctcgaaatttcgctttcaaatttcttaactgtgttggagcgcgaccgcgggtttttctatacgcgttccacctctatttcttactaagcattttgagtttgttgatagtctttgtcagttttctgtctataaccggagattgtgttgcgtcagccgatcacgtatggaggctacgtttaaaaatgggttcggcaggacaacaatttgagaatacttgtagcggattttgcaaatcgcaacccgctagggtatttacgagcctgctttatctttcggatttttgaattttttgtaatttttggctaggtgttcgcttttttctgaattaattttcactgacgaaatcaccgggaaccaaattgccgaggcagcacctccggccaacattggaaatacgaccttaatttttaaaattatttttctaattagcaacttataccattaaaattaatttaaaagaatgttcagccggtggcctgggtttgtggcttcttcacgctcgagcttcttctcctcaatttcgttaaaatactggttcaggtaaatgtctcgtcgtcccattttgtccacatgttcttcggcagtcgctcattctttgagcccaattgactggccaaaagaatacgctgcagacgaagatcgtactgaaattagggacagaccgaatattttcaatgaattatgatatataattgttcgggaaattttatttggctgttcttccccattccgacctggtaggggtccttaagacgaagccggcgccggcgcaatgcctcctggacttcgggatgcggttcgaatgcctggtcgtagaattgaagacctgcgaacggaaagactcaatgctttgacttaagagcatcggcgggctgtagcggaataccgtgactaccagggtgagcatataattttaatacagtttacatttcacgatatagaaactctgaaaatctattcctcggagagcgctggctgcaggaagaggagctgacgaatcagctcatgttggcagcgattccgcaccctcccccgaccccgcccccggaaggggatactattcctaggcgagcggtggttgtgcgacgaggaactgaccgacgagattattcgtcgtgagcaatttacgccgctgccgcaacaacaaaaagacgatggaaggaggaacggaatgagtgattgataagtgatcactttaaaaaaaattttttttaccattgattaaattttcattttcttatgcaaagcgagggtaataaaataattgaccaattaattaatgcaattgatgactaattaatacaaatgggcccaattgaatttaataaatgaccgcctcactttccctttttctgttaatttgcatataatttttcttttatccttttaatttttcaataattaaaattaaacattttttgtttttttttgaataatcatcaatcattcattgatcatatgaacccatcaacacttgtgcataccgtagtctcattggtcgggcacagtatcatctgttagccaattggtgacccatcagtcggccaaatcttttctttttacctgaagttcgctttctttccaagtggccaatttgttgtcaaaggcactcaaatcgatcacaacatcgatgttattacgaagagctaattaaaaaattaaatgatttttgttggcattttttcttggcttttcgcttcgcttactcgcataactcgtcttaatatggtcaatgccgcccaacttaacgcagtcgatgcccaactccgatcgcacgtattccttcgtgcattttcccccgtctaaccaacgacagctgaataattcttttgaaattttaaattcgaattaattaaattcacaagagaatgacgtcatcgaccgggggctgtgccatttgcacgtattcgtggaaaat

SEQ ID NO: 447 - DNA, 1603 bp, Heterodera glycines
ctgcttggccccgttgagcacttccgtcgccccttggttacgtcggcaaagtgccgagtggccaaattgaggaaattttgtgccactctgagggctctttccgtggaattgcgcaccgaaacaccgtcgacggaagggaatttgccgggaaggacgttggaagtgtcgtagaaacgggagacaatgtgaatgaaatcgggcggaccatcttcatcgtaatagaaaatgcttctgtaaatttggaaaaaggcaaaggaaaagccaaaaaaaagtggggaaaatgggagagattaaaaagcataaaatgataataaagcataataaattcgaacttcacttgtctgagcggacagatgacaatgaacggagtgtcgatggaatgggctttggtggtgaacaattggatggagttgcgtttgtcgttgaagcgtctgatgaaaacggacgaatggaacagaaacattccgatgctaccaaacaaaaccaagccggacacactcctggggagggacggtggacagtaaaaagtgccgacaaagcgaatgccaaactaatgaactaggaactaattgccctgggcaattgacgcctcaaagcgattaatttggactgattgatcagtcaaatcataaacaagtgctcatgaaatttgtgctttttctacctgaaccacaaagggtaacggctgtgcataaagcggaagccgctgatcgacgtgtaatcgcaaaaggcgtcaaagaatgagcggtgccgtggtccgtttccaatgggcccattttcgttggaattttgacacgttggactagccaatctttgaatggtctccgaaattgccaacatttgggagggaatgtgagaaaaataggcaaaaaatgagtgaagagaaatagcacaaaatggaaggaaaggcatttgaaaacggaaaatgataccttttcaatggcactgaatgtttttttttctcgcattttacgattgcaaatgtaataaattaaaagaaataattattgtaattacaatcattttgagcaaatcatgtttatttcggcggcacaatgatttttcccaatttttaaatgcattcataattaatctgttccccgttattttaataagtcacacattctctcctcctcccccattttccccttttatcccatcatttttcttttcttcatccatttttttgtcctttcttcgctaatccgtcgccttttctcccactccgatcgccccaaaactcgcgccgtttcggctcacaattcaatccgacagatttgctgtgaccaccacaccctattcagtgtacacaaaagaagaattcatacacagcagtcagtcggaattcattcacagaaatcggagcggtagggaaacaattggctgatcagccgggggtcaaagcaaaagaattggcattttgaggaaaatgcggaaaagggaagggaagggaagggaagggaaggccatttccgggcatattcattttttaattaatttttataattatttaggcaatttataatattggaggtgtttccccaatgccctcgtccatcccaccgatttgcccctttgaattggccccgcttttccttttttc

SEQ ID NO: 448 - DNA, 1620 bp, Heterodera glycines
cgaaaagggttaaacagcagaagatggaagacggaatcatgtgacggaagggggggggggtaataatgccaaaattaggaagaaaattaaattgacggaaaatgtgtctgacaacagcagcaaaatttgaatttattaaaccgtcaaaaaatcgatatttgttcatttgtcttccttctgatcactcattgctttcccaatcattcctttgtcttttcccctcttctgctgatcactcttccatttcgatcaccctctgccgagtgcccttctccgttgtgccgctttccgttgcttcctcacccctctcatccactttctccgccttcgcattcggttgggttgccacgaccggcatgggcgaacattcctttttatttcattttcttcttgttgaaaagaaaatctgaaaaacctcccatcgatggcatttgccatcatgtccatcttttggccgttcagtttcaattcggccaaacagccaacaaagttttgcgtatgaaggccaaaggtcatttcgtgaaggtccggcactccgcctaaatggccaatggtaatttttctgcgcaaatgccaaaaactgaccgacaaagacatgcccttcgacgttaagcatcgccaaaatgccgctgcttccttaatttgtaaaatgtattaaaaactatttaaactgattttggcatttaaattatcgtctcggcttacgtcccgacgttggcgcgacatcgtcaacaaaaagccatccgtcccgaccccgacgaattgcccttatctaagcaatataaatggtttagaattcaatatgaaatttccatttcactccaccgaatgcgttttgccgtcgtccaccggactttcgctgagaatttgcgccgcgccaccgcccaattcgaaggagaagctcaaatgcccgtccaacaggccaatggacaagtaatcctcgcccgtccattcgtcgtcctcttctgtgccctccgctgaattcggctggttgcccttgccaaatgatcagtccgtatgtggcagtcgtccgcactttgaactcgaccacttcctcctgctcactgctcagatggggaaactcatccgaggagaacaccttaaggggaggaaaatgccaaaaagggaaaggcaaattgacgaagaaaaggcaagcggagccattgtacggcactaattgaaggcaaagcaacaattgattgatctttaccacaaaagcactcccgtcgaattttgcggcgtattcaatgggccgaactgaaaaaataactcggagtaatttaaacgatggcaaaatgccaaaggcaattaaaacgcacattcttcgcaccgctgtcccacataatagtctcgacactcgcacatcacgtgcgtcccattcacttcttcgcattcgccgtgcgttccgcaagtgccgtcgtcgcatagtccggcgaatggtccctcaatttcgactgaataatctgccggacggggcacaaagctggacggaatgttcggctcgggagtaaccgacggatgctggcgaatcggggacaaaaagcgacggggagcgggcacaattgtggtggggtcgggagtaggggcagaagtggtggtttgaacagtttctgaagtggt

SEQ ID NO: 449 - DNA, 1285 bp, Heterodera glycines
cctcctgctcgtcgacttgctcctcatggtacgccgttggggatgggtgttgtcgttgttgttgttgtacttgtgcttctttccccctccgcacaacttcccaagttgacacccgtgtacaagtccctactcagttcggccaggcccaacacgcgcccgttcagcaacaactcttccacgcacccctcaaacggcacaatgccatccatcaacgcgtgcatttcgtcgggcacaattacgcccctcggcggcattgcccccagcagcaaaatgccatccgtccccggctcccctctcagcacgcccttcttgcgcccgtcaaccaaaatgttcattgcgttgggcgaatcgctgggctctatccgcagatggtgcgtctttttgtgtttgatgcgtttggtcagaaaatgtttgtcgaacggctgatcatcgccttagggggttaattagttaattaatgacaaatagtgagactaatcaccgtaccttccctgtgaatcacccagaatttctcctcttccattccgatggcactgatcacttttccctttgtgctgaccattgccccgaccatttgctgctgtttctgccggtccgagctcaagcgaagctcaatctgttcagtggattagcattagtcagaaaagaagccccaccgaatagggccccggggccttttggctgccctcctcgacgccgaagccaagcggaagtgccaaaaaggattgtcggccgtcaaaccgaatgccctttgtctgctgtccttcttcctcttcctccggtagttgatcagtctcagtttcacaccgagttcctttccttcccggagggcacaaacattgctcggcatttggaccgtcgtcagtagctaagacacacacgcccctgtcacacaaccgttggcctccaggacaaattccgtctgttgaaggcaattggcacaaatggccagcataaccggcaaggcaatggcactaaaagggcagagcggtacaatttatatcaaagcaattaaaaatacgaactgataattaaccattgagaaaacaaaagaaagaggtacttcgaatccccagcgtgttagctgacatttgcccccgtttcggcacggttcgttggcacattggttctcactttggtcaagtgttgccgttccgtgctgttttcccccatcaattggctgcccttcagcgctttgttctcttccttcttccccaatgtccacattttccccattgatttttaaatttcaattgagccaatgaaatttatcattttgggggaa

SEQ ID NO: 450 - DNA, 4842 bp, Heterodera glycines
ccccaatgtccacatttttccccattgatttttaaatttccaattgagccaatgaaatttatcatttgggggaagtgttttgcccgcgttgggtccattccgccgatgaaaacgcgggacgacgcattgggagggtaagcgaaacggcgatccacggggtaagagagacggaggggaggggcagaagtgccaacttgcaaagaagctgaaagagacgacggatggtataatggctaatgtcactgatcagtgccaaaaacaaatggccactcccatcgctcgtctcttaatttgcccacctttgccctgtccatcattttgcacgcgaatggttgtcggttcgttcaatggcactttgtctcggcttttaattgtttctacaattacttaattattgtttaacgttttaataacaagacatccaaccaaatcgatctccgcccaatgaaaatttataaatgacaattccattttgaagctccacgctgtgcataaacggtcgttcgtctcccgcccgtctttgatcagcagcggaagcaaaaagaataatgccattgggagactgaggacgaatctgagggaaaggggaaaacagtagattaaagagggcatgggaaagggatagggatcagctgtgtgatgtatgacaaattcagcgaatgattgggctaatagggtaattagtggattgattaatggtaaggagaggaagcgttcagctgccaaaagtgctgcttgcactagcaaaactcacttgaagctccagattcaacgcgtccagacgcattgctctctccgatggcactgccatcgccgttgtgccgctgaaatggcggaagtgcgaattttccgcgtgccatggttccgcgccttggccccgctccgtcccctccccctcttccgtctcctcctcctgaattatcttttgtcttccgaccaatgatcattcccattcttctattattaattcccttactttttcaatttcctcctcaattgtcccctttccctcctccaaatttttccctctccgctcctccgttcttagcatctgatcgggcccaaccactccaaccgctccctcccgcggcttttccctttcgacttcgatgtcaacaaattcgccaagttttagtcccggctcaatggtcgaaggcagcggcttttccgttgtgcttattgaaagtctctctgaagaaaggcaaaagacagaaaatggaattttggtggaaaatggcggcacaatcaaagcaaaagaacggcaaaggaaagaattcaaaaggatgccaaaatgcaatttccactttcaatgcaccaattcaaatgtgcaattagtaaaaaccaaccaaccaataaaccaaataaatcacttttaattaaaccgcaaattaatttgttggcttacagcaaattaaatcaaaaagttatttattgaagcgaaacctttacttttttgtggtaaatgacaatgacaaggaaacagagagagagagagagagaaaaagaaagaaaaaagtgggcgaatgaatgaatcactggggtggcagtgcgaaaagaaagcgcgtccatcaggtaattgtcaatttgttaattgggtaattaacgagaactaattaattaaaaaaacaaaatctatttaataatttgagagaataaagagaaaagtttatggaaaatgcaaaatgaagtggcggggtggagaagtgacaaatgaaagatacggtaatcagcaaatgttacggtggtggtaattgatcagagacaaacgattatcgattgattacatgatatggcagcattggagcgatcgcattttacactgattttactgttgaacaccctcagaaccaagacccgaacagtctggcacggtgcagcgccgcaggcggtgcgtcgttgcggatttcgtaatggtggtaatacttttggaactgagtgcggccatttcggtacctaaaccagtgtttgtttgtccatcacaggttcgttcgttagtctgttcgggactctcgctttttgctaattgtaagattttaatgaccattcgcttgaactgcgcatacagtagtctcgtacagtatacactacagtcccctcgttcgtccgtccactgaccgttccgccctcctccgcaagttttccttgcgcacttccgcgatgctcttcttccgcttgtgctgtgcgtgttccgtcctcttccgcttccgctgcttctttttgccctcctcctcttcctctttgtgctgtgttctcttccggtgactcgtcgccctgcgtctctgctgtctcagccgcctcagtcggcgcatccgttgaggatggtccggctcgggtcgtccgatctctaccgcttggacagtgtccgcgtcgctctccgccgcgctttgcccttccgccaaagtgtactgcggccccttctcttcctcttccgcttcttcttccgccggtgttccatcctcctcctcctgttccgtcttttgctgctgcttctgttgatggaagctgcgccgccgcttttccgcctccgtctcttcgccgccttccacgttcaaaagtgccgacgtctccaacactccgtctttcgtctgcgcttggcaccgatatcggcccgtgtgttcaacagaaatggaagtgaagaggaggcgattggcggtgacctgtagggtaattaattagtggagtgccgtgccatttgtggccaaacgcccacttgggcattcgctggcaacgcgtccccgtccttggagaagtttacacgtgcactcgggtctccgatgaccacacagtccaaccacgcctggtcaccaacttggaccgactcggaggaaacattcagcaacactttgataattgtgtcgggcactgaacccaattagcatttaaaaattattcaaattctaatggcaccgaccaaatattttggcattcacaaagccggacacactgctctgtccgtggtgaactgtgcagcgataaatgcccgcggttgagtcgtcgaatttctcgattcttcaatggcaaagtaatcattaatttgaacagatattcgaaatttgaatttttacagcagtttgtcgcccgattggttcgaattctccggcaacgactcgccattctcgcgctgccaatcgacggtggagccgggcacaacaaagacgggacagttcagcaccgcctgcgaatcaccgtcgaactttgcttcaactgcatctaaacgtacggtaggttacgatatggttcaaatagttaaaataatgaagaaacaaaatgttagcaaatcacgaaaaacagacaaaggacatttgcttgaagcatttttttgtttcttttctcatttctgtctatctcactctctctcttttctctctccttttcttcctctctctagtttctctctctctcccattatattactcgcccttttgcctcttccgactctccgtttttctcccaatctttaaactgactgttttccgagtcaaatccgacagaaactgccgcctgtgcctgtccgaccgtctcgccgtcctcgctctccacttcgcaccggtaaatgccgtaatcgttgctcggatccgccgacttgaccagcagctgactttgcctgcccaactcacggatcagtgctccgccacgcgcgagtgaccaggaataagtgaactcatccgcagaacggcctaaggcattcgcgtgcaaatggcattttgtgagggcccattactatggaaatcccctcaaaagcacaaggaaaatgggaaaacgcaaaaaaggatacaaaaggattgtggataagcattggcataattctgtccatccatttgttagagcaaaagcaaaaaataaacgaacaaaagaagcaacagaaaaaagccaaaggcatcaaaataaggtaaccccgtcgcaaaacgataagataaatggcacggctgagcatcactgtgccgttctccaccttcgcctggacggtgtaaatgccggattgggaaggtcgaacattttggagatgaagcaacggaataaggcaccagcggaggggcgaaagacggagcggaagatcaccccaaagccaagtgaaggagatcaaaggacgacgatgggaagggaaagtgccgaggggcactgggaggaaaagccaaagtcaaaaaaccaaggtgggataaagcaaatgaggaaaagcatttttgaagggagggaaagggagggacaaaaagtcgttgtcatttttaggaaaacggacatttgggacttccggtcattttccatcaccaataaaagaaaaaccattattaaatgtccgtaagcacttgaacaaaaatgcatttcattaaaaaaccaaaatcactttaataagcaaaattattactgctaattatccccttaattgcctcgtaatttcccaatcattgctcgctgttttcctcccactacaaactgaccgtgcaccacacagtccaacacaattgagtcgcccgcgttcaccatgcgcacttgcggcggtgaaatgtccacgtgcaaaaggtcgggccgcgtgtcgccctcggggtgcacttccactttgctggtggcgatcacttcctcgttacggtacgcgttgcactcgtactcacccgcgtgatcagcaggctgaacaaaagcacccgatcacttttgagaaatagtaaatggttggcccaattaattaattatcctaattaaccaaccaacatcacccttcaattattcattcccgcgacagttttactttgaacgggtcgaatcggagcaccccgcggtgttcctcgtcgctggcatccgaaggcaacgcgtccccgccggccctcttccactcgacgcgttcaacca

SEQ ID NO: 451 - DNA, 2858 bp, Heterodera glycines
  misc_feature (33)..(33): n is a, c, g, or t
accgttgtcattcccgacggttcgatcactttntggcaattatcacagtaatttgaaaacttagctgaactcgatcggtaccttcaatgcaaattcccttagtgacggaggcgaagtcattgctggcccggcaagtgtaacagccggaattgccgaggccaatgctcggatggcgcaggaactgctcggagatggtgattggcacgtagtcatcgggaaggtcgccacgttcggggcccgggtcactttaatttgacgataatcggccaaatttgcaaatttccctcccccaccgtgaagaaaaaactcactgaagccattctacgtccggatccggctcaccctccgcttcgcatttgatctccaacggttcgccgacaatcatcttcagccgggcaggcgcgggtttttcctccttgataatgttgataccaatggacggaccgatctcgactttgccgctgtccgatgcttcgcccagcggattggtggcagtgcaagtctggcaattgaggacaaaggattgttgactacattgattggatggcaatcaagaattggatggaatggctagaggattaatcaaaggaacagactgatcagattccttccttcccccatttgccagttttaaatgttgtgccatcccccccccctttacatattctccgtcgtgcagttccttcttggcgtctttgatctccaacactccgtcccccaagtcgacaacatcctccggtaattcgtccccatttggtccgctccactgaattaattgtccgcttttcgctcactttgctctcctaattgctcactttaatcgatgggtgtgggttgcccgtcacgtaacatttgaactgtttcgattcgccgggttggccgttccacactttcggctcgacacgtgctgtcggtggctcttcctctgaatattttaattaacaaataaactaaaatatttagtgaatgggaggggggggggagtgaattgaatgacagaaaatgcgtcggtgattttccggaagccgtgtgttctcctactctccccaatttcgtgcacagtttccagtatcagtaagtattaattacgatcattaacccattcattacccccaccctccgcgctgtccccgtccctaccgtccgttatgtccaatttgaccgggtcggcgtgtccccgtccgaacttgttggtcgccgtgcagtggtactcgccaatggtggcctcgtccgctgctgcaatcagaatgtcctccccgtccacgctgactccgctgggcaatgctccgttgggcgactcaaagcctttgaaaaaagccaccgaatgaatcgcgccctttttaggcccaacttcagcagctcactcaccccaatggatttgcgcgggtgttttgctgttcggctcgcaatgaaaccgcgcagggtctccgcggggaacagtttgctgcgggggcgtggccacggggcggggcggctcgccaggttttcgcgccagcggaccgaccggtggtggactaacgtatattcgagcgggctcggacaccttttgcataacaaatggtttttgggtaaatgccttattatggcaatgaatgcttcatccgcccctctttccttccctttgcgcttttcttccacttttcttacctgtggtcctcggcttggctctcgtggttcgtaaatacattcgtaatctccctggtgatgcggcagcgtctgcgcaatgttcagattgcctctcccatcatcgacggcacccgaaggcaacggccttcccccgcgggcggtccagcgtagagtcgcgcgtggctcatccggaacccaacagtgaatgcgcgatgggtgtccctgctgcacggtttgctcagtcggctcaaccaatggtctctttgacgcttgaaatcaatgtaatgattatctaactgattaattaattaattatgctaatgacccacgttcattgacgtcaagtcgaacaggcggcgactgaaggacctgtcccgtctccgggtcaatcgacgagcaaatgtatgagtcggcatgttcacgtgccaccgcatcgaacaacaaatgtccgcttctgtccactgcgcccgatggaagcgacccgccgcgggccggcgcccaactcaaatgggcgtttggctcgcccggcacccaacagcggaagcgcgccggctgaccgaggtcaacgcgttggtagggaggctcaacttggggcggatttcgagcacgagcgggtggtggtggtgaaggacgacggacatcgagctgaggagcaacatcatataaaaacaaatcactgagataattgttcggtactgacccggactggcgtcgagtcgaccgtccgttcttcgcgcgggtcgtcgtgcgggtcataggctgtgcaaatataatcgccggcatgccgaagctctgcccgtgggatgttgagcagtgcaccgttgtgctgctcctccaccccgctgggcagcatttcgtcgagtgccggtcgccatttgagcaccgcctgcggataccccggcacccaacagcggtaaggacgtggcaggggatgttcctcgtccacaatttggtagggcggctccactagcacttggaaaggcttcttcggccgtagcttcagccgcacattgtccgagtcgacaggtcgacttccgatcgggtcgcggctcgggtcgtaagccgcgcaaacgtactgacccgggtggtgctgggacacgctggggaagtccaagtaaccgccgctctgattcgcgcccgagggcagtgggccaccgtgcgagggtcgccaagtgagcaccgccccgggcactccgggcacccaacaacggaaacgggccggactgcctaag

SEQ ID NO: 452 - DNA, 5977 bp, Heterodera glycines
attatcagccaaataatcatgtgaaatcccgaaaaaagcactttcaatatggaataaaccataaagcttatgctcattaaggaaaggaaaagtcctccagctaacatagaggataccaacggataacacgttgggtttgccaattgttccatgcataaatagcattcgatgagtacacactcatcgactgctggacataaaatgtcctttttaaacatgtgctttgaatccatccaaaaatgaccttgacattgatagtcattcaggaggatttcctttggcaattcatatgtgagtttgtgtacattctcatgaatgtaacaattctccgagcagcaaagttccactttccgaatttctttcggaatctttgccaaaacacctttgtttgagcaaatgagtttacactcattgcattgatttgttggataggctcctgccaatccaaaaatgcagaaaatagtgagacagttaagaactgtcatcacttttgctttgctgcgagtaatcattccatgtttgttttggttggcttttggttcaaccaaatgagaatttttgtcctcatttttctcctcctcatttggcaatttattttccaaatgaagaattgttttttctgttgaactgtttgcagtttcgtctttgataaccttcaaattttctttgccatcttcggtaggattttcaaatcctacctctaatggaaaaattttgttgactggtcgtgtaataacgactttccgaggcatggttccatacctctttgatttaatgccatgaattggcatttccaattgaacgcttctaatggcacctggtttaccattgagctcaattatttttcccaaagtccactgattccgaggagtgaattcctcatgaatcaggactatcattccttcttttggctctcctttgtcttggagatgagtacctttatgatcccacttagacctttctctaagaaggagaaggtactcattatgccatttattccagaagctttcatgggcttctctggttgctttaaataaagcagccaatttctccgaggatgaaatttgcttatcgttgggatcggtttcttccgtcgttgtctcccaatttatctgtaaatcgggttgaagtaagtcgatggggcggagtggctgaatgccatacgctccctctgataccacagtgattggccgatggttgagagtagcctcaacttcggccacaaaagtgttaagctcatcgtaattgaggatttttctccccaatgtccgtttaaagcaatttttgcataattgcacgaggcgttcgtaaacgccacctgcccatggactaatttgagcaataaatttccacttaatcttattaagtgcaagaaattcatttttgttttgctcaactccctttggagttgtcaattgctcaatcgttttttgagataatttaaatgaagtggcattgtcactccaaatgaaatctggtttccccctccgactaatgaatcgtcggaggacatttaagaaagattcggccgttctgtcaagcatggcttctaagtaaactgctctcgttgtgaggcaagttactataataatccatgctttgaccttctctcctgccaatcgtgtctctgttggccccaaaaagtcaatgcccattgacttaaagggcatttgtcggcagactcgttcctccggcagtggacgcatttttggtaaggcaaattgatatgccttcatccttcggcatcgacggcagttttttataactctttttactgccgttcgagactgaggagtccaataaatgttgagaaattccgtaatggtgctgtccacccctaggtgatgtcgtttctggtgacattgcaaaatgataagatcccggatttccgagttctttccaagaagtatgggatgtgaaaacccataaggttgatcactccttgccaatctcgttttcagtctcagaatcccttcactatcgattagtgagggaaattttgtgaattcatctggatcattcaattgatccaaacgaattataaggtattcagctagcagaacatcttctgctgtgaatgctctgtttttagaaatcttgacgatttccttccggtgcctttttgtgagctctgaagggtctcttccatttaataatttcaaatggagaaggtattacaaagataactgtccggaccaacttggtccaggaatggtgtctctttgcattaaataattgctgttttggctctgcacatgtatgagccaaaaatactttttcatcttccttcggtggatcatataactcttcctcttttatatcaaagaagagttcatgaggccaacaattttggtcctttgtgagccaattgggcccattccaccacgaagaattggttgagagctcttctggtgttgctcctcgtgttgccagatcagctgggttttcagctgttcgaacgaagtgaaacgaacacttcgttatgctgcgaatttctttgattcgccgttcaatgaattttggttggacttcttttgaagccacccaatttaaggcaatttgtgaatcactccacaaataggaatgttcaattgctcgacgcaattgagtttgtataaattttaagcctcggattccaataagaatggccatcagctccattcttggaatagtgagtgctttcgaagcgctctttggcttaaggcgattttttgagaaaatcagccaattttgaattttgtttgaactctccactcggagataaattgcagttgcaaatgtgtggatcgaagcatccacaaatgcatgcaattgaagggagcattcgccctttaccattgtccttcgtggaactcggattcgcttgtctttccaagaatcttggaaagcactccagcgagtcgagtcctcttctgagagggcatcatcccagcctttcttttcctcccataagctttggaagaaaagttttaaaggctggatgcatgggctcatcaatcccaaaggatcgaataaagaggccaaaaaacttaggacgagacgtcgattcactatctttaatgaatcgacagatgggaattcaaagacgatttcgtcttgatcaatgtcccaaataagtcccagcactttcactttagctttctcgagtcgatcctccggagggatggcttccatcacctccttggaatttgtaataaattcccgaaggttgaaacagccttctttaaggatagccttcgcttccttatattttgttaatgcttcctctggagtttcacactccatgagcgcattatccacgtatagcgattcggctaattccttagccaaaatcgaacgacaattttttagatgatattgtagagtagctgctaggatgaaaggtgaactgatcacaccaaatgcgactcggcagaatctgtatatgatcagattatccgacgaaagtggcttttccatgtctttgagccacaaaaacttagtgacttctctatcctctggttccaaggaaatctgcaagaaagcagcttggatatccgcgagaagaggaaatgcagggcatcggaatcgcaagagcattccgatgagatcaggtaaaagtaccggacctctgtacaaacagtcattcaaactgtttgtctcccttgtgtgagcactcgcatcgtaaacgacgcgtagttttttgcccttagccaacactccttgatgcggaatgtagtgctcaagagtgccaggcgcttccctggcctcttcaatgatgccttttgatagttggtcgtggattgtgttgttatattgttgtagaagttcaggagaatgtctgagcttattcaaagtcgacattaaccttgagaaggccattctgtaattggaaggaagatttggtgtctcttccttccacggccatttaactgaatatcgtccgccgttttcacgacggattgatttgtcaaacagctgtattgctgtttgatcatcatcttcgttagggtcttcctttatccctaatgattccaaattaaagaaatattcaatttctttagtagctggcatctgcttttgattggactcgtcaatggtcatcattgacaatcctggattttgaacttttggtccgaagtctgattctccattgactagagggcccagagttgtttgaatgacaaacaacccaggcaaaacttcctttttgctttggaaaaatttccaaaagtgtcgagcacttatcagaatctcaggctcgtcttcggagagggtcagagcttggaaaacatcctgctcttccgttataatcatttgagttccactccaccattttgaatggagtggaaatttgctcggttcgattgaggaggatttcctcccacttattgtcactccgttgaatttgaacggagtagacaggtgaatggaaccgtattggtccattcctttcaccaccgaaaccgtagacttccatctcttctgaagttactttatgtggcttcagtttttcgattaggcggtcagacatatatgatgtctggctcgctgggcaaaaagaaacatagctttgatcatccgccgagggtcacgacttgacctgaccctcaatcgtcgtgtcatcaaaaacgcatgtgacttctttgtcacaacgtttgttaaaacatttgttgttccgtcagaaattgctatttcagacggtttctcccttattcttaagggttcgtttgttgtcgaaaaatgattttgtgttggacgaggtggttctcgtatgttggaggactgtttcttttgaacagtccctcctttggtcgtatgtttaggagtgcttcctctcggagcgtctccctcagaatagcaaatcatgaagtggtgtttttcaccacattttgggcacctctttgatgagctgcattgtgcattgttgagaattgtgcccttgcataaggcaaaaaacatcgttgttgatctgcaagccgccttctgcgtgctccaggtgttggatattttggacacttgcttggtgcgtgtcccatgtcactacaaagagaacaaagtgggttcgttcctcgttctcgaggagaaaagtgtgtttgttccctctgattgacagtgttaaatgatctgtttatttggggagacatcatccccacagactcatttctgttattgggtcgccaatgaccctgacgaaattggttgggagggaaatttgttcctctcccttggaaattgttcctctgcatttgaggaggaaaatttcggggtttttcttccccacggaagacttgtgtacatctttgtacttcttccttcacttcaacaatggaagtgattgccttgcgtaggtcggaacaatcaaatgttccacctgaacgcatttccttctccaccacttgagtgaggagatggtatggcaatttggattttatcgtggaggccatgaacttattttgttcattttctccaaaatctgacaactgctgacaaatcctttcaatggactctgagaactgcctcagagattgaaccgaatctgacggttttgaaagatggagcaactctgattggagtgtctccacaattgacttctcatccccaaatcttttcttgaggatttctaccactcgcgggtagttttcatttgaaggcgggtacaaatcaattgctcttcgagcaactgacttctcgggaagacatcccaagagataaatgtgttttttgaagttttcaatttgaagactttcaactgaagtctcaaacagcttccaaaataaaggccattctcggggttcacccgaaaattttggaagcgaaatgggcggcaacatcacttcatgtcgctgcggagccacaaccacttgtggctgaatgttttgaacaggctgttggacctgtgcagggtgaacgacatcgtccccctgttctgagaggcctaaagccccatcaatggtgtcgacaagccctcgggcttggtcggccccatttcatgaag

SEQ ID NO: 453 - DNA, 4685 bp, Heterodera glycines
aaatctgacactgctgacaatcctttcaatggactctgagaactgcctcagagattgaaccgaatctgacggttttggaagatggagcaactctgattggagtgtctccacaattgacttctcatccccaaatcttttcttgaggatttctaccactcgcgggtagttttcatctgaaggcgggtacaaatcaattgctctacgagcaactgacttctcgggaagacatcccaagagataaatgtgttttttgaagtcttcaatttgaagactttcaactgaagtctcaaacaacttccaaaacaaaggccattctcagggctcacccgagaactttggaagggaaatgggcggcagcatcacttcatggcgctgcggagccacaacaacttgtggctgaatgttttgagcaggttgttgaacctgagcagggtgaacgacatcgtccccttgctctgagaggcctaaagccccatcaatggtatcgacaagccctcgggcttggtcggcccattccatgaaggcttttccttcaggtttgtagtccttgtagttctgctcttcctcctgaagagcatgacctttaactcggtggaagactgcctcccacttgtcattgtttttctccaacaatgacactgctctacagagattttgtctctctgcgagcaaatctgttttgatttcctcagtcaaatcttttgtcagattttcctgagccgtctcaatgtacaacttgagacgcttcacaatcggcgcgattgtgattcgcaagagttcactcatctcttacgaatgttggacaagctttattcaaagcttggacttctctcattgagggggtaagctacgactggagcttgacccctatggggctccaatttttgtcgcggaatggacaaaaaatcactggaaaggaaatctttccctctaagggaattctttcctttccctgtccgacggggacagtgttgaaaaaatgcaagtgatgatttcagtgcccaaatgtggacactgaaactgagagttctctttaaccctcttaatgacccaacgggggtcaatttaatggtctgtatgaaagggctcctgaatgtcccctttacagattgagagaagagcttttctcttactctttattcgattaaacaaatataattctgtgctgagcagaagaagtgaagagaatgaaaatggggcgggcttttataccctcacaaatcaatggggcggaggaaatcacgtgaacaaatgtgcatacaaaaaatcgatcgatggatgattcatagggaaaatgaatgaagggggaaaaggatgactcataatagaagcgaccgagagcaaattgatcgacaaattaatgaacaaaaaactaattaaatggtgaatgaattttatgtcgctttccgcgacaacaattattaaacttttgaacacagattttgtctacattgatttgtatgaattaatatttttttattttgatcaattatttttttaaaacttttttatgatatattgattttttaaatcttttaataggtaggtatttttctttatctttttccaacgctgtaaaaattctgttcatgttttttttcctattaaatttattccgaaataaaaattaccctcccccgttttcatttgcattgttttttacttgaatttgtttaattattgaaaaaaaacttttttatcaaaatttaaaaaaattatcgactacttatcaaaataaatatatttaagaaacctttttataattattaatgttaaacttttgcttgattaaatttcacaacttttaaccaattagtcattattctttttttaaaagcaaagattaaataataatttaggattttattattcaattcttttttgaatttccaacaaaccccttacaaaatatgtataatttgttttttcttttcttgctgaatcttggggttaaaaaataataatatttgtatttcaaaaaaaattttttttttaatgttgttcgcaattgtttatgttctattttttgtcattttactatttttatagaaaaataaatgattttatggaaattacgctggttgtaaaatttctatttttctgtgtaaatttgaaattataaattgattattttgttttatttagtttgaactataaattgactttatattccatatatttatttgatttttttttcaaaattaatgcataaaattatagaaaattgtttatatgtaagaatgtcattctattaaatttcttaatgttgactaaatgtttatatttttctttattttctcattaatattcccttgttgtctgctgcaggcgttttcccgttctgcgtgtttgagaccttttattattcttcaatagtttattttccattttaatgtcataatttaaaaaattaactcgccaaaatacgaaaaaactcataaatttttttcaaaaattaattttattacaccatatttgaaaatttatttgttcaatttatttttttaacagaatccatcgaaaacattattgtctttctggtctatagtaatttatataagttcatgtaattttattttaatgcatttggtaaaaacaactaatcaagtataagtaattacttaattgtctgatatttttcaaaatagaattaatataaggaaattcttttaaattactttttataaattcaaattttcaaaataaatattcgatttttaagtttcaaaaataatcactacaatttgcatttgcatttaatttaattttttaagaaattaattaatttaaacttggattttaatcatcaaataggtaggttagtttaatttttcaattaaaataatggtttttaattttaaatattacttgttattctacaaaatttaatttcatttgctggaattttaatttattaatatttgaattagattacataattcatcatttaaaaataaattaattttaaattccaactatagaagttttgaattaatttataggtctattaaataatttttataataaaaatttaaaaagttaatagaaatgtgattttttggcgttgcattctttttttttgaccttacatgaaatgaagttttagtgaaatactagcgtggtcagcgccttcggcgcatcccccgcaaggcagtacgattgtgttatagaattaagaatgataaaatcgactggctcggccgcttcgcggcctcgcatcattttcttggctttttctccaatctctgggactcaacccaccagcatttcaatctctgagactcaattctcaggctttccaatcgctgggactcaacccaccagcaattcaatctctgggactcaatctccggcattccaaacaatgggactcaaatctccggcattccaaacactgggactcaaaacaccaactttcaatgacattccaatctctgggactcaacccaccagcatttcaatctctgagctcaattctcaggctttccaatcgctgggactcaacccaccagcaattcaatctctgggactcaatctccggcattccaaacaatgggactcaaatctccggcattccaaacactgggactcaaaacaccaactttcaatgacattccaatctctgggactcaacccaccagcatttcaatccctgggactcaaatctccggccttccaaacaatgggactcaaatctccggcattctaaacactgggactcaacacaccaactttcaatgacattccaatctctgggactcaacccaccagcatttcaatccctgggactcaaatctccggcattctaaacactgggactcaaatctccggcattctaaacactgggactcaacccaccaactttcaatgacattccaaacgctgagactcaacccaccagcatttcaatctctgggactcgaatctccgacatttaaatttcgagtttagtcatcaaataggtaggtttgtttaatttatttaattatttttgcttgaatatttaaataaacgtctaaattaattttcatattgttttcaaccttgtagatttatccaaatattcaagaatttgttttcagacgtgaatgcttgctattatgagattttaaatatcaatttcaatcaattcaattaaaataatggtttttagttttaaatattacttgttattataccaatatttaatttagatattatatcaagcgttgaaatataattttttaaatcttgtttgctgcatgaggattatggtgaagagcaccattcgtttttgctttttatgctggactatttttttcgagaaagtaaactgttatgccggccgatggcaaacaaacaatcaatatttatttgagcagaaaggaaaagaagacacaaatttggggaggaacatttaaataacaaaagagggaaaataacacaaataaatgaactgaactgggagggtcaacatcgcgggtatttaaaggcctcttttctgctgatcacacatccggcacgccatggttcatctcccaagctggcgatcacattctctccaacggcgaagttttgcttcttaccacggccgtcttttctgaagaatttcttctctttcttctggagcactccgttcactttggctgtctcagttcggaactttgaggcagaacattcctgatggagtccgacaatcccagtct

SEQ ID NO: 454 - DNA, 5381 bp, Heterodera glycines
  misc_feature (5210)..(5210): n is a, c, g, or t
tctgtccatcatgtccattccgagtaagttctttgatccgtctttggaaacaaagaaatgcccaaacgctgaatgttctccaaacgaaaatgcagcttttcctttgccaacaaatggacgtgttgtcccatcgtggtacagagcacgttcttcacaacggctcaatttcaaagctccgattttgcgcaccgtgtcctcatgaagaacagttccttcggtgccgaaatcagcaatgaattccactttggtgccattcacatcaatcggaacatcgatcattccattcttcctctggttttcgcccttaaccaggaaaatttttccaacgcggacgttgttcaccgctttttccttctttcctccattcttctttaaccatgcctggtgcttggcacacatcctttccaagtggccattcttcttgcactttcggcaaaccgtttcttggtgtcggcatttcctcgacgaatggttccaaccgcatcgccaacattcgcgttgcgatcgatttctgcgccgtgtccctgtcgaaatgatgctcgcattcgacgaatggtccgagttcttcctcttcttttggcccttcaattttgctgtcaacaaaagcttcgaaatgtgtggctgctccaatgccttggcttcggcgatggtcgacatgtagatcttcaggtcgtctaccacaccgtcatacttgacagtgtcaccatccgctgccaacttggccaaaattcgtgaccgtagagtagcattcttcggcgatttcaaagaaattagcaaaaccatacagttgaataacagcttcaccttcaactcgtcctgaaggttcggcgttgcacagtcaagaacgaacataaatcgcttgagccagtcctcaatttcacagccactatgctgactagcatcaaaacattccacgtccgggagtgttggcaattgtgaggcgttctgtgccggtggcgtgttttgctgttgagcagccaacaactgctgcaaaatatccgtcaatcgttggattgctgcgtctcccatttttgtcgttcaccactctattgctaacagcgcctagcttgttaacagtgggtgcgcgtggatgaactgaaaagtgtcgccaatacacaaaatcagcagcgcaaattttttactactaacagtgcctaactgttagcaggtccaacaaaaatgttgtttattatcgcctagataataaacaaatgcagtccagcagcgatgactcagcaaattcgattgctgttgacctctccatccaatcaagagtcctaagttcaatatttatttggagcagaaaggaaacgaagacacaaatttggggaggaatatttaaataacaaaagaaggaaaataacacaaataaatgaactgaactgggagggtcaacatcgcgggtatttatgagcggaaaaaggggcgtaacataccaagggaaaagggaaatacaataaagcaaagggtcaaaatgggtaccggccaattgggtcccaaccctaacataaacatcataattttcctttccattattatattaaaaacataattaatttgtaattttgcctttcttagcacactactaatttttgataaatttgtatacaaaattcatttttaaattaataaataaaattttttataaattcaaacaaatgattaaaatacgaattattcacctttcttcctttgactgaatcggtttggaatgaagcatgcctctgctgaatttttcttgggtttatataggtatggaaaaatttaataattttgaatattggtactttatttgctttaattaattatgctaaaagagatgaaatatatatattgtgagttcgattgagctgccataagcacctgagaatagagaacaaatgaattttgtaaattaatgcctttattttctcttatcaacgatgcgttttcacccgctttttgatgaaatttataattttattaaataagatatttgtttaataatttattcgttttgatatattatttttaaagtatattggtagaaaaaatatattttttcttttattgggttttgtcttatatttgtaaaacaaaattatttatgttattttgtttttatttttttaatattctcatgtcccaagtaatcgtaaacttggtcttgtacgacggcttcttttactttttgatgtacggcttcttttttcaatagttacatttttattttattttatattttgcaatcaatttttgaaaagtggaaaaatcaaagcaaatcaatgccataaaagggatttggatttcataattttttttcaaatgccaccaaagggtggccaaattgcatccctaacaatttcaaataagtaatttgtttttaaataattttactttttgatttatttttagtaaaaaaatttattatcaaatcccggaaataatttcaaaattaatcttttggagtgattgaaatgatttaatttgttttatataaataacttcgaaaatttacaaaattttcgtttttgttcactagaaaatgtatttctgttttattttttatttttacatttattttttacttttattattttaggtttgtaatatcgcttttttatttacttttaaactcatgttttttgactgcttacctggacaaacagttgaaaatcgcaatttttaataatttatgtaattttatatttatttttgatttaaggatttttaaattatcatcttaaaagttctcattcggtcactaaaatctgggtattatttataaaaaataaaatatatttttataattattttctatcaaaaatggttgtttcaaaaatgaattatagcagaattgttttttcccatatattaatattttaaaaataactgacaatttccgatcattttttttattatttttatttttgctttaatgattatttaaaaatttatttaagagtttattactttaaaaagtaataatttacgatgatttacaaatacaataaacatttttttatatcactttttgttcaatttttcacgttctgttaactctgatgaacagtggaaaaatcgaaacaaatcaataccagaaaagaatttcataaattttgttttttgtccaataaaatagttattgtatgtatttaaattcgaaatcctccttataaatggtacaaatttttgagaaaccctttcaaaattaaaaaaaatttcagattataattaggtacttttccaattttacgggtaaatcagtaaaataaccgaatttgagtatggactttgaaataaaagcgaataaatctgaatgaaacttcataagaaaagcattttatttttatttgacaaaaatttaaattgcccaaggcaaattattttttcttacaataaaaagatagcccaacaaataataagcttattttaattaaattaaccaatttaaattttaaaataataataataattattagacaacaacaaaaaaaaaaaagaaaaattcaataaattctataaaaaactcaaaaaaaagatttaaatataaaaatcagttaaagttaaattcatcaattgaatggagctaattttaatcttcctcgatgatgagtaccggacatgaatttaaatttcttaatcaattattttcatgaaattgctaccaaaaacaacaataaataatattattacaaaaaatggcatcgaacaggaaaaccaaaattcaaaaacaaaaacgagagaataatgccaaaaaagcaaataaaatgaaatttggcaattatttttattagcttaagtttaaatataaattatttaatcaaaatgaaaaagaggaataacaaaatcaaaatttgtgttagatatttactaattaaaaaaaatattttttaaaagttgaaatagtcagacatatccttaaaaaaacaatcaaatgaagaattgcatataataaaataatttaaaatgcatttactataatttataatatttcattccaataaattagcaatttaattaaatacaattaatacgggttatttacttaattcaatattaaaaaataaattatcccgaaaaacaaaatggcaattaaaaataaaagcaattttataaaaaactgaaaaaatatagtaataatattttatatttcttatttgtttctttgtataccaatatcaaaaactagatataaagacaaaaatttaaaatagcttcattaaattaaaatacttatgagctataataaaattaaattatattaaaatattaattacatatacagaaaaatataaaacatgaaaaaaattaaatgcgctaaaaaatcctagttttggtaattttatcataagcacaatatatttaaaaaactgtactattaacagaaataaaataaaaacggtataatgaaagaaatcattatcaattgttcttcctaaatggcgaattcatccctttgacaacggaaaaggaagttcagccatgaattaattaaaagaagagaaaaaataataaaattattaaacaattacaaataagcaatgcaatgaaaaataatattttgtataaaataaaataaaatgcaataaataaatattcaaagtaacaaaattatgaataaaaatggaagcaaaatattatcaaacaaacaaaaaatagtaaatataaaataaataaatttatactgaaaaaataattaaattattaaacataattattatatttttgaagttactttgaaaataaatatgaaaatgtgatcattgtttcgcatgtaaataccttttataatagattttatttaagaggatatgtattttaaatatcatcttctatttttttttttgattttgtgaaattctctaaatttaaaacaactttttaaaatatttaaaactaaccaaaattggtaatatcgtaaaattgatgtacataaaaataaaaacatataacaaaaatcaaaaaattcaaaatgaaaaataatctgataaaaagattaaatattgtctgaataagatataaagaaaaatttaattaaatggaaaattcattggcaccaaaccagagttgccacccgaatcccgaaactcgaattccgacatttttctcgacccgaaacccgaatcctaaccagatgcttctgctgggtcgtgattcgggacaaaataagaatgtatattaaaatttttgtgaaacaattgtgttcaattaaatcaattattatctgngctcgtaatgtgatttagttttattatcatgttgtctcgtctatcttttattcatttctttgtgctttaaaaattattttttagatcacatagaaattttaataataatttatgaatttctttaattgaaatttttttcaaataaatacttagttttatttgcacaaaaat

SEQ ID NO: 455 - DNA, 864 bp, Heterodera glycines
caagtgtccgtttggggtactcaaacaactatggggagcaaaaatccaacgcagaattaaagtacaggctatagggaaggtattcccgaaggattcggtctccccataaatctgggcgcatcggttcagggtactgccccgaaatccaaaaaaaaattttttttggataaaaattatttaaatgaactgactagataatatttaaaataggttatttctcttcctttcagtatccctgctaagtttggtgcgcttctgatcagtttctgaaaagaaagttaagcctaaactttttggcctgtttaaaaaggaattaaaaattttttaaaatttattcatctccctttttgatagaaaaagcatcagagtgcctaaactaacatgtaaataaaatttggtgcgtttcagagcattttctgaaaaaaaatatttatgaattaataccacaccagcattatttttttttaattatttttttcattttatcacccaacgttctagactgatcagaagctcaccaaattttgcagggaaactgctgagaacccttcaaatgcttataaattttcttagaattttttgcctggaggaacacaacaccacccgaatcccgaaactcgaattccgacatttttctcgacccgaaacccgaatcctaaccagatgcttctgctgggtcgtgattcgggacaaaataagaatgtatattaaaatttttgtgaaacaattgtgttaaataaatcaattattatctgggctcgtaatgtgttgatttatcatcattttgctgatttcaagaagtctatgtgattttttttttgataatgatttgtgatttttgagaaaatttgctgatttttgttg

SEQ ID NO: 456 - DNA, 1069 bp, Heterodera glycines
tgtttgaggatgtctggctataacatagacttaatgtacctttatccaaacaaggtgcagaaaaaagtaaaatatttgattaaaacattttcatcctatttattcaacgctctagatataaaaaagattatttgttaacaaaaactaggaatatcagccttttaagtgatatggaaaagtttgctagtagtgaaaacagtggaatataaaaaaattatcgtaattttaagcaaaaaattaaagatgagcccaggggcataattgagaaaaattgaaatgttgaggggatttaagcaacaacgtgtaaatgttatgaatgataattaaccacattgcatgcgattaaacactgtggagtaattagagttatttttttaaatgtctttctaaattttgactatttaatataccggcaaaaggaataacaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataaaagaaaaattgaaatgttgaggggatttaagcaacaacgtgataatgttatgaatgataattaaccacattgcatgcgattaaacactgtggagtaattagagttatttttttaaatgtctttctaaattttgactatttaatataccggcaaaaggaataacaaatttgaagatatcaaatttgtttgaggatgctggctataacatagacttaatgtaactgctccaaaacaaggtgcagaaaaaagtaaaatatttgattaaaaccattttcatcctatttatttcaacgctctagaaataaaaaaaattattttgttaacaaaaactaaagaatacacccttttaagtggatatggaaa

SEQ ID NO: 457 - DNA, 7699 bp, Heterodera glycines
aatttgaagatatcaaatttgtttgaggatgctggctataccatagacttaatgtacttgctccaaaacaaggtgcagaaaaaagtaaaatattgattaaacccattttcatcctatttattcactgatgcggagacgaaaaaattgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgagggggtttaagcaacaacgtgttaatgttatgaatgataattaaccacattgcatacgattaaacactgtggagtaattagagttatttttttaaatgtctttctaaattttgactatttaatatacaggcaaaaggaataaaaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgaggggatttaagcaacaacgtgataatgttatgaatgataattaaccacattgcatgcgattaaacactgtggagtaattagagttatttttttaaatgtctttctaaattttgactatttaatataccggcaaaaggaataacaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgaggggatttaagcaacaacgtgataatgttatgaatgataattaaccacattgcatgcgattaaacactgtggagtaattagagttatttttttaaatgtctttctaaattttgactatttaatataccggcaaaaggaataacaaatttgaagatatcaaatttgtttgaggatgctggctataacatagacttaatgtaactgctccaaaacaaggtgcagaaaaaagtaaaatatttgattaaaacattttcatcctatttattcaacgctctagatataaaaaagattatttgttaacaaaaactaggaatatcagccttttaagtgatatggaaaagtttgctagtattgaaaacagtggaatataaaaaaattatcgtaattttaagcaaaaaattaaagatgagcccaggggcataattgagaaaaattgaaatgttgaggggatttaagcaacaacgtgataatgttatgaatgataattaaccacattgcatgcgattaaacactgtggagtaattagagttatttttttaaatgtctttctaaattttgactatttaatataccggcaaaaggaataacaaatttgaagatatcaaatttgtttgaggatgctggctataacatagacttaatcctttctcgttcgggtcgaccagcggcggaggcgtgaattgtgcgttgccatgatcttctccctcttcaccataaaggaatttgcacgaaatatttttcaaaccggtaaacttttcttttctacgatcggcacatttttcggcattttttatgacgtcacaaaaccatgcaatgtttgtgtaattcggaatctcatcttaattttgtgctttttgtgtatgaaaactttttacaaattttttgttaggctaacattgctgggcctcggctgttagttttagtttaattttacccgtttattattattatttattattattccccgccccatttgatgggccgtgccggctgaccggttgtgcagatgcttgtcacacaatacttcgcgcccttttgtgggcactttggatccgtgttgttaaatttttgaccatttggcttgatttctgctccttgttggcagttcagacctttcaatttaattaattaataattgctaaaaacattttagcaattacggtaactgtccctatacaacgacaaaaagcgatattccgattttttttcttgtccaaggtttttcacaaatttttaaatcaaaatttcataccgttgagacaatcggtcgtgtagacgaagaagatgaaaagcggcagaaacaatggcagagactggtgcattttggaagtttttgaaaatacaaatatttaaaaagaatgctttttcgttttattttgttcacttttcttttatttttggttaataaagtgattccgccaattctaaaaccgagtggagaaaaatgtgatgcgatgggatggatggtgctgagtcagtgggaatgcatttaataaattttattatcataattggtgatttatagggatgctaattttatgtaaatacatttttttcctagattctccataacctaattagtaggaaaatcactttcttttttgtgtttgcgaacaaaagttgagacttttatttacatattttcggatttttctacatattacatatgtgagtcgggggcgtttgggccccagtttttgggcccccgcgtttgggcccccgcgtttgggccctcgtttttgggccccagggtcgtttgggccccaagtacagaaaaatgaaatcacagtaaaaacaactttttaaatttcagcataaaaatgtaaaataaacagtttaaaaataaattcaacaataattttaacaataaaaaatgtaaaaattaacagaaattcacgggttcattcgatagttgcgagaaattccccggagaaactccaaaataatgtgaaattgattgcgattgtggtaattgtgatcatggttgatgttgcctgcattcatcgggacgtaaaggcgcaccaaattaagaattcgttcatctgtcgccaaaaactttcgcttttttggtggtggctcctctccggcaatgaatgacgcgtatttgacgtctgttgtcttctgctcacgacgtagcacgtcaatgaagtgaaaaatcgacgggtgtcggcaattgaaggcgccctgtaaacgatgatgctcttgtataaatttgataaaaaagtggcggcgccaatgaaaaggtcccgtcaccgaagcaagcttccattcgatctgcccaccggccaaatgactcgcgtccgaacaacaaaattctataacaaaagaaaaataagaaaataattgtcattttacctctgtgggttctcatttcctcgttcataatatacgccgctgtctcctaacaggaactgttcatcgatgccgtccgtcggtgtgtacgtctgatacgccgggctgattataagctgctcaagatttgcaggaacgacgggggggggcattcacttctcggcgagctcttttgattaactaaattggaattgtttttattatatgaaaaatattttgttttcacatcttttgctgcttgttttgacaccaaaattgccgacggagacgggacattttgaagcgcttctgctctgatgacagaaggcggttcgaaggtggcaattgcgcgccttttgattgcggtcgtgaccatttgagcatcaacacgtgacgcatctgctggacatgtgtgcggagttgcgaggcgaatgaattggtcgtggaggtccgtccagattcggccgttgcatttgtcggtgctgtttttgaactcgcatctccaaaattttgtcatcccatcagaactcattttagcaaagtgtaaaggtggccttcgtaagacaattttactttttgttttttggttgcaattgggttagccatttctgaaaaatgtccaaatcagaatgtacatcaaattggttaactattaaaaaataataggatttggaataagtaaaattgtaaaaaatgagcgagtgttaattaaacctaacttatgccaagtggcgaggcatccctcaggcttagtttttagaatcttaattttaaaaaaagcacattttccgatttttgggttggggcccaaacgaccccggggcccaaaaacgggggcccaaacgaccccggggcccaaaaacgggggcccaaacgcgggggcccaaaaacgggggcccaaacgctctggtccctgcctattaacctgcaaagtttcaaaaaatttagctgagaaacaaaaaagttatggccaaaagaactcaaaaaattgcattttcctggccattttggcgcagcgcgccatatcttttttaaaacctaatataattttttgaaattttgcaggctaataaagaacatttagacctattgattaatatcaacattattttatttggtcgaattaaaaaaaagttatgaatctttaaacttgtctgcgccaaaatggcctgcgccaaaatgaccccgaccctatattgtggttgcctgtattcaatttttgcacatttattatcaggtttattacacacattgaacaatgaatacaaacactgtacaaacacacaaataacgaatatgaagcagcacattaatggatattacacatacatacatattttgatcacattaggaaggtcgctgatcacatggaatatgtacaaaatatggggaacggacttcacacaaacaacagcaagcagtaggggggactgatcgtgaagggtgaggtcgtgcaccgtcgtcgttctcatcgctggctattcgtccgcttgggtcgtctccgctgtgctctgttctccggcgttagcggctggctcggcggcgtccttcttcttgtcctttttgtccttcttcccgtgcttgtccttcttggaacggcggttgctgtcgtcgctcttcccctcctttgatttgtgtttgtccttgcgcttctcctccttcttgtccgccgcagctgcgccgtcgcctttcttgtccttcttctttgccttctcctctgcgtcgccgccggtcgtggcttcttccttcttgggcgcttctttgtcgtcttcgctcttcggtttctccatgtacgtcttcgcgaagcactgaaaatttgaaaaaattttgtttgagatgtaaaatttggaccgaaaaacaacaaaaaaaaacttacgattcccgccccgaaggctgcagcgccgacgagaaagtgagaagtcattgtgttgttgttgggcgcactgaagtcgttcgttcgttgattgggtgttgtgtcagcagcaagtgtgcaaatggacgaaaattcccccttttatattcattttctgttgcactttttttcagtgggaaatttgaatataaaaaggcgtgaaattgagagaaatttcattctcgtcacattcttaattctattctctgcactattacatctgattgctgctgctcaccgactccatcgacaacgacacgcgatggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcggaaaattggcaattcaatttaaatttttttttcaccacccaggctcacgtgatgaccaagctggacgcccttcgagacggagacgggaagcacttctgccgctgcttggacctcgggcgcgatgagcaaagggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgaaatccgcctgctctacctgatcgacttcggaatggcgcgcaaatacaccagggacgacgtgagtttgagtgaagcgctttgaaaaaacaaaaataatttgttccctttcccccctttttcaggggagccaacaccgcccgcgcgctgtcaccaacttccgcggaagcccccgttacgctgcgatcagcgctcatctcggacgcgaatacagccgcaaggacgacatcgaatcgtggttctactgcatgatcgagctcttaaaaggcgcacttccatgggccaacgtgggggaaatgaaagcggtgagcgaatggggggggagggataatcagaattctgatttcattgtttcttttttacagataggcgaggcaaagatcaaacgccagaagaaacaaccggaagccgttcgacgccaggcaatcgccgacttgctctccggatgcccgaacgagttcggccaggtcctcaaatacatcgtgagttcgttcgttcgttttttccaaaattaataaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagcagaagaatcgccaagaagcgtcaccgtgctgaattgatcatatgaccactattactgtattgtatgtattattttgtgtccatgctgccatccccgatatacacatgtattgtattgttgacatatgtattgattgaaattgttgttgcataactgtgtttgtacatatgacttttggcgaaataaaggacattttgtatgtttcctcaagttcattttctcgaaaatatatgtagcataggtattttgatcctacttataggagaataagaccatttaaaaagtgaatggggaggaaaaacggagcaaatccaaatcgaaatgggcaataaaaatgccaatgattgcacaaattagggatttcgatcgaaatttctaaatgagcaaaaaatttttctgttctaaaaagtcgtgaaaacacgttttatggggtttttagggtcgctggtcacaaatctaacattcattttgatcaagttcgaatcccggacccgaatttgaacaaaaagtcgaaaactccaaattttcgaaattcttacttttgttcctaaattgatctaaataagctaaatttagtcaaaaaccattgaaacatcaaaaaatggtcattctgtacaggtacgaacataaaacctattttgaaaattttgagttttcgactttttgttcgaattcgggtccaggatt

SEQ ID NO: 458 - DNA, 863 bp, Heterodera glycines
aaaaaaaaaatttccaaaaaggggggggactatcggtagtattccttaatttcttttaatcgttttttacgtttattcgatcaaaatgtattaaaatattttatatttttgcttcccattatagattttaacaatcaaaattatgaggaaacgtggcatttaaaaatttattgctcgatacatcacatatatacaatatacatacaataattgggggtcggggtcacttcggcgcggaccatttctgcgccgcaaattttgaaatgctataacttttttatttgtcagtcaactttagccattctggcatcatttgaaagctctatgtgtgctctatatttacatgccaaaatagaaattaatgattcaacaataaaaaagttatggcacgcggcgccgaaaaagccaagaaaaagtcaatttttgagataaaaaaacatttaaaccatattttagactaaaaatgcgatatcgaaaaatctgaattttcgactttggttcgatagcgctttacaaagatgttgaacgagttggaattgatgctgacatatttttgtggtggaaggaaaacggacttcgctttcctgagttggcaaaaattgctcaaattgtgcattcaaattatgaaaatgaaatgattaatgatgattaaaaatattgagtcattttacctgaataaaatttaaaaaattaaccttaaatagcgaaaagaaaaaattgaaaaaccccgaccccgaaccccgaacgatttggcaaccccgaccccgaaccccgacacttccaaccccgaacccgaattttcaaaccccgacgtcggggacgcaaccctaatcgaaactattacgaaaattaatttacaatta

SEQ ID NO: 459 - DNA, 3612 bp, Heterodera glycines
aaagagaggggttgtggcccgtgtgagtctcgatatataatagccctaacatacaatacaacacatgggaccaagtggaaaaacgggggggggggtccaacaattctccacagtgtacggatcgccgccaaagtgaccacgctgtttgcccgaggctacttgtgctgcttttgccctcctccttcgtcatttcgtcaccttcggcatcgctcttcgcttcccttctctctgctgctgtcctcatcattctccaatggacttgacgatgatccttcacgcccctcgccccgcccgttttctctcttccccccttccgttcgtccgtcactctctcatcgccaatttgtcactccccaaacattgcgtcgtctttcgttgtcaatttatttgtccatctcatgccaattcatgcgcattcgtccattttcggatggaatacataaatcactgcttttataagtgatttaaaatagcaaatttgtatgcattttctctccacttttactcattttcatcagtaaaaacccaactcgtactgggatggatttcagataatttcggtttttcacattttatgagttgagggtttcgtccattttcactatgagaagagaaataaccgaagttgcgaaaaaacaagtcaattggcgaagaaaaagaaaagaaagccgaaaaaacagagagagagaaggaaattttgcgattatttgccaagaaaatggaaaagcgccgtttgaggctaacaaatggcatggcattcagttgcccgattctgttcacttcctcctaataattggttgttttcgttgtgccacccattcgtcgccattgctaatgcttttgggaccaaattaaaggatttgctgatccatgcccaccccccgcccctccccaatgacggattattacacttaatcctacgcccactctccgttaattaccataaccctgcgtcttcgtcccgccttcgttaccataaccctcctcagtttcacaccgccaattcgttaccataatcctccgtcttcgcctaatttttccgtctttttaattagacaaagtgaataaaataaatagaaaaagataagcgatagaaagctaaatacaggatataaaaaacttttcaaaagtaaaaaacactcccctaaaatggatgttttcaaaaattaaaaaattcatttaaaattatcaaaaattatattttaaaaaatcaaatttccatttaaatcctacttactttggcagattttaggtccgaaaacatcgcccttctcataaaatatcttttttatgtcttaaacaatttgaatgattttctaaaaaatgagaataaaattgaaaataaacaaaatgtcagaaaaaaacttgcatgaggaaaaattgatgaaagcatcacaatgaaatcagtcactaatccttccaatcgctggcggacaattgacacctctgggaaattgccttgagggcaaaatgaccaccggcggaggaaatccgccgaaaatgccggggggggggaggaaaaagtgacgaaaagaaagaaagagagaaacggaaaccgattccatcgaaacatttgcaatttgatttgcgtgtgatttttggggtttttttttgtaatctccagtgatcactgattgagcaactgatcaccaaccattgatatcactatcaccgacaaattctcattattagtcatcactgatcaaatgggaaatcaatcactacgacagagaaatagaaaatgcaaataattaaatattaacgaatttgattaaattgtaattttataacgaaataaacaaattcgccacacggcgaacttatcgaaaagtaattcataagcacatggaagggtgatctgctgataggttttcttttcatttagcattttcttaccttttgtcttttgccagtttttcctcctttctctgactgtaagtcgcccatttttcccccgggggaacgttcggtcgtttcttttctctccgcccctccggcgcccaattgggcggttcattcgcatttgcgtttctttctccccttatattattactagtattaagagacaataaatgatttttaagttgaccaaaaatgcatctgctttaatctcgaaggttgatcccaaagatggcattaaatttttgaaatttaacatcgaaatggccatttaccatccctcattcttcttgaccattcctctcaaattttcttaattctcgtcctcctctctctctttctctctccccagtctccccttatctctctcccctctctccctttccctttatctttccaattctctttccccactctttcccccttctctctctttctctctctgctctctctttctccctcccttcgtctccccttatttctttccccttcatctatcctctctcgctccctctgtcactcccgctctctctaactcatccaatcaaatcaaccacaaaaataaatttcctggcccatgccgcgccaagccgcttaactgctgtggacggaagatcccttcccattctgattgttgggattgcatttgctccccttttatcattccgcgcatccaatcagtcctttgaaggctacacggggcaatccttctgtttttctattttcaattcaaatatttttgtcggtgtcgttaataaagcgataataaaatgtgtcttttttcccaattttaaaatttgtgcatttattcgttctaatccatcgtacgcttaaataatcattgaacttttttggcacttttagtgccataaatgctactgccaccaccgtttttcagtttgcagatggtcgatgaaagtgccgccccgtccttcgttcctccgaatgactgtccgcttccgtccgtgctcaactcctccgctttgtctctgccgttgctgtccggccacgcgtcctttcctccggcgtattccgcgcattcactcgcccccgcccacggtcagtagctgcccccgctgcacggcacgtgtccgaatgccttttcagcgttccattcgcccttcggatactttccgtcctcgcgcgccgacccttcgccgtcgtcgtcacactttaattaccatcattatgccaatccgtcctcgtcctccgcctcctcttccaatgctaatgccaaccttagtcccttcgcttctttggcttgggtggcttcggtcgctgcgaatggcctttcgaccgttggggagggcagcagagggaggaggacgacgagaagcaacgattgcagaaaatggttgcaaaattcgagttgcagagatttttcggaaacaaagcgactttcagtgacagcgacgaacgccccctttccaccgccgccgcttcagtcccatcggttagcggaaacagcgaattgagcagaaggggacgccgggaaaggacgacgtacagcaaggtgaaacgcggaacggatggaggcaggggggggggcaatggtcaaatggaccaatctaagacattcccccgcccattagtgattggatggaaaagcacatggcccaaaggcactaaaagtgtaaggggatagagagagagaggggtagacaagcagaaaagcaattggaagggatgagagagagagggagaaggaaaggg

SEQ ID NO: 460 - DNA, 1102 bp, Heterodera glycines
agaaggagtgagatatagacggtaagagagggagagagagagagaggggtagacaaggaggtgatcaattggaagggatgagagagagagagggagaaggaaagggggagagaggggggggggggggcttggtcacttgcttgacattttaaaaagaggaaaagtgcaatttgaatagaaaaatatttttgacataatgcccgtccgggtagcaattgtcggactgtctttaataaaagtgccgcatttaatggaagtaatggtatgacaattcctgaaactattacaatacaggaacagctgaagattctcgaagagattttcaaaaagacgacggtatggccttaactttgctcatgtcgcggcatttcccttgctacccaagcaatatccggacgtgaacatgcgcgaggcattggcgacgcggattcagctgcctgaaagtcgcattcaggtgggaatgggactgaatcagcagatagtctcaatgttcaggtctggttcaagaacagacgtgccaaatttcggtgtgccattcccaagaaatcgaatagcaatcgaattgtttagtgccaataaaaaaagcgaggaaattgcgcacaaaattcatcagttggcatcggcgaagttcccctcgggcaatgccaatgattcgccgcccccggccgaaccgacggtggccaaaaatgagtcgctgaagagggcacagatggaaacagcaataacattgagcaccgcctcgggggaacagccggcatcggaagcggaggaagcgaaaatggcggagccaacagcggacgatttcggcacaatgttcgccccttccgcactcaaattggagcctcaaactacccatgccatcgcctcagcctccctccccgtttcggtggacagaacaacgatggcatctactctttgggatggcaatggactggcagcggtggagtcgacgaatcatttaacgacgggcggagcaaacggaacggcgatggattggttggcagcggcacaatggcacaaacaacagcagcagcagaatactcaataccagctctcggtaaaagtcaatggcaaaacacaaagtttaaagtagaaccggacg

SEQ ID NO: 461 - DNA, 8152 bp, Heterodera glycines
  misc_feature (17)..(17): n is a, c, g, or t
  misc_feature (68)..(68): n is a, c, g, or t
ccaatcatgatgccttnttcgacgttcactcgagctgaaatcaattttggttttcccaattccacccnccaaacaatcaaaagcaattgtccccaattgcagtggggcatcatttttacgccattaatttagtctctttgtaggcgtttttttttcccttaggcaaagttgagatgtccggtatcccttttgggactttgaccaatcgttcaatgggcacttttattggttcatctttttgcttatcaattggtacaactttagctgaagattcgccaatttcaagtattaagaatggaccgaaatttgaccaaatgagttttttatgtggattccggcggtggagcccgggaaaaatgaccattacgcgatctccgactttaaatttgttggctgttacgcgtggttgagagtcaaaccataatttattttgtttgcgcgcttctaaagcatttttgtttgcttgttcaagcatatttagaaggttttctctaaacagctgaatgtatttgtccgaatccaccgtataagcgggatttacggaaaaaggtacgttttgatcaaggggaaagcgcgcaatccttccaaacatgagagcaaaaggtgaaaatcctgtggtatttgaaggtgtgatgttatatgaaaaagtagcataagctaatcgttcgtcccacgtccaattgcttgcagttgacctttttaaaattccaattaaaattcggttgacacgttcagcaagaccatttgcctgcgggtcataccctgccgtaaatgacctttttatgctcaacatttttgatatttcttccatggttgaattcaaaaattctttccctctgtccgaatggaccttttttggcgtaccataaaccaagatgaacttttcgacaaaaattttggccactgaacctgcagatttatccggaattggttctgcgaccaaatattttgtgaaatgatccacaattacacaaatatattttttatttgaatgacttggccccacatctaagatgtccatacagatcaactccaatggttcggttgatttaacgacatttaatggcggctcattagcacgcggatttcgagtgtgcgcacaaattcgacatttttcgtgtgctttgacgcagtcggcaagcatattgggccagaaatattgttcggaaagttgtttacacaacttttttccactcatatggccagcacagtttccttcgtgatgagctttgactaattcctcacgaaactttttgggcacgaacaatctcatattgcttccactttcaaacagatacaaaagcccactgatgaccgaatatttatgacacttatcaaaaatgctttgctgttccctggggtccttcggtataatcctacgttctaggaaatcataaagtgcacccatttcgcttaatttggtttcttcgacccaaccctgataattgtgcgccaattcgtcccaatttggctcaatttctcggatttgtccgataattgcgatctcttcgtcattttgacagatttcaggggtttttggtgaagcaaacgagcgcgataagacatcggctattatattctttttaccgggttggtattcgactttcaagtgaaatctcgaatttaattcaagaagccaccggtccacgcgcgcatttcctgtttcgttttttcttttaaacatccaaattaatgctttgtggtctgtgatgactcgtgttggaatcattgttacaaactgtgcaaattttttgacaccgaaacgaactgcgagtgcctcaagttctgtggctgaatagcgtgcttcgtgctcgttgcattgccttgaggcaaaataaattggtctaacattattatcaaaatccggctggcttaaaatagcggaaatccctgccttactcgcatcagtcataataatgaactgccgatttgggtcgttttgtgcggcctcgaaatcaggaaaatacaatactacgtcctcaagaattttggttttcaaaatctctatgatttccttttccttctctccaatttcgaatttgactttttcgctcaacattttgaacagcggtgctgcaattgtaccaaatgaatgtatgaattttcggtaataagtaaggaatccaagtaaggaatggagctcctttttgttgctcggaataggtaaatcagttactggcttaaccttttcgatgtccatttttatgccttctcgggtgagaatgtgtcccaagaatggaagctcatctgcgcaaaaccggcacttggacaatttcagtttcagtcctgcgtcttttattctgctaaagacgataccaagatgctgcaaatgctcttcaaatgtttcagaagcgaccaaaatgtcatcaatgtagatgaacacaaaatcattgatcactccttcaaaaaggcgtgtcataaatcgttggaaagtggcgacggcgttagttaagccaaacggcataacaatgaactcaaaaaggccatgttcggttgtaaaggcagtcttttcaacggattctttatccatttttatttgccagtacccggtcatgaaatccatggtactgaaaaactttttaccacctaacattaacagggtattgtcaatgtttggtaagggaaaactgtcctttcgtgttactgaattgaccgaacggtagtccacacaaaatcgaagggacccgtctcgctttggaactatcacgatgggactggcccatggtgaaattgacggttgaataacacctcttcccaaataatcttggatcatttctgcaatcttttcacggtaagcatatggcaccggtctcattttgagtttaattggtgccgcatctcctgtttcaattcggtgttcaaccaaattcgtctgcgtcaattcattgtcaactaccgcaaaaatctcagtgaaatctttgctgagtgtccttaacctggctagttcattttcagaaagcatgccagttttttctttccataaatcccatattttcagattgggatttagctcaatggaatccaactgtttgcataatgacgatactattaggggatttgccaaaatgtcgtcactttcaccgatttccgtaattgactcgaattgaccaattttttgttttccttccaaagtaattgtggtcatggacaaatttgtaattggggcgataacttttcctcctttaacttttcctatagtaggctcgatgtgcaacttatcggtttgaacggaactgatcaaaatttcagaatcattgtgattttgatcaatttcgaattcgacaatttttgttgaacgtggctcaattacggtacggtatattacagtgagaaaattttgtgctttcgctttcgcttcgaacttttcgaattcaaccatttcgtcgttcagattgtcatataatttaaagccaagttttgccaaaccgttcgtacctatcagtaaatcgaatccaatcggggcttttgttacgtgcgcaataatgttggttggaaatttaagcccgcgacggcataacggcaacttcactgagaaaaggcaagaaaggtgcttgccatttacgtctaaaacacgtgcaagtgatttcgaaggcttaagcgtgcccaaatcgactttttcctcctttagtaatttgtaaaggaaatatgcgctaataagggaaatttgagcgccaccgtctaacattgcttcggtttcctgtccaaataattgcacttttaccgccatcactttaccaattgcaggaactgtctcatcctgacaattttccatattctcaagaatattgtcaaaaaaatatccatttctggggcaaactcaattttactcagacaaacatttggttggatttcttcttgttgggtgatgcaatgctgttttagataattcgatgaattaggcttagtgctatttgcattacgatttgctggcgttcctgccgcatggttactgttggtcccaaaatttgggttattcctgtccgatggaattggccagtttttttgaaactgtttaggcttttggcaatttctagaaatgtgtccaaaatcgccacagttatagcattgccaattttggctggaaaaatgctgttctgatctgggtgtaaaatttggctggttgtcagaattcgcagggaagcgatttgcgaaaaatctttgccttccatagttagaatattcttgcttagtcttttcccttcgactataggacgatgacgcataacgcattgcggcgcgctgagttgactctgccctagcagctaatgagacgaaatggtctaaagtcatgcctggcattctaaccagctccaaattcaaggctagctcggggttatccattgcacgaatgagaaatttaattgagtattcatcagacaaattactggtcaatcccgggtatgcacttctgactaatgttgaaattctgttggctaagtcatcgatcccttcgttgggctttctgcatacgcccatcatcaattcgtcgaacgcattcagatttctcgaatctgtttcttccatttgttgaagcatttctctcctaatgcattcataacgaaatggttgtgttgacaaagcagcttctaaggctctctcagctttttcatatactttgctttgaagtgccgaaatacgggttttttcgggccatccttcggtgtatacatcaaactttttgaaaaattttcgaactttatccattccctcttttccagtaagatcgggaattctttccagtaccaaatttaattcgagattgcttggaacagtcgtatcagttttcgaatggccaaaaatcgggttaggccgctgcgtttgattgacaattgcacctccccgattttgaggaaggtttggaagtgtttccacgcgcacttggttatttctttcgaaaaacattggattttgttcgggcagttgccattgtacacctttttcaaacccctgcccatgttggaattgaaaggcaggaaaagcgtctgcgtttactggaatctgttgacgtaactgttgaattggaatcgcgtgccgattttgcactctttcttctacgtttctaatgcgtgcgttattctgttcaattggtacaaatggagccaaagggtggtgacttaagtggtgattttggtgtaactgtcggttacccatattgtattggtcaaaaacaccgactgaagaacgctgaatattgtgggtaagaccattatcaggtaatggtgtcgatgtgcggtggttattctgaggaatattttgtgctaaaaccaccatcgaatcaaattgcgcaacttgtcggttcattgcgacattttgggtcccaaaattgtcggggtcacgccctctctcgttatttctgtcgatgactatcccaatatttcgaaattccgcaatacctgtgacattgccttgttgctgctgttcggcaccgagcacattttgttggcgtgcatgacttggctcgattgacacacgcagtaatgcgtttcgaatttcgtcgtcgcccataatttcgtcttcactaaaatgactttgattttggttatgttcctccaaattatgagttatgtttggggagatcgggttattagtaaaattcgtattgtctctgttttcttcttgattttgttgcgttgcagcagcggccggccgattttcgacatttccgaacatacgcaggttaagcgctctttggcgagtaagaggtggcgagcgtgttatcatttccaatttatcttttacaacactccgacccggatatgttcatacaattcacttttctgcagtttccaactttatgctgtagcaccgacccggtgtcaacaacggaagaaataggcgagattcgacccgaacttttgtcgtttttttttttttttttttttcttgttcaagtaagacgcgactcgccctttcctgggtcaagctttttgttgcacacttcgttaattatcgtccgtcctggatcgataactcacacggcgaagtctgcttagtcctatttttccgacctcccccaatcgtttttacctgcttcctcaggagcgccaaatgggatttttcttcaacttttggttcgggattcaaggaaggtgtcaaggcttctcagagagtttatttattccaaattaaaaaaagaaacaatcaattttctttggagaagacaaaacataaaactaatgcaattaaattcgaatacaagaaaaggtgggaaaaacggtcacaaataattaaacataatgccaaacaaatataaaaaataaaataaaggtcaaaaagtccaacactttccctccttcgttgttgattgaactttttaaatgtttacaatgctcggagcagggctggagcgcgcacagaaaaaaaccgcggccgcgcatcgcgcattcaaattgccgcggccgcgaccgcgcatcgcgcaaaaaaaaaaaaccgcggccgcgcaccgcgcatcgcgcattcaaattgccgcggccgcggaccacgcatttaaaaacaaaattatcaaaattttcaatttaatcaataaaattttcccaagtgaaagtttttttgaaaaaaaatttgaaaatttgactgcactttgttacgaaaattgcctatattaaaatatgtactcattgggggaggcattcgaagaatttttccattatatagaaatttttttttaaattttcatgcgggggggggggaatcttggattttctgagtcccaaaattctggatttttttgaataaattaacaatctattaattttttaaatcgcgtttttgtgggcggttccaaaaaactttttgggaacattgtgggggggggggggggggcggcggtgccgataggcgccgccggaatattttgatattttcagcgagattagttaacataatttgtcaaaaaatgaccaaggttaatttgtgattttaggctgtttaaaaattaaagaaaaataaaagttggaatattttctttattaattaaatttcaattgaaataatgtaaagaaaatatgaaaaaactttctgttccgttgaggaattgaacccaagagacaaacactgaaggtcagaaggtttagccactacaacacataagattatggaggaatactttaaataaaataaaaaaaatattttttttctaaaaaatttctcattcctctccaattcccttctcttttctcaccagacccccattcttaccagtgcttaaaaatgcgcggcgcaccgcgcaaaaaaaaaaaccgcggccgcgcaccgcgcattcaaattgccgcggccgcgaccgcggatcgcgcaaaaaaaaacgccgcgaatcgcggatcgcgcaaaaaaaaacgccgcgaatcgcggatcgcgcatcgcgctccagccccgctccagccctgttgcttatcaattttttcagctttcgcattcataggtttcatattcatacagaaaatgctcaatgtcaatttttatgttatattaattcgattattttataagaacaggtcagaggtcaagaatatttccttatatttttatttcgaatttttttatgtgaaataaataatttataataaatatcatttaactttaaattggacaaatttttattatggtatttaattttaaaaaatattttaagattttgaatatgtttagttgtaatacaaatattatttatatagaattgtattcttattctgtatatccttatttagtttaattgacaagcttccattttattacatatcttcatttattagttttttaaaggcttgctccgatttaaatgaatatggtaaattcttttaaatactttattattttgtttctgttttttatacaaattatttcttttaaatataatatttttgttaaaaactctaaattttattaaatttattggattttatttattaaaaaagtgagaatcgcattgtccggatcctcatttacttacttatgttcttttttagaaattttatattcatatattttttaaatatttcttgcgtaacttctaccatgaataatttaatgcttgcgaatacttatcatttctattttaccgccatttttctgttaaggaaaacccatggatttatattctttgaaacccgcagtcaaacgctactggcattgatctcactgattcaaaagggtgagg

SEQ ID NO: 462 - DNA, 2511 bp, Heterodera glycines
attaaaaaattcaaaaagaaaacttgttctaagaatctaaaaattaacaaaactaaatttccaacctaggaaaacaaattaaaattcatttgtttacccatgcaaacaaggttctcattcaaatattaaactggaattatgggagagtctaactataatttaaaacaaaagggtaacccttaaacaattatttcaataaataatatattaatgatttttaaattgggattgacaattaaagttcattatatattatattcaagataatattatttaattacctcgaataattttacatacccgtataaataaataacaattttttatttatctgacagaaaaaattaatacaaaaattgaagcactaaaataaaatttttaaaatgattctgtaatctttaacttcaaaatctcagaaggactagcagcgtattcgttcctatattaggaatgtcaagttagttccagcatacacatttgcagtgcagccggcggtgccgataggcgccgccggaatattttgatattttcagcgagattagttaacataatttgtcaaaaaatgaccaaggttaatttgtgattttaggctgtttaaaaattaaagaaaaataaaagttggaatattttctttattaattaaatttcaattgaaataatgtaaagaaaatatgaaaaaactttctgttccgttgaggaattgaacccaagagacaaacactgaaggtcagaaggtttagccactacaacacataagattatggaggaatactttaaatgaaataaaaaaatatttttttttctaaaaaatttctcattcctctccaattcccttctcttttctcaccagacccccattcttaccagtgcttaaaaatgcgcggcgcaccgcgcaaaaaagaaaaccgcggccgcgcaccgcgcatcgcgcattcaaattgccgcggccgcgaccgcggatcgcgcaaaaaaaacgccgcgaatcgcggatcgcgcatcgcggatcgcggccgcgctccagccctggctcggagtccccaattccccgaattagtgtttatttatttaattttatcgatcactgagttttttgtggaacgacctagcaccggactaaaaattcgagggtggggctcaattgttcaaccctttttttttttacaaaaattctatgattttatgcaaatttttttccaataaccaaatttttatttacctaaatttgtttataaaattttttaacttgaaatattggatttaaaaaaaagtttcgatatgggcctcggaaatttaggcgaatgtttgaaaattcataattcactattgtggaataaattatagtgcaaaaaagcatttaaaaatagagaaaaatctgtttttattttttagtaaaaaaatatattaggtacataaatttgaaaaactcaatttttcataaaaataattcctatcacaattctgaatagtattcattctggaaaagaaatatactaaaaaaaaatccgcaattcttcctcaataagcttgtgtttattccatatttttattagatttttgaaaaaatttacaaaaataaaatgatttttgaattcgggtcataggggaggggagcaatgcttttgagtcacttttttcttctaaattattaaaattgttttttttggagtattttttcagatttcagttgccttggtaataaaagcctcagaacccattcgtatctgtggctggctctgagagggaaataagcggaactgaactgcacggttgaatttgacacatttcgcccaattctgaacccttgacccgaactcaaaacccaaatatttaaaaatggcaggcaagtggattcgaacccatgacccaaaaacccattttaactaacgtgcaactgtttcgcttatttccctttttcgaaaatatatttttcaggtttttcaatgtgcaaaccaaaaagatcccccctcccttcgttggtcacgagtgtgaatttgatttccattttttaataggatttagataaccaagggtgtaatggatttttttagagaaataaaaattgcaattttttattgagaaattttgtaaaattagtcattctaaaatttttttatgaattttttaaaaaatttaaattttattgaattttttgaaaatattttttgtttattttaatagatatttaaatagcaaataaatatgataaatttgccatatttttctccatctttaagcttttattcatgtgtttgtaattaatttgaagtggttatgaattttacattttagaaaaaatcaatcaaagattttccaaataaaatttataagaataccgtatttcctcgattataagccccggggcttctattgttcaacccccctccaaagggggcttatattcgagggggggggggcttccaatcgagggggggggggggcttttattgttcaacccctttccctatataaattcttaaaattttttgctttctgcataatggtacaatttaa

SEQ ID NO: 463 - DNA, 2309 bp, Heterodera glycines
  misc_feature (1836)..(1836): n is a, c, g, or t
tttcggaagttggaattcctaccccaaaaatgtcggaaatcggaagtctttccgtgccatacctggtgcctatcgacatctgcgagaaattttatgaaatttaatgcgatttggtaacagattttgtctaaaattgaccaaatgacgcagtttttgactcaatttctacaggattattaagaaaagcctatccggcggtgccgataggcgccgccggggaaatttcacaaattttgaatgaaatttgcgatgaaaaatgagttaactttaattaaatttattatttaatttatttaaaaatatttggcattgtcttagaaaaattttcaaaaaaatcaataaaatcccgcataatcccgcacaaaaaatcaaatttgcggatcccgctgcgggattggaactcaaaattctttgcgggacgggatcccgcgggattaatcccgcaaatcccgcattttccaaaaaatgcgggattgcggactgggatcccgcaaaatcccgcgcgggctcccgtcccgcgccgggctctacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacctttttagaattttctatcttcaaaatgaagaagttattacataaattttggaaaaattcgttttttgagaaaaaaaaaattaatagcgctgttctgaaaaggttttttgaaaaacacgaaattcttcctctataagcttctgtttattctatatttttataagacttttgaaaaaaagtacaaaaataaactgattttggaattcgggatcatagatggaagcaaatggtttttttgtgccatgggttcagatccacttgcctgtaaaaatgttttttagggtttttgggaccataatcaagaacttggcatccattttgcccaattccaaagccttgatccgaactcgaaaccccaaaaataattttttaaaaatgttgcaggcatgtggatttgaacccatggcccaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagttttttcgtaataaaattttttccaggcttgaaaatcttttcgcttttggtaaggctaatagagcatgttaagagctttcgagtgataccaacaatgttttatttggatgtcaaagaaaaaagctatcatggaaaaagagctggcgccgaaacgcgtgggtcccgtttgtacatttagtctttctaaaatattttatgaattttaaaaaaatactatttttttcagaaaatttttgtgttttaaaagtatttaaaataacaaataaatattataaaattgtccataaaaagcgacgaagaaattgatgcagaagtttcctaatattttttttgttaatgttttattaaaataaattgttcaatagtttttgcacgtttctgacttcaaaagttttgaaaaaaaaatttttttgaggggggcttatattcgaagggggcttctactcgagggggggcttctattgttcaacccccctacaaggggggcttatattcgaggggaggggcttccattcgaggggggggcgtataattncgagaaatacggtatatcctaagattatgtttatttcttgcatatttgattaattaattttttaaatttttttcctgaagagcgaacggcgttgacagcatttcttttcaattatacaaatgattgcatgtatgtgctttaaattgaaaatcagtgttgccaacgacgttgtcccacttggtaatggtagtgatgaacactacaactcaaagcctcattttgaaaatttagtctcattgacctatcaaaaaaccacataatgaggctaaagcctccgatctgcgagccctgtttataccactgaaccacgggtgaaaacagacgaaatttatacattgactaataatgacaagcaatgtgtattttaaaaagaaaaaaaatgatgcatcaagttgttatggtatagatttcttttccttatctcttattttaaaataaataatgatttaattaaattaaaaaataattgcaat

SEQ ID NO: 464 - DNA, 3609 bp, Heterodera glycines
ttgtttttaaggcgtgaccaatgcggcggcggagccccctggagggcgacatcggagtacaggacccatttgaggtgaaaggaagtaaaggcaaaccgaagtgaccatcgttggcactttgcaggtgaacagaccatccaaaagggactcttccgtccgaattttgtgccgacttcgcctgacagaaggtagagaaagaattccatttattacttctctctctctcctctctctctttccctctctatttccctttctctccctctctttctctgtttccctttctctctcagtcgctttcaattttaaatgccatcccccaaaataggtcggcaatgtgccgcaggagaaccgtccccgtcctcccatctccaatatttcttcgatgccaaggtttgttttgcccagtggttttggcatcgaactgaataatgtcccccccccccacccccccaggagaggaagtgcaaagtgttcttccaccacggctgtggcggaaatgccaaccgattcggcacgaggcaacagtgtgagaggagatgtgggagcagtacagcaccaatagcagcggaaggagcaaacattgaggggaggacggacaaagacgacgcccataatttaattacccatttaattatatgctaattatttattgattgattattcaacgctaatttgcgcatttggacccaaaaatttgtgtgtaaattatcgctttatttgtgtggacgaaacgccaaatttgaattttaagcattgtgagcggatgagagaaatttgagcaaggggaaagtgaaggcaaaagggaaatgaaatggtaagctacagtaatctgtaaatctgtttctacagagcacatcataaagaaaggaaggacgacggcacaataggaagaatgaatgcgcttccattattcgaaccatccctatattatcaccataattagggtcattatcatcgcatcctttagcacatcggtcgccgccgccgccgcagttggccatcctcagtaataggggtagaaatgggcatagacggacgtacggggcgcggaaccggagcgagcagaggagtaattatggctacgcagcaagtccatctgcttgaccgcctggtcaagctggtagctgactgtcgcgtatttgttgcgcaactgatcagagggggaagaagtgatcagggaaagggaagagagtgacagaaagagaggagaaagtgagcaatcagggagtgatcagagaaaattaaagtgagtgatcagagagagtaatcaaaaagaggggagaggaatgatcaaaagaagaagtgacaggcaaaggataatcggaaaaatgagcagaagatcgcgagaggggacaaatgttgcaagcaaaaaccaacccgatcgcgctcgtatcgtcacgagacagactccgctggaggccgccccgtggtgcgacttttggggatttgtaacttggggacccgacatttggggacccgacttttggggatcccgacatttggggacccgactttcccgacttttggggatccgacacttagggattccgacatttggggattccgacatttggggacccgacttttggggatccgacatttggggatcccgacatttggggacccgacatttggggaccgaacgacatttgagcaaaagacacttaagaaaaccacggacatttggcaacccgacatttagggacccgacatttggggatttcaataaaacaaaaaaaaaattaaaaaatttaattctaagccacaaaattagacaaaattacgtctgctttagccagagttaattccattgcaaaaaaaaaataaaaggttaaaaatctttattttttgaaaagatataattattttagcttgcgaagagaaacagatcttaaaggactttttcccatttgtgctcactctgaattcttatgaattcagtgtgaatgttgatgactacaaccctggatatatttttggaaaaataaaacgaaatagggcgaccagtggaagagatttgttttgcaggtcagccacaacaaattaattcgttttaaaaaattcatttaaagcaccgaacaaagtcactcaaaagataagaaaccgaaaagatgacctcggcattttgttgctgtacgcaattagacagcaaagtcggctggaactttttgaatgtccttgacggatttctgttcccgttggcccttgggaaaggcactttaaataaaaattggaaaaaggtctactgtagttaaaaaatgtattgtggtttgtctattgtgttgtggttagtatgggctcaaaattctgcgcctcctcgcggtgagtccggaaacagagttaatttttaaaatattaattaatttttttgcaatggaattaactctggctaaagcagacgtaattttgtctaattttgtggcttagaattaaatttttaaatttttttttgttttattgaaatccccaaatgtcgggtccctaaatgtcgggttgccaaatgtccgtggttttcttaagtgtcttttgctcaaatgtcgttcggtccccaaatgtcgggtccccaaatgtcgggatccccaaatgtcggatccccaaaagtcgggtccccaaatgtcgggatccccaaatgtcgggatccctaagtgtcggatccccaaaagtcgggtccccaaatgtcgggatccccaaaagtcgggtccccaaatggcgggtccccaagttacaaatccccaaaagtcgcaccacgaatttgaacattgtccaatttacattgggtgagagcagaaacatcggaatttgattttgtcgagaaatttaaaaaataataatttaggccattgtcgccaccagcggatgaagaaaaagcggatcaaaaagtcgtctgacagcgtggaagtgaattaattaattaaatttgtgaaatgatcgatctcaccaattggaatttgatttgatgctctctttttacccttatacataaatgcttttgttgattcttacattaaatcgcaaaatatgcgcatatcaacctgaaaagcgaaattttcgcttttttgcttatttctgacataaattaacgaatttttaagaaaattgaatttaatcaatatttttgacaaaattttgataaaaaatgtctttttcggaaattttttcggtctttaggggtcaaaaagtccaatttacctgatgggggccgttttaataggggttttttgaaaaaatgccaaatatgcacataaaatatgcacaaaatgccaaaatatgcacaaatatgcacataaatcgcgaaatatgcacaaatatgcaaaatatgcatatggaaagtcatcctagaagcttcaaatcaagctaaaaacatgtttttcgtgcgtttcaggcctcccacagtccagggaaaaaatatgcatgtgcatatttttggatgccctagtaatgaacatccgtatcgtaacgtggcattttcttcaatgccagcttttcttttgtccgttcgttcaccaattcaaatggtctaataataatcaatcagtgaccggactagagaaaggcaaatcaacatttttctcttagcgaacattgctttaataaatatcaacattg

SEQ ID NO: 465 - DNA, 6734 bp, Heterodera glycines
  misc_feature (17)..(17): n is a, c, g, or t
taaatggtttaaaaaanttaattaatattaaaaaaatgtaaaacagtaaatgaatagaaaaacgatgtgctcaattactttgaaattaaaaaaaaataatttatttttaaggtgagttcagatgcgcaaaaattagcttaccatatcaagttttataatttcagaatatcgtttaatgtaaaaattattgttccaataatactattttctaaatataaatatttattaattcggtatttagaatttttcaaaataaaatattaaaagtttgtattctaattaaataatttcttaccatatttacagagtttacgagaaaataataaaatgaatctttccgccggcgtataacgggggaattatgataaagaaaattaattttcaacatttaaaaaattacatattttatctatttgattttttgatttttcccattttaatggtacggaaattaaatttttatgaaccttataatattttcagcaaaatactttaaaaaatgccatttttgcctttattcaattcaattaatttcaattaaaataattttatataaaatcgcataagtttatgaacaaaattttctattgccttagaaataaattataattctttagtagttagagactccattttcaccggattacggtagccccccataggtgtgggaggggtgcatggccaactgagcgccagccatttgagcgccgccaagtgagcgcgggccatttgagcgccagacttttcagtactgaagccaaaacctattgcgcgacttttttttgaaacccaaacctattgcgcgacttttttcttgcaaacccaaacctattgcgcgacttttttcttgcaaacccaaacctattgcaggggggtgcgcgacttttttttggtgcgcgactttatgcaaattattttaattaaatttatttaattttaaattattttaaacgtcttaaaggtcaaagacgttgaatttaaattcatttaaaattctccaaaaattccccgcaccgagcggatccgaaccccaggggggcggccagactgacgcactaaccactcggccacattggcaatggataataaacattaatttgctctcataaagggaaaatttgacgtcaccagcggcgggagggggggcgagagcgggcggcgagaatggggaggcggggccaaataaacatattaattaaggaggggtgggggtgttggaaaggtgccaaataaacaaattaattaattggtcgcgtactttgtggtgccgccgtccttcccgcatgcccattatgtaatttgacaccttcagacaataaactatttattaattgattttttgtccatttggtcattttcatttcatttaattcactttacggaaggaaaagccaatcaataatccattatcatttatttatgccttaatttttccttctttggcatttgtttacccatttacccattactttttaccatttatttattgtcagattggtattattatggcaccattttttgccaaaattcctaaattgttcattttcaatttttggcattgtttttcccccttttttttcacattttcatttgccaattgctttacattttgtgccaaaattcattgccatatttttagcattgttttgtcaatttttgcacatttttgtgccaaatttccctatttatttcttaccaaatttttgcacatttttgtgccaaatttccctatttattttttttgccaatttttggcattcttttgccacaatttttaaccctttcttttgccaatttttacacatttttgtgccaaatttcactatttatttcttgccaattttttgcacatttttgtgccaaatttccctatttatttcttgccaatttcttgaatttgttttccccattttctcatttaaaaaatatttaaattcttggcattctgtttttttcaaaattaaattatggcgttctgtttttcaaatttaaaaattattttcacatcttggcattctgttttttcaaattaaaaaaaaaaatatttcaacccttggcgttctgtttttttcaaatttaaaatttatttaaattattggcgttctattttttaaatttaaaaattatttaaattcttggcgttctgttttttcaaatttaaaaattatttaaattcttggcattctgttttttttcaaatttaaaaattatttaaattcttgccgttctgtattttgaaatttaaaaattaattaaattcttggcgttcagtttttttcaaattaaaaattatttttcattaattttccgcttttttcttccaaattttaattatttttgctttccctctttaaaatatttttattttccactcttttttcctttttttttttttattcattttccccttgttttttattcattttcattgatcataagtactttgtactgtcctttctcaccccattttgttattttgctggtttactcggtactaaacccctttaggatatttgttaagccttttcaaatatcctgggggccatccttaaaccgaggagtcctgccccggtactgggttacttcccagagtggtgggcacgggcgttcactgtccacggggcttattccgctggtatccagggctgcggcagtgactgaccgaaaccatgtttccgtcatagcccgccgtgtgtcacagcgatgtttaagcccagccagatagtcggtctggtgtggacgggggcccttcactcgctggccttgagggtgaaggtgtgcctgttcctagcagcgggggtggcggttcctagccctaatgtgccctgcctacgggctgcattgttacagcgagagaataaccgggactggctggcccggaggaccgtgagtcactgagcagtgtcgaacgcgcagctgctcaaactcaacaccccggattaaaatccgcgtagacggaacacatatgtgctgtgggcgttggcgcaaatgctctgtgaagggagtaattacccgacacagagatgcctacaccatacctccgcactttggtatggtagtgccacacactttgtgttccatgagcggttccataatcgcttgctatgatagtcatagttggtgggcatgccctccaatgtgatggcttgggctggaaggttaaaaacacgtgtagggggtgacctatgcgcgtttttggctctccaaaaatggcccaaaacatcgctcaggagacgggtcatgcccgattttttttcatgcagccattttctttgcagtttcgccatatactattgttttttcttttcttaaaataaaataataatactcaattcaattttagaataaatgagccaattttccgacgattccctcccccctacccttgatggaccgtattcccctgtcggggatgatggaaccgaactgatggatgatgcgccgccgctggaaaacgtcatcaaacacctgccaaacaccgtacgtttttgcgaaatgtttttaaattttcttttctaattttgtgagatcgtttcaggttgtgccgtctgaagagaatgagcgcaagacccgcagggagccatcaattacccgcgaattggacgcggaattgttcaaccgagatggatttgtgtgtttatccgccgcacaggcggaagcgggacggttcaaaggtgtggttgtacaactttttttaattttaaaatttctaactttaattaattattcgctttatgctatgaaaagtatataaaaaatttttttttatttgtactttgattaattgaggtattttaaatgatgtttagcgtttcgattcattggccaatttttgctgagcctaacgttcggcgctgtttttccggaggacattctgcgcaacctctttaccatgtgcctttcctacgcagtcgagggggccgaatcgatgaaaatatctgcggaccacttcattttccttctgacgtcaaaacaccttgactacgaagtggctgtacactttaaaaaaatcgacaacacggcgccggagaggattctgactcgttttgaaatggtcgaccaaagcaacaaagcgaaagaaagaccgtcgctcctcgaagagccttttgtaatagacataacggcaatcgagagcaagtgtgccaaaccgaaaatggctggaaaagggcgtaacgacttcaacatcgactaccgtattaccgatggtgcaacgtatgagcttctgaacaacgacaatctctgtctcttccggtcatttgaaatgcttcggatgaaattcatccttgcgcaacaacgtttttcggaatacaaaagggatgagagaaagcagcttgaaggcgttcatgctttgtgccgggggtgcaacattgacatcaacctacccttctattcaattgaggaatacggagaatcaattcaggcaaataatttgtttattaattgactttatttttatgcattatctgttaaggcttattatgaggcgataaatcccggcatgtttcggcttttttgctttgaaacctttggcaaaatgaaaccttcatggaaatcaactgtggacaactataaacatgaactttccgttatttttattgatggtgaagacggcggcgaagggcattacgacccggttaaaaatgttggaaaactgttcagtgcccgcaactattgttttggagtatctataataatatattttatactgtaattaaataaatatgttacagtgtgagatgccatttcatcaacaaacgcaacacacagcaaaatgcaaatggaaatgccacaactgcctgcgtgttgggtctgcctttcgaggaaactgcgtccaaggcaatgacaacttttttgagacctgcttggggtgcaataaagtaaagttatttgagtttcgtttcaaagaattttttttgtttagacatttaaaagtcgtgaatgctatgaacaccatgccaaatgtacaaactacagggtcaagcgtgacaacgaacatgaaattgtgggaaaatcaatttgtaaaagctcgaagaaatgcgtcgactgtggcgtgatttaccaaattcgggttattataaaataaaatttttttattttattaattttctctttagcatcaccaacaaaaagagcatgtttgcggtcaaaaattctgcaaaatttgtctcggcttccatgccccgcgagactgctacataccataccggcctaaagtcaagaaggagaagcgcttcgtcttctttgactttgagtgcactacggatttcaagcccgacccgcaactcatgcggttcaagcaccaggtaattatttttttttgaattcaaacaatttaaaaaaaacaaaggtcaacttctgcttcgcccatgtgacatgcacccgctgcattgagaagggcatttgggaccaggagctggagcgggcctgcgctctctgcggccgattccgaacttatgcctggtctccgtttgagttctggcacacggacgtggaatgccgcaaggtcgtcgaggacccactggctaccttcaccaagtggttgctgaactttgaaacggaagtcctcggcatggagcccggagcgaagaagcgcagaaagaggaaaaacattgacaacaccgacggcgatgccatggagggtgaagaggacgaggacgccgtggatgaggacgccgagaacaactggatgttgggctatgaggaagcgggggaaaagcccgagtcggtgacgtcgtacgcatacgcacacgccggtaaattgaagattgaaattattttttaaaataaaataaaacttaaaggttcccgctacgaccatgtgctgatttatggtgaaatgctgcgcatgggtgtacgccctgaactcatccgccaaggcaaccatctcctggaaatgaaggcacgcaaaacgggagtgtacacaaccaccatctttcgcgacaggtaaaagtttgaatataattattttttaaatttttgatcgctttagctacaagctgatcccgatcaagcttgccaattttgtcaagacgttcggccttgaaattgagggagtggacaacaaaaagtacttcccccacaaattcaataaggtaagggtaatttatgaaattaattaaaaaaaaaaaaatcattaaaatttaggcggaaaattacggcactgttttggacactctcctgccaatggaggactactacccgggtggtctcttccctgccgaacgcgcaaaattcgagcaatggtacgacgagaaccgggaaacagggtttgagctgaacgaagtgatcgccgactactgcaaaacaggtaaaagttctggaaaaaaacatgcaaaaatattcaaaaaaaaattttgaagatgttcaaattctggcacatggtctggtaaaaatgcgacagctgttcttatctgagactcggcatgacatcaccgattcggtcaccatcccatccggctgcatgaagtattgggttcaattggcacaccacgacaaagagcgcgtcgccattattccacatcttggctatgagaagcgcggaaaacagagcactattgccagaaaatacttgaaggtgtgccaaaaaaaaaattaaatttattttaccttttcatttctctctcagtggcgtgccgaagaagagttgcgggagaatggccgagtcctccgccatgtcgaaagccctggaggggaagtcaaattcggcactacagctttggacggatgatggagcg

SEQ ID NO: 466 - DNA, 2671 bp, Heterodera glycines
  misc_feature (2641)..(2641): n is a, c, g, or t
  misc_feature (2652)..(2652): n is a, c, g, or t
  misc_feature (2662)..(2662): n is a, c, g, or t
aaatttcaaaagatttggtcaagtttgagcaaagttatggccaaaagtacccaaggaaccggttaaaattttgcaggctaatagagggcacttgaacggatatataggaatatgtgcaaaataaaatattaaaattacttttaaccatcacttcttaggtgtgaagaggaggagttgcgtgagaacggccgagtcctgcgccatgtcgaaagccctggaggggagttcaagttcggcaactacagcttggacgggatgatggagcgccctgatgaggacaaaaacttggccatcgaggtcaatgggtaaggaaagaattcgaaaaatgtgccaatttacccattcaaaaggtgctattggcatggatgcccaagctgcttccctgacgatgcggcaattgtgggcggtggtgagacagcaggagccctccgggcccgggacgcaaaacggactcgtgacattgcgcgggagttcgaggtggaaatcatctgggagtgccacttgaacgcaatgctggaggacaacccggctatgaaagcgtacttcgacaactgccctgattcaggcccaattgacttccacgacgccttctttggcggtaccttttccatttaatttttaactaattttccggcacaggtcgaactgggcccgaatacttgggcgcttcggtgatcaaccctgagacgggcgactggaaaagccgcacaatcaaagtgaaggactttaacagtctttatccgtcgcggtaagaaatgtcggaaaaaaatgaatagttgaaaaatcttttgcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtccttccgtaccggctcaacaaccgcacgctgtttcccctctgccggacgtgttccgaaatgtacccgcgcggcttgatcgaccccgagtacaattgcgatcattttgaggactctgaaaggggtgagtttgaagcttgtaattaagcaaatattttttcttaataggcttttcgacaacagtcacacacattgagctggaagccgctctccgctcgtggtacaaggtgacgcatgtgtaccgtgcctatatctggcctctggcgtgcgattggagcaatgggctgttccactcgtacctgctgaagtttctcaaaatgaaatttgaaggtaaaatttgaaaaacttaataaaaaaattaaacaaacaaaattttaagcaagcggatatccagcgtcttgtacggaggcgggcatcagcgaggaggagtcggcacggagaaagcaggaacacatcgacaaggccaaagaaaaggcccaagtccctcttgaggcggaccgaatcaaacacaaccccggactccgctacctgtccaagctgtgtttgaattcgctgtggggccggttcgcacttcggtaaaattttggttaagaattatgaaaaaatacaaattatacagaaaccggcttaccaaaaccgaaatcgtcgagtgccatgccgagctggccaaactgctcaacgactcgaagattgaggtcagcagcattgatcagctgacggaaaagttctggatggtctgctacaaggccaaagatgagcatgtggtggagcacagcacaagcaatgtaagaaaagttttaaaatatttaaaaaagacaattgaaattttctcaggtggccattgccctatggaccacctctgctgcgcgaatccacttgctggaatcgctgaaaaaggtgtatggccctgcaccaggtgtagagcgctacgacacccgcattctctacatggtaaaattcagaaaataaaatgaaaatgtgaagtaattttttaaaatcaggacacggacagcatcttttacgactacctgacgcggctgggggacccacttccgggtggtgagcagctcggggagctcgccgacgagtaccgaaccacacgattatggaattcatttgtggtaagactcattaaaaatagatcaaaataaatggaaattttttgtttagctgggcccaaggcgtacggattgtggctgcgcaacaacgcaacgggggaggacgagtacaagctgaagctgcgcgggatcaccctggactcggatgcctgcgagcgcatcaccttcgagaagatgaaggagatggtgcagaacaagctgggacagccggacaacaacgtccgcttcaactacccaacgaagaacttccggatcaccaagaagggagagattttcaccgtccccttggtcaagcagttcaacccgaccgtgaataagggggtggtcagggatcacgggttgaaggtggtgccctttgggtacagcgacgaagagtggtgtaagtggaactgccctggcgcttgtacctgtctgttcaacccagacctcaatgtgaacatgttcacagaagaggagctgaatgaccccgacattatgccataattgttttttttttaaattgaaaggcgtgattttgtaatatttttattcatttatttcttcatagggcacccaantatttttccgngaaatccaantaaatttca

SEQ ID NO: 467 - DNA, 2013 bp, Heterodera glycines
cggaacgtgggaatggggctggttttcccatatggcagccagatcgccgcacacccagtggatgccgtagccagcactttaaaggtgtatgggggctttcgcaagcgtttgataatttgaccaaacaggaatgtttttcctgtacctccatcgccgaaaatgaagaaacggcgcggcacagtctggtccttcgggtccgactgtattgccctcacaacagcatcaaagaccttttgctggtcgctattgaggggaggtggggtgttttgttgtggcctttgatttggctggccatgcggcatattcagaccatcatcaccaaagaaaaattcttcaactgccaaattggtatttttggcttttgaatttggtggatctggcaggccacagtgcacacagcttaagttaaagtagtgcaatcgccaatctatgtcggctaaggcttgcagctcgcgtgcttggcgtatagctgcactggtgatgccctgtgggttgtacatttggtctttatacttgttccacagttctatggcattgctcggctgcccaaagacgaggatgctcacaaagagccatctcatctggtccggccagcgatgcaaggctgcctcaccgagcgttttgtgccaaatttggtcatcttcaagaagcccatgctgtagagcggcctctgtaaaggtgttgtactgctggccattgaccagtttcaagtggtcaggatcaccgggaaagtgacgcatcaacgcataaagtgcaaatctttcccggtccgttggaggcacaggtacaacacgaccgattgggggcctcttggcaggcttccttttatacggaagccatcggtcttttgcccagcgaaattgctctgggactttttcaaaaagcatgtccttgagcgaaggaacatgctgccattcagtttgccattgcttccaataggcagagcatggcgtctctggcagctcgcctcgctgaatttcctcagctttgctcaccagttggaatgccctgtagacaacgggctgctggtttggcaaatgaatggacaaatgaacaacctggtgcgagagttttgcaaatggtattgaatgcacaactgcaaaagcttccgtagcaccacggaaattcattttggcatattgagccggctcatcgataccgattttgctgccggactcctctttgcactcgacataacaatgtccgggccctttgaatgggtatttgagtgcatatttaatgtttgctttgttaccgtaagcaaacaacacattatgatgcactcgataacgcagcaaaatgtatgggttgtacggcacgacttgtgagttgtcgtatattaagccgtttacctcaatttttgcaccaccatcgcttgggctaggccggtaatataacgcgggcctgtccgggtgtagtatcgtacatttcgaaaaaggggcaggaaagccctttttgcacctcccaaagttggggtcacgtggaccgcaccaactatcactgcatctgtgcagttgcatatgcattagttcgcggacttcgcgatgcattttcgcaattggggagtcatcatctttatctggcaaaggtggaatatgagcccatatgtattcctggatgacttctggaattgcgtccaggtcagtctgggctacaatgtgtgcgtgtgggccaccacgcccctggaactccatggactctcctgagccaaggatagtcccaaagaaacccttctcgtagagctcttggtggaagacagcaattttgccgcaccacactcgcatccacatgtcaaaacggtcagtgaacatttgaccatttttgtaaatgttctccttgaattctggccactcacggttgttcgtgaatgtgataaagagccgcgccttttttgcgtcgtgacagcgcgcaaaaatggtgttgcagtcttcatacatttttttccaatactgaagagaatttacatttctctcagaaaggcgaacaacgctgccaatgtcatcaacactcttt

SEQ ID NO: 468 - DNA, 2099 bp, Heterodera glycines
aatgtgatgtattgccactccaatttttcatcccttattgcgagatgatatttgcaataatcgcgcagggagacaaatctttttgatttgtcataatgactggtctctgactgcatcgatgcttcagatccggcatctgactctgcaattgactcagtctcgcacatgtcatcatcggacattgcttcagtgtcaagcatatcagcagacatgttgcttttccgccttctttgtgcgggtttggcatatggaatgccaattgtatatccatcgtctcctttaggcttaatcaatggataggtcaagctatcagtccaaggactgaatggggcaatttcgttcaactggccctgcttgttttcgacccatatccctttaggtgccggggcaccagtgggatctgcatgaattgcaaacatcccttcacccgttgagggggtgattatctggtggggatgcagcttcgggtctttcataccacccggagcagagcgctcattcaacaaagtcattctgaaaaaccggagctcttccgtcctttgttgtcttaacaactcttgtagctgttcacgagcctgcttgtaagcagatgcagctgggtgattttcttggatcattttttccaagatttcaagggtctcatcattaagctgatgaccctgcacaaactcttcctcgtttgtgattttttccccagtaaacgtgggattttttcgtcgctgctccatggcttcgactgggtccagaatgtacaactgaccaaagccaggaatctgggttgtgccagcctgcatgctgcttatgcggcgatggaattctccgttgagaattactgccatcggtccgccagcagggcatggcttattgccagccgaaacactcgcaaattggagcaaattattgtaccgcgacatattccgaacaaactccttcccttcgcggggttgtttatcgcacacgatgagctcttcaagctcttttgggtgcgggttaagctttggcaaaacaactcttccttgacgacagcaaactctgctgtcctcatgcgggaagagtagtgctccacaatgagagcacttcttttcaccaagcttaccagaatttgaatatcctggataatgctttgctgctgcggcagcacagcaccaacccttgtgggcaaggtagcaacgctgcgtaaatgcagtgactttctcaacagcctttgctgataagctgcgtctcggtgcgggtgaaggcgaacggctaatcgaagctgattgccgtctgcctatgcgcgatgatcgcctcggtggcgtcttcggtctgacaaatattgcatcgtctgcctgcgcaattggctcttgcggaacacaagactccgaaaccaaaccaagcgtgtcgacttggttttcaccatccacttgggcttgggtgagaatggcattagcagcctgtccacttgtctgtggttcgatgatcattatgtcatttttatcatcaacttccattgactcagcggccttggatgtcgactgcgcttcatccgtatgtcgatagacaatggggcaaggtgttggtactccttccctcggatggtacggcacattatcagagccgtaaagctcattgatgtgccataaaatgcgtttcttttcataattaatggataaatcaggcagaacaaatgtgcgattgttcataagccatgactcagcatacaggcacacgaagtacccgcagctatttccatcgtgttgttccgtcagattttcgacattaaaaatcccggtcaacactgttgacgacaaaatgtcagaaataatctttctaattttatccgtcagttgcggatccaacctgccatatggggtaggcaaagaatcggcaaaatgagtaccgaactggacatcatggacaatgagagtccaatgtccagggaaatgtactggcaaaagtatgacttctgccggaacgttggggtcatacccaaatgtcatatttttgtaaggcatgaccctgtccaagccacttctccataccattgggtcgactacgaccacttttcgttgtgatatggttgccaagtatgctaaatatgcggcagcaaagccgtcatt

SEQ ID NO: 469 - DNA, 5688 bp, Heterodera glycines
aaggagttggcaccccctaccttggatgatatgccacattatcagagccgtaaagctcattgatgtgccataaaatgcgcttcttctcataattgatggataaatctggcaaaacaaacgtgcggttgttcataagccatgactcagcatacaggcacacgaagtacccgcagctatttccatcgtgttgtaccgtaaggtttaccgcattaaaaatcccggtcaacactgttgacggcaaaatatcagaaattatatttttgattttatccgtcagatgcggatccagcctgccatatggggtaggcaaagaatcggcaaaatgagtgccaaattgtacatcatgaacaatgagagtccagtgtcccgggaaatgtattggcaaaagtatgacttcggccgggacattagggtcataaccaaatgtcatgtttttgtaaggcatgacacggtctatgccaatttgccacacaattggatcaacaacgaccacttttcgcactgatatacttgccaagtatgccaaatactcggcaacaaaggcatcatttagaaactgtgtcagatcattccaacaggtctcaatgaattttgggccagagcgtgggccttgttctgtttcgccatcacgctcgtaaaggccaacatcggcccatctgcgaattttgcaggccatatttcgcgatgtggcgaaattaatttgcactgtgctgaagtttatcttttcaggcacagttggcaaaacggccactgatgtggtagcttcagagccctgatcaattgaagagctttcgctcattgaatcatttgttttgcccctgcctggtcctcgattttttttggcgggtcgtccacggtttcgttgcgtggaaactggcgttgaagcaattgcttcattagcagacatgggtctgtcaacttcgttgaccttccattttttactgctaggcgacgactcaacattttgagtggccgatgtaaattgccgccttttacttccaatcgaagaggccggggtgcttaattgcaaagcaccaatattgggcgtggtagtgcccgggtgtgataccaccccattctcatctgcaaccaatggtttgtccaaaatcggacagtttgaattgcccttaggagggcaatttgggataggtgagcgacctggactaacagatttctccgtgcgccgcaggtgctcttctttctttctcttcttcagcatttcttgcttagaaggcatctgaaaaacaaaatcaatgggataatacgagtgtgacaaaaggtatttgaggaacattgaccaattattgtgcacaatttaaacatttataagcaaaaaatatatgaatgtgtaaaataatgatcatcgtcgtcgtcctcagccacagtgaagtcgctgccgaaatctatcaggcaggacgctcacatacccctaattgcacaaagggcattgactgcagaaacatgtcagaaaccacatctcccggaggaacagtttccaatttgtttgcctgaaactacatctcccggaggagcaggttccaatttgtttgcctgaacacacatctcccggaggagcaggttccaattgtttgcctgaacacgcatttcccgaaggagcacgtcccaatttattggcctgaacacacatctcccgtaggagcaggttccaattgtttgcttgaacacacatctcccgaaggaacaggttccaacttattggcctgaacacacacctcccggaggagcaggttccagttagttgaaaaatgggtccgttatttatcctaacgtcacctctcacccgtccactggtcttggcaaagtgcgggaccagcttcgcccaggatgttggccggtaacgatggggaaaaagaactgaaccaaaaagtctggtcgtgaatccaatatcctggtcgcaaagcagaccgatatggatgccatggtcgctaagcagaccggcactgtatcatggtcgcaaagcagaccgatactattggctatggtcgcaaagcagaccagcctcgccatggtcgcaaagcagaccggcgtgtgcactacatatcatggtcgctaagcagaccgatatgttgccatggtcgcaaagcagaccggcacgtgcacaaatctcatcatggtcgcaaagcagaccgataagatttgaaacaaataaaaatgtgagtctcaaaagggtcataaggacagaaatctttacaattgactgaataatatttttaaaaatttaagaacatttttttctgtcaagtgtaaagactacttaattctattttggagcttatgcgtgacaaagtgtacgaaacttaattcctaactaacctcagatttgggttagtaaaactattggcttagtgtacaccttgccataatttttgtatatatgagcatctaaaaattttttcttattttattcatttcatggtcgaatcgatgaattttaaagatttaaaccggccaaacacagcaattgcctgagagaattttttaattttataagaaaattgaaggatggaaatggtatcacccatcaatgttaagcgattgtcgattatcaaaaaaatctataattgatttttgtttggaattttaaatttaataaactaaaattttcttcaactataggaaaaatgtttacatttttcaatttttgaattgtcgaattcaatcaataattttcgagactataaagcgtttgaccggttaatttgagtaaaattgaaacttgcgcagcaatccgcttttgtcattgaaatgtttgtccactaaaacatggaaacggagcgaaagcagtgccaatttgagtccgagttgaggacggtcaataaaatggaaaaatgtccatccaaactgttacgcagttgctgaattgttgagcggttgctgaaaatgcagaatttaaaatcataaaaaaaaatgcaaaaacactaaaaaatggcgcttttacaacaaaaaaaccgaaattggtctttaggcaaaaattctagaaatagaaggcccccttttggcacaaaatcctttaaaaaacaacaaaacactaaaaaaaattcacctttttgccatcggaatgttgtccgccaaaagttcgaaacgtggcgaaagaagtgccaatttgagaccgagtttaggacggtcaaaaaagggaaaatgcccatccaaacatcgctctgcacatcaaatgaaattattgaaattaataatttagcggaaagggaagcaataagggttgaacaaacttcttagtgaattttacacaaaaccaaaatttttatattaaaaagctaaaacatacaaaatttcaaaaaaatttttgccatgaaattcccaaataaaaataagaaatttatgactataatggaagatataaatgtaaggcccagcttaaaaatcattaaatccaaaaaacataacaattaaatgctaaaaaacctgacagaaacaaaaaaataacgaattttaaaaatttttaattttcgggccatttttcgaaccgagaaaactttttaaaaacttaccgcattcaaatttgtccttgcaatttctggtccacagtcattttgcttttccatcgagatgtttgtccactaaaacatcgaaacggagcgaaagcagtggcaatttgagtccgagttgagcaaggcaaaaaagggagaatatccatccaaacgtcgttgcccatcaagctgaaaaaaagtcgcgaaagattttataaaatccaaaaaaaaattaacgaaaaactaagaaattttgtatttttacacaaaaaaaaaaatctgcttagctggagttgataaatcaataacataaccaaaaatcccttaaaaaagccggcactctaacacaaaaaatcaaaatgaattagttaattttgaaaaaaaaataattttcagccattttttgaaatggagaaagctttggtgcccctaaattccataaaaacactattattttaagtaacaaaaaaaccaataactttacaaaaaaaagaaactaacaaaagacttaccaaaatttggaaaaacttcgcctttgacatcaaaatgtttgtacactaaaacatcaaaacggggcgaaatcagtgtcaatttgaggccgggttgaggacggtcaaaaagtgggaaaatgtccatccaaacatcgctgcagaccaactaaaattatgaaaaataataatttagcggaaagggaagcaataagggtggacaagattttttgaccgaagctctgagcgaattttacacaaaagcaaacttttctaaaatttctaaaaaaaaatttttatgccatgtaattgccaaactaagaaatttatgactataatggaaaaatataaatgtaaggcccagtaaaaacatgtattacggggttttcggggtcgctgatcccgacaatgatacatgttttggccaattccgaacccccgacttggattctaacaaaaaatcgaaaattcaaaattttcaaaactggtttttatgttcgtatcattacagcatgaccattctttgatgttgcaatgtttgcagtaaatttaataaaaaaaaactgacacaaacaaaaaaatcaaaaaaaatatataaattttgattttttttaattttcgggccatttttggaaccgagaaaactttaaaaacttaccgcattcaaaattgcctttgcgatttctggtccaccgtcattttgcttttgtcatcgaaatatttgtccaccaaaagttcgaaacgtggcgaaagtaatgccaatttgaggccgagttgagcatggtcaaaagagggaagaatgtccatccaagcattgtgcgcagttgctgaaaatattaaaatataaaattgcaaaaaaaagcaaagaacctaaaaaatggcctgaatttggttttaggcaaaaatcatttgaaaatgaaggcccctttttggcacaaagacaacaaaaaatttgtcctaaagtcgccaaaaccgtgcgtttgcggtaccattagattcagctcgctgagctgagtaaaacggtgccttatacgcgcagaaccgttcactcttcgacaaatgccgaaagcgtaaatttcggtgaccagtgattttttcaaaaaaaaattgacacttgctatttgtcttaaagtgaacagttttgcgcgtattcggtaccgttagactcagctcagcgagctgagtctaatggtaccgcatacgcacggttttgttaaattttcggcaaatgccgaaactgtaaatttggtgaccactgaatttttcaaaaaaaatttttgacacttgctatttgtcttaaagtgaacggttctgcgcgtattcggtaccgttttactcagctcgccgaactgagtctaatggtgccgcatacgcacggtttcgttaaattttcggaaaatgccaaaagtgtcaatttggtgaccactgaatctcaaaataaatatgttggcattagctcgttgggactgcccggaaaataaaaaattcgattttttcaagcgtccgcttggggtactgaaacaattatggaggagcatatatccaacgcataattaaagaaatagttataggaaagctattccggaaggattcggcctcaatataaatctgattgcataagttcgtaggggactgccccgaaaatgaaaaaatcaattttttcaagtgttcgtttggggtactctaagaattat

SEQ ID NO: 470 - DNA, 1352 bp, Heterodera glycines
cataaacgacaccattttacttagctcagcgaactgagtctaatggtaccgcatacgcacggtttcgttaaattatcggcaaatgccaaaagtgtcaatttggtgaccactgaatttaaaaaaaaataaattgacactttcggtatttgtcgaaaagtcgacaaaaccatgcgtatgcggtaccattagactcagttcgctgagctgagtaaaatggtgccgtatatgcgcagaaccgttcactcttgacagatgccgtaataaaaaaatttctaaaatttgtgaccaccaatctttgcgtatgctttgcgaaaccaagctaattttgtaaattattgtattatcctctcaaaaaccaaccattgcacatttgaagtatgtaaaaacaattcatttttttccatcgaaatgtttgttcaccaaaggatcgaaacgtagcgaaagaagtgccaatttgaggccgagttgagtgcgatcaaaaagggaaaatgctgaaaatgttaagaattaaaattgtaaaaaaagcaaaattcctaaaaagcgcacttttacaaacaaaaaaacagaatttgaaaaaaattggtgaacactgatttctttaaaaaaaattgacacttctgctatttgtcttaaagtgaacagttctgcgcgtattctctactgttttactcagctcagcgagctgagtctttaaatcaaaaaaacataacaattaaacactaaaaacgggggcttttaaatcaaaaaaaaaaacgaatttgaaaaaattttaatttttagcgttttttacgcaaaaattcattgaattggaggcccgtttgtttggcacaaaatccttaaaactttgggaaattaaattccttaaaaacactcttagcaaaaagtaaccaaaaaccaaacagctttataaaaaatcaaaaaaaaaaacttgccgaaatttgaagaaattcgctttttccatcgaaatgtttgtcgaccaacgcattaaaatgtgtcgaaaaaagtgccaatttgaggccgagttgagcatggtcaaaagagggaagaatgtccatccaagcattgtgcgcagttgctgaaaatattaaaatataaaattgcaaaaaaaagcaaagaacctaaaaaatggcctgaatttggttttaggcaaaaatcatttgaaaatgaaggcccctttttggcacaaagacaacaaaaaatttgtcctaaagtcgccaaaaccgtgcgtttgcggtaccattagattcagctcgctgagctgagtaaaacggtgccttatacgcgcagaaccgttcactcttcgacaaataccgaaactgtaaatttggtgacctactgaatttttcaaaaaa

SEQ ID NO: 471 - DNA, 2990 bp, Heterodera glycines
  misc_feature (14)..(14): n is a, c, g, or t
aaaagcaaaattcntaaaaatcgcacttttacaaacaaaaaaacagaattttgaaaaaaagtttttattttcagtgggttttagacaaaaaacgtttgaaattggaggcccgtttttggcagaaaatccataaaaaacaataaaacccctaaaaaacaattcacttttttgttgccatcaaaatgtttgtccaccaaaagctcgaaacatggcgaaagaagtgccaatttgagaccgagttgaagtcggtcaaaaagggaaaatgtccattcaaaaagttattatgtacacaaccagctgaaaaaaaatcacaaaaaaagccaaagagggaaatatggatatttttatataagcaaatacccgggacaacagtgattataagagaaaaaacttggaaatacgatgattgaatatttatttaaattaaaaaattattttttgacaaattctaattgaaaatgcaaatgaattatttaattgaaaaacaaataaatatttaattaaaaaaaacttattaatcataaaataacttaatttaaaattaaaaaatttttaattattaataaaagcaaaacatttaaattaataaaagcattgaaaaataacccaaaatataaagaaaaataatgtacaccgtccggcttcgaacttgccccacccaaaaaaattatgcccagaatccccaatcacacagggattctgaggtttaacgatgtcttagatgaaatctgatcttcgcgctttggtaacttcgctacctaggaacagaagaggtacaacagtgatgagaagaggtacaacagtgatgagaagaggtacaacagtgatgagaagaggtacagcagtgattagaagaggtacaacagtgattcaaagaggtacaaccatggtttaaatgaataaataagagaattgttttattaaatataagagtaaaaattggatgcattaaaaaattttaaaaataaaataataatccttttcattattaaaataaacttttaaatgtataatatgaaaaatttattgaaattgaaaggaatttatttgttgaaaagtctaattaaataaaacttttattcatcaaaaaaattaaacataaatcaaacaaagaatatttaattaattataacaaataaataattaattttaatacaaatcatttatcaaaaattttttatttaaattttaaattaaaatttttattaatttataaatcaaactattttaaattaattaaaaacatgtaaaaataagctaataatatatagaaaaataatatacaccgccctgcttcgaactttcccccctcccaaaaaaatgatgacccagaatccccaatcacacagggattctgaggtcttaagtatgtcagaagtaaaatctgatcacgtattcgtgatcagcgtcctaaattggcccaaaagacatatttttggaatattttcggtgaaaaaatttttccactcaaaaatcctggtcacccccctttggtcccgaaccccaaaatcacttttatttctataacttttttcaaaaaagtgataaaaagctaaaataaaatttataaaatagagcaaaaaattgcggatttttatattattttacttttccaaaatatcttttcagaaccgagttcagaattttttactgaaaattcgaatttttccagaacttctggaataactttttttagtttcatgatagaaaatctaaataaaacccataaaattctcctgattttttgctatttttaaagctttgttgtatgaaaattgacttaccctgaggttagttatgattttcaaaatttaccccaaaatcccgagggtcaaaaaaattggaaaaaatttcgaatttttagaaaattctaaaaattatgaaacgaaaaacaaaggtcatattcgtaatcagcatctcaaaataccacagaaaaaaatttttcaccccccttttcaacccaaaaaaaattttcaaaaatttctagggggcctagctcgaaaatttttgaaaatttccgaacatttagtacaccattcgatagaactttaaaagctctacaattttgccctagggcaatttttggctataaccaacccccgacgagttatgggcccgggactcaaatgtcccgctgaggccaaaatttttttctatttccgtgaaaaaatcgaaatttttctaaaaataccaccaatcgatagagctcgaaaaacgatgttttggaagtggtctccgttttcccgggaaaaatcgttaaaaaatcttaaaattcaaaaaccaaaaaatcgttttttaggcctagctcgaaaatttttgaaaattttcgaaattttaaaatttgcaaaaatcgagctcattgagctctacaaaaagtctgctggcgccccctggcttagatcaaacccgggcgtgctattcgcctggtactgaagtgtccaaaaaaagtgattcttacgttgcctaacctacaggtcaggcctttgatctgatcgaaaaatttttgctggcaaagttgtaggccatagttggggcatttcgcttttggggtccgctaagctctgaaagcaaaagcaaaaaatttcgtaacactgagactggcggcaaagtcagttttcgagccgctgggactcagttggccaccggaccaaaaaatccgtatttttcccggatgccccgtcccagggtgcatatgtatgcaaaatttcagcctcctacctattcccgatcccgagaaatcggttttagcaacgaaaccccttacctatataacatatatataactagcgtgttggaattgacgggggcggcgtaggcaattggcttttggatgaagagaaaatggacatgctcatttgttattttaaaacatacaaaacattaattgcattagtgtgctgttttaaagcgctatcgcgtatgggggacgcggcttcgccgcgtcgctagaaagtgatgttatttagaaattcatcgcagcctcaggacgg

SEQ ID NO: 472 - DNA, 5593 bp, Heterodera glycines
ccgaattggacagattgatcgagttgggtgttctccatttgttgactacagcagatgggccgcaccaattgtggcagtgcgcaaagcaaatgggaaagtgcgcatatgtttcgactttagcactggactcaacgcggcactcgaaccacatcatcacccgctcccacggcctgagaaactttttgccaaattaaacggcgcaaaaatattttcccaaattgattttaaggacgcttatttgcaaattagcgttgatgaacagtcgcgtcaactcttaggcgttaacactcacaagggactttatcaatgccaacgcctggcattcggaatcaaaagcgcaccaggcatttttcaatggacaatggatcaattggcaagcggaattcctggtgttgttggctatatggacgacttcatcattgcttcaagcacagtgaacgagcatttttcaacaatttttaaattttttaagcgaattcaagaattcgggttccgaattcatatggacaaatgcaaatttttagttaaggaaatcaaatttttgggtcaaattgtttcgtccgatggtatccgtcctgatcaaaacagaacacgagcactgcaggaaatgccagcaccgacggacatcacaacactccgatcattcctcggggcaatcaattactatggaaagtacatcaaaaacatccatcaaatcagagcaccactggatgaattgctcaaacagggagtggaatggcaatggaatgaaaagcaccgcgaagcttttgaacaagcgaaatcaattcttttgtccgatttagccttaacgcattacgacccaaatttgccaattattgtcacagctgacgccagcaacaaaggaatcggcgcaacaatttctcaccgttttccggacggaaaagaaaaagtttttcaacatgctgcccgaacattgtcaaagacggaacagaattattcgcaaattgagaaagaaggacttggactcattttcgcaattcaaaaatttcaccaatacatttttggtcgaaaattcattttacgcactgatcaccgtccactgctggggatttttgggtccaaaaacggaatcccgattttttcagcgtctcgtctacagagatgggcactgattctactgaattacgacttcagcttggaattcgttcgcaccgacaacactggacaggcggatgtactgagtcgtttgatcagcgaacagcgcaattctgcagcaagcgaagacatggtcatcgctcagttgtgtgcagaaactgagtcggaagttgagcatcttttgaatgtgcagttggaacaacttccggtgacagtagacgaaattcaaacagcacaacaggacgacgaattgatcagggaagtgatcaaatttactcaaaacaaatggccaaaccatggcattaatcccgaaatcaaaccgtttttctcgggaaggcagaaattatcaattgtttcaggatgtttggtgtttaatggtcgatcggtcatacccccatcactcaggcaccgcgttttgaaggcacttcacttggcacatccaggaatcgttcgcatgaaaaatctcgcgcgaactcttgtgtactggccttcgatcgattccgacatcgaagaaatcgtgcgaaaatgccgccaatgtcaagaagcagcaaaacaaccgcaaaaacaaccgctacaaccatggccaacaacaacacaagttttccaacgtgttcacattgacttggcaggaccttgtagtgatggaaacacgtatttggtaattgtagactcattttcgcggtggcccgaagtgtttatgcttcgccacacgtcatcacaacatgttattgaacaattacaatggctttttgaccgatttggcattccgaaaacgctagtttcggataatggtcctcaattcagttcatcccattttaaagatttttgtgacagtaacggcatttgtcatctcttttcgccaccataccacgcacagtcaaacggagcagccgaaaagtttgttgatttcttcaaaagacagttgaagaaatgcagtggggataaaaattggttgaaacaatcacttttgtcttatcgctccatcccaattgcagttttaaacaatcgatcaccagcagaactgttcctcggccgaccactcaggaccaaactttcgctcatgaaaccggaacggccgaatccattcttccgaggcccgtatcaacaacgcatggcacaacagtttgataagaagcatggagcaaaaagggtagagtttaacatcggcgacaaggtgcaatttgtgaattaccgtgatggaaaaacattatggttatttggggaagttgtcaccaaaaaagggttaatttttggcattcgttccccacaaatcgcaaacagaattgtcactcgccatgcaaatgccatacgactcacacaagcattgggcactgatcaaacatggccaaattttgatgaagagcccaagaagaacaaatcacccgttcgagcaccacaaattcagcgaaatgtcacaccaacaccaccagccgaaagaaaccatgatcaatttgaacagaacgaagaagaacagaaccaacaacaaacaccagtgttgcggcgatcagaaagggttacaaaacgtgtccgtttcctgagtccaaggatgacgggacaacgacacaatattcgccagtgatcagacttttaagagagggaggtgttgtgtgggcaatcatggacctattatttatatttgtatgcattcctttttcctcttccaaacattgtactctgtacccaatcaataatgccctccacagaccaagtgcataaatacccttcgcttctcctctccctcgtctcttctcccattcattattcaaactcattcctcttccgacttctctcatcacttcttattcccttttcatttattatttgttgtgtgtgaaaataaagtttttacaaagacacaacaaaacacatcccctcccgacagtaaattctttaaactaaatttaacgattttaaatatgtacaattaattattagatgaccaacagcaaactaatccatctcaacaacgggaaggtatctgcgataattgaaaatattttaattatttttatttaattattaggtaataaccagcagtcaaacagcagcgccctcaagaaatgaaattttttttcaattattatttgtttcaggtgctcagcagtaacgcaacctgactctttaaagcattaaaacggaaaaaggaaaagccgaaaaagaaatcataacgctataaataatagactaattaaaagcatttaaatttataatttttttattattatgacagtaaccactggccttagttctatttttcataaatatttatcgcataaaaacccgataattaagtaagaaatttgttttaacaaaacaaatatttttttataaagcattagagaaattttctaatccatgtgcaaaaaaaaaagagcttttcgagtgccctcccctaaaaattttttctgggtactgtttcctatgatttttttatcaatacattttgtgcaattttggccatttaataaatttgaatttttttaaaaatattaaaaatttcaattccaacgtggactaagattaaaaaatgaacccaaattaagaagaaaaaaaatgaaaaaatttatatggaaatgcaaccggttcaactctagctaaattaagatgaacatcaaattatgtcaaagttcttttggcaaggatttcaaaatggtcgggtgaaagtggataaacgccgtagttatcgcgagatcttgaggagaattaagcttgaacttcaaataaaagggttaatttttggcattcgttccccacaaatcgcaaacagaattgtcactcgccatgcaaatgccatacgactcacacaagcattgggcactgatcaaacatggccaaattttgatgaagagcccaagaagaacaaatcacccgttcgagcaccacaaattcagcgaaatgtcacaccaacaccaccagccgaaagaaaccatgatcaatttgaacagaacgaagaagaacagaaccaacaacaaacaccagtgttgcggcgatcagaaagggttacaaacgtgtccgtttcctgagtccaaggatgacgggacaacgacacaatattcgccagtgatcagacttttaagagagggaggtgttgtgtgggcaatcatggacctattatttatatttgtatgcattcctttttcctcttccaaacattgtactctgtacccaatcaataatgccctccacagaccaagtgcataaatacccttcgcttctcctctccctcgtctcttctcccattcattattcaaactcattcctcttccgacttctctcatcacttcttattcccttttcatttattatttgttgtgtgtgaaaataaagtttttacaaagacacaacaaaacacatcccctcccgacagtaaattctttaaactaaatttaacgattttaaatatgtacaattaattattagatgaccaacagcaaactaatccatctcaacaacgggaaggtatctgcgataattgaaaatattttaattatttttatttaattattaggtaataaccagcagtcaaacagcagcgccctcaagaaatgaaattttttttcaattattatttgtttcaggtgctcagcagtaacgcaacctgactctttaaagcattaaaacggaaaaaggaaaagccgaaaaagaaatcataacgctataaataatagactaattaaaagcatttaaatttataatttttttattattatgacagtaaccactggccttagttctatttttcataaatatttatcgcataaaaacccgataattaagtacgaaatttgttttaacaaaacaaatattttttataaagcattagagaaattttctaatccgatgtgcaaaaaaaaaagagcttttcgagtgccctcccctaaaaattttttctgggtactgtttcctatgatttttttatcaatacattttgtgcaattttggccatttaataaatttgaatttttttaaaaatattaaaaatttcaattccaatgtggactaagattaaaaaatgaacccaaattaagaagaaaaaaaaatgaaaaaatttatatggaaatgcaaccgcttcaactccagctaaattaagatgaacatcaaattatgtcaaagttccatcgtaattgttttcaagaaatcatgtcgaatgcggatttgggataaagaaatttagaaatattgttgaataaatataatagcccaagatagcgccattttaggtgcgcaggatttggatggttgccaaaataatgtctcaacggacaaagtggacatcataaaaagcagtgttatcatgctgtgaaatgattttgtttcgctgtagtgtccagcgtgaagacaccatgaaggccgcattccgttctcatataatccctttctttttatcagtaatacccataagcagtcgatcatgcagactttttatcaagatttcaaagtaaaaaatgccgtgtaagctgttcagaaaaatcggatg

SEQ ID NO: 473 - DNA, 1714 bp, Heterodera glycines
ttataaagcattagagaaattttctaatccgatgtgcccataaaaagagcttttcgagtgccctcccctaaaaatttttcctgggtactgtttcctatgatttttttatcaatacattttgtgcaattttggccatttaataaatttgaatttttttaaaaatattaaaaattttaattccaatgtggactaagattaaaaaatgaacccaaattaagaagaaaaaaaatgaaaaaatttatatggaaatgcaaccgcttcaactccagctaaattaagatgaacatcaaattatgtcaaagttcttttggcaaggatttcaaaatggtcgggtgaaagtggataaacgccgtagttatcgcgagatcttgaggagaattaagcttgaacttcaaataaaagggttaatttttggcattcgttccccacaaatcgcaaacagaattgtcactcgccatgcaaatgccatacgactcacacaagcattgggcactgatcaaacatggccaaattttgatgaagagcccaagaagaacaaatcacccgttcgagcaccacaaattcagcgaaatgtcacaccaacaccaccagccgaaagaaaccatgatcaatttgaacagaacgaagaagaacagaaccaacaacaaacaccagtgttgcggcgatcagaaagggttacaaacgtgtccgtttcctgagtccaagcatgacgggacaacgacacaatattcgccagtgatcagacttttaagagagggaggtgttgtgtgggcaatcatggacctattatttatatttgtatgcattcctttttcctcttccaaacattgtactctgtacccaatcaataatgccctccacagaccaagtgcataaatacccttcgcttctcctctccctcgtctcttctcccattcattattcaaactcattcctcttccgacttctctcatcacttcttattcccttttcatttattattttttgtgtgtgaaaataaagtttttacaaagacacaacaaaatggcgcagtcagcctaggtatttaatatcatcaaaaagcaattggcagcaagtcgaatattctttaattctaattttattcgaacactcatttcgcccttccttttcccgtaacacatccttactgatcgttaagtcgacaagtagaccgctgacgttaacagttaaggaaaaggctttcttgaaatcgcaagccgtaaaaagcctctgtgatcactcttggaagtaaagtcggaattgggaacacacaagtcaaagcgaccgctgtatgcagctcaaattcgcaacttcccatttcaagggcttgtcttttcctgtttcattaacaatcaccatcatcactatcaccgaacttgcctgccaattaatcatcattcaaatataaatatctgacggccaaatcattcatttcatttcaaaatctctctgtcatgtcaatcacctcggaacaattaaaagccattttggctgaccaacaaaatcaatttgtcaaattgctacaaaacatgcaattaaacaccggccaaggacagcacaatcaagcacagtcctctgatatggacttgttttgtaaattgagtggccaaatttcggaattcctttacagtccagacgacaaccacacgttcgaggaatggtacgagcgattcggtccttttgtcgaacaggagggaaagcacatgctggacca

SEQ ID NO: 474 - DNA, 1005 bp, Heterodera glycines
  misc_feature (40)..(40): n is a, c, g, or t
  misc_feature (95)..(95): n is a, c, g, or t
  misc_feature (109)..(110): n is a, c, g, or t
ggaaagcacatgctggaccagaataaagcgagactcatgntgagtaagttgggccctgacgagtaccgccgcttcacggaagtcatacaaccaanaaacaccggatcannagtcggtttgaatgagacgttagcaaagttgcgacaaatttttcccgaaatcaaatcaatttttattaagcgcttcgaatgttttcagcttaagtgtggacaaaaatcaagacgttctcgcatttggctcaacagtgaatgccatggccgaaagatcgaaactggacctgactaaagaccaaatcaaatccctcatttttgtgacaggtttgggagatcacaacatggagttgcgacaccggtgtatcaaattgttggacaacaacgcttcattcgaccagctcctgtccgagtgcaaggaagtcattgcccttcgccaaagttcggccgcactttccagcaaacaggatttcaattccaatgcaatccaaattcgtccgcataaaattcaggattttccaaagaaaaggaagccgtcgcacacacgcacaccgtcgcgcacacgctcgtggtccagtcaaccaaacaacaactcaaacaccccgcatggttgaacgcgtcaatcaaggacatttccaagcagtccatgcacacgatgtggtggtcgacattggaattcggactgccggtatccgatttcggttgtgtcacatttgtggtaagaccgggcacatttcaaccatttgccgggctcggaaacccaaatcaaataattttggcaaaaacaccaatgtagttgagtgtctgcacattacgccaaccgaatggcaatgctcatggtcaacagcaaaagtcgaacacgagccttacattgaacaggacgtggaatttgggacaaagagcgtaaaaatggttgcggacaccgggtcaaagttgacaattttgacaaaggtaacatggcataagctgggaaaaccgaagttattcaaaacaaatttgtgtggtcgatcatata

SEQ ID NO: 475 - DNA, 5392 bp, Heterodera glycines
tttccaatatttttccaaataattttaatccaatttgaattggtttaatgaacttcctttttaagtgcgggattctatgtaataaattatactttttcataatttcttatcctttattcataaaaatgacaaacccttgaagtaattatgtaaaccttcatatagtttaagagtatttccattttttaataattactaacttcatttaatgttgccatgtaaatatgttttaatttttatttatctaatcgctttcaaatataaatttcaaataaatttataattcaatttaatccaattaaatttataaattggcttacgcaatgtgatttatcctttctaacttaaactcgctgtacttgatcatgttgttacattttaccatgcggaacattatacaacaattatcatattgctttgtaaaaatttttacgttaatgtgtgaataaaataataataattttgtatagttttttcattatgtattgaaaataatattttttcgacttaaatttcatctttcttttacttattttttagccttatttttaaaattttctgtttttgatacgcgctctcttccttcgcttctgtaaattaatatttaaaaatttgagctcaatagctaaatttatttgaaattaagatgaattgtattatcattttatttttatgattttatcaatttagaaaaacctgaagtcttcttttattttgtttatgttttattgatatttaaaaatttttggtctcatgattaatatacacaattgttgtgttcgttaattatttgaattaacgccaaaagatgctcgtttatcgatcatccttttgacccttcgtgttgtccatttaaaccccccttttccctcattccgtgctttttctccctcattcatttgttgtttccatttaattgtgacccgctccctcccttcgctatttattatatttatttgtgtggaataaatcaatattattccattgactgttgaacggacacaacagttgttggcgcagtcagcgaaagcaaagacgagcgaaacaaaagtggagaggaacgacgcaacaaatcgtcaattggaattgctaattccgagttggaatagcaattgccaaatcgtctgagaataaagctaattcccagtggaatagctgcatacccaggaggttgcattctcaattactggtgttaatccgagttggataacagccagacgtcaatcgccgaatttggagaatttctacattcaattgttaatccgagacggataacaattgcgaatcactgttaattcgagttgaataacagtgaccgtccatcatcaatttcattgttaatccggttcggataacaattgacaatcactgttaatcccagttggataacagttgaccatccatcatctttaatttgatcctagtttggacaaattataaaacgcaacaatggcagcggttgtaaaggctggcaaaggaccaggcccttatacatcggaaacgtcgtggaccatttgggaagaacgatttgagtttttcatcaaactccgaggcatcactgatgcggagacgaaaaaattgctcttcttctcggagattgggccaatatacaaagagcttcgccaaatggcgttgccagacgacgtccgcgacatgtcaattgatgagatcaaagcgctgatggaggaacgatttggcgagacgaagacgattgcggcaaaaaggtttgagctgttttcagccaaacagacgttaggactgtccattcgggattactcaatccaacttcggaccttaattgccaaagctgaatggcataaggattcagtcgacatgtgcctgagcgctcttttcatcaacggccttaaaaaggattcaattcgggccgagttgataaagaagggagtgaacgaaatgaagttcaaagatgccgttgaaacggcagtgcttctcgagcagtccgacttggacgcagagcaaatcggtgggcataagaaagcggaagtggcgaaagtctttgctccaaagggaggaagaaagagtagcgcaccaacgcagcaaatgcaatgccatcgatgcgggaggaatggccaccgcaacaacgagtgcccgaacaaggactcaaaatgccgaaagtgcggcaatgttggacactgggctgtgatgtgcaagacaaagcagggctccaattggccaaggaggcaagggaagccggttcaccaggtcaacactgaaagccaaaaagcacacgatattggaacactggccaagtctgaagaagtcaaatcgatttcggtgccaccagcgatgataaaacttcagctgagtaaaaaggcgacagatttcgaattggactgtggcgcagatgtcacactcatcactaagaatgattggatgtccatcggaaggccgaaacttggacaaacttcaggattgatggcatatggaaaaaagccgatcaaagtccttggatcgttcaaaacggatgtggtgtacaacggcaaagaagtgaatgccgaaatttatgtcgtggacggcgaaggcaaaaatttgtgtgggagagatttgatcggtgaattgcaaatcgatctcaacaaagcgttcggaatccgatcgatcaatgaagtcaagtgcaaggcagtggatcgagagctgggagcggtgcttctaaagtacggtgaggtcttcaatgacggactcggccgatgcacaaggcaaatttcgttgaaatttaagccggaagtgcaatcgaagaagtgcaagccacgccccgtgccttttgcattgagacccgaagtggagaaggtcatcgacaactgggtcaaagatggagtgttagagcaggtgacaacgtctgagtgggcaacaccgttggtgattgtacccaaagccggaaacaaaattcgcttatgttgcgactacaaagtcacggttaatcaatggctcgacattcatcaatacccgttgccgcgcccagaagaattgttcagcgtgttgaacggaggcgaaaagttttcaaagttggatttgaaggaggcttatcttcaactaatgttggatgataaagccaaggaatgcttgaccatttgcacgcataaaggcttataccaatttacgcgtatgccttatggtgttgcgtcagcgccagcaattttccaacaagtgatggaagacgtccttcgtggaatcgacggagtcgccgtctacttggatgatattgtggtgacagcccccaacgacgcggaacatttgaaacggctggaaatgactctccaacgcatccaaaaatttgggttgcgtgtcaaaaaggaaaaatgttcctttatgcaaaagcaaattgcttatttggggcacatcatcgacaaagaagggattcgaacgtcgccggacaaagttgaggccatacagaaaatgccagcccccaaaaacttaaaggaattgcaatccttcttgggcatggttgggtattatggcaagttcattccgtcaatggcaacaatttcggagccgttgaacgagctacgccgatcagagaccaaatggcattggggacaacaacagcaaaaatcattcgaacagatcaaaattatgctgtcgtcgaacgagctgttggcccattttgatcccaaaaagccactttatttggcaacggacgcatctgactatggagttggagcgatccttttccacaaagatggaaacacaggaaagtttggcgtgatcgcatacgcctcaagaacattgagcccagccgaaagaaattatgcgcagaccgaaaaagaaggacgcgcagtaatcttcggcgtggagaaattcaaccagtacttgtacggtagaaaattcattctacagacggatcacgagcctttaaaaaggatttttggaccaaaaggtgaattgcccgtggttgcggcacgacgacttcatcgttggagtttgaagctcatgaattatgacttcgaaatcgaatattgttcgacaaaaaatttcggttacgccgatggattgtcgcggttgcctagtccagaaattgatcaggtctgtaaggaaagtctcgagctgaacaaaatccagcaggagagccaaaacgctttgccgattactgcgaaggacattgcgaaagaaattggcaatgatccggtcttcgcaaaagtaaaaggttttgtgctcaatggatggccgacaaggatagaagacgagaaaattcgcccattttttctggtaaaagacgaattggagctgaataacggatgcctaatgttgggatgtcggacagtgattccgagcaaattccgtgagaatcttttgaaattgatccacgagacgcatccaggaatcgtccgaatgaaggcattggccaggcaaaaagtttggtggccgggcatcgacaaagacattgaaagcatgaaaaagaagtgcaaaatttgtcaaacgaatgcgccggaaatgaggaaagtccctctccatccatgggaagtgccagaaaagccatggcagcgacttcacattgacttctgtggcccatttttcggaaaaatgtggctgatcacggttgatgccaagacaaaatggccagaagttgcaatgatgaaaagtactacgaccgaggccacgattgaggcacttcgaaaattgatttggacccacggattgccagaacaaattgtgtctgacaacgggccgcaattcgcgtcaaaggagttcgaagaattctgctccaaacgcggaattgaacgaacgctgacggcaccataccacccgcagagcaatggggaagctgagcggtttgtccaaacattcaagaaaggaatgttattggtaaaaaaagacaccaactgggacaacgaattggcaaagaaccaattcttactcaaataccgagtaactcctcattctgcaacaggacggtctcctgcagaaatgatgttcggcagaaagctgcgaacactgctcgacctcgtgcgcccgtccgaatcgaccaaaattgaaggaggagaagagaaggcgaaagaaaatgctgaaaagcatggccaaaaatatttggctcgcgccaaaaagaactttgatcgacggacgtggaaacgatcgtttaaaactggacaaagagtctttgccaggaattacagagacggttcgaagtggatggcaggccaaatcatgagccaaataagcccatcactgtttcttgtccgaacagcccgtggggtctggaagcggcacttagatcagctgaaatcggacgagacgaagcctgatctggagagcaacaccgacgtggactcaacatcgtccataggtgatcagacggaggatgaaaaggacggaggacagcagacggacgtggaagaagagccgaatgatccgccaaatttgcacgatccgcccattgaga

SEQ ID NO: 476 - DNA, 3773 bp, Heterodera glycines
gtccgtctcgtcgtcctcaggccggcgggaagcgcgtgattgtgtggctcaggtccggcgcgatcagcagcgtggcgcccgtgttgttcttgccggtgtagcggggggccgagaacagggtgatcaggtggcgattcgcgaagtattccacgccgtccatgacgagctgaaaaagaagggaaggggaaaaattattaaagcaaaagtgaaatgaaaagccaaaaaaaaaatcacttgatgcgctcgaacgatgtagtcgatgccgagcaggttgcgcacgctctcgaccacgtccgcgccgaacatgacgccggctcctctggtgttcgggatgacgccacgaactccgcgtacagggtccgaccacaaaagatcggtctcgagcgtccgaagcggcgggtcgatttgcggacgattcaggcggctgagctggtcaggctgcggatctgatcggagatgccaccgtgcatgcctgaaaatcagttggaaaacagttattgacccccaaaaattgccctcccccaaaacttacagaggatcttctcgccgaccagtccgacgaatggcatccaggcgaagacttgattgaagaggtcgaagagtcgacgagcgcccggtcgcgggtaacggcggtcgatctcatcgtagaagccatacctgaaaatggggggggggaatgattaatcacaaaaaaagacacacaaaaaactttttcacttacactctgttgatgttggcgcactcgtggttcccgcgcagcagcatgaagttggacgggtatttcacctgaaaaatggggggaaatgaattacattttttgggggttccctccccccatcccccaaaaaccacaccttatagcagaaatgctgccttcgcggctttgaagagctggcggatttcatcgtcactgatctgttggggaaaaaaggggggggggggaaattaatatttgaaaaactcaaaaatttttctacctcatccgtgaagcgatgaggaggcgaacggttgacctttgcgatgatcgcgtcaagggaggcgcttgacagggttccaccacgaaggcgcaatacgagatgaagagtagactccttctggatgttgtagccgggcaaggttcgtccgtcctcgagttgtttccctgaaaacaagggatttgtttaaaacaatggttgcctgaaaagcaatttggtcaaaaaatccaccggatttcaactgaaaagcaatttggtcgcgtaaaagcaaaactgatcacaatttggtcaaaaaatccaccggatttcaactgaaaaattttcaagtttctggaacagattccaataaaatacagacactaaataaaacaattaaaagtttctgttcctaaacaagcatagaaataaaagatatgtgcatttatttgtgcatatgttaatatatgcaattttcattaatctccctcctttttatcacagtggagaattgggacaacagaatgatatttgggtttagatttccttcgcaaacagttttttctcctaattaatttatactttgtgccaacaaatcaaatagagttcccatcccctgaaataaagcccccccccctttttgagatggattgaaaaatagagccccagggggccctatttcaagaaatacggtaactttttaaatgcgcaaatatttgaatcccgagcggcaatttttctatcaagaaatcccggcacattttgccaatcccgagcattaacatgctctaattagtgcccggacagtgtagagttttctagttttgcatttttaagcaagcactgccgcttccgttgacaatagcacacaatccaccgccgtggagcatatcgcttttcaaacaccaaatggtatcaattggttaattaattaattacataattaattaatagcatttatattaattaacgtacactaatggcattttaattataaaaatccttttaaattaaattatttcggctccaatgcaatttacgcgcccaatcactgaccaacctcggtttcttaagccataactttttttttacttggtcaaaacttacattcttggtatcaatcgagagcttaaagttcactgaagtttttgtatagaaaaatgcctggataaaagcaatagacaaaaaattactgttgaatatacgcgaaaaatgatgaattcaggtttttttcattgaaatttttttcgtaatgcaaatatttgctcttttcttgtacttataaattctcgagactttaagctttcaattgataccaaggatgtatggattgaccaagtaagaaaaaagttatggcttaagaaactgaggatggtcattgattggacgcgtaaactgcattagagccattatttttgctcaatttttggctgaaaattatgtcactatttcggacttcttgtcactatttcttcactattttggcatttttactcactattttagttaactattttttgaaaaaacgaattttgcctatttttttttttgcttacaatgtttattcacacacacatagcatatacatacatacattcacacacgcaaatattgaaatgacaacagtttttgggggagttcatcatgtgaaatgggggtttacaatacaatacaacaatggggggtcagatgatccgatttctccacacgcatcgctctccgggcagttccaccatccttctgtgtgcagttagtgtgtgtgcgcgttctgtccgtccgtctcgtcgtcctcaggccggcgggaagcgcgtgatatcttctcgccgaccagtccgacgaatggcatccaggcgaagacttgattgaagaggtcgaagagtcgacgagcgcccggtcgcgggtaacggcgctcgatctcatcgtagaagccatacctaaaaatgggggggggaatgattaatcacaaaaaaacacacaaaaaactttttcacttacactctgttgatgttggcacactcgtggttcccgcgcagcagcatgaagttggacgggtacttcacctgaaaaatggggggaaatgaatttcattttttgggggttccctccccccatcccgcaaaaaccacaccttgtagcagaagaggaggatgatcgtctccatcgattggggccctctgtcgacgtagtcgcccaggaagacgtactgctgctccggcgggaggccatgcgttgagaagatcttcttcaggtccgcgaattgtccatggatgtcgcccacgatgacggccggcgggtggattctgacgagcgtatcctgatctcgaaatgctgccttcgcggctttgaagagctggcggatttcatcgtcactgatctgttggggaaaaaagggggggggggggaaattaatatttgaaaaactcaaaaatttttctacctcatccgtgaagcgatgaggaggcgaacggttgacctttgcgatgatcgcgtcaagggaggcgcttgacagggttccaccacgaaggcgcaatacgagatgaagagtagactccttctggatgttgtagccgggcaaggttcgtccgtcctcgagttgtttccctgaaaacaagggatttgtttaaaacaatggttgcctgaaaagcaatttggtcgcgcaaaagcaaaactgatcacaatttggtcaaaaaatccaccggatttcaactgaaaaattttcaagtttctggaacagattccaataaaatacagacactaaataaaacaattaaaagtttctgttcctaagcaagcatagaaataaaagatatcgcatttctgcat

SEQ ID NO: 477 - DNA, 2093 bp, Heterodera glycines
gggggtcagatgatccgatttctccacacgcatcgctctccgggcagttccaccattcttctgtgtgcagttagtgtgtgtgcgcgttctgtccgtccgtctcgtcgtcctcaggcaggcgggaagcgcgtgattgtgtggctcaggtccggcgcgatcagcagcgtggcgcccgtgttgttcttgccggtgtagcggggggccgagaacagggtgatcaggtggcgattcgcgaagtattccacgccgtccatgacgagctgaaaaagaagggaaggggaaaattattaaagcaaaagtgaaatgaaaagccaaaaaaaaaaataaactcacttgatgcgctcgaacgatgtagtcgatgccgagcaggttgcgcacgctctcgaccacgtccgcgccgaacatgacgccggctcctctgttgttcggggcgacgcctgtgatgctcgtcgacgggtcggcccagaggaggtcaatttccagcgaacgaagcagtggctcggtctgcgggcgaagcaagttgctgagctggtccaggctgcggatctgattggagatgccaccgtgcatgcctgaaagtcagttggaaaacagttattgaaccccaaaaattgccctcccccaaaacttacagaggatcttctcgccgaccagtccgacgaatggcatccaggcgaagacttgattgaagaggtcgaagagtcgacgagcgcccggtcgcgggtaacggcggtcgatctcatcgtagaagccatacctaaaaatgggggggggaatgattaatcacaaaaaaacacacaaaaaactttttcacttacactctgttgatgttggcgcactcgtggttcccgcgcagcagcatgaagttggacgggtacttcacctgaaaaatggggggaaatgaatttcattttttgggggttccctccccccatcccgcaaaaaccacaccttgtagcagaagaggaggatgatcgtctccatcgattggggccctctgtcgacgtagtcgcccaggaagacgtactgctgctccggcggcaggccatgcgttgagaagatcttcttcaggtccgcgaattgtccatggatgtcgcccacgatgacggccggcgggtggattctgacgagcgtcggctgcattcggaagacgtccgtggccgctttgcagagctggcggatttcatcgtcactgatctgttggggaaaaagggggggaaaattaatttttgaaaaactcaaaaaatttttctacctcatccgtgaagcgctgaggaggcgagcggttgaccttcgtgatgatcgcgtccaggaagccggttgacaggccgtctccttgcacaaggtccgatgccgctcccgattgacgccgagactgctcagccgctgctgctgccgttgcgtcgaaacagtaatcctccattgaagttgttgggccgggcacgtccgcttcgtgtgtgatgaagtgttgtagacgatggacgataataataataataataatataatatgagggcgatggagtgaattgtgaggaaaagtgaggaaatgtcgcccttttatacaacttttttccccttaatttcggaatttttttgcttgtctatataaaggcgagcattgcaaaattttctctcattcattgcgtccgttcacattttaattcttcaattatgcgcaagatcgtctacttcaaactgttgcaaattgtgctcagtttggccttcgtgtggcaacttctttcacttcaccaattctgcggcacatttgtctgtccaaaggtgtgctgctgcttttgttgtttttgccaattttcattttcaatttttttgtttaacgctgtttccatgcttttcagcccttcgatcatgacatctctgttgttcactgcaaacgcttttcgctgatcgtaaaggactcaaagacgggcgaattcggcgctgtgttggacgagcgcataatgacacaccaggattcagagccctcatagcttactagctaacctctaagcaaagttatgccatgttttgtcgaaaaattcgctaaaatctttaatggtacgaaacgaccctgcacgacttgaaaatcttgtt

SEQ ID NO: 478 - DNA, 3870 bp, Heterodera glycines
  misc_feature (2799)..(2799): n is a, c, g, or t
aaaaaaaacacttacgattcccgccccctcctatgcagcgccgacgagaaagtgagaagtcattgtgtccgttgttgggcgcactgaagtcgttcgttcgttgattgggtgttgtgtcagcagcaaatgtgcaaatggacaaaaattctccccttttatatgcattttctgttgcactttttttcagtgggaaatttgaatataaaaaggcgtgaaattgagagaaatttcattctcgtcacattcttaattctattctctgcactattacatctaattgctgctgctcatcgactccatcgacaacgacacgcgatggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaagggcggaaaattggcaattcaattttaaaatttttttcaccacccaggctcacgtgatgaccaagctggacacccttcgagacggagacgggaagcacttctgccgctgcttggacctcgggcgcgatgagcaaaaggaccaacaatcgggacaaatgaagaagttcaactacatcgtcatgtcactcgtcggtcgtggcctggacggagtcgtcaaggatgccggcggccgcctcagccttggaagcgcagtcggcgtctcgatccagatgctcgccgctctcagaggactccacaccgtcggctacctccaccgcgacatcaagccgggcaacgcaaccatcggacgtccggaatcaaacgaaatccgcctgctctacctgatcgacttcggaatggcgcgcaaatacaccagggacgacgtgagtttgagtgaagcgctttgaaaaaacaaaaatgatttgttccctttcccccctttttcaggggagccatcaccgcccgcgcactgccaccaacttccgcggaagcccccgttacgctgcgatcagcgctcatctcggacgcgaatacagccgcaaggacgacatcgaatcgtggttctactgcatgatcgagctcttcaaaggcgcacttccatgggccagcgtggtgggcatgaacgaggtgagcaaatgggggagggagggataatcagaattctgatttcattgttttttcagatcggcgaggcaaaggtcaaacgccagaagaaacaaccggaagccgttcgacgccaggcaatcgccgacttgctctccggatgcccgaacgagttcggccaggtcctcaaatacatcgtgagttcgttcgttcgttttttccaaaattagtaaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcggcggaggcggcggaggaggagggggaggagacagctacttcaactgatgagccgtgcagcagcagcagcagaagaatcgccaagaagcgtcaccgtgcagaattgatcatatgaccactattactgtattgtatgtattattttgtgtccatgctgccatccccgatatacacatgtattgtattgttgacacatgtattgattgaaattgttgttgcataactgtgtttgtacatatgacttttggcgaaataaaggacattttgaatggaaaaacggagcaaatccaaatcgaaatgggcaataaaaatgccaatgattgcacaaattagggatttcgatcgaaatttctaaatgagcaaaaaaaatttctgttctaaaaagtcgtgaaaacacgttttatggggtttttagggtcctggtcacgaatctaacattcattttgatcaaattcgaataccggacccgaattcgaataaaaagtcgaaaactcaaaattttcgaaattcttacttttgttcctaaattgatctaaatacgctaaatttagtcaaaaaccattgaaacatcaaaaaattgaaaaaaattttccaaaaagggggggggcatcggtagtattacctaaatttcttctaatcgtttttacgtttattcgatcaaaatgtattaaaatattttatattttttgcttcctactatcgattttaacaatcaaaattatgaggaaacgtggcatttaaaaatttattgctcgatacatcacatatatacaatatacatacagtaattggtgaatgacaatatatacacatatgtacagtgaacaaaagcagggcaaatgaacatagagacatcgttaatcacatacaatacatacataagtataataatatcatcactcagagggcatcacatcacatcaaatgtaccattcgcccgtttgttgctgcggcccttccggcggcggtgtcgctggcggttgcgtcccctgttcttccggcggttgcgtcgtcctctgttcttccggcggttgcgtcccctgttcttccggcggttgagccctctgttcttccggcggttgcgccctttgttcttccggcggttgcgtcctctgttcttccggcggttgcgtcccatgctcttccggcggcggttgcgctcccggtagtattggtgccgtcctcgctatctccatctccacacgtcgacgcacttcctccctgtatcgtgccgggtcgctgcggaacaaaacctgaaattttgnatgaaaatgatatatattcattcatatgccgaagaatcattccacttacggcagcatccacattggccggactgttgaagtttggctccaccaacagcagttgaatggacaccaaaatggactccacggttcggttgcgattccaacgctcggccgcctgctcgtagcccagtggatcagtgccaggctgatgaagaatgctgatgcagactttgccactcgtgtcaactgaaagggacgggtgggggcttttgctgggatttgatgaatcattgcgcgcttttcttactgttcggatgaagaatgtcggtgaggaaagtcattgttggcggataagacgggaacgaagctgggaatttgagcagtgccgtaaacgtgcatcccgcgctaaaaaaaggagaggggagggattaatggggaaacaattaatttgattgatttgcacttttcctctgccgccgccgcccactactcactatggtgtatccggcggaccatcgatgaaaatgcgccatttgaagatctgtttaaagggatgggactgaaatattcgtaacggaaaatcggatcagatcagttcggtcggtcgctgcttctctcacattgccatcgttgatacacgcacggaatccgatgttggcgttcgagttctgcagcagcatttcgaactggcgcatcagcacacgtctcgggctgtccctggcgttggtcctcgtcgttgttgtcatttgcggacggacggagtcgagtcgaacacaacacaaaaagtcacacaccgcagcagcggcgatcggagcggattggcggcagaacagcagcacagagaggtgagttgcagcaaaaaggcgctgaaagagaatggagaggtaacagcaccaacagcaaatgaaggaaagagagggagggcaagtgatgcgaaatggcgtcaatttcgaccaactccgcagcctggacccgaattcgaaccaaaagtcgaaatttcaaattttccgagtttcacatttttggttcaaacccgacttaaatacaaggaaacaaaacataaaagtcatgaatgcttcaataaaaaaa

SEQ ID NO: 479 - DNA, 3210 bp, Heterodera glycines
tgatcactcttttccaatcttccatcaaattttgggcattttatttttttccaatggattagtcctttccaataaaaatggtcttccgttgcccggtcaaaaatgccattgacgatggcccatcgtccgtccgttgtccgtctgttccgccaacggtctgtcaactgcgacccgcaatggctgatcagatgcccgggccgagtgaataggatcggcgagcacatagtctacagtgactactccgtgcttcagatggctattgagcacagcacatgggtgggtcggttgatatacgacactcactctgatcagaggatcggcactcactctgatcagagggtctttactttgatcagagggtctttactttgattagaggatcgtcactcactctgatcagagtcccaattgggaaaattcgaattaaatttttgattcaaaaattcttgactcagattttcacttttggaacctttatttttcttgagtagctcgacccaatggtactcatttctctgatcaggtcgctgttggaccatcgccggaacggacggtgcaattggtcaacgaagaagaagaaaaatacccgtaaatgaaaattaatttttaaaacgtttgaaaggagaataaaacataaaaataaaaattaattctttatttttagtataattttcgaaagtgaaaattgaataggcttttaggcttgataaaattaacaaatataatttaaaataattaattctttatttttgaaatttaaaatcaaattttcgcttcttaattaatttaattatttttatcttaaatagtattaaatatttctaaaacaattaattaatttccttccaagtcccttcactttggtcatttccgattcgttttccggcgcttcctccaatggcgccgtgcccaaatggcaccactattttttggcgggttggcgcggcattttggagagtttagcccaacgggagggtgtcaacacagagacagaagccttacaaagagttttagcttcgaaaataatcaaaatttcattgttttttttgtgcgtaggccaaaggaatgcgtgcggtggtggccagtcgaattccgccaagtgccggactgagcagctcttcggcattggtctgtgccgcggcattggccacgctttgtgtgcaaagtgccgactttggtggtggtggtggacagcaaatttttgaacacatttcgaaggtgtgccaaagcggggaaggaaacgcgcaaatttgagcaaatttgtagggatgtgcgagagtctcgactcgagaaatttctcgggtttttcgcgtctcagtctcgtccctcggggtcatttctaagtctcggtctcgattctcggtaaaaaatcatttctcgcacatccctacaaatttgggaacaatgcccgttactctttttaaatttggcgaattgttgcttgcagaaagaattggccgaaattgcgacccacgcggaacgctttgtcggcttggagggcggcggcatggaccaggcgagcaaatggcataatttcgaattaaaaaacaatttttgtgccattcattctccgtaaggcgtgcgaatgtttggcgcgtcggggcgaagcgttgcgcattgacttccgtccgctgggctggcgagcagtgcaactgcccgagaacgcgctgttcgctgtgctgcactccaacacggagatgaacaaaacagcgagtgcctattacaatcaggtgggagaagggaggggggggggggaagtgatcggacggagagacaaaaagtgatcaaagtgaactcaatgtgaagcagggagggaaactgattgatcagtggaagggggagacatgttgagaagcaatgatagagaactaaagatcagagagagagaggagagatgatcagacaaattgatcactaaaggagccattgctgaggaaaatgatcagaaacaaaggcaaaataaatttaaaatttaactaaattatatgaccaatgaatggataagaaaactttgatcaaacacataagttcattgatcggaaaaacaatgatcggcactttgttcctaagagggttgtcgagtgccgaatcgctgcccaagtgattgccaaacaaagcgggtgtttgccggcggacactgattggcgttctgttcgaaccctgcggcagggtataaagttgggtggttagacatgattcggatttctcgggacccgaaaaacttttcttggccaagtttcagttgctgcactgctcggcaaagatggccatccggagcaaatgttgacgctggtggacgagcacttggcaaaacggtgccaacgccaacagcagcagaaattggcggatggcattcacacgagggaggaaatttgtgccattttggactgttcagacgcacaattggcccaatggtcgttgaatgcgaacactcagaacagtgaggagaatgatctcgaatcagaacaaatcccagggtttcttgactctcacaattaaattcgacttctacccaatgatttaaatgccaatttgagacttttctcggcttagaaattggatgcttaatcagaattgcgacattgctttttctctcacttcatttaattcatcacaatttctccaaaaagtgactgagttttggctggccaagcgggcacggcacgtttatgcggaggcggcacgagtgttggaattcgaatgggtgtgccgtgaagggagagaagacaatggcacagtggcaaaattgggcggtaaattgagacaaaattcatcattcaatgaccaatggtttcccgaacagaactgatgaacgcttcgcatttgtcgtgtgcgcaactgttcgagtgcagttgccccgagttggacgaaacggtggccaattgtttgagtgcgggatgcattggtgcccgactgacgggtgattttcacggagttttttgcctggtttagtggaccaaattctataaattttggtgccatcattctaatccattcaaaatgctttaaaagtgatgcttgggccctacttttgtaggaaaattatacaaaatttcattattatttggacgtccaaaatgcgggtcatggtcgttttcgtacgagcccatatttttggctataacttttttattttcaaccaaatccaacactgttgttatcattcgatagccctatgtgtcctctataagcctgcaaaatttcaaaaaa

SEQ ID NO: 480 - DNA, 9916 bp, Heterodera glycines
aggggggggacagctttacaaaaattacccgtgttttgctcatttccaaaaatggtcttaaagccgtacaacgaatgtgccaaattcaattttacaaattaccaccccctcccatcaacaaatggtgaaattcgcctttgtccgctcacctcgagattgtaacgcatcacggactgctcgtgtatcttcttgtagtgttccttgcaactgacgccgagttgcagcatttcgccttgcattttcaggatttgctgctgctcttggaacgccaaaggcatccgcgagtcgagcgactcgaccgcctgaaagagttacgggaaagtcagtgccaagagctgaggagccaaacctcgatcaaattgttgacgaccgccggggtcgaagtgacggtcgggtcgatgtcgggcaaaggcaatatttgaaaggcatcgtcggccaatttcctgcaaagaaacaaaatcaaaattttaacccaatttcccattttgccggacttgaatatttctggcacttaggcacgctctttaacgctgaactcagacttcgctaccgacgatacattggtggaatggacatcgtctccgatactcggagtgaacgtgacgtgttttttcatttttaaaatcaaaatgcaaacttaaatgcttaaaaaactcataggttgtaatttggggcccacctcgtttcggcgccagcatgattttggctatagcttttttctttgtcatcaaaacccaacattgttgatatcattcaaaagcttaacatgtctaaagctttttctaagctattgcttcacgattagttaactaccaaaaaagttatacatgaaaattgcgaaaagacgaagttttttaagttttttcttaataaattttttccaggcataaaattttttgtttttttagcaaggctaataaagcatgttaaagctttcgaatgataccaatattgttggatttggattccaaagaaaaaagctaccgtggaaaaacgagctgacgccgaaacgagcgaccaaaacgggtgggtccctgtaatttgcaaaaagccaataagagcgaaataggtactaaaaagataaaaaaaaaagcgtcgcactgaaatgtacggcactaaaatggcactaaccgtaaacttttggttgactaccgtaagaataaatttcattttggcagcgccaaatacataggtaatttgagtaagtatgctcgtcgatgcgactgctacgactgttacattatttctttaatgtgtttgaaatccgaacaaggggaaggcaaaaaaagaacccaaaaatggtgtctgtcggttacataaaagctgcatttagggttttcgtttctttttttgataatgtctgattctcaaaaggatgaatacagcttggagactcccgtcccagtaagacaacactcaaatttggtttgcgttatgtcgaaaatgtttttttagtctccttactcctcttcaccgccaccagttccgccatccatcatgcatcatccactgatggtgccgccgcacacaattatgaatttggaagcttctcaacctcaatggatgacagattcgtttcttcccacaatggcttctcattcggtgatttgtgctccgtcctcttctgctgctgctcctccacgactgtcacaaatccaacaaatggcagcaagaagtgatgatggcaccacgccacaagcatcgaaggtaagaaattgatgattgcaacaattttggtgcaatggttgttaaactatgggtgggttaatatacgcggggatgacttgtcatgtttaggctactgagaagtcggtagaagttggaagcagcaacaccgccgccgccgcttttcacgattatttggcatgtgcgcagatggtaagaaaaggcatttcatataaacatttgtttatcggttgtgtgtaagtataaagaattatttttattatattttttctttaaaatttctcaaaattgcataacttggtcatactttgacaaaatctgtcaacaaatcacccttaaattacaaaatttttccctccgaaccccccccccccccccacaaaaaaagttttttttaaaagcgccgcaaaaaaccttttaaaataaaaatattgtcgcaaatttgctcaaaatctaaaattttgaaaatcaaatttcgatttacatgacaggacacaccccaaaacgtcgccggacaaaaaaaaattaaaatttttcagcaatcgtcatcatcggaccctattcttaaccacacgccgccgcctcctcctccgccccttcggccttttcatccgcctccacttcctccacaaggcaaccgcaactttcttcggtcaccgccgtgtcttctcccaccctctccgtcggggactgtcgcctttttgcacacgccaccgcctcctcctccgcaccctcgggccgcaattcctcctttgatgatgcagatgtcaacagcgactacaccgactgcaatgcgactctaaggttgctcacaagctccttcgctgtaaccgcttcgggttacatcaccgaccatgttcgcccgttccgccggggcaccatttccttcacacatgactttgccggacacgatgatgcattttggcccacctcatacttctccaatgcctttacggatggcaccgccggacacaatgatgcattttggtacgtctcgtcttgctccgatacctcttcgtatggcagcgaggccaatgttccgatctgcctctcattcacaacttcaacaaatccaaccaatggtagcgacaactgatggcaccatgcaacaatcattggaggtagcagaagcacattttctggttcaatagtttaaaatacgcagcgggctgatttgtcatgtttaggcaactgagaagttgggagaatatgggtgcaactccgccgccgccgcctctgttgatgatgatttggcatgggcacagatggaaattccgcccgagtttggacagcacaccaaattcttcagcaacaaggaattgttggaagataacaggtgtgaggaaggagagggtggggtcggcttttacaaagtccatggcatgttttattgttaattgttctaaggattggttgctcatcgtcaggcggcagacgcggcggtggtgcgggtcgaaaaggcggcggacgcggcggtggtgcgggtcgaaaaggcggcggacgcggcggtggtgcgggtcgaaaaggcggcggacgcggcggtggtgcgggtcgaaaaggcggcggtgttgcgggtcgaaaaagcggtggtgtggatagtaaatactatcaggtgattcttttattagtaattaacacaccaacaaagagattgttataggaatttacaatttatgcattgttcccatgacctttctttctttatccccttggttgcaaccctattccatttataatgagaaagtccatctcattttctccattcactattttttgaccaaaaatgaaccctaaaaagagtaaaattccacccgagttacttttcgagcttgtttcttttcttccgtttgacattctttgggccatcacaagggtttcctatgtttttgatcgttttctatgggacaggcaattttggtggattcgaaatgttttaattcgctgggaggcagtaaggcgaaaagctgtaaaattttttgtaaattaacaattatttaagcaaatgacattctccggcgtttgcgcacgacttcgtgcatcctcaaaagatgctcccgagactgttcttatttgggcaaaagaaagtatatctttagccacttaattcatgaacttattttgaaaattcagaaatatgtgctcatttttccatttccatcggaacttttaacaacgaagaattcacagaaaaaatgaaatatttgtatggactgtacaaggatgtcagtactgaagagctaaagatccattgcgaatgtaatttttgtagttttttatcatttcattttgaattttagttctgtctggcatttgtgatgaaatgaaaagacacaaacgaatggcttgggaatccggaataaacatggcagtcaattctccacgggactgtgttccctccacttctggtcagtctaacattgtccatacatcgccagaaaatgtccatcaatcgaaaaagtgtcgccgagacgaacaggtaacggaaattgattgctcagaaaacggggaattgtcactgcattatattatttcatatccatgcgtctctttttagattccatcagaggagtcagacgaagatggaaacgatccgacgttcggttggaagggaacggactgaaggtgctgtttggagcgaaccgtgcgaggacatcacgttttcccattcagtggatgagatgaaattcacttgaacaaacagaaaacaaaaatgtgttttaattttatttaaccgtaagaatttttagtttttaagttatgatgcttacttttatttacctgtttgtcagttcgaattatgtaatttatatcgttaactttgctgacataaaaattaacataccgttcaagaaaaagttttggtttgcagttttttaatatatagtgatgaaaattttattatcataaaaattttgcaaggcaagagagtctccctccccctattgtttttgataaaattcaaaagtccattttttaagtagtgccgaataaagttatttagcgtatatttttatagtggaaagaaaaaacattttatcaaataagtccatcatatgttccatctcaatcgacgcttcttcatccgtcatttgtttgccttggccagcaacgcctccgccttcgctaccatttcctcgtacgcactcttcgccttcaccaatttctgcgcgacaactgcgccctccttcagatcgtcgatgtttttattgacactcttctaaaaggggggacgatttaagataagaaaaatgacgaaattcccattttaaatagttggctttttgggagatcatttgtttcattaatcaaaatgaatttcaattcgttatcagcggtacgaaccccccataatttgtaagaatgttttatgaccaaatttttatattttatcaaaaatggaggggtgggacagccttacaaaattacccgtgttttgctcatttccaaaaatggtcttaaagccgtacaacgaatgtgccaaattcaattttacaaattaccaccccctcccatcaacaaatggtgaaattcgcctttgtccgctcacctcgagattgtaacgcatcacggactgctcgtgtatcttcttgtagtgttccttgcaactgacgccgagttgcagcatttcgccttgcattttcaggatttgctgctgctcttggaacgccaaaggcatccgcgagtcgagcgactcgaccgcctgaaagagttacgggaaagtcagtgccaagagctgaggagccaaacctcgatcaaattgttgacgaccgccggggtcgaagtgacggtcgggtcgatgtcgggcaaaggcaatatttgaaaggcatcgtcggccaatttcctgcaaagaaacaaaatcaaaattttaacccaatttcccattttgccggacttgaatatttctggcacttcggcacgccctttaacgctgaactcagactccgctaccgacgatacattggtggaatggacatcgtctccgatactcggagtgaacgtgacgtgttttttcatttttaaaatcaaaatgcaaacttaaaatgcttaaagaagcacacagaagattgtaatgtaaacaagagcaaagtaagtaaacaattggatcggacccatcgatcccacgatgagtcaccgtcggtgtcgttttaaaaaaagttaaaacggatcgccaatctaatgtcagattcgagattagcgtcctttgaaaactccaagttgttatccaaaaataacaaaagaaaacatgggaccctattcttcacgattgtcgacatttcatattatttgccagatttaaattctaaattttgtcagaaatgatatcctttaaataaaatatcatgaaatggaaatgttgatatgaacagcttaaaaaattaaatagattttaggatgcaagtatcttaagtattgaaaatgctttcattgtacacgatgctcgagttttccctgttggtgctgaacggcattgcaattataaaccgtgaacgagttctgaacaaggttaacaaacacattgttttttatccaatcgttttccccttattttaagtatttgaagaatcggcagcacagtttcggagcagaaagtgaacaatcggttgtattcaggctcgtcaatttaatttttgcagttcaaactgttcttagaggttccgtttaattaacttttttgctttattaaaagtttgactcttttagtgcctctcatcgtcatgaatattattgttatcatcataaagctgttgtttggatgaaaatatgccttggccataatcatatatttatttgcagtttattcgttcgttccttcggttgtcattaaattttttcttgttactgactgataatcttttccgaattttctatatgccaatgaaaaattgacttaatcattccaactattttttctcacatttgaatatgtaatttgcttttttcgtggtcatgtttgtcagtattggtgctgcgctgtcttcgagtcgtttttttcgatgttcaacagttgcgaaagcattgtcttgcagaagatcatcccattttaccttttaccccacagcaaacacggaatttccaaacgacaccggaaaaggtcataagatttgctcgaattttgaaatgtcaaaacattgtaccccccgcccccccatcgttcctctttttaaaaaaaattgacgtttatattgctaaacaacgaaataaatttaagttactgaacgtctcaatttgtgccagtcgatcaacaaagctatgcacatcgcaatggaagaggacaagaacacaatatgttttggcgaagacgtggctttcggcggtgttttcaggtgttccgttggtcttcaacaaaaatttggtaacaattttctgggtcgattgtttatgcgaatttaacctgctgaatcatttagatacttattgtttaaatgttacaggcagagaacgtgtgttcaacacgcctctctgcgagcagggcattgtcggttttggcattggctacgcggttgccggacatcgggcgatcgccgagatacaatttgccgactacattttccccgcatttgatcaggttccatgcaggcaaatgtgatttctgggtcattaaattcaattttgtattccagaattttgatacattttaattcgagatatttgactataaaatgtccgttcccacagattgtgaacgaagcggccaaatttcgctaccgaagcggcaatcaatgggcatgcggaggactgacaattcgtgccacttggggcgctgttggtcatggtgccctttatcattcgcagagccccgaggcatactttggccacacgcccggactgaaggtgagatgtcacttattgttaacctcagtgttttgataccacgaaaccatttttggcataggcgcaaatgagtgaacacggaaaaaataaattaattttttatccgtttctttatttctcgaacaccgccaatttccattaattgggtgcttccgtaaatgtccaagtgaagtgcacattatttaaattggcaaaaaaagagaaaagcgtttgcacttaggtgcgaagtgccatttggcatcatttggtgccaatgtttaaaagctttgcatcagtacaactcacgcacatttatcataatgtttcaccaacttcaacctatgattttcatgataaaaattgactaaacgactcgaaattctttaggttgtcataccccggggtccaatccaagccaagggtttgcttctgtcgtgcatcgaatctcccgacccgtgcattttctttgaacctaaaattctctacaggcaagaattatgcaaaaaaaaagttattcattactggaaattttacagaaatgccgttgaagaagtgccgatcgacaaatatttgctgccgcttggcaaggctgaggttgtcaaactgggtcagtgcattttaagtacaattagacgtaaattacgaggcaaataatccttaatttagggactgacgtcactttggttgggtggggcactcaattgcatgtactgcttgaaaccgcagaattggcacaacaacggttgggcgtttcgtgtgaagtcatcgatttgcaaacaattttgccgtgggatgtggaaacggtggccgaagtgcgaaaggacaaatctctagaaacagtcaaattatagtcctagtttcagttaaaaataatttcgactcaattaaattaaacgctcttcacagatggatcaattttaggatttgccttttcaagaaaattttccgagattttcccgcttttgcttttcagagtgtggctaagtgtggacgactgttggtttcgcatgaagcgccgatcacttccggcttcgcggccgaaatcgcgtccaccattcagcagcgctgcttcctcagcctcgaggcacccattgcgcgcgtctgcggctgggacacgcccttcccacacgtgtacgagcccttctatctgccctcaaaatggcgatgtctggaggcaatccgcggattgatcgattactgatttttcaccattactgacactgtggccctctcttttgccggtgtgtctcgtgccatgtcattatttcccctttttgctcattgttatgtttacacttatttctttaccaatccgacgtgtcattttgctatccgtttttcatgccctgtgataattttttgtattattgtattttgttcgccttattattgtacacttttttcactttgtgttaataaatccaagtcatttaatgtaaaccttaacaatcaatggttttttcccccttagaatatttaattttttttatgactattatcaacaatactgtgtccatttagggttacatcgctggcaatgttcgcccgttccatcgcttctccaatgcatcaacggatggcgccgtcggtcacaatgatgcattttggtacgtctcgtccttctccgatgccttttcgtatggcagcgaggcaaatgttcccatctgccgctgctccaccgcaacggatgacggcgcccacttcggttctgcccacaatggcttctccccctccggtgatttgtgctccgttctcttctgctgcgcatcctccaccgcaaccgcgccaattgccggctgtgcaggaggaaaaagacgagcgaacgttgcgcattgagcggatggccgaccaaattttggatcagcgacagctgcgggcggagcgacgggcgcaggggataatgtacgacgaggtcagtcacaaaacaattgaaaaatgcaattatatggggacaacaaattcatcttttaaggagatcatagaaggacgagtagtgcggttcaattatgccggcgagttttgtgaacagcggggcattggcgaaatacatagacaggtgagcggtatctttattaaaaatattttaaattgtcttttcagttgaggcatttcatgatcggctggtgagttattaacgttgttacaacagagaaacactgaaatcaaatggttgcgaaacaattttttaggatcggttaaaattttgcaatcatatttttaaatttggccggaaaataaggaaataaaaaatttattcgcagtaaattttccccattttcagtgcattggtcggtgcagtcacatttgcttttgtgaagattgaccttaagaagaaacggaggaggaaaatgtgggaaagacagaatcagttgtacgaagcggggaaggaagcaatgaaaaagcagaagcagcaacaatt

SEQ ID NO: 481 - DNA, 3307 bp, Heterodera glycines
ttaataaatccaagtcatttaatgtaaaccttaacaatcaatggttttttcccccttagaatatttaattttttttatgactattatcaacaatactgtgtccatttagggttacatcgctggcaatgttcgcccgttccatcgcttctccaatgcatcaacggatggcgccgtcggtcacaatgatgcattttggtacgtctcgtccttctccgatgcctcttcgtatggcaacttcgtttcttcccacaatggcctttccccctccggtgatttgtgcttcgttctcttctgctgctcatcctccaccgcaaccgcgccaattgccggctgtgcaggaggaaaaagacgagcgaacgttgcgcattgagcggatggccgaccaaattttggatcagcgacagctgcgggcggagcgacgggcgcaggggataatgtacgacgaggtcagtcacaaaacaattgaaaaatgcaattatattgggacaacaaattcatcttttaaggagatcatagaaggacgagtagtgcggttcaattatgccggcgagttttgtgaacagcggggcattggcgaaatacatagacaggtgagcggtattctttattaaaaatattttttatatttaaattgtcttttcagttgaggcatttcatgatcggctggtgagttattaacgttgttacaacagagaaacactgaaatcaaatggttgcgaaacaattttttaggatcggttaaaattttgcaatcatatttttaaatttggccggaaaataaggaaataaaaaatttattcgcagtaaattttccccattttcagtgcattggtcggtgcagtcacatttgcttttgtgaagattgaccttaagaagaaacggaggaggaaaatgtgggaaagacagaatcagttgtacgaagcgcggaaggaagcaatgaaaaagcagaagcagcaacaattgatgatggccacatgagagaggcgtaattttggcgtcgtttggacggatagtttttttttgtgggcacccggacccgacatatccgtacatatacaaggggtttcttgagacagggggagtggaccgtaacgaaggtagagaggaaattgcgcctagaagtccttaaaaaatacgatcaaaacgcgcaaaataaaaggaggtttgaatagcaaaagaagggtctccgtcggagaagatttggaccttcgtatgtaatatcggttccgagataccccccaaagacactctttgtatatgtatggacggacatatccggaaaatgtttcatctcaatgtaatttgctgtaaagagataaataaatgttcacaataaatatttcaatatgtaatattcttttgcagcttccaaaagtccatattcctttttttttctatattttacagctcttttcccttgactttggtgtcccaattaattcaaaacaaggccatttattcatttttgaatgctttccattcatcatatcagccaattcccattgaatttgttttgcttttatgtgagaaaaaagaaagaaatggaaatggcatttcgcaaagggaaaacgaagaagtgacgggagagaaagagagagtcggagagagagtctctcttttcgcttctcttcccttcgctgaaatggcggccattatccatttttagttcttcagtcatttctcattttttcattcattccattcaattcgcaagggcaatgggaggggacattaagggctcaatgagcaaaggaagggaatcattaaccatctaataataataacgtcattttcatttggttttttatctgtgtattttcgcgttttacttaattagataatttttttaattccgagctttttagtttcgagttttaaatgcttttttttgtaatgtctccaacagaaatttttggtttttaaaatctcgacaaacaatagtttaacaaattaattcaaatttttgagtatttacttcgaacacagcgttttcacgtttgtctgccacccccttttcctccttataattataacaaagcaattcatacatagccaactgacatcgataaaaaaatattcatttttagtgttcaatttctttttctgggtttgcttaaaagtcgctgtgcaaacaatgaatgaattacgcaagaaccccacaccaacaaaaaaagaaaaattcaatgattcttcttttttgcttgactcattaaactgtcatgcgttttggccatttctttctttatctctctccattttccctttttgtatattggcggaattgattgaatcatcctttacgatattcttttctgccatttactttttaatcgaagtatttttcagacagttcaaccaaacacctcaaagcttcattctcgagttgtctccctgtttatcgcattcttcgagtccgtaatcgcttccgggatagggcgtttatggacgtgtcatttgacgcgactaccctcaaaaccaatccaaaattacaccggaagagcctttagaacatctattgcccttcacacttccttcggtaagcattgtatgacatcaatttcgactgatttgtgttaatttttcagtttgtcgtccttcgcttggcactgctgaaaagtcactgcaccgaaccgcggccccgaacccgggcctcacaacacttggacgtgaacgcggagcctccttgggtttgtgtcgtccattcgcattacaatttaaagtagttgttctttaggaccctgatccgaacgcaattacctgacattcgttcctgtgcattggtgaaattgtcctccattattgttaggtttgtttctgtggacaggggatatgttattcaaattagaacatgcacattaattgggggttggccagggatgcttggtaatttggattagtttttaggaaggggtggctgatttggattttggcttttttaaaattaaattttaattgtccgtccatttagtgtcccatctattgtctcatccctttgtttctgccgacttcgtctttgaagcggcgttcttattcaacacgccaaaattcgtctcttttccaaccccaaaggccttttcctactccgtctttcgtcctcttccttcgtcactgtgcgtccccatcagttgaaggtcgaccaggagcgtctctcccactttcggttccgaaagtcggccgccttcgtccgtcgtctgaagcgaccgccctaatttgtttgtcctttcattcattggcaactcggcattatttggttggtactttaattgcaatttgcagatacacccaatcccgtcctaccatttataaa

SEQ ID NO: 482 - DNA, 1468 bp, Heterodera glycines
ccgttgcactgcttgaactttgggcccagtttctcccacgcgtgcagcccttttatgcgctcaattgcaacgctgacccaatgctgcttcgcttgatggcctctcatcagtctgttgggttcagctgctcatccggcgcagaaatgctcaatgtgaaattcaattagttttcatttataatgctgagaaataacccaaatcgaaaattttttataaattttttgccaggctctccattatgtgtcggctgaccgtgtgtttggcgcctttccctgttggactcggtcggcactgcgccaggcggaaacgtgtggcgtgtacacgctgtgtttcgacagtgagcgcgacttggaccgcatcttggccaaccactcaaacgccaggtagggaagacaatgtttggattactggctaactacatttattgtttttgtggaaaacggatttttttggtttctcgtatgcccttttttaattaattcatcgaagttagttgtcacactcttaattggccccgctattcattttcagattgcttttgcgtatctgcgtggacccctgcgcgactgatgcgaatgcgttgttcggagccccgcttgacgaggcagtcgaactgttgaagctgtgcgttcagttgggcctcaattgcattggaatttccctctcaactggcccttccactgatgataattgcaatttgtcatcatcgtctcttttccatttctcttccgtctatgcgtttgccattgaatgcagtgcgcgtctgtttcgcattgccattgacttgggcctacggatggacgtgctgaacattggcgatgcttttgcttgtccttggtcatcagcatcgactgaaaccgacgagtcactggcgcatttcgcggaggtatgaaccaaaaccgaagggacggaatagtaatcacttctttttcagttttgtaccgaatttaaccggtccttcgatgtccatttcccgtctgatggcattggccgtgggcttcgcattatggcaacccctggccaattctttgcgcgttccccattttcattggtcaccaatgtgatcggaaagcgaagcactgacgcaagtgcagtgaccaacaacggtacagaaacccaaagcattcgcttctttaacccaactcattaaatgcaaatttcagattttgatgctggcaaaaccgcttttcattaccagactaatgagagttattacggcacatttggctgtcgaatgatggtcaacaccgaaccgcgttgtgcaccgctttttgtaagcatataatttattttttctaataaaactgctgggaatccgattttcgtcgagattttgtcatattcctcaccagggcgcgattacatattaagtcactgaatttgaatcatttagaatgacttcgacatggacacggaacagaaccaatgcttttattatggaacagtgtttggtcagtcgggctttgac

SEQ ID NO: 483 - DNA, 3597 bp, Heterodera glycines
  misc_feature (36)..(36): n is a, c, g, or t
  misc_feature (3577)..(3577): n is a, c, g, or t
aattttacccgatcaaaatgtcgttctcgcgtatcncacgctttctgctctggtagagaagccgtgcacgcagcacatcgacaggcccttttttggtggcacaatcggtcgaagcggtgccattcccgacggaaaaacgtttaaaaagggccgataattgggagctggacgcacgtggacaaagcaatgagtgcattctcaaaattattcgaaaaatccacaaattgtctttttttggtaatttgaaaaatacaggaatagacacaataaatttacaatttcattcatttatgagatttcaaacaaaaatagtaaaaaaacaatatttaaaatccgaatcatccaatcacttagaatttatgggcaacatcatcatcacttgactattttttgacaaaaaaaaacaaacaatttttgaggcacatttgggcataaggaaaatgtcacaatgaaaaattaaattgaaataaacaaaaacagagaattttttgttaaatacgatgaatgtaatttaaggcaatgaattgcaaatgatttaagacgatgatcaatcaattggatgtgcaaaattaactcatgaatgacaaaatgacagcttttgttgcggtttgaattttaatttctgagcccggcaaattttgactgaccaaaaatagaatttctgaaaattaccttctgtcattaaaatgttgttaatgaaaagaataggtacgtgtaaaataaagaaataaatacttaaaagtggaaaaaagcaacaacagcgcgctttttgagtcctcagcggcaaatgaacgggaaatacacacagaaaacggtggtacccatgaaaaagaggatgatgatggcgaccacaatgcagatagccaacattattttcagctaaaaaattggttgctcttttacagaaattaaaatgttttcaaaattttgccaaacatagcggtttattcatatttttttctgtcctatattaccatcgtcgtcaaaaaaaagaagcgaacttagaaaacccaaaatagtaaagctgatcggaaaataggaatcgatgacatacaatttcaaaaggggaaaaattgaaagaaaatgttctagagcccagtaaaatgtttgacgattggcagttgtgccaccatcaccttcatgttgcgcttctttgccacctccgcagctttcaccgttttgagggcgccgtccgcgtgttcctgcgccgtctccacattccgctcgatgtgatcgaccatttcaccctgtttcgtacaacaattaatggagttaatggaaaaatcccctgtggcatttcacctgactgtccacaaccatcgccaagtcctggaatatttcgtgcagctcgccaatggtcttctccaaccgcacaatgtcgtcatgtctgcccttgacatcctcgaacagcatcttcttgtcccgctcggccagcattatcttctgtgtgcgcaacaatgaataggacccaattcatgtggaccaacagaccccgacattgttgaacaatttgccattctcaatcgcacggtccacttcctcttccggcatctgaagacccgcttaaaggggcacagatgttcactttgtataaacgagacgacacaaaatattaaagcagccattctccagaaaacaggcttggcaccaagttgtaccagtccggtctttccccacccactttcagagtcggggtttcctaattccccactagatacaatgggcccccaaaagtgagtccgtcgttagtcgtgtgccctcccactgaccaatgtccaattggcgttgaatgcgtcctttgcaccgctctctgtagtccgtctgcgttttgttgtagtcggtcatcacttcgacgaactttcgggccagtgttgcgtgctgagtttgccgaattcgttggtcggcactcgctttttgtatccgaattcgaaagttgacactcggttttttccgaattcgcaggtcgacgttcgcttgtcctccgttttcgtcgtggtcgaggttattttcgatggctggaaatagaaaaaagtatttaaattctgctggtggagccttgtcttggcactaacaattccttttcgaatttcagttgaaagtagtgcaaatttttgaatgaaaaagtccaatccgaataattataaatgaaataaaacccaaaacaaataaaaagtaacaaatgaactgacatttcaatttcccgcgtactttgttcgcagtttttttgatctcgaccatcagttcgtccagctgctctttgatttctttaaaaagtttaaattgtcttttaaaaaattcgaaagtgactatttataaacgacggaaaacccccgccccatcccgaaatatgaataaaattcaatgaggaaaaattgaacccgctttttcttggtaaatccaaaaattttcgtttaaagaaaaatataggtaggttaggtcatcgtggagctatgtaaccacacgcctgccaattctacaaagtctgttttatcttaactctattttagtcttacatcttcacttttcctcaaaaaactcacttgggtcgttgaccgggttggacagaatggccgagtgcttctttttcacttcctccacgctcgtggcgatcaggtcgatgctggcccgaatctcttcaacctgctcgaaaaagtcttccatgaactgactttggctcgccaccaaatggtcatcctcggtcttgaaatgtttttaataacgcaattatcattaattgggaaaataaaacaaaaaaccgaccgtttttagggtccccagccggtccttcattggtctgttccatgacggattgcatttagcggcaatgttccgattcataccggacaactgctgaaaataccaaaagcatgtataaatatcgtaacaaaatggaaaaggcagtcatttctatttacctgaaattccatgaggcggtctttgaccattttttgttttcactctctaaaattaattgggatcaactgaatgtatagtgtaaaacccattaaaacaacatttgacgagatataacagtttaaacatccgtaaaaaatagcgtattttccgatttaaagcgattgaaaggcaataaatatggttgaaatcaaatgcttaagcacagagctcacggagaaaaggaatcaaaaaagagaaattgtttattttatttgttttttgggcactctttcgctgtgtctcaggtggccgcgtgcattcgaaggcgcttccaccgctcctccaacgaggaggaggaggacgaagtggcaccaccattctccaccaaagcggagccaacagcagacgacgacgacgaagcggaggcgacagttccagccgatggtccgccctttgaaaatgggggcaaaatttggaggagataagaaaaagtgacattttcgatgaaatattgcagcccaaattctgggacacaaaattttaaaaggaaaatgtaactttttttggttattgactaaaggtttaaaccaatgattcggacaaaactggtacttccatggaaaaaacgtaataaacaaaacaaaaaaaggcccgatgctgtgccagaaattcgccaaggtanaatcctgagaccattcccgc

SEQ ID NO: 484 - DNA, 11154 bp, Heterodera glycines
  misc_feature (1391)..(1391): n is a, c, g, or t
  misc_feature (11129)..(11129): n is a, c, g, or t
agtcgctctttgatgctccgattcgcacgctcagccactctggcatgaaattggggagaagtgagcatacaaaagtgttcaacgtcttttgtgcggaaaaactgttgcactgcgcgggcagtgaattcctttccctgatccgttaacaccttccaaggaatatatttagaccttttgaatatatgttcaaaggcattgatcatgttagcgctcgtcttggtctttacgggttcgacaaacacctgtcggctaagggtatcaatacagactagcaagtacttgtagccacgattttgtttagcaattcggtcaaaaatagccaaatcggcctgccattcagtatgcaagccgggtgccaaagttggcaaacggcggtagcgccgctttgcctggcgatgcagtgtgtatgtacgttgggtagctaaataattttggacatcaattcgattaatttttggttgacttttccgcgcctctttcagaagcggttcaacgctcgtgaatgagacaggcgaacttaagtccttgtacaagaactcgagcaaacgaaattttttcaaatccatagggatggtttaaacttaagtaaagtgtttttataaattcctttgccggattggccttcgggaaataaatacctactcaattgtcgattctgctttgccctttcaataaattctttgaatgctgttggctctttttggccacgcttgtccttattcagcaggtgactaacaatatcatcgacactgctggttataaatggccgtccacccgctctcaagacctgtccttcctccgacacccccagagattgggcgtttttataaattaaatttaagatttccatttgtgtgggttgacgtttatttgtactcgacgcgcgtggagtttcataatcatcttcatcatcatcatcatcatcttctaattgttcaacattttcttttcgcgcacgcccaaccttgagatggcgacgcgtagctacaaaaatcggtcttttaatgttgaatggttttggcatggcgtcaaccacatcactcaaattttctaatttaacaccgacgggacgttcatcctcgtcctttttgagcttgttgagacgcttaatttcctgctcatatttgactgctctttccgcctcatttatggcgtcattattttttatttgtttaattctggcacggaccagctcaattggtgaaccgtcagacggtgacggtgttgccaaactctgataaatctcttcggggaccaacaaatagcgctttgtatgttgcattttacttttttttttaaactttatcaagcactatgtataattttcaatgacgttcgcaataagcggaagggcaatcgatgcaatgagccctacaatggctggggaggcncgtctccgtgctgtagcaaaaacgtttttggcagagcgagaacaacgtgtgcgggcgagacgacgaagcatctgtgcgtgagctttcagcttctttaaatgacgtggacgcaatggaactcggcccttttagaatgttgagacaaatttctaccaggcataatagttgttcatcggatgcgtctcgaataacaattttcgcctttttggaattagacagtgtctccaaaaaggattcatttcttgcaatcaattgcgaccctttcattttggcatataaacgatttgtttttgttcatatatatttgttctaaggcgaatctcttccgaactctcggggtgcatgtcaaccaaaaggtagccaaaatttttagcgcatgcgtcccggtaggcttccataaagtgggcggtcattgacgggaagaggtgggtggctattgtacggatctgaagagcacccgctgggtttcgcattaataccaaataatgtgaatttgtgcgagcgacgcgcaactctttgttgaacaggtgttgggtcaccaaaattacgctcacgccccaattgtgtgagccgcgtgtgaaaagcgagtccaaatactgttgactcatccccactaccaaatcatccaatattagcaagagtttttcttttttggcgcaatcgcgtacctgttccgcagatgggaccccgctgtgcacagttactggcaatttgccaatttttccagtgcgttgcaaattcaaaacattagtgttcaactctccgtagccataaataacgcgctcaatgggggtagagatcattttctctaaattgcgtagaagactcattacccactctgacttcccactgcatgtactcccagatacaatcattgtgaatggatgacgaaattgcaagtccacgtgttcaaagcttggaaacgaatccatttttttttattgcgcgttgatatttaatatatatatatatatatatatatatatatataaattgatttcattacagattaattttttttaatggatttaattcttgctaccgattggataaacaacgcttatcccgaaatggaccagcaggaccataataaggaaacgccaaaaaaggaccagcaggaccataacaatgaaacgccgaaaaaagaccaggaggatgaggaggagacgaaggagcctagctggatcagcctcattgacgaagagcagaagcaggacccgttcaccccaatttatgatgagccgccaagagcaagtattcaattttcttttttttttttaaacaaattggttaatttaggtaccccaaagacttgtgcttgtgcagaacgcccgcgcccgatcccgctcgtcgagcacttatgcaagcgcttcaactgtagcgcgcatgagctgcacgtgttgttccgaaacttggagaagcgccgagacattgtcgagcacttgcgctctgctcagctgcggaccgcccacctgcgcccttttgttcgaaatttcccggtgcgctgtaacgacctctccattctcgacgcccactcagtcccggcctaccgcggcttcttgggaattacggtactttttggcaatttggtggacataattaaagattttaggtacgaatgcattactacataaaacatggaatccgtttgcatcatcccaacttgccgtgtgtcgtagaatttggaggcggtgatcacaaaacctttttcccgcttgaaattctcactattatgttttagatgtttttcaatatttaattgttgttgtttttaaaataaatttgttgcgtaaaatttttgtccattttaatttagatgaaaatttctaactgtactgttatttttaaaattaattccttgaacacgcaacagtttttggctattgcacaacgtggaattaatacagaatataatccacgccgtttccacgcaatcatcatgcgaatccgatatggagcaaaaactgtggctgcactcatatttcaatcggcacgtgtcgtcctcactggagttccacaccctgatcaagcccaaaagtttgcagcaagggttctacgacgaattgaatacacgcaatgcagaacgatgacaatctatgagctacgtgtggtcaacattgttggagttttaacgtttgaccaaagaattcgagtggagaaactacaacaatctctgggtggcatctatgatcctacgatcttcccagcccttcggtgcaaattagataatggagccacgtgtctcatttacatttccggaaaagttattcttactggggtgaaaaatgtagaaaatttaaaaaattcatttgattacttgtctaaaattgttcctaattattttcggtaaattttattttctcgtaacaaaaaaaaaacgaataaaaacacaatgtaaaaaaattaaaaccatcgcgagtgacccggctgggtgggatcggcttcaatcaaagtcctctttcggcgttctgttggcggtagtggtggtggttgggcgtgctgttcgacatccattggctgtggagcatcttcgacgtacccaaatgggcgcgtttgcatcccagggcggacgcgtcccttagcgtagaagggccggtagtccttgtgggcctcccgggtgaagaggtcggcctggacgttacggtcaatctgcggaaaggagacgcggatggcgcgatgtgctccaccaccgtagacgaacaagtcgtcgttgtcaatgacgtcatcactaaattgaatttgtattattattaaaaaattaaagtggaaactttttacatgggtccatcaatgttgtacgtagacagcgtcagctccttcattgcatcgaaattgataagctgctgcgttgcgtaggagagacggaagctccgtatcttcagattcgcacgttcatccgctccatctcgggctgtgtgtcggatgccgtagttctttgggcctcctgcgacgaactccacgatgcgcctgtccacgagttcccgcttcatttgtcccaacgcttcgccctccggtacgcacggagctccaatcttgttgacgtaatagattgagtccgtgtctgaattaccgtcactgataacattaaacggtagaagacaaaccacagtagagaagctcagcgttgttcaatgccaacacttgctccatatatccgtacagatggaggcgtgcgtacgaagtgacaaagatggccactggaaggcagttggtcaatggtgctttggcgaactcgggtcgcttccggacgacgacacggtccatgtggtcggagacgtggacaaagtccagtttgtcgtaagtcgggtcgtcgagcagcttgtggaattcggcaggcgtgcgcgtgtactgtatctcagtgtgaccgacgcgctgcgcgagctttccccttcaaatcatttttttttaatatatcgtagaaaaaataaaataccatagagagttcgccaaagtcttggcgatcagacggagacccgggttgaaggccatcttcgtcgggtccagatgaatcccttccgtacgcagaaactctgcgacgaaggcctgacgttgctcttcggcgtcgcatccctccggccaaccactcgcctgcactttgagaccgacgaagctgttgacgtagctactgaatagcgtgtcgtcccactcagcgtagtcccacacctattgaaattggttcaaaaattacatcaacaaaagaaatacctcaaataggtctgtgacgacgtagccgagttgaagtgctttgttcagctccacgtgagtgtacgcacacacccacgatcgtttgtcgtcaccatgtagacacggtcgttgttgccgacggtccgcacataagccacacagtggaaatgtgaagcgctcgtccttggtacggtagccgagaagtggcacacggatgtttcgtggcgccagaacccgaacgagcagaagaccacggaaggtgttgttttctgggcatgtccacggaagaggtgccgtcggtggatggaggagcacttcacgcgtcagcaccatcgggttccccacggggaagggattcaccttctaagatgaaatattgttgaaacgaatccataaaaaaaaatgcaaaccatgacgtaagggtacaggctgacaatgtcgatgcacagcacctcttcgtcgtcggcgcacacgtggtggagcttgaagggctctgtgcgccctcccctcaacgcgtcagtgcgggggtccaatgggcatggcgtgaagacggcttcgtatcgttgcttcagctcatggtcacggcggaggcgctccttccactgacacccccagatgacatggagctcacacccatgttgatgttccaattcaaagaggcgtcgcatcgttcgctcgtacaagtcttcggctgttcgtcctgctgccaacttctgttgtcgatcagggaagcactcaggacatcctcaaaaaaaaaattttttatttaataaatatttattgattggaagataccgtgatagaaacatcccatccattcgatggccaacggacgaaggggtggctcccgtcgccaaagaccgtccacacggtacccagaatcctcgatgtgcgcctcccccactgaccagtcagcgcattgcacctgggctccatcgttttccaactcaaagaatcggatgtagcgacgagattcagcggaagcacgtcgtccacggaggtagccgccttctggtgagtgcaccaaacggttggcggggaggaagcatcggcggagcgttgcgagcgctaggccagcggcagttgaggcgcagagaaacggatccaggccttgggtgtgttcaccgatgagctgacgaaaccgaaggacagattcacggaggattgccacatcattgacgcagtacatgatcaactgctcacgaagctggaagttggagtcagcgtcgttgtcaccgtgccaacgaaggaatttggtccgtttttcgaccttcatcgtgtcgggcgaataatattctatggcaggaagaccattgagacgctgcagcagatgttggcgctgtatgtagaggtacgggaagaagggtttcaccgttgccagatgttgaggcaaatcgaagctcttaaccaaggcatccaattcacagaagaagtaattgatggagtccttgaatgtaattcgtcgttgatttaatccacgcaacttcatcgaataaattttgagccccgtcgtgcagagtcgcttcggtggaatgctgcggcgatgaagtgcctcaagtacgagatggaaatcgtattttccaccattgtgcgcaatgcagactgtgtgggccttcttggagccgtgcttcatcaaaaagagcaaaaattgctcaattgggtcattggcttcatcgtcgaaggaatgaaagtagaagcggcgctgattgaatgccggagcgccctctgggtgaggagtgttgtcgcctgctccattgacaaacggaggtgaagaccatcgcctcatctgttggccacgcaccatccgacagagacaaacacaatcaggagctcttctcccgaatccatcgttgacgttgattcccgctcgaagacatggctcgcagatgacttcagcaacgatgagaagcggtacgtgcttctgagcaatttggttgttcaattgcaggggccgctcctgagacgtttcagcgtcgaagaagcaaagacgcagcggaagttcgtcatcagcttcatcgtcgtcgaggatatcagcgtcgtcatcgtcgtcgtcatcatcatcgttgttgttctggtgagcagtcctgtcaagaagtggctggatgaagcacggctcatccagtgtgtgccgcccatgacaacgccgacagtcaattggtccaacgggccgatggagtggtgcgcactgatggttgtttgcataagcaacacgcccacagatccgacagaagcgcctccagtggcagatgggttgacgttggcgttgacctcggccatcaattggcgcaggagccatgttggcaaaatgatagtcgtagcaaccgtcgttcggaaatacgaagccacattcattgcagcgacgagaactgcttccaccatttggcaactaaaaacataataatatattcaattatttttttttttttaattttacctgttccggttgacatggaaacccggcgccaaaccgtaggcagagtcggcaaaccactttacagccagttgcatggtagcgcgcatctgctcttcgctcacagtcaatacgtagttcggcactttgaatagttgctcgatgcgccccacatagttgaaatgtccatgctcaagcagaaggcacaaattgaaattcgctgccacacttgaaagaatattttagacattaattgaaaattacaaaatactcacccctctcctttgaaaacaatccgatactcctgctccttctcgaacacgacaagccgaatttgtccaacaccgtgctcattgatgatcaaacgctgcagatgaccaacgtcctccaacgtgtacaagtccttgtccaccgcaattccagcacgtgtcagcagaaccacagcttctggcccatgttggtgttgtcgtgcggcatacgcatcgaaagcgtcgcgtccaccaccgttcggctgtctcgtctcacggtcacggagccccaggaggacggcacgcgccagacaatgcggtcatttggattgactacgcgcactagggactgcacggtgttagaaacactgtgctcagtgtcaaagtcacaagcacctaaattcattagaaaaatcaatattaaatgcagagtacaacctccacgctgagcatcagcacgaacggattcaaggggccatacagcaagaactttggttactgtagttccggcaagaagttcgattccagctgccgactgttcgttcaggcgttcaatggctgccgccaatgttgccgcattgttttgctccggtgggcggagtcggatgacgtacggtcgatcgaatccgggcgggtgaagctgaagcccaacgagcatcggtggggggtgaccttccaggacacggtcgagcagatgctgaatgagcgtctcgagcacgaggtcgggccgctcggcgtcctccagaggcaggaagcggatttcgcagagttcgcccctggtgttgcggagggtgttgcgcattggcgtcgtccgctcaatgacgaaacaatcctcaattggtcgtgtggcctataaatttagtcatagtaaaataattgaaaacaatcacaccccaaaaccaaccaattgagctgcccgtctctgaggaagacgcgcgcgtatcggtaccccaaagcgatggtcaatcgtctattaatgtattccaataaatattaaaaacataacaaaaaaaaatcattttctcacattattattttcgtcctcttcttcaattggaccagctgcgggaggggcgagtgtctgattgactgtacggcctccaccagtctgaaccgtagtcgccttaaatatttcgatatttaaatttttttgaagaaatgaaatgaaactcacttgtcctcccaaagtggaggcaaatggatggtggagtccagcactttgcggagccgtcgacttaacacaaaattcgatgataagaaaagtttgaaaaacttacctgtggagctgcggtgtgagggacgacaatggcagttttgccatcgacgccaatgcgataccaacagtccagatgctggtatcgggcccgcgcagtgcagttggtgaaccagtaggcactcccaatgtccaaagacgccagaacactggcctggtgctgccaacccgaagcttcaacacgttgaccgtcgccgttacgaagcacaacattggtcacagggagagggccagctggcgtttgttggtgcgggcggtggtccactgctactacggtgagacaaagcggcctgaaaaaaaatcatttaattgaagaaacattgtaatgaataacagacggcagcgggcggcccacaatagagacgctcccattcaaaaattgaatggtgtgagtgccatcgtcacaaaatggcgactaaaacagaatggttttccgattaaaaacaaagaaaaataccggcatttgctgatgtgccgcattgatgaacatgggttgaacaagttgttctacctgtccaaggggcggcatggcggcgttgaaaaagctattgggtcgagttgacattgatttaattctttttaatgcttaaaatttttaattaaaatattaatagaggacagggagacgaaatttagtattaaaaaaatgaacgaatgagaagaaaggtgaactcccaccttcttataaaccaatcaaccaatcgatatagtcttgtacaccttcctgcggcaacaaaaaaaaaatgagcgactaatcgatttaaaaactttttgcgggccgcctcctccggattctatatatgaaaggttctacgtgcgtacgcagaaactccatcaacgcatacgtattcttaatgcgtacgttgtctacggtagatgcgtgcgtaagcatccaatcgatattcaacactccataaatgcgtacgtccatcttcgcatacgtattcttgatacgtacgttgactacatgtctacggtagattaatgtatacggtagatgcgtgcgtacgtatccacatactcacgatattcaacgctccagaaatgcgtacgtccatcaacacatatttattcttgatgcgtacgttgtctacatgactatggtagattaatgttatacggtagatgcgtgcgtacgcatccacatactcacgatattcaatgctccagaaatgcgtacgtccatcaacacatatttattcttgatgcctacgttgtctacatgactatggtagattaatgttttacggtagatgcgtgcgtacgcatccacatactcacgatattcaacgctccagaaatgcgtacgtccatcaacacatatttattcttgatgcgtacgttgtctacatgactatggtagattaatgttatacggtagatgcgtgcgtacgcatccacatactcacgatattcaatgctccagaaatcgtacatgcgtacgatgcctacggcagatgcatcgtacgcagaatcccattacggtatcatacatgagtacgatgcctacggcagatgcatcctacgcagaatcccattacggtatcatacatgcgtacgatgcctacggcagatgaatcttacgcagaatcccactacggtatcatacatgcctacaatgcctacggcagatgaatcttacgcagaatcccattacggtatcatacatgtgtacgatgcctacggcagatgcatcgtacgcagaaacccattacggtatcatacatgcgtacggcagatgcatcgtacgcagaatcccattacggtatcatacatgcgtacgatgactacggcagatgaatcttacgcagaatcccattatggtatcatacatgcctacaattcctacggcagatgtattgtacgcagaatcccatttacggtatcatacatgcgtacaatgcctacggcagatgcatcgtacgcagaaacccactacggtatcatacatgcctacaatgcctacgacagatccatcgtacgcagaacgcacgccacccaatggtaccgtatcaccacacgcacaccaccgtattaccacgcgtacgccaaacgacgtacgcgtcacccaatggtaccgtattacatgcgtacgccatcccaatcgacgcgcacgccacccnaaatgacgatgcgtacgccttctta

SEQ ID NO: 485 - DNA, 2981 bp, Heterodera glycines
agtacaatgtattcagcgcgaccattcctcgacgcgtaatatttgcgttggttggcaattcagcatttcatggtgactacaaactgagtcccttcatgtttgagccgtttgatttgcgtgaaatttcgatacatgctggagggattgtctacccagctgttccttataaactaaatttttcaaaagatcactatgtctacgcctttgttgacatgtatgaggcactgggtatggctaattcggagcgttcatttgacatctcaatgacccagttcaaaaaagggtgggccttttttgtcatcccattgacatccacacttgacgacagctgtggatttgagctgttgagaagcggcacaacaaacgtacgagccacatttaattcaccaattccagttggtggtgtggagatgattgtcatgggagaatttgatcaaatgattatggttgattacaaccggcacattgtgaccgattcaaagcttggataaattataaataactttattattaatttagtttaaaatgaataacactaatacaacgaagccagccatacaaattttgaattcccctgaagagcataatgaaacccttttgcatgtattacttttttctcattatatcattgcatttcctgtgtttttgcttttttggttcgttttaattaggtggcttaaaagccacggtcatctatcgcccagcgaagccgagacagtaatggaagagattaaaaaaatcccccgccagccaccaatatttttcgcagcaaaataatgcaaagaacatgactacggtagattaatgttttacggtagatgcgtgcgtacgcatccacatactcacgatattcaatgctccagaaatgcgtacgtccatcaacacatatttattcttgatgcctacgttgtctacatgactatggtagattaaggttttacggtagatgcgtgcgtacgcatccacatactcacgatattcaatgctccagaaatgcgtacgtccatcaacacatatttattcttgatgcctacgttgtctacatgactatggtagattaaggttttacggtagatgcgtgcgtacgcatcaacttactcacgatattcaacggtccagaaatcgtacatgcgtacgatgcctacggcagatgcatcgtacgcagaatcccattacggtatcatacatgagtacgatgcctacggcagatgcatcctacgcagaatcccattacggtatcatacatgcgtacgatgcctacggcagatgaatcttacgcagaatcccactacggtatcatacatgcctacaatgcctacggcagatgaatcttacgcagaatcccattacggtatcatacatgcgtacggcagatgcatcgtacgcagaaacccattacggtatcatacatgcgtacggcagatgcatcgtacgcagaatcccattacggtatcatacatgcgtacgatgactacggcagatgaatcttacgcagaatcccattatggtatcatacatgcctacaattcctacggcagatgtattgtacgcagaatcccatttacggtatcatacatgcgtacaatgcctacggcagatgcatcgtacgcagaaacccactacggtatcatacatgcctacaatgcctacgacagatccatcgtacgcagaacgcacgccacccaatggtaccgtatcaccacacgcacaccaccgtattaccacgcgtacgccaaacgacgtacgcgtcacccaatggtaccgtattacatgcgtacgccatcccaatcgacgcgcacgccacccaaatgaccgatgcgtacgccttcttaatgtaatgcggccaggtgcgtaccgccctcttcgatggacccctcccgttgagcgaaatccttcgacgactccctccaaacgcagctgcgaactcccaccgccgagcgcgcgggcagctccaccgacggacctcctccctccaaacaaaaaccttcgacggacccctccccaaacagctgcggactcccaccgccgagcgcgcgggcagctccacgacggacctcctccctccaaacaaaaaccttcgacggaccccctagagcagctgcggactccctcccgccgagcgggcgcctccaacgacggacccacctctcgccttacggaccctctctcacgccgggcggaccctctctcacgccgtgcggacccctcacacagagcggaacacgcaggtgcggaccttctgccgcaagcgggcgcctccaacgacgaacctactccctccaaacaaaaaccttcgacggaccccctctccacgcagctgcggacacttccaccttcacccatccccccttttcaacatcacaaatacaacatttaatctttttcttccaacgactagccgggatctcgagccgagatctcggccatcaccgggaccgagcagcctattctcgaccatcaccgggaccgagcagcccataggcacgggccctgctggcgagagaggttagacggtgcactctctcgtcgctgtagaggctagagagtgcactctctcgcctcaaaagaagccaacaggtttggagtggaaatcaatcgataattaaagtggctatacattgtagtatcgtaattacgctcaaaaagctcctcaaacaattttagcgcttccaattccttctacaatcgcctttatacatcccattatgagcgctaaaattatcagagtgccgaaaatcgcatgtcatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattaaggtcaaaaagcttttcaaacaattttagcgcttcccaatt

SEQ ID NO: 486 - DNA, 1214 bp, Heterodera glycines
ccccccccccccctcccgccgggcgagcgggcacctccaacgacggaccccctcccgccgaacaaaaaccttcgacggaccccctagagagctgcagtctccctccctccgagcggaccccctcccgccgaacaaaaaccttcgacggaccccctagagcagctgcagactccctccctccgagcggacccccttttcaccatcacaaatacaacatttaatctttttcttccaacgactagttggccaagtggttaacgtgtcaggattcgcctcccaggttcgagtccacttcagtttttaaattttctgcttaaattctcgcgcaccacacgacagagaccgggatctcgaaccgataatagccgagatctcgtgtcgagatctcggcattatcgggaccgagcagcctattcgtgtcgaggcgggaccgagcagcccataggtacgggtctgctggcgagagaagttagacggtgcactctctcgtcgctggagaggttagacggtgcactctctcgccccaaaagaagccaataggtttggggtggaaatcaatcgataattgaagtattctgttattgtagtcttgctttttcaggaaaacctttattttagacaattgaaaatttttgggctaagtactgccccaatgaaatgtgagtgctttttgaaagacgttggccaattcacggggccataactttgtgatgccaaagtaaaaaccataatcaattggtcaaaagttggggctaatataatggaataatctggcaaagtttcattaaattcactttattacatgaattattgtgattttaaaaataaaattgttagatactttgcaagaacttatacaacacccaaaaaataaccggtcgtgtatttaaatgtttaatattatgaaacaacaataggcagttgagctttttgattgttattttggagattattcatcggagtttgctgttgtacaacggcatttggtctcctgcataccgtatgtcggatgaaattggcgaccgccttacggtactcaccgacacagaaaattgagaccagcggattcagtacgggcagccaatgcaaaggaagagtgacgcacatttgaataaacagaaaactcggggacaattggaaatcaaaaatcaacgtttcaacactgagtataatgcttattatattcataatcaacggtataaatgcctgaaata

SEQ ID NO: 487 - DNA, 7167 bp, Heterodera glycines
tctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagctcgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtgacttaggggatgttctcgtcgccgtagactccctttagagtgtcaccaggcttttggcatctgcgtccctggacgggttgctaacccgcccaactcagcagggcccactggcagcatgatcgccagtgcggtatcccgatttgcgctatcgagattccttccatccctacatacacaaatgacctacgggcgcaagcacccataggaggaattcgaggttaccagctcaccaccatacttccagggttctcacttgtgcttcaatgctccgaccttcatatactctacggggcatttccgcgaacagaggtggtcaccgtttccactggtggcttgccgtgggcttagatacatacctccttccatctaccggtgtaggggctgtcgacatctgggctacgactaagtctcggactcgctcctaggtacactcaagtgcgcccggataacatgtccagaaccaattatcgcagcacgctgtatcgactcaagcaaactcgggattcctcgtttaggtatcccaagttcactcagcctcttcgttatatttggtaatacctcgccgcacgacccaactactatcgggaccaccttcactgttgggaaactcgtaccgtacgcaaggcctaacgcatgtttcaggttaggtcccggtatttcagcttccgctagttccaatggttcgatcatagaatttatggcatatttccgccactttatgagctcctgtttaaccaggttctctctccatggcaccgaaatttccacaataaggatcgtacgtgcttttttatcgaatattaccatatcgggcctggtgctacgcagacccgtataactcgtactcccatcctccctagggaggacgccagcaggcgaagtatgcaacgcgacatcgtacaggattttggcatgttcattctcgattaccgcatgcaaaggaacgacatgagaagaaacgggcagtccatatttcctgcataaagccgtgtgtacttgccgtacaacaccgttatgtcgatctaacatagttccagtccgtgaccaagcacaaccactaaggatatgctgctcggtttcaacacgaccgtccccacatcgtcggcaccactttgctttcgcatttatatgtggacacataagctcccgcgctttcaactgtccctcctgtgctgcaatgcagtctcggaacgaacgcctgccaatcctcgcacggatcaaccagtggtagctatgaacctggtcgagctctggcaatgacacgacccgacctcccataggtctacctttccaggcagccaagcgtcgcgaatcattctccttacggaggatttttacgattgctctggcaccccgagttggttccatgaatatcatttcccctactcggaatcctggggaggcatccccatcaaggtcagatactcgctgggcggaatttttcgagagaagggcataacttcggaacactttacgcgctcctttcgcaatgctctgttttataccgcttctagcactcctgtttaaggttccaaaaagttcacgagccagctccaactcgggcctacattgcacgtaagcccaacagtaaatgatagactcagacaaagtgtcctctacggacacgaagccaagtccaccgtactgtacgcggaggtacaagcggtcagcactacaatgcttaaaccgccatcccggctcgttatctcttctttcccacaggaggcgtcggatacgcaggtccatgtccttagctttcgtcagggtttcactccaactaggcccaccaacgattacattgagaaagaggtacctcgctactggggcgatcgtactagcgaaggccgcacgcaactccccgaaggtatgttccgtgcatagcaaggtgcgcattctctcaaacatcttggtacggactcggtcccacgcatcctcgaaaacgataccaaatctctcttcgattccaaggtatttataagtgtctcgtagaccaaggaccgggatatcacttccagtttcctcgttctctctttcacgggggtgtaccagagcgcatttcctcttattgattttcaacccgagggctgaagcggttcgctccaatgttactaacatcctagtcaaggacgcttcactaggagcaaaccctttaaagtcatccatatagaacaagtggttctgctgctgcatcactcctcgtccaggtatggtgacctcaaaatcaaagaggctgcctactgcagaagaaacaacggctactgagagacaaaagagcagcgggctcaacgtgtctccttgtaacactccgttcttaactgccaaaggcgcactccttaacactctcccgctcttgaacacttcataccttacgctccaacatttcataaggattccaataagacatcggattcgcttgtgaactccagcgacctttagagcgtacctgatccacggttgactaactgagtcgaaagccttcgcaaagtccacaaagcctacataaagcggtagtccagtggcctctgcataagacgtaattgctctgtcaatcaccatagcatgggtacacccccaagtgccagacaccatcgctcgttgttcaatcggcaaaatagagtatgtggtcaggtgttccgatacccatgccgtcaccataccagtcactagtttgtactgcgtgttcaaacaagcgattggtcggtagttggccgggtctaccgggtcacctcctttgggtaggaggaccacccttccttttgtgagccaactggggacactgagctgtttccgcttgatccccattaaccacttaaataacgcctggtttgcggatggtaaccgtttccaaagtaaattggggattccatctggtccgggcgccttcagtggcctggccttacccagtatctttttccaaacagtttgatccacatggtcacttgcgaaaccttgtccatcggtgactttgctcctcacttcttcggcccagttttcaagctccgggatttttccaaattcctttcgctctccaatcaggctggcccaaaatgttcgtgcctgctttgtgtcaagtttagagtcacccaaaggttcttccaactttctccgcaggggtaacattcgtttacgaactcgctcttcacgatccatggaagagttaattcggtcctgagccaatcgaagacgacttacaagtctttctcgttggacttccaagtcccgggtttccctcacgggtttacccaaaacctggtatcgcctttgcaaccatgcaaaattactcaactgtctggatgttgggttctttcccgtcctcctccgtgttaactcatcggtaatccacccgatgtgtctacggatgttgttgatttcggacttttggcgaagcaaccattccgccgactggcgtctgatcacctgcctcctttccttgttgccttccgccagcacgtatcccgccgcataaactgcaacgttcaaatgccggaggacgcaaccgcggtacccattggaggtttccctctttttgagcacctcaacaacgcaggaatccagtacttcccactgggcacggttaaccctattcggttcgatttttagagccggtctaaaacccacagacctcttggccgttttataggcgctccaaaaccggtctttcaggtctttccgttcactatcactgattatcccatgaacaggtacgtttactcgctccggtttccttaatccttcttccgccggattcccttccagggaaggtttattcgacggttccgtttcagtaaaacctttgctttcaactccttccacctggggcacgctggcgggtacacttggcaaaggcacctcaacctgcacgctcacttggtttatttcgcccattacatggggcagggacaaaagctttcccttaaccagcgatctcttcatacccttatcagccttaatcgctaccacgtttggcttacggcatggctctgcacattggccaattactaagcattcattagcacaatcccattgccatccgcgttgtcgcaagagtcggaccctttcatagtacgccctttccgtcctcattgggtactcgggcacaccatccgacaaggatcttgactctctctcgccatcccaatgaatgagaaactgacttctagttatggcacaggtcccccgggcttcgctaccatttaacatggcatgctgttccaaccgtgaccaatactcgaagacagctttctcctcgctgggagtccatcgcacactcctcaaattccctttttgagacccccgctgagggggatctttaccagcacaatcatcgctggggcaccggtgcattgcgacacccttcccattatgacttaatgtgccggaagaaccctgtgctaaagagcacattttgggataatttctcgcaggcacagacatagcaatatgacttgaaagctcaggtatatgttgtaaaaaactttttctcatatttatctgtgcagtacgacccaaaagcgttcaaccaataatgtaataacagctcctcacgagctatctccgcgcagaccccgaccagatacccaaaggctcattacaagttcaacctggttaggagaaacctgggcagaacgacagctttataaggcagagtgcttatccgacacatcattccagaggtaccaccccaaccaccccttatctgacgagcaaagcactcgccagaccagctccactagcccaggctggcactagtaggaactgttcctccggaactacggcgtcatcagaactctccgccaaccatcatccacatcccaagtcgcccgggggcaccaggtctatctttacctgcataaaacatgcctactaacgtatacatgagtaggtattaggaaaggagttaagctttggagaaatcgaagaaataatgcacgataatttatcgcaacaactggaaaaagagatcaatatgatcaattgctgagatcatcaagatctattccggtttgttggacgaatggcgccgcaccttcttcccagacggaggggctcccccctccttttgcgcggcagacggcccatcagcgtccagctcaatggtttcggcccctttggcaatgccatcggtttcgtcccctttttgctttttgccgccgtcctccgtacctggaagtcaaagtattgcttcgccgtcaatcatgctattatctctaacccgtccccgctttctctctcttctcccgctgcttttggcgtttcagagacttcttcgctgcctcattggcaccagccctaactggcccgcgcggctgcgtgccgccacgagccgtcaagccgtccatgaacagcttgatgtccctgagaactccctcaaaagtcgcaccttcgaaatggcaaacgaatgtggtcatatttctcttgaggaaaaagcaggttaagaaatgaaaatgaacactgtatagatatcatcgggatatacccgtatgaggtcagagaaaacacagggtccgcttcacgtattctttggacccccccccctccagtgctagccaacaccggaaggggctcggattagcgcaacccgtgcagcacctagggactttcgcgacctgtaggccaactcctaccaggctccccggaggttccgagtatcgccacacgtgcgcgtcggtagttagccgacgaggcatttggctaccttaagagagtcatagttactcccgccgtttacccgcgcttaatcaagtttccttggcttaacattcagagcactgggcagaaatcagacacggtcaacgtccacaaggaccatccgtctcctctgttttaattagacagtcggattccccgagttcgtgccagttctaaactggtcgttcagcgccaaccgaagtgcataccctgacgagcatacacgcagctgaagcgctccacaagcagctctcaccactagtccacgcaccatccccgaaagaacagcacacagccacgggcaaaagccgcctgtttcacgcaacagcccggctgacccgacctttagagccaattcttttcccgaagttacgaatctaatttgccgacttcccttacctacattattctatcgactagaggctgttcaccttggagacctgctgcggatatcggtacgatcaggcaggagattcaaatagcttccctcgcattttcaagggccgtgtggagcgcacgagacaccacaggaaccgcggtgctttacgggcgcaacatccctatctcaggctgagccacttccaggcacgcacaccctaaaccagaaaagagaactctggctcggactccacacgacgtctgcgagttcatttgcgttaccgcgcaaaacagctcttgcgaaccgtcatt

SEQ ID NO: 488 - DNA, 4567 bp, Heterodera glycines
acacatttaaagcggcggaaaattctttcgcaattcatcgattctcaaccaacaaacatcattatattttaataaaaaaagagaaagtttacaaaaaataaaataaatgaatttttattaattttccattttgtttaaagtgccattttctttttgcttctcttctttttcggcactgcctccgtttctggcactttcacaattgacttcatcaacggtttggatgccaccatttccgctccttcgtccgtcgagttgaaacggtccaatggcctggaaaatgggccaaaaagttagttgttgagaggattaaggatccgtcggcattgcagggggaaaaatttggattttagttgtgctaattagacaagaattttctccgttctccttggccatttcccatccgtttaaattattttaattcaaattttatgttaaaagggataatatgaaaactccaaaatattgatttgtcttttctataagtattgaaaaagttttgtcgaaaggggttttttgcattttttggcttacaattaggcaatattcgcctcctaccctggattcaaattggaatgtttatgtagtttaaaacaggaaaattttttaccgttcagaacttgactccgcaaagagacggaagcccgtccacgctgctggtgcccatcaagtgacacaactgttggcggaccgagaatgcttaaaatcacattttattactaaaataacaaacatgcactcagaattttagtgaacccaaaaaagaatgaaaatcgctaatttcggcgccgaccgtctcggcgtcgttgctaacaactcttctcattatcaaccatgtttttggtaacattcgattagttcttttggtttctatattaatctacaaaattttaaaaaatttcgtcataacctcaattcggactttttcggtgttgtggacacaaaaagtcactacactcatttttttagaaaatcaaagcggaacgtttacgaaaacccgaaatatcgatttgtctttgctgtaactcatgtgccaatcgaccacctaaccgggtcagtcccagccaggacgggggtggcatgacaatacaaaaaatgaacaaaacaaaattggcatttcaactatacctcgataactcgcgacggaacattttttttgggggcatgtccataaaaagaaaacttcatcagtgtttacaataattcggttcatagattctgactcagtagaatagaagaaacccgattcgtattttttaaatagctttaattttttagaaagggtcaaattgggcagtaaaaatacgactttttaaattcatttcgggccccaaacgcctaaattgtggtcgaatagacgaaattttaaaatttcatgacttttcaattaagtgcgtactttatatgtcgtttgatgtgaatttggtttaaaatccaaatttacgaattaaaagttggaacttctatgtttttctaacttgttttttgataaaaaattaccggctaattttttttagattatccatgttaatgtcaagcttcaccctttcgattttggcacagtgttgttgcaatatgtcattggcaaaactgctgcatcaatttgcggtgctgtgctttttggcgcacgttaaaaatggctttttggcgcaaatatttaaaaactcccaaaaattaaaaaaaaatttttatttgcctttcattgctcataactatatgccattttctttcataatagacatgatgctaatgcagtagtgagcaacggtgcagaattgtggtccctattcaacttttatatcactacccgtaaaatctcgaggttcctggtccacatctgaccataggtttgcctaattccgaccctggactcaaattggaatgtgttttaattgtattcacgtgatctgccaaacgcagccactcttgctcatcctgcacatgcccaacgctggtcccggtgaacatgatctccgccgccctcccgcccaaaagggtggccaattttgttttgaattgggggagtgtgtaggtgccgtccatgtagaacatcgtctgtccttcccacccgcgaacgtcatccccttcaatggacatctgtttttcaaaaaaaaaaaattagcgctgcatcttgaaaccttaaacatttttcccaataaattatttttgtccacaaaaggtgcacccaaaaacccattgccgaatacgctttttgaagcttcaggtgaatgtctgaagcgaacaaaaccttcaatttgccaaagtaaaaaaatatgctcaacaaaaagttatcaaaaaatggtcaatatatttatttaaaattttaatgttagaaatgctattttcgggtgccggattcgtgatcagagaccccaaaatccttgtaaaaatgtttaaatgacttttgaaaacataaaaaaatttagggaaaaggggagggggtcaaagcacaatataaaatggagaattgaaaacataatttgtaatcagtttaacaaattaattgttttaccaaataaatactgtaactatgatcgtattttgaaaaaaatagattttcaaaaaaattacccatcgcagatggtctatgctgtcagccgaccaccaattgatcgcccagtgcccgacttcgtggcaggagacgcgcacacggtgttgccgcggagcgcgaatcgtttggcgcaactcttcgttaaattgacgacgccaattcgccattcgtcgtcgcaaatcattcgctaccatttttttaaatttgtgtgctaagaagcgaaaaatccgaccctggactcaaattggaatgtatatgtaattcaaaataggaaattttttattttgatccaccacttgtctatttacatatttggataattacggcaaaaccggttttggcactttttcattttgttaaactcctttgttcccaccgtaccaattttaatttaaaattttttcacctgccactttcaaccactcttgctcatcctgcacatgcccaatgctggtcctggtgaacatgatctccgagactcctccgcctaaaagggttgccgattttgttcgaaattggaggagtgtgtaggtgccgtgcaggtagaacatcgtctggccttcccacccgcgaacgtcatcccccgcaatggacatctgtttttcaaaaaaaaaaaaaattagcgctgcatcttgaaaccttaaacatttttcccaataaattatttttgtccacaaaaggtttgtattaccctgatatcatagtagcagatcattcagcactagttaagcttacaactagcagaaacgaaaaatgtttatttatataaattttttaatttggcaaaccacgcgacgatttatcaagctttgttccggaaaatacggtgctagctgattgtgagacaaactatcaaaatgttatcgattgtcgactttaggccgaatacaattttgaagctttaggcatttatgaagcgaacaaaacctctcaatttgccaaaatattctcattaaaaaatacccaacgtattgtttttcgcaaattccggccaaacttgcttcttgcacgaaaatcttgtcaaacccactcgtcggacttttaagacccaaggtcgaactaggacgacccagtccgaacatggtggtccatacccttgaacacgaactgaaaacgttgaatgaagacattgagcagccagccatcaatcttcattttcctcgaatggaagctgaactgagttttcccgcaaacaatcatgtctaagagggaagaagacccagccaagtggtcgacatcactgttcaaaaagacaattactgcagcagtaagaagggccaaccaaggtccaaagaggcactcaacgggacagagtccaagcctcgcacgcgccatatgcattctgcggaaacaaccactggaacaaccagtgcaacaactatccaaaggttgaaagtatgagaaacaaccggatatgcgtaaagagatgtgcatgaaatgtctgagaaacggagaagcgcccaagattccctaggccaatgaagtgctatcatagcaagggcaatcacccacaagcactgagcagaaatgcacacaggactgaacctgacattcaggcaaagctgaagaacgaggaggagaacgcacttgtgatgaccacagtcacaaaatctacaatccttccaagtcttcatcacaaatgatcggcttcatcttcttggaccccgggagccaaaactccttcattacggctgaagccgttgaccatctgccgctaggaaagctttcattctgaagaacgctacttctcgggttttggcgacaaaaccgaagaaatacaagacagaatacgtccgaataggactaaattgtcccaatggcgacccaatggttctgccactcaaattttgaaaaaaatagattttcaaaaaaattacccatcgcagatggtctatgctgtcagccgaccaccaattgatcgcccagtgcccgacttcgtggcaggcgacgcgcacacggtgttgccacggggcgcgaatcgtttggcgcaactcttcgttaaattgacgacgccaa

SEQ ID NO: 489 - DNA, 4338 bp, Heterodera glycines
  misc_feature (4313)..(4313): n is a, c, g, or t
aaattaattgttcaccaaaattcacaattattgtccaaagccgattcaatagacgggaatataatttcaaaaaaatagagattcacagccatttagtgcagcatttgaatcgtttttggacaatacatgtgaattttggtgaacaattaattttcgacttttgttcgaattcgggtccggggttctaaataggtggaaatgaatgtcatattcgtgatcaacgcccccgaaaacccaagaaaaatatgtacaaaaaaaaaacattttttatgtggggtaaagtgaaaaagtaccgaaaattttacattaacgctaaaacattgataaaatttaaaaaagccgaaatttgaaattcacacaaattcgcttctgtcttgacaaaacgacgaatatgttaggctctcgaattgaaataaatccccctcccccattttgtcaatattagctggatagaaatccattacaaatagtaaaatgtttcataaatttagattgcttttctactaccgctttttcaatttgatacccacaaacaacaacttttggtgatgagtcaaagcgaagtgaagaagacactgcactagttgaaggtcaacgaactgagaaacgtgttggagaagcgcggcatggacaagactggcatcaaagccaatctgattgaccaggttgggattttttttcagcaatttgttaaccttgctcatttttcatattgcttgaaaagttttgagggtttattgggacacttcgaatgtgcatgtttattgaaattctagttttcaaaatttctattccccccattcctgcatatggccaactcagaaatccaaaaatttgactcgatgctttatagtctttaatgaaaaaaatgtacaatatggtccaatgaatgaatttttcgagtaatccattgagttataatgtcttgcttgatattgtgcaattaatgcaattcttggggctcacataattgtttccttccattaactggttcgtacaaacacgaattgtgataagtgtgagaactttctttcatcttggtaactgctgttgttgttattgttgttggtgtttgcctttgtgtgcacgcgtctgccgctgcttttggcacagcgtggcgttgtgctgctgctcgacttcactgcgtttgtgctgtctgtgtgtgtgcggcgtagtctttctcaaatgaactctcccgacttcctttcgcccttttcccacttttttgtgcctctgtttttctcacacataacacaacgacgcttaaacaaatgtggcgccacatgggaagacccaatctcatcattttcataagagtgcgttgtgttggcacacacatttttcgagaaatgaacaaaggtccccattaaacgggggggggggagagaaaattgcccgaggagtaattagcgcccatttatgtgtaatcgctgggctgatatccttcgcgtatggaattttttgacggcatggaaaaattaacgccttttatgcaaattacttataaccaaatacaatggggggaataatcaacggcgaaaaacaatatgtttaagacgctcaaacaaaaaatttctcacaaaacaaatttaagaactgacgacgatggaaacagggcaaaacagtgaaaatgctgcgacagttgaaaccgccgggaatgatgtggagatgtcaaccgaaggttttgcaattttttttttcttcaatttctcacccgttgattttcaaaaagaaaaaaacataaaaacttgccttggtttgatgtttatcaatcttattaggagccattcaaagtttctgtaattcaatcgcattagatgaaaacttttttcatcatattttcctaaacaaattttgaattgacaaaaaattctttgacccattcaccatttgttcaatgtttttcattccttgcaattagacactgctgttgctgaaatggacaaacaaaatgcaaccgatggcgaccaacagcaacagaatgttgcaccagttgatggtcaacaggcaaacgacgaaaccaccacaacagtagccgatgttggacaacaacaaaagcaacccatggtaaccggaaacgaacaatgacatttccctctcccccaatccaaaaaatgatatatttaacctgattattacgataatcgtctgtttgcatggcctgtttgggccaccgagaagttgccaagacggtgatgttgttggcttttatgtgaaaaaagcgaattggttcgcaataaataaacgggggacacattttgcacaacagaccaacaattgtactacaggaaacgataaccaaccacggtgatggtggtgatggtattgatcatcggaatgctcatgacgagacgaccgtccagccggtcaccgacccaattacgactggccaaaccggagatggtggcagtgacaaaaataacggccatggaaatggtggtgaccatcaaatggaccatgatgagccggacatcatcatcgagacgcccaagaaggcgatcaagactgagtgtgttgaagatgttgtgctgatcggccacaccgcttctgcgtcagccgtcggcagtgccgggcgtggtgcaggcaatggacacaaagccgcagagagaagtgatgaaagtgactgcaactgccgcaacaacaccgtcttcggcaaattgtgctgcgccatcaacagcagtttccaacaccgatcagcaaccgaaagcgccttcagcggtggtggcaaatggtgggacggcaccggaaaccgctggttcagctacggcgacaaaagttctatcagtggcgacaacgaacgcaaacaccgccgtgacgaacgccccgccgttgttgacgtcgtcctccgctggttcaactggtgatgacgtgatactgctcaacagcgaccaacagcagcaacgccagggcaaaattggcaaggagaaggacgctgttgctgcccagccgagcgatgattccgccggtgggaagaagcagtcggctgccacaccgacgggaacgacgagcggcacatcgacggcacaactggtggacgggaacaatttgtcgtcaagcctgtggatccgcaacattaccaccacgacgaaagcggcagacctcaaagtacatataggcacattccacttgattttttaagcctccatcggcttttaatcatgaaaaaattaggaataacgactcacaccccccagggttcaaaaattcgatcatttttcatgtcccaaaaaaaaaaaatttcgattgctaatgccagctaagtgttctggttcctttaaactccttggaaaaaattggcgtatcaaaaaaaaaacagtttctcgcataaaactgctctctgtacaacttttgtgctgatgccatgccccatctgtgttccacaccaaatggatggatgatgatgagatggttcatcaacaaaaacactgtttttaaggcgctgttctcaaagcacggcaaagtaatcacggcgaagattttcaccaccaaaaacaaacagtcgcccacctgttttggctacgtgacgctggccgatgcggagacggccaatgtgtgtgcacagaagctgaaccgctccaacttcaaggggcgcatcatcaacgtggaaaaggcaaacgcacacgcacaattattattagtcttatcctctccacccatcgaccgatcaaacattgctaattatactggtcactctgatcaagcatggtgacagaaattttttgactgattcttgtgttcacgagacttaatggctcgtgggttttcatggccaaaaatacgattaaattaagttggttttaaaatttcgtcatccctttttaatttaattggtgcttgctcattaattcccttttacgaatttggtgtgtgacaacagcgtcgtcggtctaccccttcccttcccaacactcttactcaccacatcgtctataaaaaaaaattgttgtaggccgaccgctccaacctgtcgcaaattggcacgcaacagcagcagcaacaacagccggcggcggcgagtgacggcagcggcgccaaaacggggacggcaaagagcggaggttcgagcaaagcggctggcgggtcgtcggatggcggcaaagggagcggcgctgaaccttccgcctcgtcctcctcctcaaagaaagtgcgtccgcggatcactgccgcgaccgcatcgcccacgcaacggcagcaccgcaacaacaacactaacagcgccaaaactgcccgccgcgggttcgtcctcgaggacatccattcgagagcgcatcgcaaaacggggcgtcgaaaggaggatgctggcacggcgtcanaatatgactggtattgcacaaaatg

SEQ ID NO: 490 - DNA, 1173 bp, Heterodera glycines
aaatgcagcatatataaataatattgtgcctttttgtttttcgtcatagcgtaaccaacagcgtcgctattttcgttcggttgcctacgcttcgtttggacatcggggcggcccgcaatacattgtcaagtcacgcagcgctgcggaaccacggctcttcaaccgtcttgtgcaccagacaagccgaggaatccgcgtctcggccttcgagggcggtggttcgcaccaatacggtgccgcgcaccaacacgtgccgggtggcggcggcttccgtgacttcaacaccatcaatcatcgtcgtacgatcaacaacaaaagcaacagtttggtggcggcactgccgcgctgaatcccttctcccagccgcaacccttcgccggtggctcctccgtcggggcgctgtcctatggcaagcagcaacagcaacagtactcaattggcagcggtggtggtggtgggtcgtcacggatgacgtcggcaacgtccactgtctctgctgctggtggtggtggcggtggttgtgaacggcatggccaaatgcaaggtggcttttcgcgttcgcgttttatgtgttggcactcaaaaaatccagcacttttttctataagattcaaggaaatataaaaaattttcttgcgatttttaaaaaattttaaaacaaattttcggtttcaatttttatttggtcgtaatcaaactgtttcaaaaattcaatttcattttttggggattcttttgtcttttcaaatggactttttaaacgattttcaaattttttcccgcccaacaggacgttcttattacaacgatcgttatgccgacacaacaactgatgcgagtgcgtacgcctcgcgtaccgacccgtcgtatggccagcgcattggccaacagttttccagcggtggtgggacgcgtgacgaaatgtacggtgtttcgagtggcgggggcggtgcgttcggagacagcggttacgccacatcctcgtaagtttttgtaagttgcattgaattgggtgcaacaacctatttgttttgcaataatttatgtatttgtgggaataattaatgttaaaatcccattagaaatctttacttttttcgattaaaaaacaataacaatttatcttaaatatcaaaaaacgcttgaaaattaaaaaaaaaaacataatttggg

SEQ ID NO: 491 - DNA, 4306 bp, Heterodera glycines
  misc_feature (4182)..(4183): n is a, c, g, or t
aattagagtgcagcgagaccgggaaatttgggcaagaccgggaccgggacttttttggttgaaaaaccgggactttttggctgggaaaccgggaaaaaagccgggaatttccggtcaaaaccgggaccttggtactcagttgtccgtgttcaggtcccggtcccgctgcactctagtaatttctgtttatcttattctttatttataaaataaaaaaagcgctgacccacaaaatgtccagcccacgaaatgtccaagtctcgaatttgagttttttattattcagatgggcctaaggttaggcaaggggtaatataaagggtatattcgtattcagagaccccgaaaaccctaaaaatcctaaattagactcattttgtttttataaattttgggcatttcgtggcttggacactttgtgggggtgccaaaaaaagattattattacatatattatcaatttgacaaaaagaaagagacaggaaggagacaaagttgagagaaatgagatttggatgaaaaacgttattaataaaactctatcaaaatttattttaaattatctgaaaaacgccccgagccggcgcctagcactcgtatgttattattattcaatttttttaaatttaaattttagcgttttaaataaaaatttgttgacggattgtccattggcgtaatgtccgtgcccctccccccactttccatgtcccttttgactttgtttacgttttccgcctctctctctctctcttttgctcaatgattcgctcgctctgttttctctctgtgtttccatttcattcgctttctttcccgaacattctcagcaaatggagtgccatggagaagcatttcatgcggcaataaatacgcaaaattttcgggctgttcaattaaagcttctctgcagttaaatctgaacatcccaaactgatttatgctcctctccccatttccgattacttttccgtgattttttctctttttcccactttttccatttgatttttagtttcccaactgatccgattaaacatttctctttatttacaattagcaatggttttcctgtcaaaattctcccctaattcaattcaaaaacaataattctcccgttgtttttcagcatttaaattcaaatctttcaaccaattctcttttcgtcaaaatgctttctcccttctcctacgatccgttctatcgccgttcgttgtggcctatggccactcatgttggcaacgtcctttcgcccttccgccagttggagcgtgaactcgaccacttcttcgaggggatgcagcccatggtgggcttttactaatcaaaattctttaaattttagcttttttgttttttagcttcgtgaccatgtcgctcagctgaacgtctcggacaagggcgacctcacttacaaagtgagtgggcacagaaatttaccgaattccatggctaattttcaattttttccttaaaattttcaggtcgatgtcagcggcttccgccccgaggagatcaacgtggaggtgattggtaatgagatcatcgtcaacggggaacaccgcgagcagaacgacagtgagttttgccattgttcgaataaatttcctccattttgtggccatgtttcgcgttttcagatccatatttttgcaaatcctcatattggggttattttgcgtcccaaaatatcacgcactgtccttgagttttcaaaaaaccaaaagcgtaccttttcgggttagggcctttggttggggggggggggggtttgtcctggtatgttccgaacctgtgattggtttaaatacagtttttcatgtctgaccaaatgctgttttctctgtgtttcattgcccccctccacctcaggcgaatcggtccaccgtcagctctcgcgccgcgtgctcatcccggagggcatccaaaaggagagcatcaagtgcgagctggacggcggtcgtttgttcatctgcggaatgaaaacggctggcgaaggcggacgtaccattcccattgaaatgaagaagaaggcggccgtggaccagcagaaggaggaggagaagcagcagtagaaaaggacggcggaagtgaagacggactgactgtcggtcgaccgaatgatccattgacattgatctttttattttgatacttttgcaaagtgatctataaattatttttccttcaattaagcgtttctaattaaggggatggtttttttcacgggaattagtcccaatgaattcataatggacatcgctttgaagaaatttcgttttaccaaaataatttaagatggcagaaattttggaattgtgcagtccaaaatgccaaataacagttctgaaaaagaaatccggcaaaaagagagagccacccataatctgatcactgatcaactgtctaaataataactaatcgttttcatatgaaaagctcgacaaaatcaacacattcggattgcttgcacactgttttgtttgtttttgcacagaattaaataatgacgaaacagaaaaatggagcagcgagattggctagagattcatatcaatttaataattaatcatatgaaaagtgttgttgttttgtgtctctttatttaattgtccttttttgtacgtttccatcgtttcgttcacttttctttgtccgttcatggcacacagcaaactccgatcaccacactgatcagcaagtcaatcatcagtcacagttccgtcatccgctcgtcatttaatgccgtagtgccattattggcgccaaactggagcgtcctggtcggcaccagtcaattccatgaaattttcaggtcgatgtcagcggcttccgccccgaggagatcaacgtggaggtgattggtaatgaaatcatcgtcaatggggaacatcgcgagcagaacgacagtgagttttgccattgttcgagtaattttatcggggttttggattttggtgagacaaatgtcagggcttgagtgttaatggattcatttaaatgcttttcggaaccatatttagccaatttaggcttacatttagcgaatcagagaaatatcgagaaacttcttttaatttggaaaatttatgtccgtatttcggtaatactggggtttgttccccccctttttttggcaaaaatttcaaatttttaaaagtcacgtaaaacattttttctggggttttcggggtcgctgatcacgaatccggcatccatttcgcccaattccgaaccccgaactcaaattcgaacaaaaagtcgaaaatttatttttcatcaaaattcaatttatttcaccaaatctattcaaatgcacgaaatcaacaacggaaagaatagattgacaattattcacaaggatagatttcaattctgagtgtaagaaccagtcgcggggtctataaaattctgtgaatgattcacagtaaaatgttgataaccctggggcagcattgagatggaattgtagccccgcccaatgaatgaccatttcgtgcatttgaatagatttggtgcaataaattgaattttgatgaaaaataaattttcgactttttgttcgaatttgagttcggggttcggaattgggcgaaatggatgccggattcgtgatcagcgaccccgaaaaccccagaaaaaatgttttacgtgacttttaaaaatttgaaatttttgccaaaaaagggggggaacaaaccccagtattaccgaaaatcagttttattggcttgtttatttaaatatttccagcgaaaacaaacttcattctgaatgctcaacggaacggtggaagcggcggtcactgccgcggtggccgacgattggacactttgcatgttgttgaagctttgtaacccaaagtaaattcccttgaagctgtgtaacccaaagtaaattcccctgtgcttaacggacaaatggagagttaacaatcttcataaataacaaagtgaagaaaagtgaacgagggaggaaggaaggaggagtatttatgcaaaaatatgaggggtcaacaatgaatgagtggagcgggaaaataacaaaaacataatgccacacatattcaaatgatgtctcccggacattaaccttcgtaaataggtgcaaattgagacaaaaaaaataaaaataaagcatcaggcccttgaaaatgctttcgccacaaaactcttctacaannttagtatgtcaggcttttctagtttgtttacgtacccgactcgtaattccttacaaatttaaaaaaaataatcaatgcaatgatcctgtttaaaaaaatatgaatagggttttaaatattttt

SEQ ID NO: 492 - DNA, 1632 bp, Heterodera glycines
aaagtacagacaaaaatgtataattctgccaaaaggactcaattcgagaggagctgggcgctcttatcgtcttttataattcaccggcttatcactgcaaattgtttattgtcgaaaaaatatgccatagatatgtaattgatcatttcttcgcaatcgcttttgtatacaattggattcgcttaatttaacagtacatgtgcgtaaattgttgctaatatttatcgactaacaaccaaaaatgagcacaaaagtacagacaaaaatgtattaattctgccaaaaggactcaattcgagaggagctgggcgctcttatcgtcttttataattcaccggcttatcactgcaaattgtttattgtcgaaaaaatatgccatagatatgtaattgatcatttcttcgcaatcgcttttgtatacaattggattcgcttaatttaacagtacatgtgcgtaaattgttgctaatatttatcgactaacaaccaaaaatgagcacaaaagtacagacaaaaatgtattaattctgccaaaaggactcaattcgagaggagctgggcgatcttatcgtcttttataattcaccggcttatcactgcaaattgtttattgtcgaaaaaatatgccatagatatgtaattgatcatttcttcgcaatcgcttttgtatacaattggattcgcttaatttaacagtacatgtgcgtaaattgttgctaatatttatcgactaacaaccaaaaatgatcacaaaagtacagacaaaaatgtattaattctgccaaaaggactcaattcgagaggagctgggcgatcttatcgtcttttataattcaccggcttatcactgcaaattgtttattgtcgaaaaaatatgccatagatatgtaattgatcatttcttcgcaatcgcttttgtatagaattggattcgcttaatttaacagtacatgtgcgtaaattgttgctaatatttatcgactaacaaccaaaaatgagcacaaaagtacagacaaaaatgtattaattctgccaaaaggactcaattcgagaggagctgggcgctcttatcgtcttttataattcatagaaaaaagatatgggtgttcgcaaatttgatttttaattaactcataaaaaacgtattaacaattaagaaaatcagctgcagaaaattattttctctatcgctaagcaaaatttgaagaaaatctctatgaggaaaaaaaagcttcttagagagaagtgaatgttgtttttcccaataatgaaaatagattgtacaccaaaaggagagaaaaattagagaaaaaaagatatgtgtttttctctgcattctctatttatttggaggttgagtttactcaaaactcaatggtttgtacttccgtgttttgctacccccccccccccccccgaaaagttttaagacacttcatgatcagtgactttgaaaaccccaaaatatgaatttttaaaatttttcgaggggggggggggagtaacaaacacggaagtgccgacccaattgtaattttctaccccggaaatgttttgccgtttttatttgaattcatttcaataatgtgtccatcacaatctatgtataaatctagggttcctccccgacat

SEQ ID NO: 493 - DNA, 1637 bp, Heterodera glycines
  misc_feature (1606)..(1607): n is a, c, g, or t
agggcgtttcttaaaaacttctactatgggcgtttcttaaaaactgccactatgggcgtttcttaaaaactgccactatgggcgtttcttaaaatctgccaagtgggcgtttcttaaaaactgccactatgggcgtttcttaaaaactgccactatgggcgtttcttaaaaactgccaagtgggcgtttcttaaaaactgccaagtgggcgtttcttaaaaactgccactatgggcgtttcttaaaaactgccactatgggcgtttcttaaaaactgccaagtgggcgtttcttaaaaactgccaccttgggcgagaattaaactacaaattaaaacaactatatagaaatattttatctaaattttattgatataaagtttgtaaattaatatatatattccagtatttcttttttaaattttcttattctttaaaatgttcaccaaaaacatgaactgacaagcataacaaattctaaaaaataaactatttaaaatactaataaatacagacttttgttaatgaacattcagcactttcatacaaacatttgcaaaagcttttgtcgcaatcgtagcgttttctagatttgtttatatagcataaatcatagtaataacagcaatcatcgactatatcatttaaaaatttataataaatttaaatttttttaaaccttttttaaagttgcaaaaccatattactggtgctataaagcatgagtcaaaacatgaagtgccacaataagtgctacaatatttctttgcaactttcaaagggaaattttaattataataagcttatcagtaaaaaatttaaataattaatttatcaagaaaaaatattaaatatatcgttgagctcatttgtaaattttattaactacaatcatcagaagcaataaatttattacgcccacttggcagtttttaagaaacgcccatagtggcagtttttaagaaacgcccacttggcagtttttaagaaacgcccatagtggcagtttttaagaaacgcccacttggcagtttttaagaaacgcccatagtggcagtttttaagaaacgacctagcaccgtttttcgtgtttcagaccatagttaactcaggaaaaaataggcaaaaacctaaaattgcatccctagtcattattacgtagaatttgttaataaagcagcctaaagataaattagcatcacttttattctttcccccgtctgggtgaaattgttgaacgaaacagcgatatacaatatatatatatacagtacaataacaaacatttcaaaaaatgacgtcgcaaaatttgcactttctcaattgcttcctccattagcctctgaagtcacggatagtgaattcgtcattctttaagcccctaatagcgctgattttcgagactttgtcgacggtttgcttttgcgcgttctcggcatcgctttctttaagcagagaacagttggagaaggtttcgtaaatcactgagcagaacagaatgacactgggaagctgaaaacactaaaattttgttataaatcccgacaaaaaggacctaccaaaaggaaacacagaaaggactgatagggtcggaaattggtgcattnnccaagagtggtccaattcactgactccaaa

SEQ ID NO: 494 - DNA, 7942 bp, Heterodera glycines
  misc_feature (34)..(34): n is a, c, g, or t
tattataaataaataatttttaatttatattttntgagtattacaacaatttaaaacagcattccgtgaactaacaaataagagtttattttttcttttttctcagagcaggtagcattttatattaggttaaatttttgtttatttaatataaattttttttattaagataatgcatgtagattttatgtatttattttaatttaaaataaatatatattttttgttgttatctatgaatttatgtttattcattcccttgccaagtaatatagttcgtgcgtttgccatttttgtgtgctcatataattagtatttttactggttgtcttcttaacttatattatttataaatcattaaaacattaaaatttaaaagatttctaaaaattttaaaaacgaatagaagatagaaatgtgctagtattttcttattggattcatttaatctcttgtaaaacacacttatttttttaaagggagcagaactatgcatttaatttttaaattttcgctatagttattaacttaaagaatcagcttactttgtgtagttttttttaatgtttgtcaattgacttttatataaaaaattttaatattttattatttatcaagcctcatgaatgaaaaaggctgattttttagattataaataagaataaatgttcatttaatttttaattttttttcgctattttaataacctaataaatgagctacatatttaaaaatattttttacggatagaagttagaatcattttttctgatagagtttattttttatttttacctttcaattataatactgacatcataatcattttgtaacccattgtcccaatcaccacccccctaatcacatatgacataaccaattgttgccgtgggggcggtccctttaatccaactcttttccccttccccacttctccacacaatcagtctctgtcccgactgcgaatcgggaagaggcggtccatccaattgtataaaattcttgaataaatgattgttaacaccaccgctaccaatttgggaatgatgatggacccgcctggacccacagtattcatggaggtcccgccctaaggacagagactgtacatgtacatactgtatcatacaaaattttttattaaattaattactggaaaatataaaataattataaaaattttttcaacaagtccagccaatgcaaaagagaaaggaagtgaaattaatggaaaataataacagaaagggagagagaattgtgaggaatgaaagagaattgaaatgccggaatggattttaataaaatttaaaaaaaggtgtttaaagcaacaaattgccaatggcaaacatccatcattggccaaggctcaaacaaaggactccgaaacaggctaaaaagacagaaagggcttatcaattaatgttaccaatgtgagtactcacaatagccaatgatgaggcattcttacgagccccagagcgcaaagagtggcgcaaaatgtttttgttgggcaatgaatgatcgccgaaggcacgctgagcgaaagaaatttggaaaagttaaaaataaaagaaaatcctccccaatcattacatttttcgaagaacgacgagaaagtcggccaaaacacaaaaaacagacaaagaaggcgaggaaaaggccgagaagcaggccaaaaaacaattgggcgagcaaaaccaatacaaattgaaaggccggcagcgaaaaataattggtgaaagtgttagggtcaacggaagcccccaagcaaatgttagggttgtcaaaatgcaatggttcccagcagcggttcggaaaagcgcaaggaattttgcaatttgcttgcagttcccaagtgacgtggtacattttgaaatttaaaacggaaataattaataaaaataaatggcaaaaagtgagagagaaacggcaaagaaaaaatccacaaatgacgaactgcgatgaacgacggactgtcaattggagaaataagcacattttgcacctgcacacatcattacatatttcacaaaattgcactattataaatcacaattttgcacaaaatcaaatttaaattaattaagcaaatccaaacacaaacaattgcacacagcacttattaaagcattctctacaattgtcgacaaatcaagcagtttcaaacaaaagtgtgccaagtaaaagcaaagccgaaaggaaaaaaaggacaaaagaaagagagttaaaaaagggagaaaaagtgactttggaaagtgaaaaagttaacgttaacagcagaaataaaaagcaaaaaatggcggatgttgatgatttggaagtgaaatttgaggccttaaaatgaaaagtgaatgacttggaagataaattgacaaataaacccgcaacaaatttgccagcggggataaaaacgccgaaatatgatgctacagtcgactttttcaaattcatacgagaatttaatttgatggcaactgccagcaattggcatgccacggactgcgtccgaatgtttccattatttctcgagggagaagccaaagagatttttcttaatattccgcctaataaaaagaaaacatggcgagatttaacaaatgccatggcggaccagacaaaaaaaattgacggtccaatgtggccaaaaaaattgttggccagagcaaaaatgggccacgaaagtataacagaatatgccaataaaatacgtgagttggtggaacaggcctcccccgacccaaattacacgagcgaggcccgagaatgcgagagtgtccattattttttaaatggactcccgattttcctaaaaaggaaattattttttatgaaaaaaccaaaaacgcttgttgaggcaatttccatggcaaaagaagttaaccaagcaagggaagaacttgcaaatgatgaaaagggagatgaaattaaacagcaaataaatgagataagggagcaaattaatgttatttcgagtcaaaataatggaaaaaacgaaaatcaaagagaatttgttaacaattcgtggcgtaacaattttggaaacggaaattcttggaatcgtgggagagaaaataattacagaggagggcagagagcacggaattttaataaattttatacgagaaacacaaatattggtccgagaaattcaaattttgtaccgcttaaccaaaacaattggaacagaaattggaatgaaaatggaggaaataatgatcgaaattggaacggaagattccaacgaaatttggaaatagccgaggaaatacgagaagaagaggaaatgacagacaaaagtacagtatcaatatggtgggaaatgaagaagaaaccccctcaacatcgttcagacgttcacctaccccggtattaagctttttaacaatcgcaatgattttttgtgcattatttggtaattctgtggcacaataccaattgtgttggaccgagtaccaacaactccgatttctttaccgaacatttctgaatgtactgtcccgaaaaacgaaaaagcagcggaaagtacagtaacgctttttgttcctattcgagacccaaaaaaaattctcagtttataaatgttaccaaaaacttacaaaaatttgcactggcagcctcttattcttttggaaagacataaaaagctaagacacaattgttaaaggagtgaattttgaaaaatgttatgattttaaaagaaaaattgaactgaacagacaaaaaatacggtaattaccccaaaaacaaaaatggcggcagtaacaaaaacggtgccaactccaaaagttgaaaccccacctttttcaaaaagctggataaaattgaaacagactgagcagaaatacataataaaaagagtgaatgttgggaaaattggtacaaccataattccggttaccaaaacaactaaaactgtgaaaaatgccccaacaacaacggtcaaaactccgttaatgatttttactacaacaaaacccaaacaggaaaaaacacccaagaatatttcgaattccgtttttgagaatgaaaagtcaaagcagggaaataagacaaaaacagagacaaaggcgaaaaaggaagaaaaacaccccaaaacggtaaaaattggtaaagaattaaacgaaaaaacaatgcctaaggaggaaaaagttccaaaaattgtgaccaaaaacataaccacaacagaaacacctaaaatgaccacaataaaaacaatttcaaccacaactcccaaaccaaaagtgaatgaaatggaaatgaagtgatgatcaaaaagttgggggaaatacgacaaatggcgttgtcaatcaacgaagaagtgcaaaatgttttgggtttaattgagaggaagggagagatccaacattggcaggaaaatggtgcttggaacagacgcggacgaggacgtggcggaaacttttaccagcacggaagcggaagaggcaattggcaacaaagaggcagaggacacattcatcgtgcggactggacgactccatgcacatcacgatcagtgatgaatgaatggcaatgaaatgggcaaaaagagcaacagctggactttgttaattatgttgcatttaattaaattttcctattttatttcaaataacaaaaaattaataatcaaaattttaaacaaaatttaaatttaataaataaatgcaacataatatttttcatttttgtaattttcggggtcgaaaattctggggtccctcgatgacatcataatcattttgtaacccattgtcccaatcaccacccccctaatcacatatgacataaccaattgttgccgtgggggcggtccctttaatccaactcttttccccttccccacttctccacacaatcagtctctgtcccgactgcgaatcgggaagaggcggtccatccaattgtataaaattcttgaataaatgattgttaacaccaccgctaccaatttgggaatgatgatggacccgcctggacccacagtattcaataccatttatttttgacagattccattttcttttaaaatttttatctccgtatgtctttaatcaacaaaaatatattaattattcatttattttattcaatttgcaagctaataaatctgcttctttgtaaaatttttatttaatttagatagttttattatgttgttgcgattaatttttctcttatttagttttatttttgagatttattggtcaagcccaagaaattttttactcgttcccaagttgaggcgttgagattgagctaattaggcataattgttcctttaaaatgttttttatttcatttttgaatatttcatattatttcaatttttaattttttgttttatactagatcaacttcactataaggactttgatttaattacatcatattactaacttaaattaaaaatgttttatgaaataaatttttttaaggtattcttaataaattaattattttttgagtattaactccctctaatttaatattttttgaaattcaaactatcttgtttaatataaaaaaataatttttttgtgaaatctcgattgtagcttagggtttcatctacagttgcattcatgttgtttatgacaaactttgtagtttcatttctttcaatagatttttaggcattttttattggtttgccaatattttattcaattctttggtcttaaaatcatttctttttataacaattgcattaattctgaaataattaaaatggtatttaacaatgtttctgtttattaataaaattttgtttttttattttacaatgcttccagagtgacattatagctttgtatatatatatattttaaacaattagtaaatattttaaattctttacaaatatctcaaattttgtgaaaagaataattattttatatctattgaataatatacaaattttctatttagattatattaatttttctttgttaattgttcatttaattttaaacttccagattgccaaggatttgtatcttttttatttttcatttgaattgacaagttttttaatggcttacgatttttgcgttattaatttttttaatcgtgtattaatttataactttttaattttgttttactttacatttggttttgttttgaaaagcatcgagtgtttcttttataaaagcatcaaatttgcaattgattcttaatatttttattatttcataacgtctcctcctttgttcatagtttccataatattttttcattttaaatgcatatatgtgtaaattttatttaatttatttaaaattttttgaatttttatttatttatactatttgtatgaaatctaaaattttttgtatttattttcaaagaaaaattaactatactttattaataaattagcataatcataaaatccacaacttttttgaaaacattaattgacagaatttaaaattcaaaacgcatttaggtataataaataaaaaaatttcttgctggcattaagcaaattcttttaaataatttaaaaaccttataaataaattttcaataattgtgtgtgattgcagtttttttattttatgattagatgttcattttttatttgaagcataaaattgaatttacaaatgtattatgttgataaattattttagttttagtgatattctcaattttgtaatttttcttcataatattaatttttatcctgcattttttcatatttagcttttcttttaaaaattcatcaataaatgtcaactatatctgttaataaataatattaaattgttgatttaatatagttctgcattcgaaactactttaaattatttttttctttttagtatttcatgttgttggaaaattttgaatctattttaatgataaagttccggagttggatggtgtcaaaagaggaacatatgaggggaattttagaaaaatttaataatctttctttctttgtaagtttttgtttttttatattaaaaaagctaacaattctgttttgattttttaaagtgattaaaatattataggatttacaaaaattataatttcattttttcttttgcaaaagcttctgtatatatttgacgtatagaggagggtctagagtacttataataaaaatttgcaacatttgatgcttgcattaaaaaaatttgaatttttttaaagctcttaggaaagtttttaaattttaattagaatgatatttagattcatcgaaattcttttatgaccagctacccttgtcatcattaatttagcggaaggttaataaattaatagaattttatttcaaacagaaaatattttatttaaaaaattttgtattttagaatggtataatttattaaaaagctaaatattaatgatttatctatttgtttttaattaataattttaagcatattttttcacttttttaattcagcaattcgcttattgtaatttttattttttgtaaacaacaaaaatttcaccatgaaattttgttttttttggttattatcaaatgaaaaatcgattaaataattgaatttcattatttttttatatgatatgtattattcttattcatttttctgaatacattatacttataatttgattattgctggccaataaagcaaacactaactttttatgtttattatatattcataatttttattgaaacgaactaatgttttgtcattttttgtagcattttttatggcctttccaatgataccaaacattaagcgaaatactggtcatgcccgaattacatttgactttgtctgccacactccatttttgggtggtcatatgtttatggacaaaaatttaatctcataacaaatcaatattttgtgggcctaaaaattatgaaaaaatgcctgctcagctggcttttcatgctgatccccccagaaggaagacaacttgatcagatcactccttc

SEQ ID NO: 495 - DNA, 4238 bp, Heterodera glycines
  misc_feature (4166)..(4166): n is a, c, g, or t
gggacatcccaaaatacactgatattcgggaaaattttcgaaaaaattcctagggggttgggaaaattttttctggaaaatttgagtagtcctgtcataaggagtacaaaattctctacagaattgtcttttggatggttggtctaagaattatactcgctgaggtttgggcacttcaattttgatgttgatcatctccactgtaaaatgcactattttctgaagaaatacagtactttttgtagacaccgaaattgaagtgcccagcccatacctcaacgggtataagccatagagacatgcgatcatttgcattttgtagagaattttgtgctctttcccataggtctactaaattttccagaaaaattttcctaacaccctaggaatttttttcgaaaatttcctcgatttcaagccatttttggtttttcagatcaccatgaaggagtgatctgatcaagttggtgtaaaagatttttttgttcagcatcaaaagttagcttagcatgaattttttcagaattttctgccaacttggaaattgaatttttggcgattaactattttgtccataaacatatgaccacctaaaatgggcgctatgcctattcactcacgtgtcattttgttaataattattatttcagaaattgatttataggtttagaaagcccataaaaaatgctacaaaaaatgacaaaacattagttcgtttcagatttattcaagcaaaagggcaactatttttctcgatttatcatttgtccataaacatatgaccatgactgtatatgatgtcgctcctgtacttgctgatagggacagatattgttcacattagaaataactttttatgattgtacattgtcagaaaatgcataattttatcaatcattaataaaattcaaattagttaacttattacaagttagcttattaattttataaattgtacaaaatttttttttttttacaaaatcattattaaattaaaattaataaatttatttattattttcttatactttccctttagaaataaacttaattttttagataattgtaaatctcgaattttctgctttttattacctttttaatttgagtataatataatttttttctcacgtttcttaatataattctactaataaattattctttatttaaactttatctgtcgaagtgacaacagacgtttcgatactctaaaaaatagttttatttattaaaacataaatgagaagaaaatagtagaaaaatgaagtggaatagggaagggagggagaacgaccaattggattgtggcaaagccaagccaaatgatgtgctgacaatgagagcagtgccaaaggtgccctcgaaacagcgtcaatttatattgattttcttccaaggcacaaagagagaaaaaaaaataatgagagacagagagataacaaaagttatgactttttatttacataattttcttttattttacatgagtagggagcgaatttttaggtttttaattatttttctgctgctttaatttaatgagaaatgcacaatttcaaaaaattttcgttttagtgcaactattcttcactaggaattcactattttggagcatacgaaattttatctgacaactctacaaattgaatttattatccattgcaaataatttataataattcattatctcttttatatttggttcaataactaatatgtagcttaaaaaagcaactatccctttgcaccaggttttttgagtttttgaatgacactatttttaaataagcttatttttttataaataatgcatatttatattgtttatttcatgcaatcagtagggctgctaattttaggtaaatacctaaaatttttgcacacttaatacacggagattgttgatgtttttcattattttttcggcgctagttaaaaagtggcctttttttgaaaaaaattttcacttttttttggtcaaatttttttttttttgttttgatacagaatttgtttttttaacagatggtacgaatgacaaaaaaaaacaacaaaaaaatgtgaaagattttgaattttgtcaaaaaaccaaaggggggactctttttgtttaaaaattgaaagattttgaattttatcaaaaaccatagggggacccttttttgcaaaattttttgaaacaaaaaatcgtgaatatacttttattcgccaaattatgctcaatgattaatttgttcatcgaaaccaaaggtgaaaagaagaattattttgtatgaaagtaaagagggaaggagagagagagtgaggagaggagagaaaagaggaaaggaggaagagagagtgagagaaggagagaagagtagaaacgaggaagaatagagaggagaggagagaccagtcgaaatgatcgagacaaaatgtggaaaggagggaaacagagaaaggaggaatgaagagaggaaagagcgagagaagagtagaaaggagaaagacaaggagagagagaggataggaaaatagaaaaaaataattaaatgagaaagagagagagagtgagaagaaaaacgagaaagagagagagtgatagaggagagaagagtgaaaaagagggtgagtggggagagaagatgggaaaagagggagagagactgagaaagaaaggataaatgagaaaaagaaagagagggagagagtaaggagaagagaaaataaggaaagaatgagagagagctagaggaaaggatagagagggagaagagagaggaaagtagggggagagactgagaagaaaagagaggaaaaaagaggagagagaggagggaagagaagagaggaaagaagggagagagagagtgaggaaaagagataataaggaaggaattagagagaaagagaggagaaaggaaaggaggtagagagactgaggagaaaagagagcaaaggagaagaatgaggaggataaacgaggaaaaaagtaagtgactgaggaagaaaggagagagagagtgaggaaagaagaggaaaggacggagagagactgaggagaaaagagaggaaagaaagatgaacatggaggagaggagagaagagaggaaaggatggagagactgagaataaagaaaagagagagagtggggagataagaggaaaggggagagagagtgagtgaggagagataataaggaaggaattagagagaaagagaggagaaaggaaaggaggtagagagacagaggagaaaagagagcaaaggagaagaatgaggaggataaacgaggaaaaaagtaagtgactgaggaagaaagaaaggagagagagtgaggaaagaagaggaaaggacggagagagactgaggagaaaagagaggaaagaaagatgaacatggaggagaggagagaagagaggaaaggatggagagactgagctcagtggtccgggttttggaactttcactttttcgcatttttgttcgtcatatttttatggtaattaaaatgtcaagaaccttttttattatgtaagtgaattaattcaataaaatttaaagcaaaaaagaaagctaaagaaaatttgctaaatggtcaaatacgtgctgacgcgtttcataaaaaaggccacccatgcgcgttttgtaaaaaggctaatgggctcgaaataaaaaatatgtaaacacataaaattcataacttggctcaagttcaaccaaattaatatttcatggtatcattcaatagctttaattgatctctatcagaatatgattttacaaatttttttacttaagtatgagaaaagttataaagcattggacaactatgttttttggtatgtatcgtgattataactataataaacgtgtacgacattatatcagtaaaatgtgctctaataatgcagattttattacttgcaaagaaattattaatcatcactgtcagacaaaaaacaatgccaactttctctaatttaaaatttccatatatgttcaaaaactacatgtgactgacgcgttttctactggagcattttcgggagatgagtcttggttctcccgatcactgattaatttcattttccgtttgtttttttgatattttcccccattttttagtgcgttcccggcaacttccaaccagcttaactgatcacgacgttttgacggngaaaaattgtggaaaaccggtgaagcatccccatcaaacagcaactttaagcataaacggttttttcacggt

SEQ ID NO: 496 - DNA, 3073 bp, Heterodera glycines
ctctaattacctttaaaatttcagaaaatttcatttatattaaaaaagttctggacaaaaattcctgacttaatattttttgaaattttgtgacaataactttttttttatgtttaagtaaaaaattttataaaatcatgatagagatcaattaaggctattgaatgatacaatgaaatattaatttggttgaacatgagccaagttatgaattttatttgttacatattttttgtttcgaacccattggcctttttacaaaatgcgctggcccttttacgaaacgcgcatgggtggccttttttacgaaacgcactagcaccgctcaaataaatgacaaaaattggaaaaccaagatgtggtaaagcattgccaaaaattacaaataccatttaaataaatgcttaaaattgcaaaaatctctgcagtctttatccattttggcatcgcaacagcaagccaaaacatcaaaccattattataacaaataattcacttaatttgtaaaagttcaattatcaattaaattaaaacaaaatagacataataaaaaacattttttaatgatagacttaaaccaaataaagttagcaacatctcattttctaaaaattttttatttatgcttagatttaaaaaaatattattacaaaattatttttaaagaataattcattatttagaaaaaaccaaacctttaatactaatacatcattaaattaaaaagtttttaaattaattaataaaaaaaatgaaaaataaattagaaatttaattttaaattaatataataaaaccaacacaagctataaattattaattatggttttattaattggagaaattttataagaagataaaatgccgagaattaattttaaattaaaatattaatacatgttaatcttggaagaattttatatgataaattaggtgatttaaaaattttagaaaatgtaaacctaataaattcttaaggaaattattgaaaaatgtaaaaaaaaatcgaacctttttctaaaatttatcaacataaagaacaaacaatattttgaatataaaaattgaattattacaaaaatataactcattattaaataaaagcaaataaaaaatcaaacaataataatatgggagacaggcaaaagttgtcagttttttttgctagaaatacaataaacggtgtaaactttaaggtagagttgggcgctaactataatctttttattatttattttgtaaaaaagatgatctgctaagggttataaagttacttctataaagaaaatattctccattcaattatactatatgaaagaaaaaactataaaatttattaataaaaaacaaattttaaatataaaaatagacttaaaaaatgataaaaatttaattatactttataataaaactaaaatatttcattattaaataaataaaatgacaaatagctaaaataatgatttctaatgttaaacaaaaaacatgcaagaaaggttgcaagatgatgtcacgaacaggattacaatttatgataataataaaaatgagaatttaaatacaaaatttaaaaacggaaaaaataaataattttctaattatatatgcataaatttaatgaaagtatttaaatcataatgaactatattaagtgtgaattaaattatgaaaataataatcattaaaaaattctttaataactaaaaattgttttgcataggattcttgagcacttcacacctttttgacgaaagaaaaacttaaaatatttgcgaaattttaatatcatttatatatgtccaaaatataaataaattaatatctaatgaaaataaataattatttttaaaaattaattttatggacaatcaatgataggttgtttaaaaacacccaaatgccataaaattctcgagttttgcctcttaaaaataaaactgacccaataatacatcagctaatcaatacaccaaaaaatttataggcgaacaggagcgcctccgtcaagataaaaccaatcgcaaagcaaaaacttttaaatttaaaattcgaaaaataaatcctttatgtgtttaaacagatatatttatttcctattgtattagactggacgaatgaatgttatatgaatattctaaaaaagaaaaattatatgtataaaataaccaaaaatgcacaagaaatcatagaccattaaaaaataaacaataaaaaagtaattattcccacaaattataaataataattaaaaaatatttgttttaaatgatttatttattgattaacaaaaaccaaacaatagtaaatgtaagtaaaaatccattaaataattaaaagttcattaaataatgctaaaaataaaaaattaataaaagtgaaaaataatataaatttttccatcaaaatatacttctaaaatcagtgattttattaaaaagcaaaataataaagcatttctttttaaatgtagaaatagttaattactgaaattataaaaaaatagaataaggcaaaactctaaatcgaaatatatatttaaaaattttagtaaaaagagcaattaaacaaaagaatatcaaatagtgctattatgtcgattacttttttcgaacttaaaaatatacgtattttattcagaaatattcagaaatttaaagtcaaaaaatatcaaaagagccttcatttgaataatcagaatataaacataattgttcttaggaaatgcataaataaaaacaaaaacatataaaatcaaattatcatggaatttctttccaggaaatgcattttggacgggtgctaggtcgatccacaaaaaaactcagtgtaggcgatccacaaaaaactcagtgtgggcgttccacaaaaaactcagtgtgcgcgttccacaaaaaactcagtgatcgataaaattaaataaataaatctaattattcaattcacaaaacacggcgccgtccggttaatactaatgtaccgcgggacgcaagtcattttcaaattttatacaaatttcaatttttgacatcacttctcgcctattctctccatttgtaatagacatagcctgacg

SEQ ID NO: 497 - DNA, 1442 bp, Heterodera glycines
actcaggcacgattttggactattaattgatttgtggttgagaataataaaattaaacgaaaaaacaaaaaaatatttttaaaaaattttttgaaataattacttaaaaacaaaaaattcaaaatctaacaacactttttaattagcattaaaaaataaatccattatttaaatgaaacaaacgatgcaaaattttggtaaatttcttgcctaatttggtacaaactttattgaatataaaatattaatattgtacaataggcaaaaatatagatttttcctccaacagagggttttatatttgcttaaataaaacgtaaaaaatgcgacccaactttttatccactgaggttcatctacgtttttaaataaaataaaacaacaaaatgactttaatatattaaataaagttcatttaccaaaaaatactcacaataatgacctgatcaggcacaagaataggaatctctaaacaacgaattttatatagtcactttccttgagattataatgcactataaaaatttaaaaaataattaatcagaatataattaccacaaacccattaaattaagaggtgtgaaaaaattagactttatgtattgattaatattcatattcccctttttataaaattcattttggttggaaaactaatttttaaaacgtaaattagtgaccaaaattaaataatgtatttataaaaaaatgctaacaatttaaatgaatgagtgcaaatcatgaagaagcacaattagtgaccaaaatcaaataatgtatttataaaaaatgctaacaatttaaatgaatgagtgcaaatcatgaaagcaccgattgagtccattgaccggataccaaaatttcagcactttaatagaaacgaagagaaaattaataaaataaataagttcattcgcagtaacatcaaagctcttccttcgctcaattagaaaaataataatgtaatgtaatatttatttaattatgtaataaccaagaaaacataatacaaatattatattgaataagtttgataagacttcttaaagatgggggaacaagtcacgagtaaataaaaaaataatagaatttgcagtacatttttttggcatttcaaataaactaaatacaattttttataaaaacattaaaacaaaatttaaaaaactcctaaaaaatttatattaataaaaatgaaaacatttcataaaaccgttttatatgactgtttttagtagggctgtaattaaatgaacatgcatatttttatgaaatatattagacctgaaaagcacgaaaaagcatctttttaccgtgtttccataagcatttgcatattttgattttgtgcaattgcatttttcaaaaattcacatgtaaaaacgcctattttgagctcaaagattattcgttttttttattcgagttttgttaatgttctt

SEQ ID NO: 498 - DNA, 7664 bp, Heterodera glycines
gacggggggaagatggtgcagaacgcatttgagtgggcaaaacagaaggcgccggctatcatttcatgagcgaaatgggattcgattggtgcgcgcatttttgaatttgcttttactgacattgtgtttattccttctgcaacgcaggcacgaaacgattcgacgcctctgacacgggggaccgagacattcagcggacgatgttggagttgctgaaccaactcgacggattccaacccaacgacgacatcaaagtgagtggtggagcaagccaatcaattcacattcattttgttttcatttaacgcaggtcattgctgcgacaaatcgtgttgatgtgctcgacccggcccttcttcgctccggacgttttgaccgcaaaatcgaattcccagcaccaaatgagaagggcagggaacaaattcttcgcattcattcgcgccggatgaacgtcgagtcggtgacagaattttaggaaaacaaattattcctcgttttcagcaaaaatgtcaactttgttgagctgtcgcgctgcattgaggacttcaatggagcacaatgtcgagcagtttgtgtggaagcggtgagcggataaacattttttgaggatatgcgtcagcttatctcatttttacagggaatggttgcacttcgtcgtgactccactaaaattctgcatgaggatttcatggacggaattttggaggtaattagtaacaatttgagaaattttgggggaataagccaaacttttcaggtgcaatgcttgaagaagaataatctggtgtattatggctgatgggcgtcttctccggcggaatttaactgatgtgccacggctgaacactgcccagcaatttgtattgacattgacccatttccatgtgatgccttatgccttgtagcctgtattgtactacatttcgtatatgtgtttttgccactgtatttcatgtacaaatgttctcgtttagtgaaattgttgtttgtgtgtgtttgtttatattatgtacataaattattcgcgcgtatagagaagtacccgatagcaaactgtaaccgtataagtgagcaggaatttcgtcactgaataatacatttgaaactcataattaatatttttaggtcctaaaaaacagaataattgctaaaaacgagaaaaagtgccaaaaaaactaaaatttagggggtgtaaaatgacaaaattttattccaaaagcttgagttaaattatttttaaaattacaaatagttcatatcaaaaaatataataataactagggtgcggattcttaggtttttacttattttttctgcggctttaactcgacgagaaatgcacgaaaaacacattttttgttcggaaattcttcgttttaacgtccctatccgaccctaggaatccctattttggatattcgcccctaaaaatccctattttgagtgttcgcccctaaaataagtttttatccctattttggcgtttcgcccctattttcgcccctatttcgcgaattttttgcccctatttaggtccctaaattggaatttttcgcccctaaaaatccgcaccctaataataactttaaatttatgaatgattgcaaaaattcaatttattttatttaagaaaataattagcaaaaacttcgcccaattagtgacactttttgcagcccttcgaattgtcctcagacaaatcgcaaaagccatctttgcaacggtcacagctgaacaaattaacggataaatggagtcattgtttaaatttattattattattattttaattttctgtccaatttctcccactttttcccctgcacattttccttgcaaaggcattgtccggccaccaattggcgtgccgtgtcatcctccgccacgcatgtgccgtcgttttgggtgccccttttgtcgcattggcatggacgacaaacatttgggtcttgaagagaacctctcatggaattttaaatctttaaagagtttttaagtgtacaaatccttcaaattggcattattttgaaaggacatttgaaacaaatgtatgtacgttaattcacttggcactgttcacaattcaacccttttgtgttgtgtttgcattcgtaaatgtcatggacaacctcataagaacggctttaaatcaacaaaataataataattaatcaaattgaaaattgtggcacattgccgcgcctggcatggtggccgtactcatattttgtgtatcatcgtgctgaattaagatttaatttgaaaaatattcaaaataggaaactctcgcacattttggcgcactgcaactgcacacaatgcaaaaaaaacgtccaaaattgtgtataaaagtcgctgttgtgatgcatttttctcatattttactaacggggcgtaacacaacgagaagatggcgcacccagccggagatgtggtgagcgattggtgcttttcattttctttttctatgtcatttcattttttcaatttttcagaccgacgcccaagtgctggagatgtcttccgaccaaattgacgaacgcgtacgacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatgacgaaaagcattttcagtacatgaaaatgccgtggctggtggccaatgtcgtggaaattctggacctcgcggatgaccaagcggaaggagaagaaggctcgagcagcgacttggacgcgcgtcagaagaaaggcgcagtcatcaaaatatcgaagggactcgtcatgtttttgcctcgcattggtcgcgtcggcccagacgagctgaagccgggggacctggtcggcatcgacaacgacacttatcacatcatcgcaaaattgccgccccattttgaccgacgcgtcaaggccatggaagtggtggaaagaccgacggagacgtacagcgaaattggcggatgcgagacgcaaatcaaagagttgcaagaggccattgtacgtgtcaaaaaacaattttggatcaaaacttcccattttctcattttcaggtgcttccaatgaccaaaaaggagctgttcataaagattggcattcatccaccgaagggcgtgctcatgtatgggcctccaggtgtcgtttctcacaaatcaattcaaattttcattttttctgataggtggcggcaatttctctcttttttaaggaactggcaaaacattgctcgcccgtgccgttgcttctcaaacaaaggctacctttctgcgtttgtccggtactctgctgaaccaagtgggcctcggcgacggggcgaagatggtgcagaacgcattcgagttggccaaacagaaggcgccggctatcattttcattgacgaattggattcgattggtgcgcgcatttttgaatttgctttactgacattgtgtttattccttctgcaacgcaggcacgaaacgattcgacgcctctgacacgggggaccgagacattcagcggacgatgttggagttgctgaaccaactcgacggattccaacccaacgacgacatcaaagtgagtggtggagcaagccaatcaattcacattcattttgttttcatttaacgcaggtcattgctgcgacaaatcgtgttgatgtgctcgacccggcccttcttcgctccggacgttttgaccgcaaaatcgaattcccagcaccaaatgagaagggcagggaacaaattcttcgcattcattcgcgccggatgaacgtcgagtcggtgacagaattttaggaaaacaaattattcctcgttttcagcaaaaatgtcaactttgttgagctgtcgcgctgcattgaggacttcaatggagcacaatgtcgagcagtttgtgtggaagcggtgagcggataaacattttttgaggatatgcgtcagcttatctcatttttacagggaatggttgcacttcgtcgtgactccactaaaattctgcatgaggatttcatggacggaattttggaggtaattagtaacaatttgagaaattttggaggaataagccaaacttttcaggtgcaaggcttgaagaagaataatctggtgtattatggctgatgggcgtcttctccggcggaatttaactgatgtgccacggctgaacactgcccagcaatttgtattgacattgacccatttccatgtgatgccttatgccttgtagcctgtattgtactacatttcgtatatgtgtttttgccactgtatttcatgtacaaatgttctcgtttagtgaaattgttgtttgcgtgtgtttgtttatattatgtacataaattattcgcgcatatagagaagtacccgatagcaaactgtaaccgtataagtgagcaggaatttcgtcactgaataatacatttgaaactcataattaatatttttaggtcctaaaaaacagaataattgctaaaaacgagaaaaagtgccaaaaaaactaaaatttagggggtgtaaaatgacaaaattttattccaaaagcttgagttaaattatttttaaaattacaaatagttcatatcaaaaaatataataataactagggtgcggattcttaggtttttacttattttttctgcggctttaactcgacgagaaatgcacgaaaaacacattttttgttcggaaattcttcgttttaacgtccctatccgaccctaggaatccctattttggatattcgcccctaaaaatccctattttgagtgttcgcccctaaaataagtttttatccctattttggcgtttcgcccctattttcgcccctatttcgcgaattttttgcccctatttaggtccctaaattggaatttttcgcccctaaaaatccgcaccctaataataactttaaatttatgaatgattgcaaaaattcaatttattttatttaagaaaataattagcaaaaacttcgcccaatcagtgacactttttgcagcccttcgaattgtcctcagacaaatcgcaaaagccatctttgcaacggtcacagctgaacaaattaacgaataaatggagtcattgtttaaatttattattattattattttaattttctgtccaatttctcccactttttcccctgcacattttccttgcaaaggcattgtccggccaccaattggtgtgccgtgtcatcctccgccacgcatgtgccgtcgttttgggtgccccttttgtcgcattggcatggacgacaaacatttgggtcttgaagagaacctctcatggaattttaaatctttagagtttttaagtgtataattcaaattaacagcttttgttaggctttgcgattgcttgtaaaagtacagcttgcatttctcgcaatttctgtcccgtgtgttttgttggcaattgtcgtagacgccgcccgaggcaaaggcagtcgaattgtaaacggaccaatcgaaatggcacataaaataaaccattaaaattaaatgcatccatttaaatcatttttgtggcttttaccgcggcacgtgtccattgcattcgcattcgccacgctctttggactgctcgccgctgccggggcgccacggcaaatcgttgtacaaatccttcaaattggcattattttgaaaggacatttgaaacaaatgtatgtacgttaattcacttggcactgttcacaattcaacccttttgtgttgtgtttgcattcgtaaatgtcatggacaacctcataagaacggctttaaatcaacaaaataataataattaatcaaattgaaaattgtggcacattgccgcgcctggcatggtggccgtactcatattttgtgtatcatcgtgctgaattaagatttaatttgaaaaatattcaaaataggaaactctcgcacattttggcgcactgcaactgcacacaatgcaaaaaaaacgtccaaaattgtgtataaaagtcgctgttgtgatgcatttttctcatattttactaacggggcgtaacacaacgagaagatggcgcacccagccggagatgtggtgagcgattggtgcttttcattttcttctatgtcatttcattttttcaatttttcagaccgacgcccaagtgctggagatgtcttccgaccaaattgacgaacgcgtacgacagacagctcgacgaagaaattcgcgtcatgagggacgaaatgcgcaaaattgcgtacaacatcaaaacaatgggaacgaagacgaaggagaacaacaaacagatgcagaaagtgagcaaacaaacaaaaggaggaacgacaaatttatgacgaaaagcattttcagtacatgaaaatgccgtggctggtggccaatgtcgtggaaattctggacctcgcggatgaccaagcggaaggagaagaaggctcgagcagcgacttggacgcgcgtcagaagaaaggcgcagtcatcaaaatatcgaagggactcgtcatgtttttgcctcgcattggtctcgtcggcccagacgagctgaagccgggggacctggtcggcatcgacaacgacacttatcacatcatcgcaaaattgccgccccattttgaccgacgcgtcaaggccatggaagtggtggaaagagcgacggagacgtacagcgaaattggcggatgcgagacgcaaatcaaagagttgcaagaggccattgtacgtgtcaaaaaacaattttggatcaaaacttcccattttctcattttcaggtgcttccaatgaccaaaaaggagctgttcataaagattggcattcatccaccgaagggcgtgctcatgtatgggcctccaggtgtcgtttctcacaaagcaattcaaattttcattttttctgataggtggcggcaatttctctcttttttaaggaactggcaaaacattgctcgcccgtgccgttgcttctcaaacaaaggctacctttctgcgtttgtccggtactctgctgaaccaagtgggcctcggcgacggggcgaagatggtgcagaacgcattcgagttgtccaaacagaaggcgccgactatcagtttcattgtcgaattggatacgatgggtgcgcgcattggagaatttgatgctagatgaccatttattcgtttttcactgcaggcgagatgcgagtaaacccctttgactcgtcgggcagtgtcagtcagagcgtcctgatggagttgtaggaatccctattcgggatattcgcccactaaagtccttatagtgagtggtggagcgtgacataagattcactccctttttgggcgtttcgcccctatgtccgcccggtatactcagatgaattttatgcgcttatttaggtccctaaactggaatttttcgcccgctaaaaatccgcaccttaataatacctatgaatttatgaaggatggcaaaaattcaatttattttatttaagaaaataattagcaaaaagttcgcccaattagtgacacttttagcagcccttcgaattgtcctcagacaaatcgcaaaagccatctttgcaacggtcacagctgaacaaattaacgaataaatggagtcattgtttaaatttattattattattattttaattt

SEQ ID NO: 499 - DNA, 1957 bp, Heterodera glycines
ataattatgcaatgattatgttcagatatgtttcatcgcattacttatcacaaaactacctcctaacgtattgaatgatttaaagctccttttttgtcagattacgcaataaggactgcttctttccgttgtcttcattggtggagtaattccaggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaataatgtcgcggagaaaaaggtgctgcagaaatatagctttaagaattaaaataacattgttaaactgtgaaaatcaaaaaatgatgaattttgacgaagattttacaatttgtgggaaacatttcttgtaagccgtctctgatgccattttctaatgatttaaagctccttttttgtcagattacgcaataaggactgcttctttccgttgtcttcattggtggagtaattccaggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaataatgtcgcggagaaaaaggtgctgcagaaatatagctttaagaattaaaataacattgttaaactgtgaaaatcaaaaaatgatgaattttgacgaagattttacaatttgtgggaaacatttcttgtaagccgtctctgatgccattttctaatgatttaaagctccttttttgtcagattacgcaataaggactgcttctttccgttgtcttcattggtggagtaattccaggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaataatgtcgcggagaaaaaggtgctgcagaaatatagctttaagaattaaaataacattgttaaactgtgaaaatcaaaaaatgatgaattttgacgaagattttacaatttgtgggaaacatttcttgtaagccgtttctgatgccattttctaatgatttaaagctccttttttgtcagattacgcaataaggactgcttctttccgttgtcttcattggtggagtaattccaggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaataatgtcgcggagaaaaaggtgctgcagaaatatagctttaagaattaaaataacattgttaaactgtgaaaatcaaaaaatgatgaattttgacgaagattttacaatttgtgggaaacatttcttgtaagccgtttctgatgccattttctaatgatttaaagctccttttttgtcagattacgcaataaggactgcttctttccgttgtcttcattggtggagtaattccaggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaataatgtcgcggagaaaaaggtggtgcagaaaatatagctgaaagaattaaaataacattgctaaacatgtgagaatcaaaaa

SEQ ID NO: 500 - DNA, 2391 bp, Heterodera glycines
ccgtttctgatgccattttctaatgattaagctcccttttttgtcagattacgcaataagaactgcttctttccgttgtcttcattgggtggagtaattccagggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaatattgtcgcagagaaaaaggtgctgcagaaatatagctttaagaattaaaataacattgttaaactgtgaaaatcaaaaaatgatgaattttgacgaagattttacaatttgtgggaaacatttcttgtaagccgtttctgatgccattttctaatgatttaaagctccttttttgtcagattacgcaataagaactgcttctttccgttgtcttcattggtggagtaattccaggatctgctaaggctccaccacaccaatttttaaatctgctataattatgcaatgattatgttcagatatgtttcatcgcattacttatcacaaaacgacctcctaatgtttatattgacttctgacctgggctctttataggattatgcaattaaatattgtcgcagagaaaaaggtgctgcagaaatatagctttaagaattaaaataacattgttaaactgtgaaaatcaaaaaatgatgaattttgacgaagattttacaatttgtgggaaacatttcttgtaagccgtttctgatgccattttctaatgatttaaagctccttttttgtcagattacgcaataagaactgcttctttccgttgtcttcattggtggagtaattccaggatctgctaaggctccaccacaccaatttttaaatctgctataattagcaatgattatgttcagatatgtttcatcgcattacttatcacaaaacgacctcctgttgcggctcggcccacaagccgcaacgggacggttcgtcgtccatggttcggggtggggtggagagaaggaagggggagggggagggggtcccctcccaaactccccatgctgggttttctctctttattcggtgtacgatcggagccatgaaatgaacaattcatggggcttaaatacgatcacatttgggttgggcctacatacaaaacatacaaaccaattaattagagaaatgggctgatcaaatgggctgtctttttctcttccttctcttctttcttcgctgtgacttccttcatttgcggcagaacattcacatgcattggttgatgttgtctccattcacgtgcactttttgtccccatcggaccatgtttgggcggggagggccggtttctgtgttcattcatgtgcgccgcttggtcgattgagctgttattctctctccaaattgccacttttttgcccatttttcatcgtttcatcgcccactgattattttcccccttttttgccctttcgctcgtcgctctctttccattcgacaactgtccgatcatcggacagtcgcggctaaattcgagccgcgacattcccacgcttgaccaacgtgtgcacgtaatcgcccttggcctctgacttctgctgggcactctgccccttggcctttgacttcacgatgggccccagcgcccttggcctttgacttcatgatgggccccagcgcccttggccattgacttcatgatgggccccagcgcccttggccttgacttcatgatgggccccagcgcccttgtccattgacttcacgatgggccccagcgcccatggcctttgacttcacgttgggccccagcgcccttggcctttgacttcacgatgggccccagcgcccttggccattgacttcatgatgggccccagcgcccttggcctttgacttcacgatgggccccagcgcccttggcctttgacttcacgatgggccccagcgcccttggccattgacttcacgatgggccccagcgcccttggccattgacttcatgatgggccccagcgcccttggcctttgacttcatgatgggccccagcgcccttggcctttgacttcatgatgggccccagcgcccttggcctttgacttcacgatgggccccagcgcccatggcctttgacttcatgatgggccccagcgcccttggccattgacttcacgatgggccccagcgcccatggcctttgacttcacaatgggccccagcgcccttggcctttgacttcatgatgggccccagcgcccttggccattgacttcatgatgggccccagcgcccttggccattgacttcacgatgggccccagcgcccttggccattgacttcacgttgggcc

SEQ ID NO: 501 - DNA, 2968 bp, Heterodera glycines
  misc_feature (12)..(12): n is a, c, g, or t
  misc_feature (822)..(822): n is a, c, g, or t
cttaaatacccngggaaacgataaaattttccgattaatgcaaaaaaacaaattttaattgaagaagaaaaacataaaaatgataaaaacgagcaaattgatcgaaaacattagtgaataattaatccttccttcagagagttgccaaatcgaatttgaaattgggcccaaaattcgcctcaattttgtaaccagagccaaacaaagaaacgaatggataaagagaaccatcagcaaaagatggagcaacgaaaaaatcggagttatctgtgaaaaagttaagggatttttgattattttaaacataaaaataaattagataaaatagacaattaaccaaattgtaatttaaaatcgtaaaattatattatttattcatttgccaacccaaacgaagtccatttttggtgaaaatgatctgtcgagtggccgaattgacgccaattcctacggtatcgccaacaccgtaggaatatttgccatttcttccctttccttctccgttaatccaaagttcgccatcactgtcaaatgcttcgccatcactgtgaaatgcataagtgcccttttcaagtagaattgtttcatccaattttgtctgctgtttaacagcgaatccgaagatgaagccccaactgaataaagaaataaattttaaaatatttcactttttataccaaaattcgcttacttctcttttttcataactgaaatttcgtagtaaaaaaagtcggacaaatgcttattcagcacaatcggatatttagcgaagacggagcgccaacctttttaagggaaattgaatttttatgtaaattttanaaataccattataatttcccatattctggacaatgagacttttgtcaccactgatttcgatgtcctcgtgacaagcgaaggcattccaacaattttcttggaattttaaaaacccctgaaagtaaataattcgattttttaataatattatataataatttattaaataaattaaaaattatttttaccgtaaaatatttttactttatttttctcttccaattcattcacctttttctttgtctgattctccaattcactgattttttccaaaattttcttctgatcattttgcaattgtaagaaccgttcctcagcagcttaaaatagaaaacaattaattatttatttatttaaatgaaaataaaataaatttaataattatattcctatggttttggcattttttcgcagaatcggtcgagttttaagattttctctgattgtattaattctgctgttgccagtcaaaatgttctcaataattaaaggattcgaaaaatgtccaattgcgcagttaccaaagaaaagcccaaaaatttcattttcgttaaattgccctcgccttttgtctgctgttgttgctgcttctccatttcaccaattctctccaaaattgctttcaaatgatcttccgaaactgaaatttgaagcaattttcaattatttttttaaattgtcgttaagttagcaaattatagctgaaaatgtcttctaatatttgtatattaccatcttttgtcggagttttcctgtcttcttgctgttcttttccttcttcttcttcctccagactgaactgatcatcattcattcctcaaaataaaatttatgaaataaaatttaaaataataatttttggctctattttaaataaaaaagttattttctaaatatttttggccattactttttttgaacaaaacaaattttatgaaatttacagaataaaaggactcttggagctataaatgatacaaagaatgttaatttgggtggtgcttctataaaatgctatagtttcaagtgttcaaataattttaggccatttcttttattattgtcctgtgaactgcagcaatagggcccaaatttttcgctttatttgattaataaatttcaaaaccatttcttttaatgtataattttcatactgtatccactcaattatacaaaattccctaccgtatccgtcttgtccaaacacttcacaacttgcgacagatggctccgttgttttcgctcgattcagctcagcaattcgggcaatcagaacactcatttcctccgatgtgctcagatttggaaaaattgctgaaaatgaaaaattaatttttaaaaaattaattttagcaaatttaattattgaaaaatgtttttattattgtattttaattatgcattttaacaaattttttacgttgaagaggagaaaattcgtcggccgatgaagaagtcgtgaatgatgacattttaattttaaaatctaaatttaaacatttttatgattcttttcgtaaaaaatgatcctgttaaaaatatatttttctttatttattttcattttaccataccgtttttctgttcaattttggccactttttccttcaatgccttctgttcgcctatcatttcctggtgctttaactttagtgccttctaaaaataattagaaaattttggcatttataatttactcaaatttttatagcaaactcacattttccagttccaatttggccattttcaattccgtttccaatttggcaaacttttcatgaaattcctgaatttaaattaacaaaatcgcttttgtctcacattaattcaatttttctgcaattctttcttctgttagcttttcttccgcccaccttaagctgttgttgttgatcagtgatcgtttcactgtttccatcaaattgtccatcattttccaaactaattgcatcgccattcacttctaaaatttaaataaattaaatctttaattttaaaataatttaattaattcatattcaaaatttaaatttttctcccatttcctttacccctgttttctgctggtgtaaaatcatctccacaatttattgaattggtcgaaattgacagttttgagttttggtactctaaaaaaagattaaat

SEQ ID NO: 502 - DNA, 6319 bp, Heterodera glycines
  misc_feature (295)..(295): n is a, c, g, or t
gcgatcaaaaagccatgcaaagtgcgaaaaagggatgtaataagtcaaaaaaaatcaaaaaaacatttacagaatgccgtggccattgtccgcggttgcgcttcatcggtttagtgctttggcattgggcggtcgggcaaggtccgctaatgaccaccagcagcagcagcagcacaacgggttgcgggagaaagtgggccaaggccgggcacaatttggggaccgggaaaggcacgccgaactcggcaagaagttcagtctgttgaagaagtcgactagcaatgacggagcagcncatgggatggtcaacttttgtgttatctatcgaccatttctcgtgttcggctcgcaatcagtggacattcttttgttcatcagggtaattaattaattattaattgagcaattaatttttgatttttggcactttttcactctccagggccttttggaaggtcatttcaatgcaaaaacaatggacgaatatttggagaatggcaagcaaactgagaccaattcgtacttgttgaccactcatttgtcacttcgaaagctgaccattcaattgctgacagtgggagaacattttggatacaaatttcaatgtgaagaattaagaaaatgatgaaaactcataattgtaggctgttaaatttaatatgagttatctccggattttttgctaataaaagattaggtaaacagaaacacttgggttggggtcgttttcgtactacgagcccaaatttttggctataacttttttatttgtcaaccaaatccaacattgttggtatcattagaaagctgaggtgtttagaagctttttctaagctattgctttgcgattagacaattatcaaaaaagttatacatgaaaattgcgaaaaagttgaaattttcaagttttttctaaataaaattttctccaggctttaaaaacttttcgctttttggtaaggctaatagagcatgtgttttcgaatgataccaacaatgttggatttggatgacaaagaaaaaagttatagccaaagacatgctgaggccgaatcgtgagggccgaactgagaccgaaaagtgaaatttttcggtttccgagactaaaacccgagaccgggaagcgaaaaaccctagaaatttcccgagtcggtaaccgagactttcgcatatccctccctaatcattagtgctgctgatttggggcacaaacattcacaaaaaatgttttataaaaacaccaaaggcatggaaaggggcagcagaaaagccaaaaagagcataaaaatcgaaaaagacaacatattttcatgaaaagaaaatagaatgacaataactcaatttttaagaatttttttctttccccgcaattttttcaatagatttctaaataaagttttattccgttttaggccgtaatttttgagaagatttaattttcaaaaataaatttgagtgttggagaagcccatgaaaaagcagaaaattatgacgaaaaacgggtacaaagtagggttggccgttccgggtacccgaaaattaaaatcaagaaatatgtaataaaatttatgctaaaaattctgaaattaatgccagcgaaaatttgtgaccaaaatttgaaaacaaagtgtgttatgcataaaaattagatgatcagattttccgaatcttccaggccgcgctgagctttttttgaaaacgatcggtttccgggcccggcttctcgaaaccgtccacaaaaagccttgatttaaataataaacaaataaataatacatataattaaatttgtcatgaagtgcaagggcgatttttgcacacgaatttacaagcagcatggggcgaatgaatgttgtgatttcttgatttgaaggagcatgaaaataaaattgacgatcaaatggaattatctcgtgaaaaaatttaacagaaccgtgcatcattaatagagctcgcaaaaaaaggcaccataataggcaccaaaaaattgaaaaaaggcatgaaaagacacaaaaaatccaaaaaaaaggaaataaataattaggggtgtattttctgaaattttttgggtcacatttcttagggatgtattttcccgatttaattgcatttgataattatttgaagcttttcatactcaaaaatttgggattttgctatgagaaaaagatggcccgctaaatcaagaatataacaaattacaacgtgcaattcattttaaaaatacacccaagcaaaaaaaaagaatttcttcgaaattttggcaaatttttcagatattttgttcgcttccgtaaatttacgctgaaaacagaatgaactcatcagaaaatttttgagatataaggttagaaactgtgaagctagagtttgataaaaatttggcatttttatttttgttttagtttaatggaattttttatgtttgtttaagcaaaaattgaatattttggaattttgaggtttctaatccatatatttgtccatatttgaccatttgtgaactttttagtccttcaatttatcgctaatataaacttgcaatttttgtatcgaagggcggaattcctttgtgtccctggaataaaaaagctgtttaacgagaaaagtgaaatgatattcgaaaatcataaaaaagagcatgataaatttgtctgatcgttcttcgtctcttccttatttatgtgttcgcaaagagaaagtttggtccaaaatttgcatcaatttgatcaccgggggaaagcaaagaaacgaatgggaacaactgctgccggtgatcagttggaaatgaaaggaacatattggcggtaactgtaaattaaacaattatgttttttattatttttgctttttattagagagccgagaagtgatttgaacaatatgatcaaaaaagcgaaaaaatcaacaaaaaaacgataaaaagttcgatagtaatcagacgatatccgatcgcatcgtctctattttaaatgtattttttttgatgaaccggttcaaaaacaaaatcgatctttcaagaatttgaatcttacaaatcaattcgagttttattatcagggatcattttttatgtaaatacatgtttttcccctggattctccatagcataattagcaggaaaaacactttttttgtgtttgcgaacaaaaatcgggccttttatttacataattttgcattttttgagaattttttattaaatgccaccaaaaatccaaaatttcgcaattttttcaaaaattttcagaatttatagaattatttgtgaaaagtaaaatttttttttgaaaatgtgctccaaaaaaataatttttttttaaatggaatatcaaaaatttatttttaaaatagtaaaaggtgattctaagcccttttaggtcatttttatggcaatttgtgcctgttttaccctttagaaaaaatatttttccaaaaaaatcacatttaaaacatttttatttacatatttttgtacatatttctggatttttgtacatatttcgtacatatttcagaagtttttcatacatatttcgcaatttttcttacataaaaatgatccctgattatttttatttgtttaaattaaaaaaacccaaacggtgtccattttttgtgaagataatttcaagagttgtcaaatgaacgccgagaccgattatatcaccactcgaaaatgaatgtgccgcgtctatatgttgttgctggaaaccattcacataaaaaatgccattgctttggcacgccaaagtgccccagcggttcacaaccgacacaaatggctttagtttgatggcaaatccgacgacggcaccaaatggccttgaaaaaattaacgtaaataattgctaatagattaaaacaggaaatttgagcgacaaatatttcccatttttattcatataagaaacctttttcgacaaatttttgccaaaaatcaacaatttttggtcaaaaattgtttatatttcttaaatttattaactttaaaaaaattgtgtcaacaaatttttcctttttttaagatttaatgcatttttcttaaaaatttttgttatatttaaagttcgaaatatgtttttatgtgttgaaattaaagtcaaaaatttgttgattctctagcaaaatatttaaatatatgcaaaaaaaaggatgtaaagtccaacccttttaataattaaaataaattaattaaataatttcttttaaataatttttcctcacgatcgcaatttttcgatagcaatttcgaagtagaaaaggccatttgaattggcggagctttgaatggaatgtttcgcaaagacagttcgccaatctttttttaggaaaaatatctttttattaataagaataaaacggaaatttcaaatttgctggatctgcgcgggattgagggattttggaaatttcgagaaatttgaactatgtatataaaaaagctccaaaaaacaaaaaaatattttgaaaatgttgtggtcaaccaagtgtttttgaacgagtccgagggttggagagaggtcgggctgccaactttggtaagtaattaatccataaaatttgacgaatttatgttgcctttcattttactttttttgcggcacactttttcaaaatgccttttcgtgacagaggtgagggttctgcggtgccgattgcgaaattgcggacttggaccccagcaaaatcccgcgccggtctctaatgataatgattatgattagggatgtgaattttaggttttaactaaatcttttgctcaattgttttgaagaaaggagctcaaaaacgcatttctgcgttaaaaattttcgattacaaatcgataatttccgttgatatcgcttaatttgggggaacacaaaaaacggtagcgcactgcgctgtggacgaggattttagcattcaaagtagtgaccgggggctttataatttaatcacttttctctgttttctcgcgcatatttttttaactctttctctaattctctcctctctcctatagtgaatgcgcatctctctgcccaggggggcacagatttttatcccaatactcacccctaaaaaccgacgcaaaaattttcaaaaatcactcctaagaaatgaaaatttttttatcgaaattcattttcttgtcatgaatttttaattaaaaaaatttttagatacctattttggggttttgcccataaaaatccaaaccctactcatttgcaattgcaatagtggaaaaaaaagttttgcttaatttttggctgaaaattatgtaactatttcggactttttgcctttggcattttttctcactattttagttaactatttttggcttttccgtcactaaaagtcacatccctaattatgatttataaatttacataccatcgttttgctttcgtgtggtgtaactgatcgtcagacggttaattatttcgaggtcataaacataattgaagcaacgagaatcataggtacaggtacgagcatagtaatcccaacaattaagctgttttttggtctcgtcgcttctgcgggcgttggcgttggtaactgatgaaaaaaaacattgtttttttgctttgttcgttttatgcgtcccataagattatggcatttgccaattttttttgcacatttttttgtgttccatatttttatgccttttgtcaattttccattagcacattaattttaggtcaggattttgcaaaatttgatttatttttttgacaaattcgcgaaattcttcaaaattttggtccttttgtttgcaatggcagcatttttaaattttatgccgtagatgccgcatttcggccccaaccccaaaaaccccccccccccccacccccttgcctttttaaacgatccatttattacctgcgcttttttctgttgtttggcattgcccaatttggcaggctctttggtcgtttggtttgccagctgccaaattaaggaaatagtaatcatatactaactaactagaggaatactggaaatttttcatgaaaatttcttcaaataaattttttctaaaataaaattgaccccccccccccccaaattggctccttgacattccgacagtggacaatccgtcagtacacaaagataagaaaatgccgtcgcagaagaggatcgactgagccatattaagaatataagggaaataggatggtaaaaagtgtacagtgggtctaaaccattattcttctgcagattagttttcggtttggtattttgtatgcgatggttgcttttttgttggcatttttttttgccattcctcccatgtgattaacgttttgtggat

SEQ ID NO: 503 - DNA, 6016 bp, Heterodera glycines
  misc_feature (5889)..(5889): n is a, c, g, or t
atcattttttaggctctcctttgggccgatgagaaatgccgtcagaatggcattgactgctcgggggacaatcgtcgtgccgtgcttggccctgctctgttccaaattcgttttccactcatccccaaagaggacttttcggaacaaattggtaagcattttaaatactttcatttaattaattgatttgttttttagtgccttccggcgttttgacaaatgacgaaatgtttgccgttttgctgtaccattcgagtcgcgaaattgcaacagaatgccaagctccgtgcgagctcaaatttgccaccattcggcgcaattacatttgcaagcggacttttttggtgaaaattgaacagttttctgcgcttccacgtgcctccgataagaattacgagccaattgacagcgccgtggtggacatcaaagggatccgatggcaattggcctattcgttttttttattccaagtgaacaaaaaatccggttactttcgcctttctctcacgtgcaaccaaaatgagaaaggtaatactcagctgagaaatcttaaagtgattaattgcgcaattaccaacacaattaagctgccgattggaagtgccattgttggacaatcacgcgaacaatggcacaacaaaaaacgggcaaaaaatgcgttgtctgggagagagatgacatttttcgtcgctgcaggccagacttaacatttaccagctttttgatggatcggaaggtagtcatgggatttgcttgttaactttcattaattttcaaatttattttcattacttttgttaaaaataattcaaatattttataataatatttggcacgaaaccaaagcgagaacatttattgggtttattttttctaaaaaatgtttaaatttgtcttcaaattattctcctgttaataatccagaaaaaggatttttcaaattttctataaaatatttttaaaaattttttgtcaaaatcaacaaattttcgtatataattattttaatatttcaaaattgttcattattttgtcttgagatttgaaatttttgccagtattttaattaatttttctttaacaaattttggcaatttgaaatttaatttttaatatgctaaaaagtcactttagattatttctcttgtaaaatgttaatttcaaaaaaaagtaaaaaaaaaacattgatgctaaaactttgttaataatttggcaccataaaatggtaaaaaatgatttagcaattgatggacccggccaacggtttgtacaatgcggaggaggacacggtgaccactcgcatgcaaataacgtcttgtggattatggcacaatcggctgacttcggcgacggcattttcttatttttgtgtatttttctgtccgattgtccagtgacgcccaaattgaccatttgctgctgctgcgtctccaattggacaattcgtcccaaaatagtattctgatcattttgaaaccgagtcagttggccaactgaaaccgggcaaagcattattagtttttagtagagtagagcgggaccgggaccaaaacacagacaactgagtaaccgggaccgggattagtcccgggtttcccacccaaaaattcccggtttttcaacccgaaaaggtcccggttttgcccaaaattcccggtcccgctctactctagtttttagcatttcggcatttttgtgtttatgaattgaaatcaaaatcaaaaaaagtgcacatcattgggacataaatttaaaaattcgtcattaaatttttttattaatcaagagttttgaattattttgtcaacaattaaaacaaaataaattaattttttgttgccttttattgctattaattagtagggctgggaaatttaggtaaaaaaatcccgaaataggtataaaaataggtaaataaaaatatttattgacgatttttttgtggaaaagagcaaacaaagatgaaaaattttggttctattgctttgtaaacgaataatttaaatattttaatatttacttagaaaaatattgaccattttacattaaaaattttgttaataaaaaaataataaatttggggaataaattttcatgaaaagtttccaatcttatgggtgtattttttgaaaaaattttctgttcgattcttaggggtatattttttgattttattgcaattttgttaagattttttgccaaaacaggtataaaaataggtacctagttaataagtataaataaaaactcccaaataggtaagaatatgtattataaaagtagaagccccaaaccttttacaagatgaatagagtcggagaaattttatgaaaaattcaaaaactttagatttaagcgcatttaagttttttcaaaattaaaaattaaaaaaccaacataattcgtatatttgaaatgacaataaatgaatgtacttttttttcacttaccatattcgacttgcccgtcctcttcattatgctgctgctggtgctgctgttccgtcttgacaacattggcctgcaaaaaatggactttttcgaaaaatctgaaaacgcactcgaaaagcagaattggcatcattaagaaaattatttttttgaccaaaatttacattttataaaaagacgacgtgatactttataatattaaaagttgaggggtacaggtaattttcaatttttgccggtactggtactgctcaattctagtgattatacctaatttatattaaaaaaaactttccggtgccggaccttccactgaagagaaaatttttttgaaaaattatgatcaaaaacaaaattcggaatggttttttggttgttgatcccatttaaatttatatattcaaaaatatatattagacggagataaaaaattttaaattttattctaatagaatttatttctcgttctgaatagacgattacacattttttattttataaataaacttccacaaattctggaaaaagcccgagcccggcgggcgccaagaaaatttgggaccggacccgagttgacagggaagcccagcctggtcaattgtctaagcccatacccaagcccagaatctttaaaattccgggctctaaaaataaaatattcattttaaacataataatttcaatgattaaaattttttatttttttttattttaagaaatatttcttatgcaaaaatatattttttattttttttaaatatttcaattttcttggccacaatttttgggttctaatataaattagcccaccatcgccgtgttctgctgctgctgctgtccttgctgctgatgatcaccagcagcaccgattgatgacgacgactccacggcgccactgggcagaaattggcccaaacagaacacatcagcagaattgcctgttttggcaaagtcccatttaaatgaaactcagtttttaatgtttgcttaaatttagatttctgggtagtccaatccaattatggttaagcagattttaaaaattgacggaaaacatttgagaatcatttagatattagattttcaaccatttgaacatttttaggatttcaaagataaagcgagtttgctgagatcatcatcataagcgatgccggtggaattttttttgaaaatctttattcattttattacagattttcaacccgtaaattttgtaaaataaaaatagcaataaactgcctttcgtttagaattttttgcataaaactcattttgtaccctttggcatattttacccctttttaatgtatgttcttgaattcaatcatttattttaattgcatttcctttttattgtgattttccccattaccctgctgctcttcagtggctggcacaaaaccaaaatatttcgagtcgattggatcagccattttatttccaaaaaaaagtaccttaaagaataataataataatgtttttttctcgatacacaaataaaataagtttattttgttttgtcgatttgtttttatttaaaaaacaaaaaaatatataaaatttctaaaagggcgctaaataaacaaaataaatattatgctcaattaaatatttgtgaactcatttaaagaggtacataatgagaaaattgaaattattttacatatgatattatccttttatcattaaaaatgacaaaaaaggtttatagttttctttttaaactcccttaattaaaaatatttttttaaaactttcaaaaagatgggaaaaatgcccctgctgctgatcggaattgggtcttttgcgtcacaatttttggcaggacacacaaatcagtgatcagttttttttgttttaaactaaatttaaattttataaattatacctaaaaataattttacaaataaaataagcaaaaaaagaaattggatagatttgaaaaatgagtggccataaagaatttgtgggatcaccaaaaatgaaatgtgtccagcaaaattttgactcaaaaaatgaagcggattgatgggagggaatctataaagcaaaatgcactctttaattaaaattcgggaattttcttaatcaatgcttcacgtttttgcttgagttgttaaatcctgacactaaagatataatgtacaaatgtaatttttgaattttcatgaaaatgacaaatttgtgagctttttgactcaaatttttgtaaaaccaaaggaattgttggttcggcggtgccgttaagtgccctcgggttaaatttttgaaattttctgcgattgttaacaagttttggaaacagaaaaaggatgccatcatttgtttccaaaaagcctgaaaattccaaaaaatctataaaaactcttcaactcaacaattgtcattccttcaaaattgtcatctcctctcctaatcgatggcaaagagaatggcaaatttttctcctccttctgacaacactgccccaaaaaaatttttatccgaccttgacccactacaaatccccaaagaaattgacacagacaactccattcccgactacgccaagttcttattaagcagcttcactccctcttaagcaccgcctccgtcctaattcattcacaggctgcggctgtcgacgcggtcgaggaggaacgacgactgagaactgtcgttgtgacaaatatgcccgaaagcaaatcggacaaagcggcggagagagcccgggaggatcgtgccgttgtggacgaaattttgaatgccacggacgtcgaccaagcaccaattgtcttccgcgttcctggctagatttgattttatctgccaatgaaaaaattattactgattgtactgttaaaggaggcattttttcatcggatcatttaacacaatttttcacattaattactcctaaaacaaaaccgaaaacaaagatcgtaaactttcgttggttttgtccatcgaatgtgttacattttaatatagtcatagcatcaaggctaaatgccttgtcatatgaatgctttagcataaatcaaaaatattccgcctttaacagtatgttgttagaaattttaaatgagtgtattccaataaagcgtttaaccaagaatgatttgactcctaaatacccacaacatttattagcatccatcaaagaaaaggctaaattattcagacaagctaaaactgacccatccaaaaaagcactatacgatagcatttctttaaaaagggtgacaaaaataatcccgaaaactataggccaatttcattaacctgctcactctgcagggttatggaaagaattttaagcaaaaatatttacaattttctattaaaaaacaaaaaaatttcggaatttcaatttgaattaatttttatccaaatgggaaaaatcggtataaggggcaaacttttgatgtggataaaggactttttgagtaatagnaccttttcgtgttacaattgtggatgatttatcctccagtaaaaaagttggctctggcgtcccccagggctctgtccttggacctttatttatttatgattatattaacgatcttcctgatgctttg

SEQ ID NO: 504 - DNA, 4741 bp, Heterodera glycines
cacctcgctccaaacgttcaatgacacctgcacgggacctggactcaatcactcccgcactcgcagagcaagaacgccaacgcacattggttctccttggcctcccggaaagcaatggttttcgcccatcggaacgtgtacaggaggacaggaaagtcgccatcaaaattctggaccagcttgatgttgaggctgagccaaccgccgtcttttgcctcggccgctacgacccgcagcgaacaacaccgcgcccgctcagtggtcatgccaacacccacaccaccaacatgtggcacttgggggatggaagcgcgagcgtgctcgactccgttctcaacagaacatggcccgtctgttcgtccgccctgcgctgaccaaagaacaactcaagaaggaatacgaagagtgcgtcagaaaacgtcaacaaaactcagctccaatggcaccggcaagctcacagacaaatggcccgactcccgttgtcgaagatggaccaaaccaggaggaggccagcgacgacatttccaaaccgccggaggtttttgaccaaacaatcctcgtctgttatgaagcattaaactcattaccacccaccgacaaaattgttcacgaaatgcaatcgctcaaaaaacaattccctcatcttttcaacaaatagttctaccagacctccaacaatttcttcaaataaaatatccctcaaactttctctaaaaattttactcaaaaaaatttttttttccctcttctacaacccctaaaaacaacaattttccctttgttggaggtctgacttttctaatttctgcttctccattcaaaatttcaattcttttatcactactttccatttcacctcatttccgccaaaagtgtaagtggcacatgcccttcttttggttatttttattttgaataaataaataaatattagaaaggaaatttacttcattttcaactattttttaaaagaggccataagggggattactcggaattctgatttatgacattttagggtcaaattccgatttttgggtgttgttttgaaaaaaaagaaaaaactaattatcttgctaaacaaatttttttaaataaaattttatatgcaaatcattttttaaacactttgacgaatatattgttggaaatgtatatgttaaaaaaaggtgagcgttttcgtaagttatggatgatgtgagagatggacgtaatgcacaaagaaaacggtagaaaaaatgccggaccaaatgagatttgggacgagaaaattggaggaaaaaggtggcaaaaaagagaggcggatgaatgagaggcacttgacgaatggcaccaaaaaaaggtaagacgaagagcatttctgtcgatcattcttactccatttcagaaggggaatcagccggcggcggtggactaggcgcataaagctataatttgaaaaatgcaagaaaatatgttttaatgaatcactaaaaaaatcaatggattaattttaaataaaaataaacagctattttttattataggtttttatgggcatttgaaaattgcatttaattttgtttgatacgttagcttacttcatttagcacgtcgctgatttcactcatgaacccgtcccaggcatcataagtggcgaaaaaggtgaccatacaaacgtcccatggctgtttggttttaaaatatttaattaaaagaaataaacccacaaaacattctcaaaaagcaggaaagaaagtaaaaaaacttgtttaaggataatttgtgctaaatttagtgggcttatcataagaattggcccacaaaatcaattcattatgcttacaatatgaagcggcaacggatggaaagtcaggccaacattgaagcgcacttcaagttcattcaaaacgccctcagtgaagtgctcgcgaatggccgctttctgaatcaattttcaaaaattttatttaaattcgttaataatatattatttataaggtttcgtttttaggcacaaaaaatcgcaaaatatgcattaaatggcacaataatcctcaaataggaacacaaatatgtaggcaaaaaaaaattgtttgctattaacgctttttatgaagtaaaacacgtaaatacttaaatttttcaattgtaaatgatattattaaataatttaaaaaaattttcgaataaggacaaattttaaaccaaaaatttttattaagaaaaaatattaaattttgtgatcaattttttgaaaattttaacccgaaataggcattataaaagtcatgatagaccagggttcggatctattctgatttatcagaaatcttctgatttggaggtagtgaccaaaacaaaaaaaatttccgccggacccttttccctcgcccatttcccaaaagttttggaaaaatgcgccgcaaaaaaaattcttaaaaatctgaatttttgatcccgaatggcagatcagaatctcaattaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaaatctactaggatttggattattttgtacaaaacttatgttagaccgttattggaatatgctcctgaggtttggaatccatctcttctaaaaaatattaaaaaaattgaaaaatgtcaaaaatatttcaccaaaagagttctttttaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaggctcattgaaataaactcattaaattaatttaaaaataaaattaaaactatctctattcccgtaaaatagaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatggtttggcctcaatgtaagcggatttttcccttttgtggactttttctttattgacaataaataaataaataaattggtataaaagacatttttgatcagcagtaaaaattagcttagagattttttaaagattttcctgctaacttggaacgaagtgtttggtgattaaacattttgctccattacttgtccccaccaaaaagggggtataagacttttgtgccaccattcttttttgagaaaatcggatttaaaaaagatgaacaaattttttttgatccaatacttttgacctgtctgtatttttctatacaatctttttcagtccaactaatttatcgaaatgacattttccaaagtttttcagtttgggtccatttggatttgcttcattatcagagcgcataaaatttcttaaatttgatgataaaactattttcttaggtttgtcttttggttggaatcttgggccactaatatctttttttggctggtggcccacaaaagtccaaggtgcaaatgtcaaggcattatcccataatcatcaaatgattcaatattctcgtctttgacatacccaaaaaataatgttctaacacgccatacacttcttcacggtctcttctattatttgtgcatgtattggagatgtttttacaaaaatccttgacatagtgcaccatgcacagatcaatgtagctgaaaagcaaattaaataaatacacatacatttgtaactgatttgtgtggtgacggacgaacgaaaatttgtttactttttgcttgtcgccaatattggtagttttctactacacctgggatgccattctgaggccccaaatttttcgtaaattggaattccgaggcatccaaaaattttcggacatcggaattccgaggcccaattttttctgggtaatcctatgtaagtttattgtatgtttaataaacaaaaataaaataaaggtaaaacccatcaaattgcgccacgcactgctccacacaaaattgtgcatattcagaaacagaatgaaactgttgttcatcaatatcactgacggaagtcatgaacagttgctttgcggattcaggtcgaataatgttaatttttgcgctgacaaaaacatccgatcggctaaggccaaacaagggcaaagatttcttgaaaattaatgaattaaattaaaatacaatggtgactttttatattttctaaatgttcattaatagggcttccatttttaagcagaaaaatcgcaaaattattaatattttaaagttttcggatatcgaaaagtttttaaacaaaaatttttcttaagaaaaatagtaaaatttgaggtaaataatttaattttttttatcaaaaatttctgatccctcaccaattcccttctcttttctcacccagacccccattcttaccagttctta

SEQ ID NO: 505 - DNA, 1433 bp, Heterodera glycines
caaaaaaattatgacaattttcctaaaatttgtattaaaattgttgtccaggcccttaaccaggggatggttggaaaattctatggaaaattgattaatttttagaaaatttataacaatttttcataaaattttaataagagttttcctggcttttggcaccaccgaacacactcaaattttcataaaaacgaaccccaaagaatgcttaaaattggtcaattttttggcgaaaaatgaaaaaagtgctcaatttaaaaggtataataatgtcggaatacagttgggaggtcgaagaaaaaaatttcagtccgaaattttccgatttcaggaaatctgtcgcccgccccccccccttttgcataattggtagaacaacagaaagagaaacgaggagacctgcagccacgtctccaggtcaccaccattgacatactccaacacgagcaccaaatatttgacaccctggaaaaaaaaaattttttttttgaaagcccccagaggcccaccgaatggggcgaaacttcggtgaatgagtagaagcatttgacaatgttggtgtgggaaagcgacttgaaaatgtccacctcgttcagcaccgattcgtacatcagctggttctccttttcgatggctgacagctgaaaaaacggaattaaaaaaaaaaaaaatccatcgaaaaacaaggcccaagagtaagggaaccgcccactttggcgcggccattttggcgcaccccaatttataacgtgcgccaaagtgaccccgaccccaagagtaacggtttttgtagcacaagcccccattcatgcttttttgaaccgatccaatttggtttcatttgagcaaacgttatgggttctctattagcctccaattttcaaaaaaaatcgttaaattttgaaaaaattttcggtcaaacgatcagaagagcatgacttttttttttgaaatttaatgaaatttttgaaatattgtgggctaataaagagaacacataacgccaaagaatacaaaaatgaagcgcgaaatacaaaattatgtcgaggcgtgaccaatcggggcaaaaacgagaggaccaacaaatcaaatactgtgggttgaaaatttttactacggttttttaagcaacaaaaaaaaaacggaaatcctttcatggctaggaggtttacaaatttacaaaaaacatatttttgaaactcacattaatccgtttgagtgccacgtggcggtagcgttcggccggcgccgccgttatcaattcacgggcgcggaaaacgttggcaaacgcaccggaaccgatgccaacgacatccttgacgggaattttttttttgtttgggctaaatttaaagcacccattgatgcatttaggcagaaaaaatatttcaaaaaatcgggttggaaatttttttttccccgttttggaaacg

SEQ ID NO: 506 - DNA, 7509 bp, Heterodera glycines
  misc_feature (44)..(44): n is a, c, g, or t
aatcggtgcttttgtcaaaatttgctgcttttacggagaaatgngatgatggaatgatcgatggagctccttaggaatctctttatcacactataattctttgaattttgaattacgtaatcaaaagtcgcttaaagcgaattttgttgggaagcggacggacgggcaattgaaaatgcacagattcggcatggttgataaacacataaaattttgcttctgctgctgatccacgacctttgtggtctctcaatgttttttttttgaaattttgtttctggcgtgaccagtggtggacggtgtacggacatttcgcctactcgacatctcgcctaccgacatctcgcctactgacatttcgcctactaacccaaaaacattcatttcgcctactccgcaaaaacattcatttcgcctactaattagtaggcgaaatgaatgtttttggcttggtaggcgaaatgacagtaggcgaataagaggggcggggcaggggggtgggcaattagttaaggagggttaacggtggatgagttaagttaagaagttaatgtaaatgtgagaaattgtggaaatctgaaaaggggaaggaggggggaataggaaaagcattttttgaaaattaggaaagggttggggtaaaagccagacattaaatgtgaatttttacgagtttgggttcgagttcgggctcgggagtccgggattggccaaatggtgccattttcatgacccgaccgactcaaaaatccttgggaaatgaaatgtttttcgaaaatttggatgtcgccactctgaccaccgctcttcctaaccaccagaattccgatggcacatcattaacaaacactactccgtcttgagacgaattctaaggcacatgggtgggaaatcgtcggcataattaagcccagggtggcaattttccgcggaattcttcagggcgtgtgcattttttagcaaaaaaaaatccgcccgtcttcctctataatatgtcctgtgtgtgacacacacacattcacgtccatgtccagttggttggcggcgggcggcatcttcttcccctgcccgcccaggcgtttgaatcactgatgaaaaatcgattttgggattatggcgtttgaatatgcaatgtcattgtgtaattaggcagactgtgtctctaattaatgtttttttttttgaaattttgtttctggcgtgaccagtggtggacggtgtacggacatttcgcctactcgacatctcgcctaccgacatctcgcctactgacatttcgcctactaacccaaaaacattcattttgcctactaattagtaggcgaaatgaatgtttttggcttagtaggcgaaatgtcatgtagccgtggtggacgacctccttcctcagcaattatttgttgttgccgcaactcccccccacttaattgacttggttaattagcctttgatgattaattatggccccggcggtcagagattttggccaaaaatttagtgtgacatttgaaaaataagaaattctggcctccgagtaccgaaatatttagggatgattgtttttcaattctttgaaccttcccaattttttcaattacataatttctgagaattttctttacttggccttgtttttgactttagctttttaaggtaaaaacccaatttgttgagttttctaaattttttcgagtctcaagccattttcactggcggaattatttgccaactacatttttccatgaattgtttattacacacaaatacatagtataggtcgaacaagtacacataatatacaatatagaatatacatacatataatatatacatagggctgacaacacggaataatgaatataggtccgaacaacacggaataatgaatgaaacacgcggggcacgacaatcaatcaatcaggttgcactccttgttcgtcgattcgcttctttctcccagtcgtaagggaactcgtggatgccattcgtgttgaggtagtcgcgcagaaccctgtctatccattcgtatttgggccgctggtaaaactccaggtcgtcctgtgggaagaggggggggggggggtaattagtataattaaagcggcacaaaatgtcgcataaaacgcacaatgtgtaacaagatgtcgtagaatattggcgggcatttcttcaacagtgcatgcagggcccgttgttgcacttccttcggcttgtggcttagacggagtcgtttcattttgcctgtctgaaaatgaagggggaaatggatatttgaaatcccgcgccaaatcccctccgacccacaaaactcacgcggcgttcgctcgtcacatgggtccatggcagcttgccggtgtacatgtcgaccagtgtgtagaaccaagactcgatgtcgtccgctcggcagtagtcggcccgcgcgtgcgctgcgatggatgcgtacattggcgtcccgcggaagtgcgtctttgatctttctcgcctgaatcgaccctgtgaaaaattggaaaaaattaattatgagagaggaatgggcggataatctctgctcacggattggctgatgtaacggcgcgcaagtccaaagtcgatcaaaaaaatgcggcggcgctcattggtctccgcgcgtccgattgtggcattctccggcttgacatccagatgaaggtagccaactttgtgcagcgccctcagtgcatcgagcagttgaagcgaaacgccaattgccgtcccagggctgaacacgtcgcccgccttgctcagcagatcaaacaggccacgtccgatcagcgacatactgaaagttgggggaaaaattagaatttttggcattttaatgacgcgattcggacggcactcgacttacacgacgtagttgaacgtcaccagctctccgctttgtgtgtcccgttgaacgtctcggccctcgtcaaaacagcgacaaaaatgttccgagccttggcccacccgaacagtgctcacttttcgcataatttcggcctgtaaaagggggagggatacacattaataaccaaattggtaaattacgaatttaagggactcaatcgaaaaaagcaattttcaaatttcacagtttgggggatttgtagtgctgttttgagtagttcaacgcatattgtgggtactgatcagtgtgatcaccaatctgacacgtccatgtcaaccaatttcgaatcccgtatcgttttgaacaaaaagtcgaactccaatctggctcaattcagtcaaaaaattaattttgcgactttttgtcagactccggaattttgagcaaaaagtgattcgaattcgggttccaggattctgaaattggttgaaatggacgatgcgtcagattcgtgatcactgatcagacgcgttcgataatcacacagaactgctgctcccgtccgcccccgccccgcataaaccgcacctccttccacaggaatggctcctcgtccgcgcgctccgttttcattgccgcttctcgtcgcccggcgtcagtgttgccgctgcacagaaacacggtgccaaacgcgccctgccccagctccttgatgatggtccatcggccgccgctcacgcgtgtgcctgcgctcagtgagaccaagtcgtagctgtccttgcgctccgccgacgctgttccagggctctgcgacaccgcgtcgtcgtcgtcctccgcgcgcttctccggcatgtgtcgtcgtcgcaaaagtgaagaaaatatgaatgtgtgtagagggattgaaaacaaatggcaggagtcatcaaaatgtgagccttttatacgcaaattctgctgggcactgcagcacccaaaatgtcgccggatgaatctttttggttttgggatgtataaaaggagggaaaatgtcggttggtctctcattcccttcacagcgacaacaacaacaacaacaaacaatcagcaacgacgacaattgcgcaacgcttcaacacagcacatccatcgcccgtgcacacgttgactccgatcacttctgctgctgctgctgctctccaatcaacacaatgggcttcctcttctacatgttcgtggctgcggttgcgttcggcggtggagcggtgggtttgggggtggggggaattcgcgttgttgctgctttttctgaatccaatcaaatttgtatccattccaaaatgtattgtttgtccttaaaacaatggacaaaatttctcgggattgagctttcaagcagggtaaattcgagactcataaaagcacggaaaatgcatttggcttatttatgtgttttttgctggtgtgagacgaaaccaaattttagaatccaaaaattgattttgagccttttcagaagtgccattaacatatacaacgttcagtttgaccaatttcggacccgaaaacccaaaatttcattgttccatgactagtaaaatggtttagttggcccgcttttgcctccgttcgtgttcattttgtgtctaatttgttcccattttcttttcagtactgtggcatgatttacaccaccaaacgggccagggcatcggcgggcggcggctccaagaaggacaagaagcagaaagcgtcgaagagctccagcggtgaacaatgatcgactcgaggacggccccgcggatgaacgaacgatggaattcgagcaacaaacgcttctccccttctaactgctgctgatcccccaatatgacgctgtttcccccctccccccaaattatatcatttgtatgtgctttatcaccctctgatctgttgtccgtgataagctttatgcgctgtccatatcagtgatcaaatcgttgtaattgttgtaatgatatatgtatgtatgtcctatatattgtatttgtatgtgctccaatgcaacacccaatcattatgtgtacataatatatgttgtatgaatgtattcggacaataaagctgtaatccttgtatcacacttgtaacagggctggagcgcgaccgcgatccgcggcaatttgaatgcgcggccgcggtttttttttttgcgcggtccgcggccgcggtttttttctgtgcgcgctccagccctgacttgtaaaactgttgttttttgggtttctaattaggcgttcaaccaaaacggcatttcacccatcccgtgccattttacgcgtccaacaaaggtcatttcataggtaattgatactaaaaaaaaattattcagcagttagcattttactgggacaaaaagtgtaggtagaaccactcaacgtaacggcaattcaagacaaaatcctattgtttaatttttagtcataaaaaatcgtcaaaaaacgtacgtaagaaatgcaaaaaagtcctgaaaaattaggcaaaagtaaagcacaaaaaatagaacattagacaatgaatttctaaagacaaaaaagattttctgcgtaaaagttccaaaaatccagacaaattacctaaatgtattcaaatgaaagaagcaacaaataaatataaggaaaaattatcagatcaatttccattcctatgatcaatcatttgtcatttcctaataattctttcactttttcttctgctgtccgctgggctcgggattcattttcggatgattttttgcgttcatttggcccgcctttagtggagacaatggcctgaatattaagtgaaatttgaatgactttaaacgaaacaaaaatgccgttgccacggaaccccgacatttgcgcctttgtcaaaaaaatcggaatcaaatttaattttttttttcaatccctgatctaaagatcattaaaattaaaacacagtcttctcacttattagagagcattaactctgctctttgaaaattttaatatcataaattcattgacgatcaaatgatcagatacgatcactttgtatcgcttgttttaggcgatcagcaagcagggattgaaaaaacccgatttttggacaaaaacgcaaatgccgggacacggttgccacgcacccaatgcaatttccataaagacgaatatcgactttgttcaatttgtccgactttctgtcctcccactgaatcgtcgccgtccccccaattgggcatcgcttcaacagccaaacagcatcagtaaattgactatcttcatccacaatttcatcgtttccttctttctcaaatgtcagcatttcgttggtccgttcgttcatcacttcaaatggcgtgacaatttccgttgaatcataaagttcaagtcgaaatgtgtagccgacaggagtggtggcacgaagaaatgcctaaacaatgtgaaacaaaaagcaaatggcaattaagcaaaatattttacggaaatatggccacacacctctttgaaactgttgaccattcccatggtttctgacacatgacaatagtcacaagaacgcaattgctttggctttccatcgtttcgcggagtgttcaaccaatttgacagcacttggccaacagttgcatttggtccatcatcagctggtgaatcgggcaataaatcatcggagtcgattgaattcaactgatcgagatcggcgagaattgttggcgaaatgagacgacgcaaattgtccaaatgatggtcatcgggaaagtccaaatggtgaatgttgggcgcaacaatggccaaatttcacgcgcaaaaacatcccaaatttgctggactttcatggcattatcggagcaactaacaatgaaccccaaatcggtgcttttgtcaaaaatttgctggttggcacggagaaatgtgatgacggaatgatcgatgtagctgaaaaggaatctctttatcgtggatgagttaagttaagaagttaatgtaaatgtgagaaattgtggaaatctgaaaaggggaaggaggggggaataggaaaagcattttttgaaaattaggaaagggttggggtaaaagccagacattaaatgtgaatttttacgagtttgggttcaagttcgggctcgggagtccgggattggccaaatggtgccattttcatgacccgaccgactcaaaaatccttgggaaatgaaatatttcgaaaatttggatgtcgccactctgaccaccgctcttcctaaccaccagaattccgatggcacatcattaacaaacactactccgtcttgagacgaattctaaggcacatgggtgggaaatcgtcggcataattaagcccagggtggcaattttccgcggaattcttcagggcgtgtgcattttttagcaaaaaaaaatccgcccgtcctcctctataatatgtcctgtgtgtgacacacacacattcacgtccatgtccagttggttggcggcgggcggcatcttcttcccctgcccgccccggcgtttgaatcactgatgaaaaatcgattttgggattatggcgtttgaatatgcaatggcattgtgtaattaggcagactgtgtctctaattaatgtttttttttgtgccatttgaaaaataagaattctgggctccgtgtaccgaaatattttagggatgattgtttttc

SEQ ID NO: 507 - DNA, 1067 bp, Heterodera glycines
atcgaggcgatactgacgtcaaatttggccaaagaattttttgtcgcggaggaaagcgccgaaaagaacccgaccgtggaatgttcaaagacggatgctggcacaggcttaactcgccaccaccaatcggatgccgaatggattcaaaaggcaggggacgccttttctcggagggtcgggatgtgttaatgtttgattattggcattttatttagtaattatgttgtcccttcttaattttgtctcattgcctgtcattgtagtctctcgcctaatctatattttgccactcccttcccagcagaaaatgttcccccccccccccccgtcttcccttcaattcattctgttggcagtgcactttcatatttgtattttgttcttattttcctccgactcttctcccattttattgttgcggttttaaataaagtgatttgtctccgtcttggaaatatttgtggaggagaagcagtgtattagcccgacccgaaaagcattatttagcacgtggcgctcctggcgaagagttagctgtgccggcatagtggattttggactgctgaaaaactgatttggagaagcgaccagaacaaaacgcattgctgcggttctgcattcgtcttttgcttctgacagaacaaacgcattgctgcggttctgctttttaacgcattgctgcgaatttcaccgatttcgtcccactgctaacgcattgctgcgagaagtgaggattggtatttaacgcattgttgcgaacgctttgaatttggaatcgccgacttttgtgcgcgtcttcaagaattatgcaaattgttcgaccgccgttgcttagagggatgaccgaacgcaatttcgagcagattcgcagtcggacaaattcatcgattgtccatgaaggaaatgtccaattcgccaacgaaaacaacggaattgaaatggatgaaaatgaaattagacgccttctgcttcaagtcaagatgcgacaagacggaaatgcagaattggcgagacacggcgaacaggacattggccatagagaaaacggaaggccaatctttaatgag

SEQ ID NO: 508 - DNA, 1092 bp, Heterodera glycines
  misc_feature (27)..(27): n is a, c, g, or t
  misc_feature (1013)..(1013): n is a, c, g, or t
  misc_feature (1025)..(1025): n is a, c, g, or t
  misc_feature (1027)..(1027): n is a, c, g, or t
cctgtgctacgcactgtatgaaatacntaatgcgcaatttgatacaaaaaagagatagctattttggggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataaaaaaggcaacctgtgctacgcactgtatgaaatacctaatgcgncatttggatacnanaaagagatagccatttttgggcacgttacgatttttctgtctgtgtccacaccctactaatgctt

SEQ ID NO: 509 - DNA, 1379 bp, Heterodera glycines
cgttggccgggataagaaaaggcaccctgtgctacgcactgtatgaaatacctaatgcgcaattggatacaaaaaagagatagctattttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagctatttttgggcacgttacgatttttctgtcggtgtc

SEQ ID NO: 510 - DNA, 1339 bp, Heterodera glycines
  misc_feature (37)..(37): n is a, c, g, or t
gaaaaggcaccctgtgctacgcactgtatgaaatacntaatgcgcaatttggatacaaaaaagagatagccatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagccatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggataagaaaaggcaacctgtgctacgcactgtatgaaatacctaatgcgcaatttggatacaaaaaagagatagccatttttgggcacgttacgatttttctgtcggtgtccaacaccctactaatgcttcgtttggccggataagaaaaggcaacctgtgctacgcactgtatgaaatacctaatgcgcaatttggatacaaaaaagagatagccatttttgggcacgttacgatttttctgtctgtgtccaacaccctactaatgcttcgtttggccggattaaaaaaggcaacctggggtaccccctgggatgaaatacctaatggtgaatttggataccaaaaaaaaaaaacccattttt

SEQ ID NO: 511 - DNA, 1366 bp, Heterodera glycines
ttcttttttacggcaccccctccccccaccgcttttcctccggcgttgtgccgtctttttttcccttcgttcgtttgtgccgtcatgctcatttgcctttgggcatcattaaccgcacggaggcacagcacaatccgctgctgctgctgcgagaataattcccaaaggcagcataacggaaatggacgacggttctgttttgactggccaattcagtccgatcgccatccttctttttagtttatttctccttaaaattaaattttgaatattcgagaatttcgaattaaacttattttttggctattaaaaaagaaaaacattgcaacataaaaaagtgcctttgaaattgaaatttatttattttttgccattaattttggttgattggcaaagttttgagactgaattggctgtgcccgaatcggtcgaccatttggcgccgagaaacccaacgaaagcgacgacggcgcattggaagcgcagccatagacggaacattcattatgccaaatgagcgaaccgtcgcttctcttttggcacacaaagacaccaaaaagctgcccgaggctattagcggacgcaaagcgaaggaatgccctgggcgaagcgaacctttcgattttttgcagcaaaaaaggaaatgtatttaaattaattggattatatggggggggggagagaggagaataaatgcgccgaatataaaataagcatttcaaagtgaaaaaatagtaagacagattagcccaaaatcgcaaattttggtcattttttggacaaaaatatgtaaacaaatcgcattaaaaattacaaattttttccgtccttggaacggagcatggacgatggcaaccctgtttaaaaccctaagaagaaattgaatgtaaaattttttgaaattcatttacatttaattaaattagtacacaaaactttcttcttaaatttaatgaatttatattttttggctgattttgagttaaatcagcaataaaatggcactcaaaaaaaattttcaatctcatttaacatatttgccccgttttcgctgctcctcccccgcttttgcttctgtttgtgccaaattccaatccatccattgcccatggcaaaaagtgccgtcctcgtcgccaattcttctttcttttcccattttctccctctgccttctctctctctctcggggcacggcacttttcgtctcatttgcataaattaatacttttcagcacaacgcggggactcttcccctgcggggtttcggggggggggggtgtgataatatattattaaattatattaatgtataatatttatacatcatttgagtatttcaatggtagaattgaataacccaagcata

SEQ ID NO: 512 - DNA, 4270 bp, Heterodera glycines
  misc_feature (169)..(169): n is a, c, g, or t
tcagcatgccgactgcgaaagtttgtcatatcgcaagatggaaagaaactcgtgccattcttcacatcagcatatccattttccaatcacttctcctgccgatttgtcattgatggactcgaattttcgtccagtgagcaaatgtacatgtgggccaaagcgagcgttntcggagacgaagaagcggcatctgcaattctgcggacgtcaaatccgaaggaatgcaaacgcattggatcgcgaattcggttgttcaacaccactgcttggagacgaataagcatattcgtcatgacctgtgctaactggcataagtataagcaaaatgaagacctgatgcgccatctcttcaattttggtcccgatgctgaatttgttgaatgtgcagcaaatgacgtgtactggggcgcaggagtagcaatttcggatgttgaaaaaattcgcaacacgaaccgttggcctggaaaaaacatccttgggaagattctctcagctttatgaagaaatttttgcgtaagaaatctggtgaaatgaatccaaaaaattacatataataataagaataataatttaatttaattatattaaatcgtattcattcaaataacacagcaataacaaatgattcttttacagatatgtcggcatcaccagcaccaccaaatgttccggacctgagcgagttcccgccgttggaaaagttaacattggaggatgtaaggaaaaagaacaaaattgcctcggcaagcccaagtggaaactcaaatatttctaaggaaacctgtagtagtgcaataagtgtggatttagttgcttcggcaagtcaaataacttggggaggggaaaaagggaacagtgggcaagaaaaaggggaaaagaatcaaaaattaaataaaaatgttgcttcggcaagcccaagagattatgaaaaatttgcgaatcaaggatttgacaaaaacccggatgaaatggctgaagaaatgatggaagaattttcaagttttaatgtgagagaaaatgaagaaaaaattgttgaatacctggtttgccaagtagaagaaaatatagtgattggaggaaaattgaggacaatggcaaacaatggctggccacattttgtagcaatctcaaatgaggtggctgaaaaggcaagagagtttaaaaagaaattgcaaatgggagacatagttggagtgaaaaaatttgagtggaaaaatgattaccgatacttagcaaaaagagaaactgacaaaagtcatttcaacaaaatgtggtatgtgcaaaaaataaacagtcaagcaacagtcattgacctcggtcatataagatatgcaattctgagggaacataccacccccccccccccccgcccggtccaattgggtggcctaagaatggggaggaaaacaattccatttaggtgttgtttggaaaattttacgactttgatgaacactttatttcaaatggctttaataatcaaaataagtttttttaaacagttaaataatgttttatattttttttatttttaataatttgtttcaatttattcaaaatgctaccatttaactcagttatttgccgtatcacttcaattaccccacccatcattagtgttcattaatttttgcagctgtctctcccaaatcgatcctccgtttttttcccgggggccgctgggatttaagcccaatgaatttgtgtgatggaatggacccaattagtacacaattttcattcctccacctttttcccaaaatgggctactaaattaaagggaatcattatcaaagagaaaatgtcaaaagaattaattttaagttttagttaatcaatgtcctatttattatgtgccaatctcgcacggcataaagcccattttccccttatttatgccgattttgagtctgttttttcgcaaatgccaccattcgttgtcccatttttcagtccaaaaatctccccgtaatcatttgttcttctcccattagctttaatcagtcaatgccttccttccggatcaattactccacttccgatcgatggtcgtgttgtgtctgtgctgatttggcccattcggccgttgatttagtggccgatttttgggggaatgcttttattgagtgcctggggctttgtttttctccttttttcctcgcccggccttctcaccatccgccgtcgattgacaagtgttctttcggcttttcccgagtgaagcgagccaaaatttcattcatttttttaacgaaaattttccaaaaaataggcatttggctgcaaaagaatttagaaaaatgcaaaaatagtcaaaatgtgccaattgatcattggccttatccccttgaatgaaacaaaaaacaactgcttcaaattacttatttctaaatgataaaatcactttttttgctttttcattgccattttctctcattttctctgccttttccgttttgccaaaagttcatttcaatagactcaaaatctcacccaatccaatttattttatttacggcaaaatattcccccctccgtttccatccgccgtctgaagagcaattttctgaagacgaaaaaagcctttaagccccgaggcgatgccattatgacgcacattcgaaatggcaaatcaattatccgccgagtgaaagcggcgccgccaaattccgccggaaaaatcgcatcattcaattgcattttataagccaattcagtgtaattacaagtgcccattttaggggattccaatgagaaaatttgcaactaaaaattatattttattgaaattatatttattatataattaataatgcaatccttgcgccatttgattatttatgctttttattttcaaagaattgcaaagcattttttttcttccaatttctccgaaaagttttgtttcaaatacatattcttctttttactttttttgtttgaaaatgtgaacataaatgtcacattaaattcattgacttttttattaataatttttaacaattagataaaatttatgttttatttgctgacagcatttactggcaccgtcagattctgcataaattttcaaaattaggcgaaaatttgtgatgaatttttaactcaacaatttcaaatttcttcggcttggcaccgccgacagacggacctttccgaagaaaaggaatcagaaaattcaattaatttacatttcgaacagcgatcaacgcttttttcttcagtatatattaaatgggtctccgctcttccaaaagtgccgtccttcgatcgtttccccctttacttttgccgttccgtccgcttttcctttcccacgtcactcttctgacactaattaactttgtctgctcccccccccccggcatttgccatttgcttctctcctcacgcttttcgattatttgtctcctctgtctgtcactcatctgccggcatttcccgtcataattaatttgccgtttttccaccggagcaaaaggcattagtgccaaggcggaagtgccaataaaagcggagtttaatttttgacatttcaatctttttgaaactttccccactattttatgctttgattgcttccttctttttccatccctttgcttttcatgctttatttgtcagcttttcttatttcttttccctttttcggcgtttaatcaaccgaaaaattcacatttttcttttatgcaaattaaaattgccataaatttgagaacaatgagcaaaatttgacctcttccattaatcccccctttaattgctgatttctgtttagccaatttcatttattatttaattttccaaattaaatttggccaatgttggccattttcttggccattttcgtcccttttttgtctgttttgtgttccgccgccgccgaccactaaaagtgaagggcggcgaagagatttttgcccccggcactttctgcgctctctgtccgtcctttcgccatctgtgccccattctctcgcacaactaattctcacgccgtctgccgccttagctttgagtgcgcgcgcatttagccgacttttttgcctccggcacatatttaacagtgcctcgccttcggcttcattttcgctaaaatgggctccgtggctgcgtggcttccgtttgccaggtaaccaactgattgtgtgctttgccttctgcacttttagcgggggggggggggggggggggaagagtaatttaaaagcgattacccaattaaaatggataattgaattatgggttaatgggattaattgacttttat

SEQ ID NO: 513 - DNA, 2344 bp, Heterodera glycines
tgcttctgctgctggtctttaaacgccattttcaccaacactcaaaaggcggaacaattggcccaattatttgtttccctccgccgatcactgatcatgtgaattgggtggcaaaactattggggaaatggcttctgatatttgacacggtccgatcatttttctttctttgataaaaagttaccgaatttttcatgccttcgcagaatttttttttattgtttttgtccaaatcgtttttattttggcgggccatcgtcggaatgctttaaaaacgatgaaaaaatgcatgaaaaagccgaacaaaccgcaaaatcgcatcagtcaaattctgccgcttcttcccaatgtttgtccaaattcggcattggatatttggccaaaaaggagggatttccaatccttgcgattatttgcacagccaaagtgttgatatggcgaattactacagcaaacacattttaaaggccaaagaattggtagttgaccatgtgggcgatgttcggctggtcatcaacgtgtccggggttggattcaaccattaattaatttattgatgaattaaattatatacataaatttagcgtcgttttgagacatggaaatacaccttggaaaggtttcccgaaactctgttgggctcaagtgagaaggaatttttctacgacgaaagcgccggcgaatatttcttcgaccgggaccctgaactgtttcggcacattttggccttctacaggaccggcaaacttcactacccaaaggtgggaaattaaattatttggatgatattgtaaagtaattaattaattgtgtagaccgagtgtttggttgcctacgacgacgagttggccttttttggcataatgcccgatctgatcagcgattgtatgttttgccatttgcaattaattggctgaaaatcaaattgttttgcattaaaaggctgttacgaggagtacaaggacaaaaagcgggagaaccaagaacgactgatggaggagcgcattgacgcgcccgacaaacgcaagaaggacttgacactgcaggtggggggggggggggtgggtaattagcgcagagaaagggaaactcgactaattaggataattaattaggcagcagagtcaaatctcagtcatttgggttaattttaggagaaaatatttttcatggaacccgggaggttcaaacccccgttttttcttcttaaacaattttgttttgatcctattttttcaccaggattttctttttaaaatattgggctaattataatgtaattacttttcataattattaatgctaaaattttcagcaaaaactgtggactgcctttgaggtgcgtgaaatattttttattatttaatttttatttatttccaaattttccttctcattgtcagaatccccacacttcctccgtggctttggtgttttattatgtgaccggctttttcatcgccgtttcggtgctttgcaatatcatcgagacaattccatgcaaatatttggccaacaatgtgtccatcacttgcggcgatctctacgaaaaacaggtggacaaattcaacgctattattatttatttatattttcatttttaatgtatttttaattatattttaattgatcttgcagttttttgtgcttgacactgcttgcgtgatcattttcaccgttgagtatatgctgcgtctttttgctgcgcctgatcgttgcaaattcgtccgttccattatgtctctgatcgatgtgatcgccattttgccctattacattggcctggggcttcaggtggccaaaaacccgatcatttcatttatttttgtttttaattttgaatgttttctttttgtaaaggaaaataaggacgtcagcggagcatttgtcactctgagggtgtttcgggtatttcgggtcttcaaattttcaaggtccggcacatttcccctttttcatggcatttccctccccccaggcattcccaagggttgcgcattctcgggtacacgctcaagtcgtgcgcgtctgagctcggctttttggttttctcgttggccatggccatcatcatcttttctacaattatttactataccgaaaaacgggtaaattcgaaattaaaattggcaattaaaaaattgcataaatttgtttgtgcataaattgcccattttcaggtcactgaaactaaattcacgtccattcctgccgccttttggtataccattgtcacattgaccacactgggctacggtgactttgtgccgcatactgtacatgccgaatttgtgcattaaaatttacataaattcattcatatttgaatcatcattacaatttg

SEQ ID NO: 514 - DNA, 8665 bp, Heterodera glycines
  misc_feature (4997)..(4997): n is a, c, g, or t
atcgcttggcctttggaagcgtcgtttaagcccccaatttttgcagaaagctcggatggcacgcattcggctggtgaagaacgcctcgggccaagcgctaacggccaaaaaacgggcgcacgaggcgcggatgaacgattttgagcagggactgttggacgcggaagagctgaaggatgaggacatcttcgagctgcaacaccaccaccttttgatgtgcctggagaaagcgacggttggtaaaggaacactcacaaaatgggcaattagcgaaattgtgacggcacaattttgttaaatttggggaaaggactcgtactccatgtgccatggaaagattttcctttcatgccatttgcgttttttatgccgttgtaggaacgggacgcgcttcaacagcaggaagaaatggacgtggagagtcagcgcgagctgctcgatgcgtccaacagcagtccgccgcccgcgagtccgctgtccgtccgctttccatcgggcggtgcgttggcacaacactttcagcgcggttggttcgcgcaaatgcgacgccactgtgccgactctcgttggtgcagctgttgcggaacccagcaacagcacagacaccgaagaggcggaagcagcgcaagcggaagcagacgcagtgatcacagagaggaaaagggtacggctgatcagcacgcggagggggaccaacgggactgatcaggcattaacatggccactcacttctatgatcaatccgtactaagaatgaccattggaaactcgaaatgtcattaataaccgctaattgaactgaaaagacagataatattcgagactatagactgtatagaagaaatttctctgatcatacattgccgtttaaactgccggtcaaaaaaggcatttattgggacaacagagagggaaatggaaaactgctcatagcgcattgatgaggataattagttttaaatattttacagtacccgagatgaacatgtaccagcaacaccaccaccaccatgttaatcagctaaaatatacggacatcaacaaacaatccaaccaattgtattcatgtacgaccgccacaacgtcggtgacaacgccgcactgcaacggcgacgacgacgacgacgacaacggtgacgtggaggaaggcattggcattccgatgcgacagtcaaaaggcaatttccgaaatggtaaattgttgaccgatccaacaatcttgatatctttcgaaagctcttcacaggctctattagcctaataaaaattacagagaatgtctaactgaaaaaaagaacagagacaacaacacttttttgtgagctacttcagcatttagaaataacttatttgttggcaatacatatcttctaatcatttaaagctttcgaatgatatcatgtttgttatgtttggtcaacagagaaaaaagttatagctttgtgaaatttgttgagacggtgttgactcctatcgaaatgggagaggcaattaggacattttaaacattaattacaacagtccagcaaccacttagcaataattaaaaccattagcttccttttgcgtaatgatttagccaattcttcgccatctccgcccgtccgaattgtcgtgtcggaagaaaacgacgaatacgagccaacacagcagcagaagggcaatggtcaagatgaagcaggggaaggacaccaacattatcaccaacaacaatggcatggccatgatgaaaatgatggcgatgaactgttgggagacgaagcggcggacaatgagaggcggaagagttcaacggaagaggatgagggagaagaaatggaggacaaaacggaagaggaacggacgaggaggaggaaagggaggagggacagcagcaacgacaatggcaccacagaaatgcccggcacggaaagcgtcggcaaaagcagcagaagtcgaagcagcacatcggcacgggacaaccgctgcagtccgaccgccgcagcggggcggagaagacggaaacggcgcggatgggcgcaaaaaaggggcaaagcgcaagcggaggaggaagaggaggaggagtgtatgtccactctttgaagtgggggggggagggggaaaagcataagaggagaagccaaagccaacaaatgccatcattcgtcaatcgcagcaaatgtcaaacattggcacgggaaagtccttccattttaaatacatagagggcaaatcaaatttcaacaatctcagatgatcaaattggtcatcagaggagagagtctctatgtttttggcatttattttcgaattctcggcttgtgtttaaattggaattctcgacttgcattgcgttttccaatgggactttcctaccatatcaaagcatcattatcagccataatcattgtgtttgtttttttattacttttttatttactacccaatccaaaaatgattaattaattaattgaaatttaattctctgattgggcagttgattcactatttcttaatcattttcttccattttttgttgtattttctcacagattctttcactttgattaaactattaaaaaaatattcaaatttttcaaaatacaaacaataatgacattaattagctgaacgtgtgagactttgaaaatcaccggcgatgggttaatcactaattattttattttattttaatccaagaattattccgatcacaggcattgaggtcttgaacaacatctgaaagtcatcagatatttaaaaacataaaatcaattatttataaaaattaaatttaaaaatttttaaaaaacttacattttgtgcctgaaactttcgctgtacacacaatagggaaaatcgacgaatggacaactgttaatggccgtgcattgcaatggcaaattggagtaaccggggtacatttttggttggcctattgaaaagcaaattaattaattaatgactaattaggcctaaattcgaaaaattaaagtgttattggtgatccaaatggttttctcaaaaataaattcaaataattttaaatctatcgaaaagcataaataatttaacccaaattaaaattaccgaaaatcggattttctgggcccacgccgcagcaaatgtattggcccgttttgtacacgttgttccattcgcaatggtaacccggcgaacacttttggtaaatgcaatccttcgggattccgctgaacaattcgacctccgccgacggattgcgacatttcgctgacgaagagacaaattttacattgttaaaaatgttttataaattgaatatgcatttattattttcaattaaaagtgccgacggaatgcccgctgctcctccgtcggctcccaacttcggccgatttggctgcacacgccgttccggcagatcagtgccgcttcgcccggccgtccgcggcactgcaaatcgctgacgcaccgttcgccaacgcccaacagcggaaagcattggccattgacacgcacttggttcgaggaacaagcagctgaaaatgggaaaattaatgaaataaaatgaatggactacgattggaataccatatttttccaaaaattaaatttttttttaatttgttaaaaatgattttatttgccaaaaaatctatttcctttgcgggaagggcaactaaactgtggaattaattaaataaagaacatgcaaaaataataattttaaaacaaaactcaaaaaatctttagaataattataaggccaaatgactgaaaaaatatataaataaatctttaattaattagttacataagcgctgcgataattttgataaattgagctgcattgacttatatttattttaattgtgcggtctctcttttatttttattttccttaattacttttggacaattaatttatttggatgtccaaaaagtaacgcatctctcttttgtggatcttttctttattgacaacaaataaataaatagttattaaataatttaattgctttcccctaacaaataagtggattttgcccttcgcttttcttaccgtttgacggaatgtttgggtcgtccgcgcacttttggccattgtaaatttggcccggtgggcacacacagcgccgctggtagcagaagccgcccaggtaattgcattgttccgctttaaaaggccaaatattaaaagggaatgatgatgagaagggcaaaacggtggtgtacagtaatcgcaggtggcaccgtaactgacgtaactgtagcaacgaccgttgatcagcatttggccggacaggcacaaatttgacgattgcggggcatcatctgagaataatccggcgggaatttggttattaattaaattattttttaattaaattaaatttttacactccgtcccccgcgggatgcattcgtagccgtcaaagctgtacccgaacctgcagtagcatatgttgttggcacattcgctgtttgtgaatttgcaatgttctgccaatgtgcacgcggcaccgtaactcgagagggacgctgtttaaattaaaaacaattaggatgatttattgttaatatttcaaatggcaatcggccggcatattggacaccaaatggcttaatatgtccgcggcttgttgatctcaaaaacccaatgagtggaagaaaagttgataaatttgcgcaaattaattggcaatttcaaaattttccggctattcgcgtcgaaataaattatatttgccataatattcgcaatttacgctttgccattgcgcaacagtgccctctgtagcagaaaaagccggtggccaaagcttggcactgcgcgtcctccgcgcagctgaccccgtcgtgcaatggctgcatgtccctggcgcactgcttggcgcccgccttcggctccaattgcacctccgccggcagcacagtgttggccaacagagcgggcagaacgaaaaagcattggggaaagcctaaaggggacggaggcacttgcaaaggttgaagtgggactgaattggaccatntaaaaagtaattaattaacggaatgagttgaaatttggaataatcgggaaaaaaatttaattaatttttattttataaaatgcattatttatttcgtttggaagagttggcatcattcattacctgggtagcagagggcccccggcgatgaagctaagtatgaggggtacgcttgaggagggggagggggcggcacaaaagggccggacattttcaaattgagaaacaatggagaggaattaattaacaaaaagtaataattattattttatttattattttatgcttttgttttttctccccaatgtctgtcccttctctctcagtgacttttccgccgatcgaataagctaatatcattcgttttcgttcgctatttgctttacctcttcatgatcaaaaacaacaaaaaagaaaactcactccaatcaaagaaagtagaattatattatgtggtaattcgatattgagcacaaaaggggaaaattcgtttaataaaaaatgaaaaaataattttgacattccaaaaaatcatattttattaaaagcatttgcagacgaaagcgccaaagatcaaaatttaacaatgcttattgtttactttacaaatcttttctaagtatttttctccttgaaaatcaaataattttttaaataaactttttttttgatttttcattttgctaatcattggcaatgactcactcttttcttccttcattcattccttacttcgttcattggccacaaattgggcttaatccgatcagttcgcttaccctttcgcctccctttggcccctttcattggcggcgtattgcgcgagctttggagacggatcaacaaaagcagcaaacaaagcgaggagagaagggaagaaagcaaagagaaaagaaacaataaataaatgggaaaataaaaaggcaattaaacgataattgattagttatttaattaattatgcattcgactgattacatatcatgatattaaattctattttttaaaattattattgcataaaaacaaattttttaaacaacattgcaatcgattaaatgcttcgaattaatttcctgaatttacaaatactaaaaatttcatggaaatgtcgccagtaaccttcgattttttgtccgatgttcttttctgattccaaactttgttaagcctaatggataaataaaacttttttttcgcatttttaatgttctcaactttaattgtcaatttgttttaattgtgataattatttaatactttaaagagaaaagttttggttcgtttttattttcaaatttaagttcggatgatcaacgacccgaaaaaacaagttttctgtctattcatcatctttcaaaaaatttttgctaggcaaaagggttccgcccttatggtttttaataaaatttaaattgggccatttggccgcactttttccatccagcaaaatccatacaataaaagcatttttcatttatgtccccccccccccccgtattagacaacccaacaatcaatcactaggccaaaaaagggcaaaaagtgacaattttttggcaaaatgccttataaatttttgtggccatataaaacacgtggtaatcagaggaaatacaaatgcttttgtgaattctatgaatttatttataataatcattcattttatattataaataatatttcagaagtaaaaaagaatcttttagcgtataatttcattttttcctactaatgcttcttttttcttctgctctgctacggttttttgtaattttggcccatttctgcgcgattcattcgggtttttaactaattgaatttaattttaaaaatatatttttataaagctaaattgcaaaccaatgaaaattaaaaaagcccgaccccattttgaccttttccgaatcccgaatttaaatttgaacaaaatcgaaaccccaaatttatttttttaccatttttttggaattggtcaattggatttatctgcgatgacgaaaaccgttaaaaggattttcacgtctttttgttaaaaaataattttacaaagcaaagggtccttttggtttttaataattttcaaaattaatgaattatgaaaaagcgtcgttttccattaaattcaataattaattaaaaatgaaaaaattattcttcagcacccgttaaacaaagtgtggaattggtattcacacaaatctcagaaatagtgataaaaatggaccaatttttggcaacaaaatgcaaattcgagaaagaaaaaataatgtcgaaaatgaatgagaaaattagagaggaaaaatatggccaaataattggccaattgaaacaattgcgactctctgaacttcaatttggacggcagaaggaaaatgtaggcgaattgagccaacaaacagaagagtttatcaaaatcattttggcacattgggtcggaagcctcgaggcaattaaggttttgaaattttatggaaattaaaaaaaaaccaaatttaaattaaaaaagaaagttgaaaaaattgttgtgaatttcatctacaaataatttcttaagtggaaattttattttttttttgtaatttttggcagagagataaacaaagacaaataataaaaaaagaaaagaaaaaattgtacattgtaattttagaaatgtttaggtttttttgtaattaaaataataataaaatttattagcgtgaaattcgaccgtcggagttaaacaaagaactggccaaattgaacgaaccaaaagacaatttaatagtcatggagaaactgttcgatttggcatggtttttgtgcgcaaaattgaaacatgacgaaaagcggtacgaattggcaagatcgaagacaatttggcgaatgatcgattggaactattacgaagaattggagtggaaactgtgcaagactcgggaacttattcggaaaatattagtcaaggaatttcaagtgccaaagtcaattcattcagccattaacagactaattgactaaaataataataataattagagtgctcattttgcagcatatgctgtttttctttgttgctaacttggggcgtgataataagcatgaaaaacgcattcctaacttggtttgaggcttctaagtccacttttttcatgctgatttttgcagatttctcgattttttgatttttgtgctgatttggcgtttttatgcttttttatgctgtttcgtcattttgagcaattttttaaaatattttcagcaattttcaaaaaatttattaacaaaaatgcaataaaaacgaaaaatacacccttatgaatcgatccaaaaaatttgagaaaaatacacccctaagaaatgaaaatttatacaaaaataattcatctccaaaatttatttaatttatttttttgacaagattttgattttttaaagtatctcattaccatttttagcacctatttttgaggttttttataatcagggagcaaataaacgtttttttgacgacttttttcaatttttggtgcctttaatctcttaatttttatgtttttttccaattttttgtgctgcttttgccttttttgtgctttttcatgcttattttggaaaaatttggtgctgtttacagtgcttaatcggtgattttttgtgctggaaactgagcactctattaataa

SEQ ID NO: 515 - DNA, 649 bp, Heterodera glycines
cccccctcttaaaaaaaattcaaaatagaagctttttccacataaaatgggtataattggatcgaaagtgagcccaaatgccccccccccgtctcattatgcacttgtccatgccccgcgggtcggccattttggcggggacggacggacgccccgcagtcggtcgtctcaaaattgctcactttcgccgccccccccccccaactatgcttcatcttcggctgctttttctgccctttccgtccaattcgtccagctgtgatgggatgggaaagggagggacacggcgacaattaccggaaaaatacttgcgcaaaaggaaaagtgaaaaaacgaaaagcgtaaccgaacgaagggcaaagtcagccgaacagaagaagaagcagtacggaagcccacctgattgcttcttaaataggctgtcctgctgcaaaagctgctcatttttcacattttcaaaaacccttaaaaaatttttcgctaaaatgcgacgaaacaacgctttgctgtttctgctgtacggagtgggcctttccgcactgcttgtcgagctggtcgatgcgtatttgtacggcggaaacattgggtagggaatggattttaaagaaatatttttaaatatttatttatttattaaaattaatttaaa

SEQ ID NO: 516 - DNA, 767 bp, Heterodera glycines
caaatttttaaaaaatgggagtgcgttacgttcccccaccaggagcagagctcgtttccccctcacccagaaaaaacaaatacaacagtttttataagaaaatttgaaacaatttcgaaaaattttccaaaaaacaaaaattttcttacccttgccgttatctctccacgccataaaattaaaaaaaaacaaaaaaaaaatttttagttttcaaactctcttagactttcctggtaaagctagaatttttcaaaaaaaaaatctggaaatttttttttttttttacaaatttctattagtatttattgcgattttctgaattctctctcgtttctcaaaattttttaaaaattatttattttaccaaattttcattctcctcctccatcctccgctttttgcactttgtctgttgttcatcctcggcctccttctgctgctgctgctgctgctgctgctcacttttggcttcgttttctgttgccataaaattggagcaagaaaaatttaatgaaataaataaaaaatcgcttaaaaaacgcataaaacaattaaaccacaacaaagcattggtacttccttgttttgctaccccctccccctcgaaaatttaaaaaaatcatagatattttattaaatcagtgactagatgtcatagatatcaaaacaaacactattttcatagtcagagtgaccttgaaaactccaagatatgaattttttaatttttcgagggggggggggggtagcaaaacacggaagtacca

SEQ ID NO: 517 - DNA, 2337 bp, Heterodera glycines
ctaccattgaaaaatggacgcaccccaaatttcgccacctattctaaaaagatatattggacttaaaatagcaatttttcaagaaaaaaaaaatcttggaaaaaagttttaaacgaattttctagaaaaaatctaaaaaatttccttacaataagattttttcttgaaaattttcaagaattaaaaaaatgttggcggtaaaattcggccggcgaaattccggcggcgcaattttgttttattttttaacataatttacaattgaaattttgatggctgaaaaagctcagatttcaagtgatactaaattcgttcattttgggcaacttgaaatgagttatagccaaaaacacggattagatcattttcagtagagaaacgacttggggaaagtgaagtgcattcaacgcccagttgtcctttccgttaaagttatataatgtgacctttcatcacaacttcaaaaatgatgcccgtgtagtaatccaagccgcgtgccagcgacggctggaagacaatgcgcgacggatcactgccaaaaagttgcgcatatcgaatgagcagtttcatttcggcaacggcttggtcaataatttgcaagtgcttctcagaaaagggtggaaaattatcttcgtcggtccatctcttttcggagaaccattcgagcaaagtccgattgtcccagtccgggtgtctgtctgaaaaacgaattcaacgagtgttttagtcagggctcccaagtttttttttcaaaataagacaaaatgggtgaaaaactaagattcggaccccaaaaataagattttttctgaaactaatagtagcgcaaagaaaacacaataaaacgtgaaaaatgacttgaagcaatattttattagcctaaaatgcagggctgccaactgtaaattttcaaaatcagcatttggctgacaaaaaatcttcatttgggatcaaaagtcagcattttgaaaaatttaattcaaaatgaaaaaatctatattattttttttgcggcgcgctttttccaaaaaacttttggtgaatggggtggggtccggcggggccaataggcgccgtgggaaaaattttagaaaatttcaatgcaattttgtggcgctacttaaaaagagtactcttttgaaaattttttcacttttttttggtctaatttttttttttgtttgttttgatacagaatgatgaacacattaagcattgagcataatttggcgaataaaagtatattcacgattttttatttcaaaaaattttgaaaacaaaagggttccccctttggttttttgataaaattcaaaatctttaacttttttttgttgttttttttgtcattcgtaccatctgttaaaaaaacaaattctgtatcaaaacaaacaaaaaaaaaatgttgaccaaaaaaaaagtgaaaaaattttcaaaagaatactctttttaagtagcgcccaatttgttaacagagttccgccagaaaatgaccaatttttgagattttgagccaatttttaagaaaacaaataagttttggggacccgcggagccgaaaagcgccgccggaggaaaaatagaaattttgactgttttttacagattttctctgaaattttgggtattttacactcaataaaacgaaataaatttgaattttttcaaaatcgaattagtaattcaaatattcgcttcaataaaaaacgataattcaaaacattcattaaaattttgcatttttttattttcaaatcccaaaataagcacgtaatgctgaaataagcacattttaggtttctaagatccggcccctcaaaataagcacaaatcttagaaataagcacacttgggagccctgggtaaatgccttttggtattctttattttgatcaaccataactcgcttcattccccactaaactgaacaaatttggtatctaaaaaaagtttttgaaaagctgaatattttctaagcaagtgctaagcatttgtcatgtcagaaaaaagttgtgagagttttaaattttcattacgttataactcaagccctaggccgccgtttttaaccaaaatgcgtaaattgattctttttatattgattctaaaaaattaaagtgattttataccattttatcgaaaattgttagcatttgcgaatttcacgtttttcattgggtagagatatgaaaatagtatgccaaacggagaggaaaagaaataagtttttatgttattgtaaggattattcgacgcatttccctcatttaattatttcccattggccattatcaattcaatcacatttatccattttcacacgtttttccttttctc

SEQ ID NO: 518 - DNA, 3316 bp, Heterodera glycines
ttttgaatttttttccttttttttggtctaatttttttttttttgtttgttttgatacagaatgatgaacacattaagcattgagcataatttggcgaataaagtatattcacgattttttattttaaaaaattttgcaaaacaaaagggtccctcccccctttggttttttgataaaattcaaaatctttcacttttttttgttgttttttttgtcattcgtaccgtaccatctgttaaaaaaacaaattctgtatcgaaacaaacaaaaaaaaaaaaaaatgttgaccaaaaaaaaaagtgaaaaaattttcaaaagaatactctttttaagtagcgccacaaattgttaaaagagttccgccagaaaatgaccaatttttgagattttgagccaatttttaagaaaacaaataagttttggggacccgcggagcctaaaagcgccgccggaggaaaaatagaaattttgactgttttttacagattttctctgaaattttgggtattttacactcaataaaacaaaataaatttgaattttttcaaaatcgaattagtaattcaaatattcgcttcaataaaaaacgataattcaaaacattcattaaaattttgcattttttattttcaaatcccaaaataagcacgtaatgctgaaataagcacacttgggagccctgatttaaacttaaaaatacgaccccacatttttgctgattttatttggcaccattgtttcagtgatcgcggaaatgtggaaatcgggtccggggctccgaatcgattgaaagtgatatcatattcgtgatcacttatcagtgtgcctacgattaaaaagtgatgcataattaaagaaatataaaatattttttttgttgcctgagggcccttaacttttttgcttcccattgtaattttgaatatttgatttgaattttgatagattcccccccccccctcgccgctccaaatggaacaaagtgaagacgttgatgccgagccgaatgatgagttgacaacggcgcggcggataagaagaatgagttgaggggatgggaaatggtggcataaaaaagggaggggggggggcagagaaaaaatgactgaccgactaattgccgttggcattcacccatcgctgagctaaggaaggcatttgatcaaattaatatttttaaatgtggcttgtttatatgccggaatgtgacggtttaaagaaaatcactaaaatttatccgaaagcggttaccattcatacaaatttcgaattttatgcttcctgtattaaggttaccctcataggcaagatgccaatgaggatatcatccatacaaattttctaattttatttttgttcgagttcgggtcaggagtttgaaattgacaaaaatgggtgctgtattcgtgatcagcgaccctaaaaatcccttaaaacttattttctaaaacacatttataggaatctgaaaatgtatgttaaaagtatcatgtaaactagacaagtaccccgaaagctatacataacacaaataaaagttgatcaccgcaacaaaacaacaatgttatacacatcaaataggatcaaattcattctccaacttcacaattcaaattgatcgatcacttctcagcaaatctctcaaatgtcgattctgttccattggccattgaattgccagtcaatcgcttccttttcccatttcgcccatttgtccatgtcgcgcacaattggacaacggatcagaagaaaacggccgacatcgttcatccatttcaacgtcagttgttcctgagtcacttcgttggtcagatcaaaggccaaattggggtcaacagaagccggcggtcgccaaatgacaacaatgaaactgacgggagatgaagcattggcaaatgcctaaaatatgggacaattgattaagaaatcataaaatgacgcaatttgcattcgtcaaaaacgagttgaatgccgtccaaactattttttgtcagcgaacccaatgaacgtaaaatgccaattaaaatcaaatcgaatcaccgctttgaaggctccaatgcgcgacgacaaattcccataccaccacggatgcaaccagcatttgaacacctttggcacattgtcaggacgaggagtgaacagccatttggccaacgcttgtccatccgatgccatggcactgtcatcgcaaggaaatttggcgaagaaaccatcagcataattggaattgacaacacgaagcgatggacaatcgttgagaagtgacgggacaaagcgtcgcaaacggctgagagcatatcggggcaattgtatggcacaaatgtttttcgcaatcattggccaaaatttgcgcaaaatgaactccaaagtgcggtcatcgtccgtgtagataaacaaattaattggagaagaggcgaaaagttggcgaaaacgctgcagaaaagtgatggcattttggtcgatgtaactgtgaaaataaaggaattgttttacaaacagaaaacaaaaaattaatcattcatttcactttattgaaatggcttcgaatcccacgactttctttggcagcgctttttgtggagttggcaattcttttccatcgcaattgacaatttcccatccatttgtgccatccgcttcaaatttggctttaatttccatggctttgagcgcccaacgccgcgtcttgaagtgttcgtcgacgtaaaagtcaaaacggtggctgacaagtgcaattccaaggcccagttgagaaggctcaagcaaatcgaacactaaaagccaacagtctgaggagatgaaactgtaaaattaaattcaaatttttagatttaatttttctattttacattttctttttgtgaatgtgtagttttttcatttgtgccctataaatattagaaatggtgcaaaagacgacaaacattgacacaccatacaaactaagaactcagaagggcacagggacccttccaattaaaacacgctgaacccaccaaaagttttttaatagtattgccatggaggaacaatcaaaccaataaacagttccatgaaaagaaaatgaaaaaaagggaaaagttttaagatttaccgcaattttgaaaattatttaaaaaaattctaaattttaccgtcatggcacattgcgccaagaacaaaatgtgttggagtgcgtatagatttatgggagagagcaatgacaatgtacgaattgctattaaacagtgtgtcaaatttagagggtcttaaatttttgaaaattttttgaaattccgtctccaagcatttttgtatgtaccggtatgccacttt

SEQ ID NO: 519 - DNA, 12456 bp, Heterodera glycines
  misc_feature (7229)..(7229): n is a, c, g, or t
tctcctctttttcttcgattgcatttttcaaatgaatttttctaagaaaataaagcccatttaggaaactaaaaaagtgccgaaaactgtcttaataatttgctgcaacaaaatgtcagacaacagaaaagaagccgaagaaaaaatggaaaaagcaatgtaaaattaaaatgtcaatttcaattttaaattttgttttcctttcagttttatctctggcgacggttggctttgtgtgttcgatttgcttgagccttctcaattgggccttggaattgcacttgtcagccaccgttttgacttttacgtcgacgaacacttcaagacgcggcgttgggcgctgaaaccaatggaaatttggagcaaaaatggaacgaatggcgcaaaggaaatggaaattgtcaattacgatggaaaagaattgccaattccgcaaaaagcgctgccaaagaaagtcgtcggattcaagagcattttaataaagtgaaatgaacgattttttgtttgtaaaatgattccttaactttcacagatacgtcgaccaaaatgccatcgcttttctccaacattttcgccaacttttcgccttttctcagattaatttggccataaatacgtccgatgaccgcactttggtgtcgtttttgcgcaacatttttccaatgatcgcgagaaacatttgtgccatacaattgcccggatgtttcgtgccgtcaattctcaacggttgtacatcgcttcgtgttgtcaatgcctattctgatggtttcttcgccgaatttccggccgatgacagtgccatggcatcggatggacaagcgttggccaaatggctgttcattccccgtccggacaatgtgccaaaggtgttcaaatgctggttgcagccgtggtggtatgggaatttgtcgtcgcgcattggagccttcaaagcggtgatgtcgatttgattttaattggcattttacgttcattgggttcgctgacaaaaaaatagtttggacggcattcaactcgtttttgacgaatgcaaattgcgtcattttatgatttcttaatcaattgtcccatattttaggcatttgccaatgcttcatctcccgtcagtttcattgttgtcatttggcgaccgccggcttctgttgaccccaatttggcctttgatctgaccaacgaagtgactcaggaacaactgacgttgaaatggatgaacgatgtcggccgttttcttctgatccgttgtccaattgtgcgcgacatggacaaatgggcgaaatgggaaaaggaagcgattgactggcaattcaatggccaatggaacagaatcgacatttgagagatttgctgagaagtgatcgatcaatttgaattgtgaagttggagaatgaatttgatcctatttgatgtgtataacattgttgttttgttgcggtgatcaacttttatttgtgttatgtgtatgcatttaggataaatttagggattttctgaaactgtaattggctttaagaaatgctttagaaggttttttttttttgaaaaattttgccgcaaaacaattgttaaaaatctgattgtttctaacccaaaaatgcactgaaattcactaaatattatttgtttatttcttctccaaaattgttaaagatgataatcggaggcgaaaattaattaatataggtaaccaatttttaaaaatggaaatttcaaaataattattttttaaaattcaaataaatagctttaaaaatgtttaaaattttcgttttattcaacgcttttttgctgatcaatttggcaatcactcatgaaggaagaaaaatcggtgaaccggttgaaaaggatgtgaataacaaggagattaaggtaaaaaaaaagtaattaaaagcaattctcgacaatctaagttttcgaaccgagaaaataaaaaattgactcaaaaattgcaaaatttggaattttgtaacaagattattttaagagggcgtataattttaagagtgggatataattttttgggaaaatcgggatcaccaaagtcggataagccgagctcagcagtagaccctggactgacagtttaaatcggatttgtatcgggattacttttttttctcaaaagtcggattggaattattgggaggaataaatgtgaaattaaaaaaaaaaagaataaaatttaaaacttccaatgaaaagcaaagtgaaaagtgaaaccaagcacgtatacaattttaatttaaaaagtgatgtttttaaagcagccaaaggcaaagcgcgcaaactgtgtaacggaaactgttccggcagagcgaaaggcatcgatttcttatttaattatctgctaattagcctaattatctattctttaggtctttgaagtgagtgtgttccaacaaagttggaaaaatgttgaggacattacattcgtacccgaagaacacatgggcaattcgacaaaaaattgtgaataaaatgataagcaataatcgtgggtgaatacaaatttttaatttggtgcaatttttaattaataaatttgtgtaattggcttaaatcagcaaagataatttttatttgaaataactgttgttcttcgtctattgttttcttgatttgctctaatttgcaaacaacaaaaaaatgcctattcacataaaaactcattttaattttttcactttttaaaatatattttaaaaatttataaattatttggtaaaattgaagaatatgtgtacctcaccgaattcgaagaatgatatatcattcgacgcctctcggtctgtaaggcaaggatcttaaagaattttttgtcggaaaccactttgggccgagttatgggcccgggactgaagtgccgtcccttacggtcattttttgacagggctcccaggtctgaggctttagcctcattttgtggttttttgataggtcaatgaggctaaattttcaaaatgaggctttgaggctttttgtggttttttgagaaattttgaggatttttgaggcttttggggaaaatcctcagaatcttttaaattttgataaattggcataatgtttggcaatttaaagaatttttttaatgaaaatacgcaaaaaatatggtcaaaattcttaatttttccaacggcggcgcctatcggcaccgccggaccgtaaaaatccttaatttaaaagcaaaaatttgctcaaaaaaagcgccgcaaaaaaatcaacttcgtttttcatgttcagaatcccaaaaaatgcttatttctaacaaaaaaaaaatgctcaaattgatcatgggcgatcaaaaatataacatttgaacattttaaacgtgttttgaataaattttgtaaaaatgaggcttttttacccaaaatgaggcttttttgcctaccaaatgaggcttttgaaacttttgatctgggagccctgttttttgaggacctttggacggtttagtcccacagccatttggccacttcagtcccgggcccataactcggcccaaagtggtttcctccaaaaaattctttaagatccgtgccttacagaccgagaggcgtcgaatgatatatcattcgtcgaattctgtgaggtacacatattcttcaatttttccaattatttttaaaactgtcagaaattaatttattttaactaatattttcaaaaaatcaaattgaaatcaccgctttcaagtgttcaatgcacgacgccaaattctcataccagccacttttcattattttccattcgccattggatttttgtccctgacaatgccttcaaaaatgcttctgtacgttttgtccattttatttcttgtcgacatttacccttttccttctcattttttagtctgtacggtgtgccaatgtttgtcggctgttgcgccattctttggatttaaaaaaaaatcatataaaagtggttgctcctccaccacttttcattattttccattcgtcatttgttttcgactctttcttcgcgttttttccatgacaaaaccctttaaaaatgatttttttacgtttaataaaataaacttttcttgtgaatttttacataattttctcctctttttctttgattgcattttttcatatgaatttctaagaaaataaagcccatttacgaaactgaaaaagtgccgaaaactgtcttaataatttgctgcaacaaaatgtcagacaacagaaaagaagccgaagaaaaaatggcgaaagcaatgtaaaattagaatgccaattttcaatttcaattttaaattttgttttcctttttttcagctttatctccgccgactgttggctttcagtgttcgatttgcttccgccacttcaactgggccttggaattgcacttgtcagccaccgttttgacttttacatcgacgaacacttcaagacgcggcgctgggcactgaaaccaatggaaattaaagccaaatttgaagcggacggcacaaatggatgggaaattgtcaatttcaatcgaaagccgttgccaattccacaaaaagcgttgccaaagaaagtcgtcggattcaagcgcatttcaataaagtgaaatgaatgattgattttttcttttgttgtaaaacgattccttcaattttatagacacatcgaccaaaatgccatcacttttctccgccgttttcgccaacttttcgcctcctgcccaattaatttggtcatctatacggacgatgaccgcactttggagttcattttgcgcaaattttggccaatgattgcgaaaaacatttgtgccatacaattgccccgatatgctttccaccgtttgcgacgctttgtcccgtcacttctcaacgattgtccatcgcttcgtgttgtcaattccaattatgctgatggtttcttcgccgaatttccggccgatgacagtgccatggcatcggatggacaagcgttggccaaatggctgttcattccccgtccggacaatgtgccaaaggtgttcaaacgctggttgccgccgtggtggtatgggaatttatcgtcgcgcattggagccttcaaagcggtgatgtcgatttgattttaattggcattttacgttcattgggttcgctgacaaaaaatagtttggacggcattcaactcgtttttgacgaatgcaaattgcgtcattttatgatttcttaatcaattgtcccatattttaggcatttgccaatgcttcatctcccgtcagtttcattgttgtcgtttggatttcggcgcctttggcttttcccgcacaatttgatctgaccaacgaagtgactcaggaacaactgacgttgaaatggatgaacgatgtcggccattattttttgatccgttgtccaattgcgcgagacacgaacaaatgggcgaaatgggaaaaggaagcgattgactggcaattaaatgatcaatggaacataatcgacatttgaaagatttgctgtgaagtgatcgattaatttgaattgcgatttggagaaatgaatttgatactatttgacgtatatatagtattgtactttttgttgctatgatcaacttttatttgtgttatgtgtatgcatttaggataaatttagggattttctgaaactgtaattggctttaagaaatgctttagaagtctggcatgaagatttgtggcaaaatttggtcatttttcgacaaaaatcagtttacaaatcgcattaaaaattacaaaaaattttccaggcggcgcttatcggcgccgtcggacccatcaccgtcactccaatctccaaagtttttttttttttttgaaaaatttgccgcaaaagaattgttaaaaatctgattgtttctaacccaaaaatgcactgaaattcactaaatattatttgtttatcctctccaaaattgttaaagatgatcagggaacggatttatatgtatcaaaaaaatcgccaaaatatgtgacaaaaactgccgaaaccccaaaatatgtttttattcccaaaaagtccaaaatatgtttttatatgtgctaaaaactcgctctgattgaaaggaaaacaagtaaaaatgttatttttgagcttttcatgcgatagcatatgcgcaaaaaaaatatgtaaaaacatataaatccgttccctgaagatgataatcggaggcgaaaaagataataggtatttaataattttttgacaaaataaattgtaaaaataactgatttgaagcaattttgcaaaatgtcctgatttttgaccccaaaatctaaatttttgggcatgatgttctgattttgaaaactttcgatagttataaaaagaaaagaataaatcataaaattctataacttttttgaaacataacaaatttttcgaaattttttacaggataatagagaatgccaagggctatcgaatgataccaagattgtccaatttggttggcaaaaaccttcaaaaataatttccgaaaatcgtcattttaatttttggacaaaaatagataaaaattcatgtagcccaacggactcgaacctcaccccctcctcctcactatgacccttcattttcttacaaaaaccatttcgccacacatgtaaactcttaattgataactcaaaattgaaacgatgtgtaataaaacataaaattcattctgtgtgttgtccttttccctttttttgtttaatttggccaatgaaaaattcacaaaatgataataaaataaataaggaattgaattgaaaatgtgcttttctgaattaattatagcaattagtaactgatgaaggaacgaaagaatgattgatgaattcggaagctataaaagttggtgccaaattttaagattttccattcattttcttaatccaaaaatttataaaataaatttcaattaaacagctttataaatgtttaaaattttcgttttattcaacgcttttttgctgatcaatttggcaataactgatgaacatgtaattaattgtgtaaagactggatgggaagtggagtacaatccgtataaggtaaaaagtaattaaaggctattctcgagagtctgtttcgtgtcgagaaaaaaaaactggctcaacatcgctttatttggtatttttttggacaaaatctgttttaacaaatcggattaaaatattttgaaaaatcttccccggcggagcctgtctttaaaaaaaaagtcactacatgcccggaagccttcgcaaaaatttcgattgaccccccncccccccccaccccgttctttgggactttggtctcgaattattatctaattttgggctcgagtctcgggaaatgttcggtctcgagcatcgctagtaattaattattgaaacattttggcgcaaaattccttaattattaattatttcggtttaattaaggcattcgtcgctcgtgcggtggccaaagcgaacaaagagtccaacaatacgtatcagtttgtcgatttggatgtaatcaatgtcatggtagaacccagagaagaagtgtatctctatgaagtgaccattttggctggacagacaaactgtgcaaaaaatgtaagtgccaaatggactgaaattggcacaaaaatgggcaaagtcggcacaaattttaccccccaaagtcgaaagtcgaacattccaagatcagcaggccctggggttgattgacatctgctgagatcagatttgtaccatggatttccttttttaaaaaagtcggaccgggaattgttgggattgctaaaaatgtgaaattcgaaaaaaataaaattttaaatttccgtaaaattaaagttttttaattgggcaaacaaaagcaggtgtatataattataggactttaaaataatgctgattttttaatgcagccaaagatggactactcaaattgtgttgaagtcgatcgggcaacgcgaaaggcattaattaatcctaataattattttttaattagcctaagccctaattactcttcagaaatacaaatattccgaatgtttatgtgccagaataaaatagaacaagaaaaaatgatacgaaaggatgtaattgggaaaaaattgatcatcaaattatcaaaatgagcatgttattgaataaaatgttctaattgacattcaacttccttaattatatgactcatttgtcacaattattgtaaattgagaaattttgtatttttaaatatttcaaaatccataaaatcgccgggatttttaggaggaaagggaaaaatggggaatccagtcccgattttttcgttttcccgtttccgaaaattttgttttaccacacttcacgttaaatataaaaagaaaagaaaaaataaataaaattaattctgtgtgttgtccttttccctttttttatttaattttcccaatgaaaaattcacaaaatgataaaaaaataaataaggaattgaattgaaaatatgcttttctgaattaattaaagcaattagtaactgatgaaggaacgaaagaatgattgatgaattcggaagctataaaagttggtgccaaattttaagattttccgattcattttcttgatccaagaatttataaaataaaattcaaataaatagccttaaaaatgtttaaaattttcgttttattcaacgcttttttgctgatcaatttggcaataaccgatgtgcaagcattgttggataatacagaacttctggacccgaatgacaagaggtttaaggtaaacaaaaaaaagtaattaaaggcgatgctcgagagtctcagtttcgaatcgagaaaaaaaaattggcccaaaagcgctttatttggatctgttacaaattgtcttaaataagtactatcggcactagggatggcattccgaggccccaaacattttcgaaaatcggaattccgagacccaaaaatgtcagaatcggaatttcatgccatcccagatcggcaccgctttccgaataatttggcaaattcgtttcattaattatttctgtttaattaaggcactcatcgctcgtgccattgacaaaatgaacagagagtccatcaaaccgtttctgtatatgcctgtcaacaagatactcaccgtaaacacaatgcatggaaataactatgtaatgaaaatggtggtcggagaatcaaaatgcgtaaaaaaagtaagtgcaacaatggactgaaattggcacaaaaatgggcaaagtcggcacaaataataaaatactcaaaaaattttcccggcagcacctatcggcaccgccggaccactattttaccatatttttgaaaaatggagaccaaaacggcaataaatagtaatttttggcgaaaaacggcaaaaaattttgtaaaatacacccccctaatttgggatttcaaaaaaacgaaaaatacacccctaaaaatcgagtttttaataaaataatgctaatttttaaaggagccgctgcagccgccgccaaagattgactacacaaactgtgaagcgaaagctgacccggcggcgccgaaacaggcattaattaattcataataattatttattaattagcctaagccctaattaattactcttcaggattacaattacaccgagtgtgtgtgtggcaaactttggtgaattttgtttgagtcgattgaattcgataaaaaaaacattggtaaattcaataaattgttacgaaaggatgtatgggagggataaagtgatcaccaaattgtcaaaatgagcatattaaaatgccaccctgttgaataaaatgatcatccttaattatgactcatttgtcacaattactgtatttgagaaattttgtatttttaatatttcaaatccataagaaaaatttgggaaatttttgatgatttgttcacaaatcgtgtacgcctgctgctctttgcacccaaattaagaaattgagataattatacaaatcactgcaaatggtggatgatccctcgaaaactgatttttataccaaaaatgtgtagcgataaacagttagttacctgaatagaaatcgaaaaaatatgagtaaattaatttcaggaatgtatggcctatttattgcgatacaaaaggttggggatgtatgaagtattgacaaatcggcacaaaaatattgtttttattgtatagttcaaggatgtcatttcgagaccccaaaaacgtcggaaatcggaattttaaaatttggtatatttccaatttgcttaggaaaagggtgctattgcacttttttgcggtgcgcttttgcaaaaactttttggcaacatggcggtagggtccggcgatgccgataggcgccaccgggtaaaattttgttaatttttaatcgctttctcctttttgggtagaaattgtattttattcagaaactctttcaatggagaaataaaatggggaaactttaattttattgaatttaaataagtcccgtcttttcctgatttaggcaatgttgaaaatgcctccaaattttcggcattgtttatttttcggagttttctattttttttgaaaatcattcagaaaatctcattgaaaattaacgaaaatttctctctttatctaacccacctgtgatgttgttatttgctcaacctttgctcccttttctttatcatagggtaaggcccagactcttttgggattcttttggggtgagaaagtcgggtcgggcccctgccctaatttcaacttttttgagtttcatttttcactatttattaattttcattttttattatttttgcatttcctttttgtgaacattaaactaaaaatcatcatcaccactagagaccggaaatttcaaatttgcggatcctgttgtaggattgggattcaaaattttttacaggacagaatccggcaggattaatcctgcaaatcctgtatcgaccaccgacgaccgcctcacgtggggcggcgccggggggggggggcttttctccccctctgctgctgctgggcggaagacggacgggaacgggtcgggtggaccaccgaccacgtgccctgctcaatgctgccacaccctctctctctctttttttttgcgtgtctctcggcaggtcgtccgtcgatgatgatgaaaactgtcaaattgtcacccctcccaaattcacccaaaagtttctcacaagtactcctccgtccctcgttaaaatttgaaaaattgctgttgcttggctttttgccgtgttcaaatgccttcccccattttacgccggcattattttttgttgtggaaagagttgacaatgggcacaaccatcgccgcaagacaccagcaaatttgttgctgttacaccaccactaccaccaccattaattctctatcgaatttggtgagaaaattggcgggaccgttggagccgaaatttttcgtaaaaatcctgctgggtcaattctgaatttcattttataattcctgaaatatcaaatagcccctgctaggccagtaaaatttcaaaaaaaaattcggcaaatttttttttcttattttgtaacgaatcatagcgcctcaatcgtcccccccgtcatttttcgctttgtggggggaacatttattatcatttatcaaaattatcagatctgaagaatagcggaaatatgggatttaaaagtcagttcgctgtcaattaggattccaagatctcggattgtttgggtctctttaataatttttccattaaattggcagggaactttaaaattatccttgccaatgtacagagaagctgatttttctggtgaaaatggtagaccccacataaaaaatttttggaaaaatacacatgtatcttatttgtaaccgcaattaatgaataaaattgcttgtcttaattcgaaattacttttcatgtagaaaacagcaattttaaaaattatacccctaaatttggaactttttcgacctttttttcgcccttatttacggccttattttggacttctttgcccttaaaaatcctcaccctaattataaacattttgttgctttaaataagagaagggaccaaaacacaaaaaactttcaattttaaaaaatgcataaacaaagtaaactaaaacaaaagctcaaaacgagagaaaaagaaatgcaaaatttcatcaccccataactttaaaattggatagaaaataaataaataattcagaattttttttctctattacctatatgcaaaatttgttgtggatttatgtaaaaaatttatttttacataattaaaacaaagagatagtacaccaaagtgagagaaattacaaagaaaaaaagcaactacgagatagtatgtgctaggcttttctctgcacagtggagttgacccatagagcacacctctgaaccaaaaaaaaccttataaatatgtcgtctcttggggttaattttcattttgttgtatccccattgtttttacaaaagttcgctaaaaacctgaatccgcatagtttttcgagaca

SEQ ID NO: 520 - DNA, 1671 bp, Heterodera glycines
  misc_feature (62)..(62): n is a, c, g, or t
  misc_feature (1585)..(1585): n is a, c, g, or t
  misc_feature (1598)..(1598): n is a, c, g, or t
  misc_feature (1600)..(1600): n is a, c, g, or t
atcgcatcattgccttgcctttcttcgcatcattggcataaaagtggttttgagcaatttgnagtctgggagctatgattaatatttaccgaacagttaattatttttacgttttcatttttcttaaaatttgctcaataattcggtattttttcgtaaatatttatttaaatatttccaattaaatttggttatattgaaaacacagaaaaagcatttatttgggagagtaaatgcgacttaatctacagaataacaaagtaacagaaattattttatcagcatggaacataaacaaattgatacaactatgataaaataaaaattacttaaaatgttcttctatatataattatggtctaagttgtaaaaaagaaatatgaaatttcaaatttttatatagaatcatcaaaatatcaaaaaaataattaaacgaagctaaagtcccgaaatattatatattaaaaaactatataaattactaataccccaatgagtgtcaaagtatatgcttaaaaatcaacaaaaatggccataaactataaaaagccatttatattaattaaaaatcttaaactgatcttcaaaataattttccttcaagtatcaatattgttttttttgttatatcccaaaatttatttaaattcaaccaaactgagctcacaaataagtcagtcaaaatatgttttattttttattcgtcaaagaattttattaattttcattgatgattagtttttttaatcaattaaaagtagagttgagcgggaccgggactggtactgaaaaaacgggtacaactgagtacccagtcccggttttgaccaattttaccgggaccgggaaattcccgggttttttcccggtcaaaaagtcccgggttttcaacccgaaaattcccggtcccggttttggtcaaaattcccgatcccgctcaactctaattaaaaggaagcagtaaaatcacaaaatatgcaaaaaacaggcaaataaatttttatggacgctttttaggtggaaaagtatttttattatattttaataaaattcagaattctttttcatacctttctttaagcacgagaaattgcatagaaagtaaaagttcagaaatattaaaagaaatagaaaattgaatttaaataaattttgggatataacaaaaaaaacaatattgatacttgaaggaaaattattttgaagatcagtttaagattcttaattaatataaatggctttttatagtttatggccatttttgttgatttttaagcatatactttggcactcattggggtattagtaatttatatagttttttaatatataatatttcgggactttagcttcgtttaattatttttttgatattttgatgattctatataaaaatttgaaatttcatatttcttttttacaacttagaccataattatatatagaagaacattttaagtaatttttattttatcatagttgtatcaattttgtttatgttccatgctgataaaataatttctgttactttgttattctgtagattaagtcgcatttactctcccaaataatggctttttctgtngtttcatataccnanatttatttgggaatattttaataatatttacgaaaaatacccgattattgagcaattttaagaaaatgaaa

SEQ ID NO: 521 - DNA, 9085 bp, Heterodera glycines
ggcaaggcaaatgatgcgatgggaccgcgtcgttttgtgtcgattggttaagaatgaagcgagagagagagacagagagaccaacgtgcgaagatagagtgagagagaaaaagagaaagtgagagagtaagagagagagagagacacccagagagacaactgagcgaagagaaagggagagggagatgctgcgggtcggggtcacttcggagcggaccatttcggcgccgcaaattttgaaatgctataacttttttatttatcagttagctttagccaatctagcatcatttgaaagctctatgtgtgttctatatttacatgtaaaaatagaaatgaattattcaaaaataaaaaagttatgccacgtggcgccgaaaaagtcaatttttgaggtttttttttggccataacttttttgtaaactgacgaaattttttgaaattttacaggctaatagagaatctgaagagctatcgaatgataacaaaaatttttaatttggttgatcaggaaaaaagttgttagcaacggcgccgaaaaggccggcgccgaagtgggcggttcccgatgctgcttgaatattgcataaaaatcggacccttgctagcaatttttagagcccccccccttttgggggcgggtggttatagggctacgaatcatataaagaattaaaatttcagttttgttgaaaatttcatttgatggtttttataacggcatatataaaatcagagccaaaaaccaagcaacttttcaatccgaaatgaaattcactcattatctccccgaatttgttcacaaattcgacaaattgataatgaaaagtggctaattttcgatcactccatcaaatcgcataaaaggcatctttttcataagcgcggctcaattctgcatttgtacggaatgggatggacagaaaaggccttttccttctccgaagcggcggaatcagagggtcaacgggcaaaaaccttaaaaatttaatgatcaaaatgtgattgtttgtaaaaaataaacacaactttttgaaaacccagcgaaatttataaaatttttgtgcaactagagaaagccaaaagctattgactagaatatcaagatcatttaatttggttgtattaagcaattataacgtttttttctcgaaaaatctgtaaaatttgcagttttacgaaacgacacagcacgggtgaaaagtgatcaaagattgatattcgagtcaaatggttgagctcgagaccgagaattgttctcggcttggtccaaatcttgttagtatagagaagtaaagcttagagaaggaaaagcttcccattttgctcaatcatacaaagaacttggaatcgaattgagaattgcttcatagaccctaaatgtaactaatcattttttggattagtagaatatctgacttcttaaccccaaagatgtcggaattccattcgtaattacggattacagtaattacggcctttttggagttccagattacgggttaaggattttggattattccgcaattttgatccgtaaatggtttttttagattatttttcgttaattaataattttttcatatttgttgccccctgaattaattcttttatttgttataaaaattcagttttattaaatgcactaatgaatacttacgtctcgtatcattaatttttttggatgcgtttggtgctttttttatattttgtacattaattattgaataattaaaggcagcaagcacgatagagatcacaaaaataagtcctccgctttatagatgaagcgcgtgctatggaaattcttttttgaaaaaaatggtatattttataaatttaatcattattgttttttatttattttcatttatattttacttctttattttttccttaaggttatttattttatgatatatttactttaatgataatttacaaatttgagaaaaaaaggaaattcccataaattttacatttttaaaatatgagaaaattttacataaaaaatacttacaaacatagaatttccagagaaaactttagttttaattttcagctgtttttttggacaattttaaaaaaatcttagtcaattattattaaattttgaataatattttcatacaaaaaaatattttcgacaaaccggaaaatggaatgtcacgcattattgtcgctgtccaccctcgccacagtgccatgtacccatcagatttgactgtccgaacaattgcacctcgcaattctaaactcaattaaaattgcaaaaaaaaaattttttttttgattactctaaaattttttttgttacgcccctctcacaagaaaaaaaaactgcaaatttcaaaagcggggccatgaacgctgaaattagtgcataggtatataatgaaaaaaaagaaaatttcgctgaggtttcggtaaaaattccgtacaaatttttgactgccgaaaagcagcaaaaaaaaaattttttttttctaatttacactcaccggcaccgctgaaagtgctgttgaaaacacagtggcggggatggcacggagccttaaaagggcacttttttttaattcaatcattaatcaaaacaagtgtaagtgcacactttagttcccaccacacgcaaagaaaatttaaaaaaatataccaaaacttaaaaattttcaaaaaaaaaacctcttaaaattgtaaaaaaaaaaaattttgatttgggatttttttatgaacaattctgtaagttgtagtaaaaacaaaatttaaaacattatttcgccaaaatttgcaatttttttaataagagttgccctgtttcgttcttattgtttgccgaagatttttgagttaaaatgagttttaatttgctgaatttttacattgtgggcgacaatcctgaccagagcgaacgaagtccctcaattcgaacaattttcacgaaggcgtcctgaaaaaaaaaattttttttcaataagatgcaaccaactatggtttccaagacggatcaggacgagataaaattaactgattgtaaggtccaaaaaatgacagaaatttttttctgtcccagataatggggtactgaaaccaaattggttgactggtccccaatttttgggacaaattacaccaggaattggcacaaaaggccgactattaaatttgggccgcaaaaatcccaaatggtccttaaataatgaaatgtcgaatagcagtggaacccaaaaatgcctgaaaaacccaccaccgaccattggacggaataaacagagacaaattgtccaattgaacatccaatttttttttcaaaatttgctactttttagctttgttaagtaaaaattttttatataagcctaaaatggaccagcaaacaaatggtccaatggatctcaaaattttatttattttttgaaaaaaccaacctaaaatttaaccaaaaattgattaaataaagacaaaaaattgcccaattaaatgtgcgatttttttcaaattattaatttatgataaacgatctaaaaaattatcaaagtccaaaacttcttgaaaatgcaaaccgtttgagaacaggaaacattcgccctccgcgaggggcctcacttggctttgcagacgaattttcacgacgtccatcggtgtaacttaacaaaaaaaacaatttttatttgcagtgggtgcagaaatttccggttctagtcggttttacgcgttccatggcatttttttgtgtccatggcggggatggcattccgaggccacgaggccacaaattttcggaaatcggaattccgtgccatccctaactaagaggaaacctatttttttgtcgtgtatttagtaaattttcaactaaaaatttcgttgcttttttttatttcggcgtttttgcgcccgaacggaaaaatttatgctcggcggcactcagtcccaatttccgagtaaaatttgttctgtttttttttgttggcattgactgacttggcacagcgaaaaacgggaggctgtaaaaagagggcattcacatgtatttttaagtgaaattgggccaaattttggaggcggtaatccgacgaaaaaaaacaaaaaaatttttgcgggaaacccattttctggaaaaaaatttttggttttacaaaatttgtggcataaatattgggaaaaacggcaaaattttcatttcgtttgttttttaaaatgaattttctgccattgatccccttcaaatttagcccccgagaaaaaattttttttccaaaaaacctgtcgctgtgctgttcgacgctgccgtggtcgtagttgctgaactgatcgaacttgtcgatgatgtccaccgttgcaatcgttctagctgcacttgacgtcgcatttcgtgcccatgcgaactttgcagacgcgttttaaccacctgaaaaaaaacatgacaaaattgcaaaaggcggacattttatagcacaaatttttaatcgaaaacaatcccaaattgtataaactggtaatgatgcatttttttgatcctatattgtatcttattgtgcgaactgcagaaagaaatcttaacatcctttgtgttctgtgtaggtagcttgcgaggccgtcgcgggttatttgcgcccaacgcagaggatgtgtctctatgattaactagcgtgccaccaccaaatgcccgtccgccgcttgctgacgacagacccgttcgattgggtttgtgcgctggtaatgattcatggagttattggtgggttggtagtgcatggtaacggtgaaaggcgctaacgcgtcagtgatttgtttttggaatctgttgagcttgacaagaataagggttccccacatgtgaatgtgaattggatagacaggtctgtttagaaagtgccgcgagcaatgtgtacttcttccgttggatttggtatgccgtccagtgctgcactagtgaaagccaactggtaggctgcttgtgtggtaatgggatggtggcggatcgccttgctttggtgggtttgctgtccggcggaggagacacgttcgtggtgcgaaagaaaagtgcgtccatgcgctcgtacgtgagtaccctgactgcagcaggagaaagcgtatgtttgagtgttatggatggactcaatgttgaactagcgaggcaccaccacatgccccgtctggcgcttgcagacggtcagacccgttcgatgtggtctgacgctggtgatgatacattgttacatacggttcacagtatgtcccgtgaccctcatgctgaagttaagggagtgtcgtggtgcgtggctggtacaacacaagacataaacttttctttgcgaaggcatgttggtcttaaggcaagattttgcccgggtccacgcacctgtgattcaatgaattagatttcccaaattgtaagggagccgggcgaggtggactggcagcgaccggcgatgggagcgatcggcgcaggcaagggcgccgggcgaggtggactggcagcggccggcgaagggagcgatggctcccttgtgttgagtgctggcagcggtcggcgaaggcaagggagcccagcgaggtggactggcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggcttgtacaacacatgacacaaacttttcttcgcgaaggcatgttggtcttaaggcaagattttgcccgggtccacgcacctgtgattcaatgaattagatttcccaaatttcatgcccatccacttcaaaaagccttttaaataccgaacactacccccacgcccctcccccacccatcttatttttaccatccaccataaccatgcccctttccacgcccatcatcacccgcaaccatctcatttttaagcctattttttgcctattggctcaatttatttcctacgcgcgcgcgcgcgtgttgaaatggtactgagctcaatttattttctacgcgcgcgcgcgcgagcgtcaagggcgccgggcgaggtggactggcaacggccggcgaagggagcgatggctccctttggctgagtgctggcagcggccggctcaggcaagggagccgagcgaggtggactggcagcggccggcgaagggagcgatggctcccttgggctgagtgctggcagcggacggctcacgcaagggagccgggcggggtggactggcagcggccggcgatgggagcgatcggcgcaggcaagggagccgagcgaggtggactggcagcggccggctcaggcaagggagccgagcgaggtggactggcagcggccggcgaagggagcgatggctcccttgggctgagtgctggcagcggacggctcacgcaagggagtccatcgaggtggactggcagcggccggctcaggcaagggagccgggcgaggtggactggcagcggccggcgaagggagcgatggctccctttggctgagtgctggcagcggacggctcaggcaagggagccgggcgaattggactggcagcggccggcgatgggagcgatcggcgcaggcaagggagccgagcgaggtggactggcagcggccggcgaagggagcgatggctcccttgggctgagtgctggcagcggacggctcacgcaagggagccgggcgaggtggactggcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggcttgtacaacacatgacacaaacttttcttcgcgaaggcatgttggtcttaaggcaagattttgcccgggtccacgcacctgtgattcaatgaattagatttcccaaatttcatgcccaaccacttcaaaaagccttttaaataccgaacactacccccacgcccctcccccacccatcttatttttaccatccaccataaccatgcccctttccacgcccatcatcacccgtaaccatctcatttttaagcctattttttgcctattggctcaatttatttcctacgcgcgcgcgcgcgtgttgaaatggtactgagctcaatttattttctacgcgcgcgcgcgcgagcgtcaagggcgccgggcgaggtggactggcagcggccggcgaagggagcgatggctccctttggctgagtgctggcagcggccggctcaggcaagggagccgagcgaggtggactggcagcggccggcgaagggagcgatggctcccttgggctgagtgctggcagcggacggctcacgcaagggagccgggcgaggtggactggcagcggccggcgatgggagcgatcggcgcaggcaagggagccgagcgaggtggactggcagcggccggctcaggtaagggagccgggcgaggtggactggcagcggccggcgaagggagcgatggctcccttgtgttgagtgctggcagcggtcggcgaaggcaagggagtccatcgaggtggactggcagcggccggcgaaggcaagggagccgagcgaggtggactggcagcggccggcgaagggagcgatggctcccttgggctgagtgctggcagcggacggctcacgcaagggagccgggcgaggtggactggcagcggccggcgaaggcaagggagccgagcgaggtggactggcagcggccggctcaggcaagggagctcctgcctgcacacagtatgtcccgtgaccctcatgctgaagttaagggagtgtcgtggtgcgtggcttgtacaacacatgacacaaacttttcttcgcgaaggcatgttggtcttaaggcaagattttgcccgggtccacgcacctgtgattcaatgaattagatttcccaaatttcatgcccaaccacttcaaaaagccttttaaataccgacgcgtgttgaaatggtactgagctcaatttattttctacgcgcgcgcgcgcgagcgtcaagggcgccgggcgaggtggactggcagcggccggctcaggcaagggagccgggcgaggtggactggcagcggccggcgaagggagcgatggctcccttgggctgagtgctggcagcggacggctcaggcaagggagccgggcgaattggactggcagcggccggcgatgggagcgatcggtgcaggcaagggagccgagcgaggtggactggcagcggccggcgatggcagcggtcggcgcaggcaagggagccgagcgaggtggactggcggctcccttgggctgagtgccgaggaacgctgtgaatgaactgttttggtgctgcagattgaatggcagagaacggctttcgtgcgagttgtctgtcgtttgacgtgatgcaggctactgtggtgcagcattgtcgtggcctcaattttcggatgttgatgcgcgtttgagcgtgtaagtcgcaagtgaactcagagctaggaagctgatgttccgtcctgagcacgacgttaaactgcttccagggaaacctgggttttttcaaagctgaaacttgtctgtctgtgttttccaaatctgtcaatattttgaaagatgcaaattcgtgtttgtcatgaattttcttgatgattgcacgcgaatttcctactgctgatttttttgtgaatatgatggttttcaaaaaaacaatttttcattttttagctatttaaatgttctcctttattattgttttcttttgcctcctttctgcttcccgcgtcagctccatcgacccggcgggcgtgtcgctgccttcaacttccgcggaggtggccgcggatgttgatgcgcttttgggcgagatggtcgaagcggtcgcagcggaggttgctgaaccgtccggctcggaaacgttgaatgcggtagattcagtcgatttctggagaattgttattttttcgtattaggatgacgaagtagtggtcagcggcctatgggcgagtcaagcaccgggcggcccgtgctcaacaccggcacgcgacga

SEQ ID NO: 522 - DNA, 7614 bp, Heterodera glycines
  misc_feature (14)..(14): n is a, c, g, or t
ttttatgattaacnagttttgcaattaggattaaatagaactgccatcaacatcggcaccaccaccaccggttctgtctgcggtcgcccgcagacaggtgtacgacgtagaggcgggttttgctcggtacgaggatgactcgttcgacctcgacatcggtaaattacttgatcaaaaaatcataaagtgaaaatttaaacccatagaactcgccgaagcgcaagaccaccctgctgctgctgctgctgccgaagcggaagcagttgtcgactctgccgaccctgctcacgatgcgacaacgtgatgcagcagctgacttttccaccacccaatgatcctggacgtttccgtcctggtgagggttatatggcaccgtggtttgtctgttttcctccgtccaggtcctcgatcctggttgccgggcaactcgtttgaggctaagagacggtcaagcgaaaaaaacagacacaaactgtaactttacgtgcgacgttttttccaagctgtaactttacgtgcgaggtccgtcctgagcacgacgttaaactgctcccagggcaacctggatatttccaagctgcaactctgtcgtccgtatttccaaactgtaactttacgtgcgaggtccgtcctgagcacgacgttaaactgctcccagggcaacctggatattttccaagctgcaactctgtcgtccgtatttccaagctgtaactttacgtgcgaggtctgtcctgagcacgacgttaaactgctcccagggcaacctgggttttttcaaagctgcaactctgtcgtccgtattttccaaactgcttacgcgcgaatttacgcattatttcaacaatcaattggtttcccatttcctttattccaagcagttttttgcctgctccatagcgcgcgcccttattatttcatgcatttattttgtcgtttaaccatttcattatttttcacaatataatatattaataatttttttcccttttagccaggtattttgcgtgtttatttgcattactaattttcccattttggacagctttcatcttacgttctttatattgttctcagcttcatttattggtaagctgtgtgtctacacgcgttttcccaactaataacatccccatttttcagacttgttcttcttattatttgttttcttctatttttcatttatttttcattgtccttcccgatttgtcccgtctgaccccaatgccttcgggctccctctctcccctttccttccccatccttccccagccccgccccctatcccgactttcgccacgacccgtatcccaaacagctctctttagagctaaccccgctcctctctctctctctctctcgccttcttcgtcttgccgtttgacggttggcaagccatcgaagaaaggtcagcagcatttcttgtgtaataataatctcaaatatttacctttttacagccaaatttgtcccggcccctgccacggcaaccggctttgtcgggcccgcacggcgccttgcccgcccacgttcgccaactccaactggcgttcgtgtcgctgcgtctccggtccgctcgtaccggccgaaggacatcctcgccccgccgaatctccccaaggacatcgacttggggattttcaaaaagccgattgccgtatgtttgtagtcaataattaaacaacattttcttaaattattctcaaatttagggccgggactggagcgaggactgtgccacttgtgcggcattcatgggcgccatgtcagaacacatcgacacgtgcgctctggcccgccttcgtcacctgattaaggagatgaagaagtttgccgctggtgccaaagacaacttggcccactcgcgtggcgtcggcatcgccctccaggtgccaaagccgtggccggtggcagaggaggatggttggacgggcgtcaccatcccgggctgtgaggaaaaatcgcccgttgctgagccggctatcgctgaactgtgagtgcaaaatacatccttttcaccaaaattctttccttaacccacatttttaggcgtaagccgaagaagcagaagcttccaaaggtggtgcctgacaagcgccagccttggctctgcaacaatgatggccggccgattccgggactggctccggtagattcgttcatttgtttttctcaaaatattgtttccttttttaggttgcgaaacagttgccggtggctccgcttcgcaagttgccaactgacatgccgcgccccaaaaacgtgtaccacacgatcgttaagggcaaggtgaactgagtgcgaattgcaatcctttatttttttgcttattattttcaggctgtcgcgtcaatcaagcttttggagctgtcgaagatcgacaagccacgcgtgccgatcggctacgcgccaattgctcgagccgagaagccagcgcttcaaaaccgtcctgttttgaacgctgtgccgaaaccggtgctccgcgaaccgagcgaggaaatgttcgtcgttgtgggacaggtgtgttctgtgttttttaaatcaattatcgttactgaatttttttcactttaaggccatcccaaaatcggcggtggagaaggccaggaaaatgcccgacgtggtgaagaaagtgccgccaaccgtccgccacagaagaactgtgtggaactcctcttcggtcagcttcgtcgtcccgtgcttttatgtgcttcaacagtacatcaaagcaacgacttccgcggttgcgtcttctgctcccgctttgaagtcgtcatcgatgagctacgctcaagctgtaatcattattctttattttttcaaatagctttttctgttttagttaacgaagccgcttccgagcaagccacgtgctgtggtcgccagtgcacccggcattccgaataagctgcgttttgaagctccacgcctcagtgaggagccgaattggcgcttattcgtcgggacgggctcgcgtcgtaacaacatcacgacaacgcccaacgcaccaaagctgccgattctgcagaagacctatgcagaagcagctcgcacgcccaaagaagctacgaaaaagcctcttagtgcgacggctcgctcctttacccttggtgatttcttcatcagcaagggtgtaaggggcgcatcgaaagctgaccgatgtgcgctgacaactgccgaagctgctcctaaacgacagcgaggcggcggccgtgaatcgagccgaagcgctactccaacggggaacgaagagcagcacgcctttctcctggactgcttccaaagaagtccaacacaaaaggaggaagcgttcaaagcactgaagaagcagttcaagaagacggtttcaccgcggacctatggccgatggtggcagaatttttgtgacgggaagcttactttgagccaacgcggaagtgagttttttatatactcgttagttatggtaaatgccctaactcaataggaacatcagaacgcagccagtccgttcgagaaagtgtgtctccagcccagtcagttcagttggaagaacaacatcaagttccgcaggaattggaagctgcaggcaacccaacttatgacagcgaactgatacgcactcaaacaagtagcgcgacaaatgaagaacagcacgccttcctactggactacttccaaagaagtccagcgcaaaaacaggaagccttccaagcgctgaagcagcggttcaaaaatgttgtttcgccacaaacctacggtcgatggtggagcaactttttgaaaggtcaactcacgttgagacagcgcggaagtgagtttattatttgtccactttcaagattaatttctgtctgcctcaataggaccatccgaacgctcttcatcagctcgtgaaagcgtgtcgccagcccagtcagttcagttggaagaacaccatccggccccgcaggaactggaagctgctggtgatccaactggggacagcgagcttattagtgctgctgtacgacagaaggaactggatgagggcttcggtaaaattgtaaccaaaattctcttacctttattcccacattatagacactccatcatcgaaacaatctcgaagctcacgagggcaatttggcaagtcaaggaaatgcgttttctgcacaatccctttgaacgatgctgatggctatgcaatgttaaattgcggacattcatgccactttgaccagccctttgccgaatggtatttcaattattacatttattaaacaaaacgattcataggtataccgatgtgccgaataagaaatgcaaagttgcacggtgcaaaaaggcaacagttcttaaatgcaatgaatgttgtcaacgcattggtatgggcatttacgaaaccggctgttattgcgcggaaacctccgcttcagtttatcacgcggatgaattggaagcgaggtgctctttcataatgcaaatttgttattttagttttattataggctcaaagcaagcggtggcaaatgcccagattgcggcacgcaacaccccggcttttgcatgttgtgtcagcggctgttcaagctgcaggcaaatgggcttcgtcagagcaaggtgttcctgccttgctgtgactcttacactcacttcgaatgctggtagtgtttaatcattttggatttttaccccatttccttttggcaaattaggtattcgcccgcaccgaagcagagctgcccagcaaagtgcacaaagccgtggcaagtcgttcaggacatgcattaccagtaagcgactcatacattttctttcactagtatttgcatttgtattttagccaaatttgtggtgtccaaaatgctgctccgttgcctgcagtaccgaagccaagaggcatcgttggtggacgcccgctgaagaatgccaaggctgcgtcgccaacagagtccattccatcgactgttgacacgacgacggccgcggcttcggatgtttccgccaatgaatcccaagcgctgacggactcgcatcttatgccaccaccatcgttggctcctcgccgcagcacacggatcagccgacaagcgtccatcgcaagcaatcggcccagtgctgtggcgccaaagcccattgctccagtgacgcactgttgcggaaccattcagtctgctcactttggatatggctgcggttccaaaaaggcgaaccatctgccttcatactacaactcgcttcgggatcaagtgggtttaaagtatttgaatccagtagattagttcattctatgtaggcacaacacaattgccctcactgcaatgcgttgctgttggcttccgaagcagttggaccaaccgcctattcaaagtgctgcgcaaaaggacgtgtcaacttggcggaccgctacaaagcgcttcgtgctcggccagccgaattggacaacatcctccaaaacccggcggggcagtacaaaggctggagggactcgctctttcgccacgtgctgagatacaacaacaacttggcattcgggaacatcaacatcacccgcagcgaagagcgaatcgacttgcatcgaatcgtgaagtgcaacaacatgataaactacatgttgtgggatttcaacccacccgatggcggcaaaccccatctgcacggacaacttttcacgatccctccagccgatgcgcgtactcgcctgggcgaaatctctcgggaacattcgctggacgtaagattgacttatgtttccaatttcggttttattttttattttacttcaggaacagttgatggcggccctttacggcgttcttctcgcaaaccacaagcttgctgtggtctacgagacggcagcggagacgtaccgtcagctgccggaagaagaccgaatgcagttccgaatgctattggtggacaccaacaagcggggcacagagcgaagattggatgccaaagatgcgccggcaccggacaatttgcatgttgatgaccgggccaacctcaggcacatccatcctggacggcttgagaccgaaacggatgctggaagtcgccttgtggctcaagtaagcttcggcgtttggtttcatgtcatataaacagtgttcaattttttccagatttttctggactgcggagcgaatgtgatgccaccgagcgtgtacgacgtggtgctcacgggccgtgctaccaccaagatcgtgcacatgaaatggtggaacaggaacattgatcctgccaatttcccgctgatcttttccttcggccaatttggctacggtagagtgtttttgtgacggtgaagcattggtgcaattttcctttctagaatatgggtccaaattggtgttgcggccgcacgagcgcttcgactccacctacaagcagatcaaggacaaaaacaacaatgtcctgcttgacgccaccgaagaccttggcgaggaggaggagttcctcggctctgaactcgagcagcagttccatcgccgcgacaacatctcgcgatcgcaatggttccgctacatggctcacatcagaggcccgcacgccaactggcgagacggacattggctgtgggactggcgcactctggcccagctctacaccatcacgttcaacaaccggatggaggcccaaaaagtccagttcatgaagcagctgcagggaagacgacgtcttgtccttcccagctccatcatcaactggctaagtgctctgcgggacaacaaaggtagggcaaacatttcgagtttaataatcaaatagctgctatttagggtacaagggcgacatcggccgagtctacatgaccgacgagcactttcgcgggtcccggcagtactaccagcgcgagtacgccaactgcatgaccatctgcagagaaattgggaagccggatctgttggtcacgctgacgatggaccccgactgccctgagttggacgacatgctgccaactgatccagatgggcaccgccagcagtggtacgaccgcccggacgtgatttgtcgtctctttgtcgacaaattcaaagagctgtgccatgaccttaccgtcaaggaggtcatggggcccgtccgcggatggttctactcattggagcaccagaaacggtagactgagtcgtttggttttgaatagttaggattcctttttagtggcctcccgcatgtccatttcgcactgattttggactgggacagaatacgaagcggcggcaacatcaacacgccagcagagtacatcgagcagtacatctctgcagaaattccggacaatccatcgggccgctcacccgaagtgttgctcaggcgagagctttacaaaacactgaggctgaagcacatccacacgtgctcagctcgaagatgtttggttgacggaaagtgcctcaaacgttttccggttagtcaatattttacttcacttttatggttatcaagcatatcaatttagaagccgttctcgtacgacaatgtctacaacgaacacgcttacccgcggtaccggcgacgtcctcctgcccctgacgccagggcagcagctcgacaccctgagcaatatggacgcgactttcagtacacggacaaaagcggcaagacgattcgggggggacaaccgttacgtagtcccctttcaccccttcc

SEQ ID NO: 523 - DNA, 1131 bp, Heterodera glycines
  misc_feature (1040)..(1040): n is a, c, g, or t
  misc_feature (1114)..(1115): n is a, c, g, or t
tcgtccgtgtcaatgcgatgagatcggttccgccacctctcaatgcaacgagaagggccaatgtcgctgtaagccgggggttggaggccaattctgcgaccgttgcgaacatggattctacgactttggtgccacaggatgcaagtgggtgttgagatttgatttatacacaaatgtaaatctgggggcattgatctcatcgagtgcgggggagcgattgttatatgatttaggcttttcgggacttaaaaggcagtggatgccattggcggaacgaaccaacttcgtccaactccgtctgagccaatttgaatgaatataactttagtgaaggtgctgatgtccatgcccagttgacgaacggaatgagaggaaaggaggggacatcgtattcgggggaaagggatgaacgagccaatgatccgggccctggattaatggcctccccgaattgggatccccgggtcgcgcgactgattagatgcgtatggagaaatgccaagaaggagtaaaacagatatcatttattagccgataaataagttgaaaatcccatcgcaaaaagcccatctcgctctatcgctcttgactctttagccccccccccttgactgactgccgcgagaacggggagaacgggaaaaggaagcgaaaggggcggggaaaaagacaacaaagtgatcgatgatcgcttataatcatattccgtctctgtgcctcacacgtccctccttcttttgagtttgtccacaaactctcagttctgtcgtgctggtggattggtgcaacgagtggagacatgacctggctggttacaacgccaacatcgaatttcggcacgagttcgtgaaaattcgcgctgaacatgacgagaaggaagtggcggattggagatgtccctggattggctgataggagaattttggaaattgagattatttggtcgatttaaatcgttcaatggcctcccatttcgagacagaacagccgcggttgaagacgaatgaccgggtgccaaccaatcagcatgaaaacgatangtctggactgactcaccagatcatcgactaaaagtcacggacgtagctcgaactcgggcttttgatggacttanncacggacggggatgtt

SEQ ID NO: 524 - DNA, 4733 bp, Heterodera glycines
atcatttattagccgataaaaacagttgaaatccaatcgcaaaaagcccatctcgctccatcgctctcgactgcctagccccactcaactgactttttcgagaacggggaacgggaaaaaggaagcgaaaggggcgggaaaaagataacacaaagtgatcgatgatcgcttataatcatgttccgtctctgtgcctcacacgtccctccttcttttgagtttgtccacaaactctcagttctgccgtgctggtggattggtgcaacgagtggagacatggcccggctggttacaacgccaacatcgaatttccgcacgagttcgtgaaaattcgcgctgaacatgacgagaaggaagtggcggattggagatgtccctggattggttgataggagaattttggaaattgagattatttggtcgatttaaattgttcaatggcctcccatttcgagacagaacagccgcggttgaagacgaacgaccgggtgccaaccaatcagcatgaaaacgatagttttggactgattcaccagaatcatcgactaaaagtccacggacgtagctcgaactcgggcttttgatggacttaacaacagacggggaagttaccaccgtaaactcaatggccttattcagaaatctggaccaaattgggctgcctcccaattcaagaaagtcgcctattacaattagtccatgttttccacgggaaagggcaacattcaccctttgggcatcaccccaaaattcactcttacgatcctttgaaaaattggcccgttgccaattgctgaactgttgctgcttggtgactgtcgtcgtgacgatggtgatatcggcctcgtgcccctgcattgcgtctgcagtggcagagacaatggaccgactaaacccttgctctttcagctcagtgccaatctgcgcagcttgcccagcataaaaggaaattatgcggatgctgccggggaatccgtccaacaaggccaagaggtccagtactgttcgagtttgtccgctgtttgttgccgaaaagctcgtcagttccggttccattagtgattcctggtggatcaataaaagaggggattccgccaccggcattttccaaaaatcgattagcatcctgaaagaacccggcccaggctgaaggcgttccccgtggggtttgtacgccatgtgctcaacacaggccacaatctgccaatgagaacggtaatttgtcagcagtgttgtcctatccaccgctttagccttgtccaaatttatcagaactgtgtcaaacccaaatcctaccctaaccggctcgggaacgctttgcatgttgaccgccaattggtaccggtccccggttaccaaaaccttttttatctcacagagagccgacaaagttgagcagacttgcacgaatggtccctgaccagcctcgtccaacaccacgatgttccgttcacaaatcagccggccaatctgttcagcaaatcccaaagtgcagcacagaactcgcctccggtccaagttcagcacgtattccgcgatcagcgcctccttggcaatccgcgggcgtttcctcacatcccgcaaatatctgtgtacttcccttttctccttctgttcgagttttttccagaaatcttccgaagtgaccactgattccaacaaattccctgcaattttgtctaaataatccctgtattttcctttgccatttcccgaaaataacgccaaaggaacttcatcacatccttcggtttgtaaggccccgaccaattcttcgcacattttgacaaccgctacgttaagcggtgctaagcatagaattttgttttttgggttgctcattaaggcagcaacaatcgcagccaatgtatatgtcttccctgagccaggcggcgcttgctgtgccacgactctcggaacattgtcgagcattagttcggccgtgcgtatttggccaccttccagcttccgcaaggcggggtgcctctcaattcgtgccaaaacttccgaagaggtgtcttcattttcaacattgttctgtgccagaaggattttccaaatgcggctggtcccatcagacccgctcgacatgcagctgaacatgtggccataaaaacgctcaactctcaactccaaagcctgaaaggattcactaggagttattgacgcctcatggccttccgctaagcgctcaaagtcgccctcggcatcgtatttccgagccaattgaaacatgagaagaacctttgcctgtagtacaaacatttcttgtacaacacatttgtggacgtccaaaatgcgtccaacagcacaaggctttttggccccttttagtttggctgtaaccgctgcatcgatttcccaaattttggtcaaattcacaaacttacgtttttcctgtacaaaatgttcaaaagtcaccacaatattgtcttttccgctttccaagacgaacaacgccgtatgaatggtgaactcctccatctctgcttttgcttttagcagtgctccggacacagctgccgcaattccatgctcacatagcttcaaatcagtgcttgtcgaaaaggggaactcataaccattaacaaaaccgctaatccccgtgccaatgcatggttggtgaacaaccaattccctttcagaaactccctcaaaatcggctggtgtgatgtaaatgcccttagggccaatggcaatgtcggaagggcgatggatgcgcacgaacgtgacatttataagcactccaggcttaattttggccaagtcaattgtgctgtccaactggtgttgatacagtcgctggagaacttgactctcggggaaggccacgtccaccgctcttggcacatccttattttctctcaccatgctcattacaatccctatgcacttttccaaggaattttgaagaacggatgagactgtcatggcctcggcttcggcattgatcttaaaggcattagaaagccaatcgggaaagcgctcgattggggcataacttgtgacaaacacaatgtcaccaagtctgagctgtacacccaactcgaacgactcaggaattccgataatatccggacccttcatttttccgccaaaccgaatggcaatggccattttgtccgttatttgacaaataaccattttccgtccacttcctccgtcatccccctcattttccatatctttaccgttttcgtcttcactcagatttcggcgtctcttgcctaaggggtttttctccttaaacacttcaattccatcttggtccacttccaacacataattaactccctggctccgttcaatctcgacaacatccatgacagacggaccgaggtccctatttgcttcctcttcacccttctctccctcattttccatctctttcatgatcatttgcccaaatgatcctttcattttctgcgtctcttcaatcacttcaattgctctttcaatcaatctctcctcctctccctgtacggatagaacgctgatcattgctcccatggtttcaagagccccgctactcaccgcaatctcttcaaaagtgctctcattcgtgccgagtgcacgggtctcattcatgacagatggcccgaaggccgaattatccaacatactcttaatctgtggaccaatttcagatactcgatcagttcggccaacctcctctgccatcccgggatcatcagcgaagatccgatcaacatcttccggcgaaagcgttgtcagaactgcgttgtccaagtttggctcaattgttgacacaattgtattggctaccacggcgccagtaatgaccgatccttccggtgatgagatgtcttcatagaccgggtttggtagagcagagatgtccaacaatgctggtggacttgacaatgctgccgacgcagacgaagactttttggagaaacgttttgacttttggtttttgggcattagctaagattgaacccaattaaatcagacggtcatttgcttatactcaattattggataaggaaaaacattggaaggtacaacggggaaataaaaagagaaaaggagaaaaaaaactgaaattgaaaagctgtgctaagcataaatgaagtgtgagaaggatttgatcgagaaatgaatgatttgcctagcgaaaaaaaggtttaaatattaaaagagattttccttcgcggatgagaatgaatgtgaagatcgagatcagccttttatggacacattagctcctcccataaggcaaaggagccgatgaagaacacgtgaatggtcactggctaatggaacaacacaggtaatgcgaaatttcacggtttgggatgaaataggtagagagaaatgaaaaaaaaaactattacgattaatgaagaaaaactgtaatataaaatcaatgcatactgtagtccattactattactttttttgaatttcaatgcttactgtacataaaggaatatgggaaatagtaattaacatttaatgaaatgttattttatgaaaatgtctttttcttggaaattacgcaaaccaaaagtgtcttatttcaactgtacataaaacgagttggagattaaataaaaaatatttggcaagtagtttgatagctcaggctctgctctttttaatgaatctatatttgtccggattggtttcgaattcagggactagttaggttttttgtgaggtactcattagggtaaaagtgaatgaaatgacaagggatcgtgtaatac

SEQ ID NO: 525 - DNA, 5568 bp, Heterodera glycines
aaaaaaatgggaatattaacggtggaataatgttgaaaatggttttaatatttcgaaatattgggtcatttaccgtatcctaggtaaaatggtagtacgatagttaaaagatttttgaagtttatttatcgataattgacttaattataagtgcctaatcagacattcgccagcttcttgatatgtcataagaaagtgaatttcgtttttttttttgtattcgtcctatcggaacgcgcggaacaaatcgattttcaattcatcgctaattcatcttttagcgcttcttgtttttttttttttttattaaaagaatatttgattttaaccctaaaatgtcacaaaatcgttttttgtttttttttaatcctttttcgtctatcattctctctctatctctttttgtttggttttttgtttttgttttccatccttgacaattcccgcaaacgggcaactcgcgttccttttgttatgttcactttttacggccatttatagcttataatgccccgaaaaaatctgcgttcacggcaaatgagcgctcgccggcgggctcaagaatgctctaaatttgagcagcaaaagaagcagctttttgatcattttcatcggtctggcccaattccggcccatgacaatgatgtcgaattagccatttatgatttaattccgctttcattggccgcatttccggtgacaatcagagccaaatttccgccgcaagcacaattcgacgtgttcacctgtaaacttaatgattgggcgtattaccgtccacctcagggtcacagagacccaggccataggtccgcgccataaaatcagcttttatgagtgccttcagctttatttttttaagcttttactttaatgcctccggcattcgtgcacataccaagccgtgggcaaagcttgttgcgtgtgtttgtcacgaggtcattcactgcttatcccggcaattctgtggcgatgagacttctgtgtgcgcatcaatggtcggcaacaagaaatgttcggacagctttttcaagcttaaaaccattttcctcgagacttacccattcatgactgatttgctcgatatttgtgagtaaatgtgtgttgtttttttttttttttgcttactctgattcatttgttggtgataggcctattcagaatgattgtgcaaagatgattttgatttatctaaaatattggctgataggactcattatatacagaaaaatcattcagtgaaccgttttggttttgttatagccaatcgatttctcagagaatatcttttgtcaccactaatatctgcaactgtttggttggtcacattttgtctgtttgtaacggtcgattcactgctttcttggttcgaattatcagcttctgacggttcattgctctgcacttcttcctcatcatcaactgctaatttttccggcactatttgctcgtcattaggagtttttggcgatgtgcatggggggcccattagctcaaagcacttttttatttgattgacgtgtactttttttggtggctggttcggtgaaatgcagcttattatggtagcatggacaccattcagctcaactaccctgaaaattcccttccaaggaaggtgaaattttttggaagtgccaacttttccggcatagtttctaagtaaaaccctatcgccaacgctgattttgggctgtcgcattgttttgtcatattgtgttttcatcttattctgtgcttcttcaattgcctccgccgcacatttccatgcttttcttaaagtcgtaactaatttgtgagtaaattcgccatcatctttgaaatcaacttgactgtgaacgcgaacgtccaaaatttgatcaacacagaaaatggggtcccgaccaaacattaaaaagaaaggggtctctttggtggatgaatggcacgacgtattataacagaatgaggcaaattcaatgtactcgtcaaaatctgggttttccttggtgatatatttagacaaaatgttgtgatatgtacgaaaagtcctttcagtaatagcattcccttgggaccaatacggggtcgcatatgtcttatttatgtataacattgtacaaaattctctaaaaaattcggaagtaaatgccgttgcgttatcactaatcagttcagtacaacccccatattttaagtaacagttctttagaaaggcatcagctatggttcggcctttagcatcaggtagtgggaccgaaattacgtatttagtaaaccagcaaattatatttaacaaatatttatttcccttaacagttgtggggaatggtccggccaaatctaatccaactttggcaaagagagtattaacaggaaccacttgcatttcagcacgataagctggagtggggttatgtcggagttggcatgttatgcattgttgcacccagagaacaatatctgaatgcatcctcggccaaaaatactttttacacttttttaatgtttttttaatactcatgtgccctcctcctaatggggaactgtggaaggattcaaaaataagtgaccgtaatgacacagggacaaaaattcgcgggacattacttccaattttaaagtataaaactccggaatttagcaataaattacatgccaaaattgaaagttggtccttttcgctttccgagaaatcagccggaaatgatccatttttcagaaaatcaatgtatgccaaaatttcagggtcattcctctgttcttcggccaaatctatctgatagctattcccatcctcatgcctcagggttatcgtattaacaaacggtgcaaaaactatatgagatcttgactgaaccgaaaaacatattggaaattggactatgtcttccatctctggcaaaccatcaacctccttaattggcacatcctcagaagcacgtgacaaggcatctgccagtgtgttttgccgacctgccacatggacaattttaatctgataattttggagttcaacgagccaccgagctaaatggggatgggtttccgcttttttgagtaaataggccaaaggcttgtgatcagtatgcagttcaatgtcactcataaaaataaatggtctaaattctctcagtgcgtaaataattgcacacatttcaatttgtaccgtcggccatcgcctttcagatgccgataatgttcggctacagtaagagatagccgagaaagtgcctatttcttcatttttttgcattaatacaccgccaagtccagaccctgaggcgtccgtaaagatgtgaaaaggcttggaataatttggaaaaattaggtttggagactcggaaatgaatttcttaagcatttcaaaagctttttgttgctcctccttccattcaaacttgacagattgcctcgaaaggctcaaaaggggttcagctatcgtagcaaaattcttgatatgtctacggtaaaaacctgcttttcccaggaagcgtttaacttctttgacatttccaggaattggcatgtcttttatgagctctattctgctcatggttggtctataaccgccagctgaaagagtaaagcccaaaaattgcatttcttttgcgataaaattacacttttttggactaagttttagattgtaaagtctaaaacgctcaaaaacttttcttagcgaactcaggtgatcttttagagtgccatcctttgtgaatactaacacgtcatcaacataagatagagcacagtcttctaatcccaataaaacggtagtcattgccctggagaaagctgctgtggcattttttaaaccaaatggcatgtataacatttggtagacacaatcttccgtaatgacaccacatttccatgacgattcatctgacaattttatttggaaatagccactggagaggtccaatgaagaataaaaattgcaattccctattttttccatgattgcatcaaggcgtgggaggggatatctatcgggaaccatgacatcattcagtttcctaaagtctaagcatggtctgattccaccatcctttttctgtaccaccacaaatggtgtgacccatggtgtatccgactcaatcatgacaccagctgctaacagcttcgaaatgtgtttcttgagctcatcactgtatttgtaaggcattcgtcttggtgctgaagagattggcgtacctgttgttgtgacaaaatggtgttctcctcctgtaaaagatcctaaatcatactgacttttgctaaaaatatccgagaactcttcaactagcttttttaaagaatctaagtctttcccttcggcaacggatttagaaaaatcaatattaaatgaagggtcaacttcggatttttcatttttcaaggggactatactcgcgtcaatccggagcttcgctaagaatgccgtcattgtcctctaactcattggcatatgccaagtgcatgtttttaacaaaatatatcggctcatttgtcggatttaccaaagcaaccttgacagtgtcccctaagggcgcgcttaccgatgatatcaaaccaatgttccgatttgagacattctgatcagctcgttcaattaataagttcttttgaatgggaaataaagattcaattttcccttcaactatttgctgagaattcgcgggaattgtaatgttttgtaatgctgctattcttaagccctgagctaacttattacttggtcccatgggtatgcaattttctccaacacaaaacttcatttttgtgaaatcaaaagaaatttttgggagtctactgagtgagtccgtacctacaagcaattggtattcattggcggtatgaaattcgttgtcattcaccaaataaactataattgtcaccttgaaaccggccagcattaattcaacatttatcttctctttaaaatgaatcatatgccccgaggcactgactgcatacatacttgtcttaaaaatttcggcatttaaccttattgccaagtttctgggtgcaattgtcacggatgcgcctgtatcgatcaaacaattgagcaatgaagaattgactcgtgcaggcacaactgctgaattgttcgttcttaaaacacaaaccgtgcagagacagggtacactccctgttctgcgtacttggagatcttttatgggagtgtatctgatttctggcaaccgtaaattctcagaaatgccattaagattgttaagagaatttccgtgccgtcccctgctgtattcccgcttaaacatgaaataaacccggaccagcagttcaaaaattaaaattccaactaaaaaggtgatgactcctctccaagcaggggtccaatctcctattatatgtttgaccaaattatcttttaatgcatgccattgttcagatggggttgtcaaaatttcgccatctttctcatgaattttataggagacttcgttcaaattcatggtatcagaaaccaaaaaatgactatagaaatcagaggtattggttaaaaataagtggtgaaaaacatgtatgggaattgaaggaatggataatgactttaattcaactttatcaattaattcaatt

SEQ ID NO: 526 - DNA, 4666 bp, Heterodera glycines
agacttaaacctctgactggtgccgtaatagagtcaggcctgagggttggacagggagaaaggacggaagagcccataaatggcccacaagttgtgtttggcacatcattggacctttcggcataggaatagccaaattaatttgacacatgtttggaataaccatcgtcagtaacatcaccataatcattgtgaatttggagaatttagaaattttgggagcaattccttcccaacttcgaattctgatgggaactaagctatcactgcttgtcccaggtacagggtttggatctgattttggttcctctgtctttttcggggtttctaccacagccagggttttgagagtacccgctccttcgttcttgacagtaacgcccgagggccgtgattcattcacactcaaattagctatggctcgaataagtgcatcagaatccaaaacagtaacatttctcagctgctcctgcgatgaattcgttctccgttggtcatcaaatcgagctccattatttctgaaattatgattgggacggctgaaacggtgcgccatttcttcttgtctggtgcggcaaaatgaagcaatatgaccagttcggccgcaatagtgacaaacgggtctgttgctccatcttctttggctctgcatctgttgatgatagcttgaccatcggttacggcttggtgtcctatttctgtaaccgccacggcctctgccgttcgaataccctcttgacgagtgtcgatttcccaatggggttgtgtttgcacgagaaaatcgatgtgggggagactgatcaggcctctgatcagtatggacttgcctttgattatttaatgccattaccgtacccctcaatgtgtcagaaattgttcccttttccgctgccaaaagtgcttctaattcttcagcctgcgccttgacctggtctaaatcctttgcagaatttagccctactaagcggattaagaaaccaatgtcagacctaattctgtccaaaaattcttcgcaaattttctccttcctctgggaatcatttaaggacgaattgactatttcaactaacggtgtcaaacgcttaatgaattctgaaatggtctcattttcgcgttgtttacattgtgccagcgtccttttggttaattcacgtctttggggtgaatccattttacgtcgaagggcagttatcgcggtgtccaactttgcagtctcattttggcttaattgtttgaagagttggcgaggtgtgccaacgagtgacattttgaggcgagcgactttttcatcctcagtccaattccttcccaaagccccaacataatcactgaatctttccgaccattgatcaaacgcgacaactgattcatcaccaaatacctctaactgtccacttacaccagtcaacgtgttcaatgcccctaactctggctcatctccgtcttcacttgaattgcttgagttgttacttgtcccgtgctgtggattccgactcgtactgcgctcgcgtggggttgtgaaagccaatgaattccttgccgtagggttgatatcggttaatgagttaagctgcgtttgcaatactgacaggtttgaattgacttggttggccatgtcatttaaggctttggtgttggcacatgcccgtcggttaatatttcgtaggcacctgttaacagcctcttcaaagtttttcaattcgacttgagcacgttccatatcaggaactctgactgaagttttcccagcccaaaaatttttatcaataaccgagatattcattccatcatccatatcttgacagaaggcccaagagccgacgcaattcaaacccgaatattcagtaatgtaaaggagcgaaagcgtgaaatatgtcaaggaatattgaaatttggttcaggtttttatgagctaaataaaatttaattgaatagtgaccgttaagttagttggcaattaaaataatttggattaggcaataagtgagctatttcgtagaaagaaatgtttggataaatgttttccgagaatgagtgctcttatcgaaaaggggagaatgaatggttatgtttattgatgatcatctccttataaattacagtacttctacaatatttaattcccgatcagtcggagcgattgtgaaaattgttgacagcggcgcagtgtctcatgactcgtattaatcacaattctcggccgatggtctcttattctcaagcggccagcagtaatgcgcttccggtgaatcggcgagagcgctgagaaagtggagagagagagaaaaaaaaaattctttcgccggggcaaatttcgccaaaaacaaaaataatttgtgtaattagggctaagacttttatacagaaagagtttaaaaatcttggccctcaaatatctgccaaacaaaactaataggtctgcgaaaatcaacaatggccttcagttgatggctcgaatggcccgcccttaaatgttcgtcattaatttggcaatatgagcgagtggcggcatttgataaaaaaaaaaataataatttgggctgcaatttggcttttcaaaaatgttttggccattcaaatatggaccggtccttgacaagactcccgaaggagcggtgcgcacctcattccattctctttttctccacgcgtatctccatctcattctccgggagggatggactgccagcggcgtgccagcaaaccatccggtgctaccagtgaaggtgctgatgtccatgcccagttgacgaacggaatgagaggaaaggaggggacatcgtattcgggggaaagggatgaacgagccaatgatccgggccctggattaatggcctccccgaattgggatccccgggtcgcgcgactgattagatgcgtatggagaaatgccaagaaggagtaaaacagatatcatttattagccgataaataagttgaaaatcccatcgcaaaaagcccatctcgctctatcgctcttgactctttagcccccccccttgactgactgccgcgagaacggggagaacgggaaaaggaagcgaaaggggcggggaaaaagacaacaaagtgatcgatgatcgcttataatcatattccgtctctgtgcctcacaattttttaattgttgatagaatttaacaatcttgatatcattcgaaagctcttcacaggttctattagcctataaataattacagagaatatcgaactgtaaaaaaagacggagataaaaaacttcgaaaattctgcctttttatggatttcaagcgacaactttttggtgagctgcttaatcacttggaatagattagatatatcttccaaatatttaaagctttcgaatgataccatatttgataaagttggtgaacaaaggaaaaagttatagctttttgaacatttctgaaacggagttgtccagacggagttgacccctaccgtgccattggggtgttgctgattgtgagtctgtctctttgaaggcaattgtccttcaaaaacaaatgcgaaatgaaactgttgttatccaaatggctcgaacaacacactgacaacgagaaggtcatccagcaaacggtgagacaaaacacaaaatgggaaaaagggggaagaaaaatcgcaaaatgcgaggaggtaaggggggggggggggaaatgtgtgcaaagcaattggggacaaaaaggtgataatgtacttatttaataactattttggttttttatttcgcaatttttcgtacataaatttcccagcctcagtgatgatgttgcaaatggaataataattttaagtaattattttttaattctaaagccgagacaattagacggaatttaaatgcgtagaattatgcagaggagtcgaaattgggcctggaatttattggcttaattttaatttgaagacgcaacaacaaaatttttcggccgatcaattggacaaattggaacgcaaatttgccataacgaaagtcgcaaatgcttctgagtgtgcacaattggccgtggaaactgggcttacggagaaacaagttgaagtagggtttaataaggaaaaatctataatttaaaataataataataattattaaattaattttaggaatggtttgacagtcggcgcctttcactgtggcaagcattcataacgaaattcgtatgtgtaaattgcagaattttggaaataaaaatatattttatagttttcaaattgaagacaaattcttttaatttaaaaacagacaaattttgtgagtcgtttcggcgccagcccaagtttttggactatcacttctcattgccaaaatcaaatgcaacaaattggtcccaacgccccccccgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaactttttggctagtcagcaatcgttgcttaacttgccagatcggacgggtgcgcaaagtccactgttccaagcaccccaccaaaagcaaccctggaagaccaaaatataaggaaaaattttttaaaaaattttttct

SEQ ID NO: 527 - DNA, 9008 bp, Heterodera glycines
aaccagccgatgaaggagtctgtcagcgctgctcttttgacccacaccgtcgatgagccttgctacatccagcccattgacgacggctcagttcgacaacgtgcatcgattgctgtggacaacgacgactctgacgacgacgaggacgatgatgatttgccgcttcgtctctgcttcttcgatgccgagacgtcccaggacacgccattgcagctgaacaaccgcaccgtccagaagcacgtgccgctgcttatcgtagccgaagtcatctgcgaacgttgtctgcaggctggcatcagcgtcaacgatggtcttggaagacgggctcctggctgcgtctgcatgacaggaatggtgaggggtcaactgtttcgccagtggtcttcgccaccctttgccaatgcaccgggagacaacagcgcttcgccagttggagcacccgccttcaatcagcgccgcttcttcttccattcgttcgacaacgacggcaacgacccagtggaccaatttttggattttttgctgcaccatggtccaaagaaggcacacaccgtgtgcatcgctcacaacggtggaaagtacgatttccatctcgtacttgaggcactacaccgccgaaatcgtccacccaagcatctgtgcaccacgggattgaagatctactcaatgcgtctgtccgggcgtcaccaacggcgagtcacattcaaagactcaatcaattacttcttttgtgccttggacgcgttggtgaagagcttcgatgtgcctgaccatctggccacattgaagccattcttcccttatctctacattcgacgacaacatctgtcgcagcgcctcatcaatcttccggctcaagagttttacgcaccggatacgatgaaggccgagaaacgggcccaatttctccgttggcacgccgaaaacaacggcaatggattccaactacgcgagcagctcatcatgtactgcgtcaacgacgtggccattttgagggagtcggtcatccgattccgccaactcattgccgacaacacgcaaggcctcgacccattcctccatgcgtcgacagcagctggccttgcgcttgccacttttcgccgctgtttcctgcccgccaatcgtctagtccactcacccgagggcggctacttgcgcgggcgacgtgcttcggcagaatcgcagcgctacatccgcttcttcgagctggagcacccggaggcgcaagtgcagtgcgccagctggtccgttggtgaagcgcacatcgaagacagtggctaccgagtggacgggctttggcgacgggatgcgcctctccgtcccctggccattgaatggctcgggtgctattatcacggtaattaattttttcgtttccaaaatatcttaaaattgaggctgtcgtgtgtgctttcccgaccggcagcaacaattggcggcggggcgaacagcggaagatttgtacgaacggacggagcggcgcctctttgagctggagcacgaccacggctgcgatttgcacgtggtgtgggcctgtcagtgggcggagcggctccgccacgatccgaacctgaagcgccgttacgatgctgtgttcgtcccttgcccgctggacccgcgcaacgacgcgttgaggggagggcgcactgaaccgttcaagctgcaccacgtgtgcagtgacgacgaggagataatgtgcatcgacattgtcagcctctacccatacgtcatggtaggtttttcttttaaacattcgcatattcatgatgaataccagaaagccaatcgcttccctgtgggcaacccacgggtcctgacgcgcgaggtgctgctgcgtccgccaacggtaccgctcccgtggaatgcaccggaaaacaacatcttccgggggctgctgctcgcccgggtgctcgctccacgcaacatccgggtgccgttgctcggctaccgcacaaaggacgggcgattcaccttccctttgtgcgcgtggtgtgccgaccgtcggcagcagcggccgtgccgacatgacgacgacaagcgctcgtgggtgaccgcctacacgcacgtcgagctcaacaaagcgctccagcttggctatgtggtcaccgatctgtttgaggtaaagtcactcattaaaaaattttgtgtacgaaaacacaaattaggtctgggactacgaagagtgggacggtacgctgttcagcagctacgtcaacaccttcgtcgggctcaaagtgcaggcgacgggctggccagaaggatgtgtgacggatgagcagcaaaaagcatttgtagacgattttgagcggacggaaggcatccgcctggactcgaccaaaatggagttcaaccccggcctgcgcctcatcgccaaaacattggccaactcgttgtggtaaatattttagggggtgaaaatttaaaaaaaaatgacatccacagggggaagctagcgcagcgcgtgggccagacggagattcgctacacacggactccggctgaattccacgcgctcctcgacgacccaacactggacaagttggactttgtccacgtgtcagaacacatggaccgctgcgtcgtgcggtagcgaccggaattcgccaaagccccgctgaccaactgccttccggtcgctgcgtttgtcacctcatacggccggcttcatctttacgactacatggagcaggtgtcagccatcgtcggtgcggagctgctctactgtggtatgtttattttgtcacgaatggtttttttggacagcccttttgtttttagacaccgactccatctactacgtcagcaagatgggtggtccgtgtgtagcagagggcgaggctctggggcagatgaagcgcgaacacaccgaccgacggatcgtcgagttcgttgcgggtggccccaagaactacggcatccgccacactgcgcgggacggcaccgacgagcgcgccaacctcaaaatccgcagcttccgcctgtcctatactgcgcagcagctgctcacttttgaggcaatgaagaacctgacgctggccacgtacaacattgacggaccaatgtgagttttgcaattaagcattaattttgtaaataaattttaaaaaaatttagcgatgatgccttggacaatgacgacctttacgtgtacgggggcggcgaacatcgtgccatccgcgtcaacttcccgcaaattgaccgcaatgtgtacgccgacctctacacgcaggaagcccacaaagactacaggcccttctacgccaaggggcgcgttcggcctgggatgcagacgcgcccctttggctatctggaggatgatggacagccgaacgaaggacaacggacgcatcgaagaaagagaaatttagtagagcaagatcccacacagcccggccactctgggtggttctgatgttgtgatttttttgttagtttactattttgtttatttaaatttgtacaaatgaaaataaattatttacgaaaatactttggtataatattagacaaattggtaaatgactggtgcaaaatatcaagagacttggccccagtgacaatgaccttccccgaaatataaactaggcacgtgactccattcaacaatttacaacgaagggctgggaaaatggtagggtcataaataccacccagggtgttttggagtcgctctacactgattcgctgggcaaaggtttgaacaccgacaatgttgaccacgcgcagctggtggatgcacagtgtgatgctctgtgtgtgttggatgcgccgaaaaacgcgtgccgccattttatttgcactgcttgggtggggcactccggtgaggaccacacgcgccgattggaagaccagcgcagccacagttttgcccattgttgtacggatgcgcatgatgatagcgtgaaagcgcctggggttatactccgtgtttgagccacgctgcgcaattgccaagaattgctctcgagttaagggatgaacatttattttaaaaacaacagtacaattggaaattgaatacatctacaaaacaatggacaaaatttcaagagggaaaaaagttttgtgatctccgcctccaaattcaacaacgcacggcaaattagggtggcgcaagcggatgccgtgttttatgtagtagtgcatcctgacctttaaattgcttggtaccgacaaacaaaacaaattttaaacaaccgttatgccgaggtagcctcggtaagctggggcggagtgggtgtccaggatggacaggtcattacaacgcactggaaaattgcgcacggacgggcgcaggtgggcagtgcgcagttggacggagcgcaaatgctccacaatgtcccggcgtttctctaggcttttgaaaagcacatgcagctcgtgggcactgcatttgaaccgcttgcagagatggtccacgagcgggacggggcgacggcgttcagcgcaagcacatttttttggagtgcctaatttaaaatttaaatatacgtttaaaacaaaagtaacttgttgctggcgtctcctcaccaattggagcgagcggctcgcgcttcatctcctcgtcaatcaggctgatccaactgggatcatccgcctcctcctcttgctttttcgttggctctttgttctctttgttggcgtcctctaaatccatttcgggataagcgttgtttatccaatcggtagcaagaattaaatccattaaaatctataaaataaaaaaaaaaactataaataaaaagaaaattacataaaaaaagtaaaatggacgccttccaacaatttaaaagggaggatgtgcaatttcgtcatccattcacaatgattgtgtctgggagcacaggaagtgggaagtcagagtggataatgcgtctgttgcgaaatgtggacaaaatgatctctacccctgttgaacgcgttatttatagctatggtgagttgaacacaaatgtgatgaatctgcagcgcgccggcaaagttggcaatgtgccagtcactgtacacagcggcgtcccacgcgcggaacaagtgcgggagtgtgccaaaaaagaaaaaaccttgctggtgctggatgatttggtggtgggtatgagtcaacaatatttggacgcactcttcacccgtggctcacacaattggggcgtcagtgtcattttggtaactcagcacctgttcaacaaagagctgcgtgtggcgcgcactaattcacactatttagtattaatgcgtaatcctgcgggggcgttgcagatacgcaccatcgccacccacctcttcccgtcaaggactgcccattttattgaggcctaccgggacgcatgcgcaaaaaattttggataccttctcgtggacatgcacccagagagtccggaagagatccgccttagaacaaatatatatgaacaaaaacaaattgtttacctaccaaaatgaaagggtcacaaataataacaataaataaatactttttggagacattgtgtaatgccaaaaaggcgaatgcccttattcgagatgcatccgatgagcaacttttgtgccttgtcgaaatctgcctaaacattctaaagggccgagtccctttgcgtccccggcatttgaataagctgaaagctcatgcacaggtgcttcgtcgtctcgcccgcacacgctgctcgcgctctgccaaaaaggttttgctacaacacggagatggcctcccagctattgtggggctcattgcgtcaattgctctcccgcttattgctgatgtcatagaaaaatataaatagtttccaaaaaaattaaaaacaagaaaaaatgcagcatacaaagcgctatttgctcgtccccgaagagatttatcagagtttggcagcaccgccaccgtcagacggtacaccaattgggctggtccgtacccgaattaaacaaataaaaaatgatgacgccataaatgaggcggaaagggcagtcaaatatgagcaggaagttaagcgtctcaacaagctcacaaaggacgaagatgaacgtcccgtgggtgttaaattagaaaatttgagtgatgtggttgacgccatgccaaaaccagtcaacgttacaaggccaattgttgtttctacgcgacgccatctcaaggttggacgtgcgcgaaaagaaaatgttgaacaattagaagatactgatgatgatgatgattatcaaaacccacggtcgtcaagttcaaataaacgacaacccacacaaacggaaatcttaaaattaatttataaaaacgcccaatctctaggggtgtcggaggaagggcaagttttgagagccggtgggcgtccatttataaccagcagtgttgatgacattgttagtcacctgtttaacaaggacaagcgtggccaaaataaagagccaacggcattcaaagaatttgttgaaagggcaaggcagaatccgctcttgagtaggcatttatttcccgaaggccaatccggtaaaggaaattataaaaacaccccaattaagtttaagccatcattatggatttgaaaaagcttcgtttgctcgagtttttgtacaaggacctaagttcacctgtcgcattcacgagcgttgaaccgctgctgagagaggcgcggaaaagccaaccaaaaattaatcggactgatgtccaaaattatttaaccagccaacgtacatacacactgcatcgtcaggccaagcggcgctaccgccgattgccaacattggcacccggcttgcatactgaatggcaggccgatttggctatatttgaccgatttgctaaacaaaatcatggcttcaagtacttgttagtctgtattgatacccttagtcgacaggtgtttgccgagcccgtaaagaccaagacgagcgctaacatgatcattgcctttgatcgtatattcaaaagatcaaaatatatcccgtggaaggtgttaacagatcagggaaaggaattcactgcccgcgcagtacagcagttcttccgcacaaaagacgttgaacacttttgtatgctcacttctccccaatttcatgccggaatggcagaacgtgcgaatcgtagcatcaaagagcgcctttaccgctactttacggagcgtaacacgtacaagtggattgatgttgtgcaagacattgttcgtgcaattaaccactcgccaaattcgagcattggaatgcgcccagcagacgtgaactttaaaaacgcagaagcgttgagacaaaaattacataatgcagctgaaaatgttgtacgacgccagccaagataccgtgtgggagatcgcgtgcgcattgaaaagtacaagcacgtgttccaaaagggctacctcccacgcttcaccaatgaactattcacggtggtagaagtacacacagagcgttcgccagttgtttatcggttgcgtgatgaccataatgaaataattagtggttggttttacgcaaatgatttatgcaaatcactagaagacaagcagcaaaatatgtatgaaattgaaaagattttgaagaaaaagaaacagaacggggtggattatgcatttgtgaaatggaaagggtacagcgctcgctccaatagttggattcccgcaaattcaattagcgagaaaaatatataaaaagcattatttaataaaatttataaaaaaaaatgccttcaaattctttttatgttgttcttccgtcaaacaccaatattgaaggaaataggacaaattctttccgagtgcgtttaccgcgcaaattgcaattcaattcggaatgggaggtgggtcttgccgttattgtatacccccactcttggccttccataggcaccgtggagcaacaatttgttcagattgagtggcagacggggaatacggtacgtatcgaagttccaccatcaaatgtcacaaacccccatgagcttagcaaaaatttatataggctcctgggtgagggaagtgatccgttggcaaaaaaggtgcgatcaacacagaattctttcatgcttttgataaacaaggctcgacgatgggccagagaagaatacattaagcgaaagactaaagaaaaacggagcgtccgtgacgaagagctgctcctacaggccatgttgacagatactggaacattggttgatctcaacagcgtagcccaaggctttctgacacgcgaaaagagtgctgcaacgagtaatgtaccgttgagaatgccagctgatgataccaattcgtaccaagaaaaattggatgagtacttttcgaaattaagtgacaaaaatttgaacattcttgatgaattgggcatgacaaaattgaacgccgaaatcaaaaatttaacagaagaggaacgcgtgatccttgaagccacaaaggaaatgggaacggaagcatggattcaggcgtaccgtgagatacgtcttgtttgccaatttaactatgacgtccatagaaatcgttttgtcctgaacaccgacccacggtacgttaaaaaggtcaaagtctcgcctcaactcgcttacattctcggtttcaacaacacggagtttattcaatctgaaaacgaggcaagattcatgccggacatgagcggtggtgtgtcatcattccacgtttacacgccggatcttattgaaccaatgatgattggagatgtcacggccccagtgttgcgcatagtgaccatacgcggaaaccccgaccaagtagttgaagaacaattttttgccatacagtatcataaacttttattaaaggagttttctgaaattctgattgagatacgtaccaatagcggcatcttgatgccattccaatacggaacatgtacattaacattacactttagaaaaatgtcctatttttaaatgatgaacacgttggaaattaacaaaacattgacaagaaacaacgtgactcgccactactatattggctgttttgcagcagatcaaatacccgccggtgcaattgtcaaattacccgcactgtatggtggttaatcttgaccccagcacatca

SEQ ID NO: 528 - DNA, 2010 bp, Heterodera glycines
aggcgaaaacaatgttttttacaaattgaaggcacacaaaaataatctgatagtgaaagtgaattttgtaaaaataaacagttgtgttcgatggaaatttttcaaggcttgaaccgcaaaaatcgagattttactcgagtcggtcgagagatcaatactatcgaacctaaatgggaaaaccgaaaataaatgcaaaataaaaaaaattaagaaaattaaatgttacaatttttttgtcttttatgaaataatttttttaaagcatccaatacataatgccgataagcaagttgtattcttaaagtacgtactttgaaaaaaagtacgaatccgagccttccttttcattgatctcatttttttggagttagtgcgtttcgtaaaaaccgccataaaatataatacagtttaaaatgcgagtaaaattttaattataaaattattttgttatttattatgatttgttctagatatgtatatattaatcctgcatcttttcacttaaaaggtgaggggaatgtccggcgtgccgaaaagcggtgccggggaaaattttgtaatttttaataccactttttttaatcgatagaaagcaatagcaacaaataattggcaaacagagaatatttacatattttttcttgtgagaaaaatgtaatgagacatttgcggacagacatattttttcatgaatttttaataaaaaattgtgtttacaatttactaatttatcgctagtttaattaatttttttataatgtaagaaagtataaaggaaaatatttttagaaaaaaatggggatcattggaattgtataattaatttcacttataaaattacaacatatttatttattcaacataatgaaacttttttctttttttatctcggcttggattatgccccaaaatttgcctggcgaccttttgtccagcgcccaattgtctcccatgagcatgaccaactgctgaccattgtccattattttgcttgttgcatttctccccatttcgcggcttcgctcgtcgccacttttccaatcaataggtccattcatatgttctctctgccgatgtgtgttaccttttaatggcttttttcggtgccaacggggatttttatttttatttgtgttttattgaaaatgttgatttggagatttttataggtctttggaatttttcaggcttttggaaacaaatgagatttcctttttctgtttccaaaatttgttaacaatcgcagaaaatttgaaaaatttaacccgagggcacttaacggcaccgccgaaccaaaaattcctttgtttttcaaaatttgagttaaaaagctcaaaaattcgtcattacatttgtaaattatctgtgggatgaggaatttagcaccaaaagccataacgcagttttccaaagaattaattttaaaaattcccaaatttcaattaaagaggtcattttgctttatagattccctcccatcaatccacttcattttttggagtcaaaattttgctggacacatttcatttttggtgatcccacaaattctttatggccactcatttttcaaatctatccaatttctttactttgcttattttatttgtaaaattatttttaggtataatttataaaatttaaatttagtttaaaacaaaaaaaaactgatcactgatttgtgtgtcctgccaaaaattgtgacgcaaaagacccaattccgaccagcagcagaggcatttttaccatctttttgaaaggttttttaaagaatattttttaattaagggagtttaaaaagaaaactataaacttttttgtcatttttaatgataaaaggataatatcacatgtaaaataatttcaatttctcattatgtgcccctttaaatgagttcacaattatttaattgagcataatatttattttggttattgcgcatgtttaaaaattttaaagttttttgttttttaaaataaaaacaaatcggcaaaacaaaataaacttatttt

SEQ ID NO: 529 - DNA, 874 bp, Heterodera glycines
attttcaaaaaaaagaattttaaaaaaccggaataaaattttttaatttattttttcatttaataataaattttaaaatgctgatttttgtcggccaaatgctgatttggaaattttcagttgggagccccataatgagctcagtctgttcaagacttaagatttataagtctaaatagaattagacgggtctcttgatattttcgggcacaaataagccgggtattcaggtctaagtccaaacagaaaactagtacacgtctaaccttacgtttaaacagctgtaagaattgactaaatagactaaataataagatcatcaggtttcaattcttctatttttttaattttcaagaaaatataaatttttaagcacaaacttgttaaaagttattaaatttaattagtcttatgacttttaatgtcaagctcgccataatggtcttttctcagtttttgggtcattttaaatagtatccaccattggtgtgacgtgataagaatgaagcagcccactaagattttttttgtctttattttaaattaacacactgtatatcgagaaaaaaacattattattctttaaggtacttttttttggaaataaaatggctgatccaatcgactcgaaatattttgggtttgtgccagccactgaagagcagcagggtaatggggaaaatcacaataaaaagtaaatgcaattaaaataaatgattgaattcaagaacatacattaaaaaggggtaatatgccaaagggtacaaaatgagttttatgcaaaaaattctaaaagaaaggcagtttattgctattttcaaaatttacgggttaaagatctgtaataaaatgaatagtttttcaaaaaattcca

SEQ ID NO: 530 - DNA, 4387 bp, Heterodera glycines
agaaatctaaatttaagcaaacattaaaaactgagtctcatttaaatgggaatttgccaaacaggcaattctgctgatgtgttctgtttgggccaatttgtgcccagtgccgccgtgctgtcatcatcatcaatcggtgctgctgctggtgatcgtcagcagaaaggacggcagcagcagcagaacacggcgatggtgggccaatttataaaagaaacaaaaaatggttgccaagaaaattgaaatatttaaaaaaatgaaaaatatatttttgcataagaaatatttcttaaaataaaaaaaaataaaaaattttaatcattgaaattattatgtttaaaatgaatattttatttttagagcccggaattttgaaggtttcaggctcgtccgtgggcttagacaattgaccaggctcgggctgccctgtcaaaaaagccaatttaaacgggcgtcccgggtccggtcccaattttagccgggcccccgccggacttgggattttttcaagttaacatgcggggaccaaagaccaacaaaaaaaacttcattaatccgaattttcttttaatagtaatttttcaaattttttctgataggtggaaggttcgacaccgcaaagtttttcaatttttgcaggccaatgttgtcaagacggaacagcagcagcagcataatgaagaggatgggcaagtcgaatatggtaagagaaaaaaagtacattcatttattgtcatttcaaatatacgaattatgttggttttttaaatttttaattttgaaaaaacttaaatgcgcttaaatctaaagtttttgaatttttcataaaatttctccgactctattcatcttgtaaaatttaggaaaaaatattagattctaaaataaaataaattaatttgattttttttgattataagcaaaaattataatggtttttttggaagaaaaagtgttcaatatgacgggtttaaaaccttccaaaatactgaatgaaaacctacaataaaaatttaaataaattaaaaaaatatatattttttagaccaattgactccaacaattccatcactttttggagaagatactaaccgattggatgtgcgacaacagcagcaaatgtgccatgttgatcagctgatgaaaacatgcgaatccattggtgggcacagatttatgcacaactaattaatgatgctaaaaagacaacaaacaattattctgtttttaactccgatgtaataggattttcgagatttctgtcccagggatgtacttttttttgaatttagtttaaattcaaaaagaggaatttatgatttttagaatttcttcaaatcattgaagacaggcacaaaaatgccgaaaggcaataatttaatgctttgcccggttcagttggccaattaactcagtttcaaaatgatcagaatgctattttgggacgaatttcccaattggagacgcagcaacagcaaatgcgtgaagcatttatttttatattcgaaaattttaaatgaatctttctgagaaattttaaatgttccttaaaaattcctcgattatttaatgattgtcttttttaaatttgacagttggcacagcaaacaacgaaagagcccaccaaagtaggcaatgccaaacaacagaaaaaagcgcaggtattaaattttgaaaatttatttgaataaatgtttttatcataatattatggcatttatgtgtaccaatataatttattttgaaaaattttatcatataattacaaatattcaacaaacaatttctaatttaataaaagcagacaaatatacgtattagagttagttcaaacatttttttacacaaaagatagtattgttaatttaaaaattttaaaaatattttcgaaaatttctcattccactttttctcgtgttcatatgtttttaggcatcacattttctcttaccactgccgataatgaaacattttaactgctgggattacgaggcccgttcttttgattatccctactacggtagttatgacctcgaacttattgacgctaaaaatctgacgatctgttataccagaagaaaatataacaatggtatatcgaatgattatatcattaaactgattaattaaaaatattttttcctataaaagattggcgaactgtctttgcggaacattccattcaaagctccgctaattccaatggccttttctacttcgaaattgctttcgaaaaattacaatcgtagggaaaatttatatgtaaaaacaatttagttattgaatcaatttattttatattgtttattaacagggctgggatttatatttttataagtatatgcttttttgcaaaatttacgagtgaatcacgaaaacatattccatagttcaagttgccaaatttttttgtgttaagaacaatgaattaaaacataaaaaaagaaggattctctcaaagcagaattttttcatttttttataaagttatgaaatccaagaaaattaacttttttacaaaataattatttgacgaagcttttcggaaatttattataaaattttttgtatgaataataaatggcagaaaggttgatgctcaattgaaacccttgattaaaattttcatatcatttgtcttaagtggtgccgtcgtcggatttgccgtcaaactaaagccatttttatcggttgtgaaccgctggggcacattggcgtgccaaagcaatggcactttttttgtgaatggtttccagcaacaacatataaatgcgacacattcattttcccgtggcgatataatcggtctcggcgtttatttagaaactcgtgaagtttttctcacaaaaaatggacaccgtttgggtatatttaaatttaaataaataataataaaattgaaaaatgtacaactgtttttgaaatgattaatcaaaattactatacatttaaaaagagatgaagcgttcggaccattgattgaatttttgaattatttctgattttctcaattttttgaccaattgatcaaatcacttttcggctctctaataaaaaactaaataaataaaacataattgtttaatttacagttaccgccaatatgttcatttcatttccaactgatcaccggcagcagttgttcccattcgtttctttgctttcgcctggtgatcaaattgatgcaaattttggaccaaactttctctttgcgaacacataaataaggaagagacgaagaacgattggacaaatttattatactttttttatgattttcaaatattatttcatttttctgctttttttgtttcatggatacaaaggaattccgcccttcgatacaaaaattacaaatttatattcgcgataaaatgacgccgaattcctcattgtttgatcagttgggcgctcacatttgggcgctcaggtttgggcgcatgcatgtttttccactataaattttttctttgtgaccaaatccatcaatcttggtattacccgaatgcttaacctgttgaaaaagttatttctaagctattgattcgcagtatgaaaacccgaaattgtagaaagaaatgctggtgcccaaacgtgagtgagaaaaataaaaataaaagtttggcacaatgccttaaaagcaacaaaaaatctttaataaacaaaagtgctagcaaaaagaatgaaagaaatttgagaaaagtttaaaattgcttgattttgaaatttgtaacggaccttctctgatataaatgagattaatttagcttctcatttttaattttaactctaaaatattttatttctaaaatttatttattttttccgcagtgctcgaaattactaggatgtcccaaaagttccttcaggttttttatagcaatgtcggccacccctgtaaacaactaaatgttgagtataaaaaaatagcgaaaggaaaaattgtatttctgattattttgtatttcgggtcgattttaattatctttttaattgtatttcttttttttttgtctttgctgttgtatttctgattattttatggttttcatgtatttttaatttctgataataattctttgcttttctggtcgtgtttctgatcgtttttatttgtatttgttgttgaatttcttatcattttttttgtctttgcagttgtatttctgattattttgtatttcgggtcgattttatttatctttttaattgtatttcctatttttttgtcgttgctgttgtatttctgattattttattgtattaatgtatttttaatttctgataataattctttgcttttctggtcgtgtttctgatcgtttttatttgtatttgttgttaaatttcttatcattttttttgactttccagtcgtatttctgat

SEQ ID NO: 531 - DNA, 714 bp, Heterodera glycines
aaataatcagaaatacaactgcaaagacaaagaaaatgataagaaattcaacaacaaatacaaataaaacgatcagaaacacgaccagaaaagcaaagaattattatcagaaattaaaaatacatgaaaaccataaaataatcagaaatacaacagcaacgacaaaaaagataagaaatacaattacaaagataaataaaatcgacccgaaatacaaaataatcagaaatagaactgcaaagacaaaagaaaatgataagaaattcaacaacaaatacaaataaaacgatcagaaacacgaccagaaaagcaaagaattattatcagaaattaaaaatacatgaaaaccataaaataatcagaaatacaacagcaacgacaaaaaagataagaaatacaattacaaagataaataaaatcgacccgaaatacaaaataatcagaaatacaactgcaaagacaaagaaaatgataagaaattcaacaacaaatacaaataaaacgatcagaaacacgaccagaaaagcaaagaattattatcagaaattaaaaatacatgaaaaccataaaataatcagaaatacaacagcaaagacaaaaaaaaagaaatacaattaaaaagataaataaaatcgacccgaaatacaaaataatcagaaatacaaccacaaagacaaagaaaatgataagaaattcaacaacaaatacaaataa

SEQ ID NO: 532 - DNA, 4964 bp, Heterodera glycines
  misc_feature (575)..(575): n is a, c, g, or t
ataatcagaaatacaacagcaacgacaaaaaagataagaaatacaattacaaagataaataaaacgatcagaaacacgaccagaaaagcaaagaattattatcagaaattaaaaatacatgaaaaccataaaataatcagaaatacaacagcaacgacaaaaaagataagaaatacaattacaaagataaataaaatcgacccgaaatacaaaataatcagaaatacaactgcaaagacaaagaaaatgataagaaattcaacaacaaatacaaataaaatgatcagaaacacgaccagaaaagcaaagaattattatcagaaattaaaaatacatgaaaaccataaaataatcagaaatacaacagcaaagacaaaaaaaaaaagaaatataattaaaaagataaataaaatcgacccgaaatacaaaataatcagaaatacaacagcaaagacaaaaaaaaagaaatacaattaaaaagataaataaaatcgacccgaaatacaaaataatcagaaatacaactgcaaagacaaagaaaatgataagaaattcaacaacaaatacaaataaanaatgcctattaatgcctattttggcggcaacgtatgaatgagtaaaccgagttttctaggtggccgaaatggtggcacgcaaaaattttgaaaacaaaacgatgaacagatcattaaactcggggcttaaccctaataaaaactggccagttcttttgacctcttttaaattattaatcaactgaaaaattttaaaaaattattaaatcggtatgggttctgggcctcaataactttctgtcatgagttcgatgccggttgacggtttcttttttaatttatttttctaaccaaaaattcgtaaatattatttaaaaaaatctctcaaattcgcaaaaatctatcatttttttggcaaaatctattaacagatccatccaaattttcaaaaattttcccggcggcgcctttcggcaccaccggaccctttctccctaaaagtctttagaaaaagagcgccgcgaaaaaagatgttttgtgatcactacccgatcggggtccccgacccatctgatttcgttagccagtaagagtgagtcaaagttggcctttaaaccagggctttcatttgttttataagacgaaaattgctctgatttcttaaatatacagtcagtcaaaaaaatattggagcaaatttttttttgaaaaatccagttttcttttctcaaaaccccctctttgttgacgtgaaaatcggtcatgacccaaacgaccccctccctatttagtagaacaaaaagtaatggagcaaaaaatatttatgcactaaaaactcaatttttttattgagataaaattctgaaaaaaattcctgctaggctaacttttgatgctgatcagaaaagcttttgaccaagatgatcggaggaggagcaaaatgaggaccaagaaatcaaattgctgagagaattgggggagaaagtgggccaaggccgggcaaaatttggggaccgggaaaggcacgccgaactcggcaagaagttcagtctgttgaagaagtcgactagcaacgacggagcagcccatgggatggtcaacttttgtgttatctatcgagcatttctcgtgttcggctcacaatcagtggtcattcttttgttcatcagggtaattaattaattattaattgagcaattaatttttgattgttggcactttttcactctccagggccttttggaaggtcatttcaatgcaaaaacaatggaagaatatttggaaaatggcaagcaaattgagaccaattcgtacttgttgaccactcatttgtcacttcgaaagatgaccattcaattgctgacagtgggagaacattttggatacaaattttaatgtgaagaatcaagaaaatgatgaaaactcataattgttggctgttaaatttaatatgagttatctccggattttttttactgtaacttttttatttgtcaaccaaatcagcattttgttggtatcattaaatcgggacttctagcttttcatttttaaaaaagcctaattgattgatgcacaaatatcgcattaagcaacgctttacttcatttataatacaaaatatgcacacgaaatctgtgacaaaaatcagtcatttgatgggaaatttacattttatgaaaagataatgatcagataattccatccgagtggccattgattgtgtttagggctcatctgctgttgatccactgtttgcgcattgcttctgttctcagcccggtctgtttctcgacatggacgcagcacaatccgaaggcaacggtctgaaaacaaagggacagaaattgtaagagtacccccgaatataaaaattggttgacaactcgtccatacccaatttcgtcatctgcaaagccaatggtcaccaaattcggatgaggttcgttgttcaagcgcgtcatacgaaaccaggacaccacgtcagcttcactgaactccgctggacagcgcacaatcttcacgaaggacaccacgccaccacctcgtttcgggtgcacattggtcaacatcgtcagcctctcctccgtcagcatgttcaccatttgttcccttctggtgtagatgaattcgaacgaagtgaacaccatgtagttgaccgggactgacgccgtattgaaagactgaaaagcggaaatgaatgtgatcagcagaacaatgattaaaagggcacagagaaaaaacgaaatccgtccgtccgtcgatcaatcgatcgatcatcccacacacccaccatcatcaattcgttgacgaattggtcccatcggttgttccatttgagcaatttgtacaccaacggacgacggtcgacgcgcgtcgtgtgcagccacatgtacaagtcacggctcgatgtttcaggagcagcagaattgtcaacggtaggacgttcaggcaaaactgggctgacgatttcgacaaggtttgggcagtcgaagaggaaggtcggcgaaatgtgtttgcgcatcaaggccagttgcttccgcttcacgttgaccaacgtgccgagcccgttcttcagcaagggccaaatgtgacgtgccacggcttgccaagcgcgaaattctgttatcggaatggtgaacttcagcgagatgtacgtgttgaagaggcgccgaaatcgttgcaggaaattgatcacttctgcgtccaaatacctgcaaaatggggaagaacaaaatgcaattggaaattcaaaaattgaatggcgaccaaatgttgaatgtgccgttgaatccgatgacactgtccggcaacggtgaggtggccaatggcaacgagaagtaggagccgttgtttgccaagctcaacacttcggcgccagtccgtttcggcttccgctcactgatgtgaaactcctccaaacaccaccgcctctgctgcagctgcatgttcaccagggcggcgaagcgggcgttgaccagcgccaagtgccatccgacctcgccacgtccaatccacgccaatgtgtcgagccaaatttggtcgctgaaagtgccgccgctaaaacaaaacaaaataaattttcaaaaacaaaaaaaaattcccgcttttctcacatttggtccatgcgtttccttctgcaccacttttactgctgatgatgattttgttgatttgtggtgcccagtttcgtttggtagtcgatttgtgcacacttccgatggctcagctttcgttgagttgatttgatgatggcacggacagagaacagcagccgcaataatacgcaggaattaattaatgcctatttggaataaaatggccggaaaggatgaaccaacttccttttatactactcatcatttcaacatttgtaccaaatccatttttaccaaatcagagcacctcccctttatttgttgttatagaattgcctataaatagtggggaaattctcacacacgatgcttttacagagtgacaaataagtcttgcaccactttaaaatattcaaatatctcataaatatggatgcaacttttagtgacgaaaaattccaaaatagttactaaaatagtgacgaaaagtgccaaaaaagtgacaaaatagtgacataattttcagccaaaaataagttaaaaaaaaatttttttccttgcagttgcaactgaagtaaatttactttctaataattcttggcaaatattgacattttaaacagggctcggatctgttctgatttatcagaaatgttctgattttgggctattgttcttattttgttctgatttcctaaatcctcataatttagaaattttatgccataatgtcactattttacaagaaaatataaaatttgtggcaaaatttggtcatttttggacaaaaatctgttaaaaatcgcattaaaaataacaatattttcccggcggcgcctatcggctccgccggtccccctcccctcgcccattcaacaaaagttttttgggaaaatgcgccgcaaaaaattgttaaaatctgattttttgatcctaaatatactgaatttaaaatatgcttatttcctctcaaaattgttaaatttgataataggaggtgaaaaatataataagtgaaacaaaaatgtaaaaataacagatttgaagcaatttgcaaaatgttctgattttcgaccccaaaatctgattttttaggcccgatgttctgattttgaaaatttttagcaaatattgacattttttaaaccaaaaaattttaccaagaaaaaaatttggttgatgaatttttgagaattttctaaaaaatttttaatccgattcttaggggtgtatttttgaaaattttttaggtcgattcttaggggtgtattttttggttttattgcatttttgttaaggaattttccaaaaaaaaaggaaatagtgaaaaaataatgccaaaacgccaaaa

SEQ ID NO: 533 - DNA, 2274 bp, Heterodera glycines
cccccccccctccccccacattccccatttttttggaaaaagcacaccgcgaaaaaaactatttttgggattttcacctcaaaaaaacaagcagatattctgatcataaattaatcttaacaatttttagattggattttttaaatttaaaaattttttaaattaaaaaaaatttttgaaaattacggattacgtattacggattacgccaaattacggactttttggacctccgtaatgacggattacggatggccgtaactgaaaaaattgccgtaattacggatttgaaaatcagttacgtccagctctggtgccaacaaatggagaatgcaaagcagagaaaaaaaatacaaaatttttggcattttttgagggttaaaagccatttttggcagttttttaaggaatattatttcgcgatttttgggaaatttattaacaaaaatgcaataaaaacgaaaaatacaccccctatttgcggaatttttcaaaggattagcgacaaattttaaggaatttgtctctttttaaaaaggattttataaatcttgttccaattttcatgttttagtctatattttcatgaactcccagaccctttcttaagcaaatgcaaattttcaaagactcgcaacttttttttctggtgcttcaagatgcttaacatttacattgaaaaggtttctcctcaccaagagactttgaatgataccaagaatgttcaattgcttcaaataaaattttaagaatgttcattgccgtggtgcgggctcgaacctgcacagttttcgctttattatcttacaaaatccacttatccatacgcaaattttcttggtactgatgttaattttcctgacgctgtatagaaataaaaacaaaaaattaaaatgtaaatgatatgatcggattaataaatgaatcatattgacaaacatccctatccaactgcgttttagcaatgctaaacggaaaaaatcgggtgagtaattaattcacttcaaacgcacaaattggacggactaaattggttagggtttcattgctttcatttttcatatcattattatcatccacttttgaattttccccaatttaccaaaaatgtccagcctttccataaaatttgtcaactttttcctttttccattgaccattctgttggcacagtgttcgaattcgcctgacggtaaaaatttaagccctctcgagagggaacgggttggaattgtctttttttctaaacgaaattttaatttcaagtcttcaaaaaacagtcaaattttattccatgtgagatttctgaataaacattttacccctaaccagctataagctgctggaaggctttggtgccaagcttgaggctaaaattcataagcttccttcatctgctgatgttccaatgaatgcttctttgctggagctgcttgatcaattcgaaaccatcgaatttgatgggacagtgaaaggaaaagttcgctgtggttttgggctgaaccaatgcatgaagatggaatgcactctggatgcatacagtatcaacaacatggagtttaatgaaggttttgtggttggagactttttgacgcttacacaaaatccgcaaggttgtcgtttcacactggctttatttggtgccaagtcccatcacatatattaattatacagttaactcatgtttttaaaatagaaaatatatttacggaaactttaccagttgtcattaccatactaaaaaatgcaccaaagcaaattttgtgcaactaataattagttagttatcagtcaagccttttcaattagtttaattgctgctggcccataattaatttaacactaaaattctctattaaaatttatatatcacatattgttttttcatggaaaaccctaaattagccaccaaaattttgttgaaataagtatttctaattttttgaagttacaaatatggcatgcgcgtcaggaaggcttccacggtcattgtaaaagtttttgctgcaacggtgacttgtgcaacggtgcgatggttgggtggacggttggcaatcactttggcacctttgccctgattttggctgttggcattttgcatggtaaaagacaacattttaaattaaaaattaaaactactttcaatgttttccctttatttgcactttccgagagcaattccgactccagacttaaattttaggaccgtcgaaattacatccataaaattttaaaaatataattgattttaaatcagttttttacattttaaat

SEQ ID NO: 534 - DNA, 4808 bp, Heterodera glycines
ttgataggaaatatatatttctcataataaaagtacaatttttatttgtcccacgccattttctgggaaaactttttcgcgaaaagccgaaaaattttccatcggcctcttccaacggcaacagatgcgtttcaaacaattgacaatataattatgattgaagtcaaaaagcctctttagaaaatgcttaaaaaatttttgttataaatgttcacaaaatatttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgcccaaaaattgttgttgtaaatatactcaaatattcctaaaacaagctttatttttactgactatctttttccagaaggctataaaatgcaataaacaattcgcatgcttggatagaaaagaaatgggctaaaaatatttcatcacttagtcgtgaaccattacaagatttctatagcagggccatattggcaaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggttgcatttgtcccgaaacaacccgcttatgacacgtctaaagaaaatccgttaaaatttgcattcacaaactccattttttcattggcaaacgtgtaaagcaaacccgaaattgataggaaatatatattgctcataataaaagtacaatttttatttgtcccacgccattttctgggaaaactttttcgcgaaaagccgaaaaatttccatcggcctcttccaacggcaacagatgcgtttcaaacaattgacaatataattatgattgaagtcaaaaagcctctttagaaaatgcttaaaaaaattttgttataaatgttcacaaaatattttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgcccaaaaattgttgttgtaaatatactcaaatattcctaaaacaagctttatttttactgactatctttttccagaaggctataaaatgcaataaacaattcgcatgcttggatagaaaagaaatgggctaaaaatatttcatcacttagtcgtgaaccattacaagatttctatagcagggccatattggcaaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtcgaaagaaaatccgttaaaatttgcattcacaaaactccattttttcattggcaaacgtgtaaagcaaacccgaaattgataggaaatatatattgctcataataaaagtacaatttttatttgtcccacgccattttctgggaaaactttttcgcgaaaagccgaaaaattttccatcggcctcttccaacggcaacagatgcgtttcaaacaattgacaatataattatgattgaagtcaaaaagcctctttagaaaatgcttaaaaaatttttgttataaatgttcacaaaatattttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgcccaaaaattgttgttgtaaatatactcaaatattcctaaaacaagctttatttttactgactatctttttccagaaggctataaaatgcaataaacaattcgcatgcttggatagaaaagaaatgggctaaaaatatttcatcacttagtcgtgaaccattacaagatttctatagcagggccatattggcaaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtcgaaagaaaatccgttaaaatttgcattcacaaaactccattttttcattggcaaacgtgtaaagcaaacccgaaattgataggaaatatatattgctcataataaaagtacaatttttatttgtcccacgccattttctgggaaaactttttcgcgaaaagccgaaaaattttccatcggcctcttccaacggcaacagatgcgtttcaaacaattgacaatataattatgattgaagtcaaaaagcctctttagaaaatgcttaaaaaatttttgttataaatgttcacaaaatattttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgctcaaaaattgttgttgtaaatatactcaaatattcctaaaacaagctttatttttactgactatctttttccagaaggctataaaatgcaataaacaattcgcatgcttggatagaaaagaaatgggctaaaaatatttcatcaattagtcgtgaaccattacaagatttctatagcagggccatattggcaaaagaagcacacgtagagcaggctcgaaataagggcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtcgaaagaaaatccgttaaaatttgcattcacaaaactccattttttcattggcaaacgtgtaaagcaaacccgaaattgataggaaatatatattgctcataataaaagtacaatttttatttgtcccacgccattttctgggaaaactttttcgcgaaaagccgaaaaattttccatcggcctcttccaacggcaacagatgcgtttcaaacaattgacaatataattatgattgaagtcaaaaagcctctttagaaaatgcttaaaaaatttttgttataaatgttcacaaaatatttttttgttactgacaattcatttccattcaatttaaaagcgataaataatgtattgagatatgaacaaacatctagaaaaattatctcaacaatctgtcagaaacagtccaggaaaaactttgcgcgagaagccgaaaaattttacaactgcatcactgttcatttgatagggtcaatcaattcaaaaacataacttaatataaaatattgataaaaaaattattttccttcatctttagaaattgcccaaaaattgttgttgtaaatatactcaaatattcctaaaacaagctttatttttattgactatctttttccagaaggctataaaatgcaataaacaattcgcatgcttggatagaaaagaaatgggctaaaaatatttcatcacttagtcgtgaaccattacaagatttctatagcagggccatattggcaaaagaagcacacgtagagcaggctcgaaataagagcaaatgccgaaaattttaaaaattcttgttttattagacccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtctaaagaaaatccgttaaaatttgcattcacaaactccattttgtcattggcaaacgtgtaaagcaaacccgaaatgataggaaatatatattg

SEQ ID NO: 535 - DNA, 8233 bp, Heterodera glycines
tttcaaaataatgttttcccttccctttcagcttgccgctttgcaatgagggatgtactcgcctggatcgagcaacacatcgatgagctgatcgacgataccacagcatcgcggcacgacacgactacagctacgactcgaaaccgcggatcccgtcaaggctctcgaactggctcatagaagatggtgatcaatgtgtcgctgatgcgttcatatgttctttatgtgtgttgtatatatgtatatgagtgtatattacgtcgctgttgtatcaatatttactgcatttgtcccgtatttcgatcaaatgactgtcatatttgtatttgtcatgaataaatgaacatcaatcatttcatatccaatttcattttaaaagtgtataaaaattaaaaagataaccatcatttttacgaacttttggagatggaaaaattttcttaggccatttttgagatattctgatcaccagggcttcttttttatgtaaaaaaatctcaaaatatgtaaataaaattaaaaaaaaaggctctagtcggttttacgcgtgccatcactagggatgggatttaagtcacgaaaaatctcaaaaaagtcacgaaaaagtcacataacaatgccaaaaagtcacgaaaaagtcacaaaaaatgcaaaaaagtcacataaaaatgccaaaaaagcactaaataagcccaaaaaaagtcctggaaaaatagccaaatgtaattaaacccaaaagccgttttaaacattcttcgaagaaagcaatttttcagtcccgtcatttgagtccttatgctataagaaatttaagttccgtcccgaagattgatttatttttcggaattttcatcacaaaaagtcaaattttgccttaaaaagtgtaaaaagtcatgaaaaaagtcaaaaaaacgcaaaaaagtcataaaaatcccaaaaagtgtaaaaaagtcaaaaaaagtcacaaaaaaatgtatgttagaagcttcaaacaaagtgtagaacacttttgaagtcattttaaggtcatttagagtcagcaaaaaaagtcatttgacttaaattcccatccctactgatttcaagacagagatgataaaattcttctattttactaggaacattaattctgctgtttgattttttcaaaaacttactatctatcaaattatcaaacctaatcactttttatcatttatataatgttttttaggctatcagggattgaaaaaataagtttgaacccaattttggacataggataggtgcgaatgcccggggcgcaaatgtggggtaaccttggcaaagatctctaaaataattatagaaatctctataattggatgttttgatgaaaaatattcaaaattaaaaactcatgggacgcgtaaaaatccatgggacgcgtattctgcactagaaccattttttgtggtgtaccaactgcactagtatcccggcttgtttcggcggctgtgttttgtcctattccggttttttacgttgcaaaatattgattaagcactcgttttatgaatttatgagcaaaaatcaaatacaacaatatttaaatagcagtctaacatttgggttacataatcgcatcaattaacaaatcaatcaattcatttctgctgtttctgatcaccactcggcccgggcgaaccgtcgagaagactgaaaataaaaataagaatttggattttaaaattgttaatcacccatcgccgactccgtcgtctctaataatgaaaatgtcaattcgattccatcgtttgtccaattccttaatcatctgctgctgtctcttatcatctggcacaattgggcaacgaatgatggaaaagccactaaaatcttcttctccatcttctttggacagtgccaattgctccccggtgaattcgttggtcagtttaaatggcataacggcagaaagtgaagaggacggcggaaagtaaacagtaatgacgaaattgacaggagaagaagcggaggaaaaagccttaaaaagacaaaaaatagaaaaagacgaattaaatcggacaaatcaccgctttgatttgttgaacggttgccaaccattgctgctccaccgctgaatcctcaatgcagattgtcagctccttcggcaacttgtcaggacgaggcaaaaacagccatttggtcaccgcttggccattcgatgcattggcactttcatcaggtggaaattcgatggaaatggggccatagaaagtgataacgcgaagggatggacaatcgttgagcattgacggagccaattggcggattggacgaagattgacggtgtccaaagccatcccacgaatggtgtccttgagcattggccaaatgttgagcacaatcaacttcgaaatgcgaacattcaccgtgaaaatattcaatgttgttgtacatgaagcgaaaaagcggtgaaaatggcgaaggaaaatgagcacattttggtcgatgaagctgaaaatcaaactgttatgggcacaaatcatttccaaattcaatttttactcgatcgaaatgcttttgaatccgatgactttgttcggcaacggattttgcgggattggcaatgctttttgatcagaattgacaatttccattccctttgcgcctttctctccagttttgcgttgaattttcatttcgcccaatttccatttgcgcgttttgaaatgttcgttgatgaaatagtcaaaacggtggctgatcagcgcaatgccaaggccaagctgaaagggcggcagcaaatcgaacaccgaaagccaacagtcggcagagatgaagctgaaaacggaaaagcaaaattattagcatagaaaatcaaatttagaatattacatcgctttttccatttctttctctgcttctttcggattgtccgacattttttggctggtaatcaaacagaatttaggaagtgaactgaaaaaaaaaattatcaaaaaaaaaaatgcggatggaatgaatgggctgaagaatatgactggaaggggatttggtcggctttatatactcgggtacaccaaggggtggggcgcccacagaaaaaaaccgcggccgcgcatcgcgcattcaaattgccgcggccgcggatcgcgcaaaaaaaaaccgcggccgcgcaccgcgcattcaaattgccgcggatcgcgaatttattaaaaatttttccaatttttaaaccatttaaatttttttttttggggggggggggaagaaataagcaattcgtaactttcagcgcatttgggatcagaaaatcagatttttaacaattttttacggcgcatgtttccaaaaagttttgagaacatgggggagggggagaggcccggcggtgccgataggcacggccgggaaatatttttcatttttaatgcgatttgttaacagattttgtccaaaaatgaccaaattttgcctcaatcttatattttcttcgtaagatagtgagtgatattctgactagagttgagcggtaatcggtaattgtaaaaaaaccggtaccggtactgaccggtaatgcaaaaatctgtacggtaccggtaccaactttttccacctgtaccggtaccggtaaaaaccggtaattttccgacgtaaaagatttttggacaaaatttttcaaatacgaaatttttactcaattttcacgcgagtgcttgttttgtaaacagaaatgtagaaattgacaggagaagaagcagaggaaaaagcctaaaagacaaaaattttaaaaaacgaattaaatctgtctagctatcgcttcgcgattgttggattccaacacatttttttgctgtgcacaaaatagtttaatagtttatacgtaaatttcaccgtattatttgggtagtggttactattttggatactgtgccattaatattgggcgaagggcaatcaattttttttttcaaattttcttatttttagtgataacttattattaaaatttttttcttttcacacttttggcagcaaatggagctcaatcgagcgtagacatttcaggcatcatttttcattaaattttataaaaaaagttgtctaaaataatttgcaatgtcctaaaatgtctgatgctcacaaagaaggtgtgttaagctcatttccaacacattctattatagcacacaaataaatgttaagcgcaactggagaattgtatcaatggtgtactgtatttttaaattactataatttcttcacaataatttaaagcgtgaaatggcacaggtgcagcttactgtaagggattacggtatctgattcttgattttttcaaagtacattgtgaatcctattgatgatgacagctttcaaacaatttaccgcttaagttaaaagtcattttttacggggagccccatttttcaaaaagtacagtaccatcacaaaatcgcaatttttccgggagccaaaatttttaataaatgaaaatgaggtagggggaggagaaggaggcggacaaaatgtaaataaatttcaaaaaagagtgacgaattcaaaaattgtgtttctttttgtccacaatgtgtttgttgctctctctgctgtcacattgatcaatgtcatctccctatgtacacatatcacaacattttgtcaatcgctttgcttgtccgtcgtctcttttcgtcggttgcgctgattttatcgccgccggcgattggatgacgacaagcgcaccgacgacgggcggcggcaacttgttgtttgttgttgctgctgtttgtgcccccaggggcgcgaccggccgccggcgacgacgacagacactaatttgttggcgaccgacggacgaccttcattagcaggcatgaaagggtcgccacagaccgccgccgccgcccccgtcgactgtcgtagtcgtcgtcccactgtcgccgccgctgtcgcgtggcgacggcggtggcgataattttgtggcggttgccgccgcttgactttgtaaagtgccgccgccagcttcactgccactggtgccaccatcaaaacttgagccttaaaagttgggcttatttaaaaaaaaattgaaatgagaaaaatatatgacagagaaaaggtcagaggcaaaattccggccgtcaaatttcggggaaattttatttttatttttttgcaatttttcatcgagatccaatggcgggatctctcatgaccatttgcaaatcccgcgggattggagtcactataatttttcgcgcaaatttccatttccgtataagattttggcactattcatcaatacgaaaaaataaaaataaaatattttcatttgctaatttcttagtaaattccttcagcaattgtgaaagcagaaattactttctgtttttgatgggagcgctttttcatcatcagctgcgtcagtcgtaatggttttttgttttttgtcgctttttggtcgcttttttggtggctcttcaccgctttcatcaatagacgacgccgaagaggacgacgaactttcgctggttgcgtaattcggaccggacagctgttggccaattagtgaaatgccagtggaactttaaaggaaattcaaattacggtcaagacacagattcggagttcgcgaaatacagtatcaaatacagtagtattgaagggctcaacagtgtcggtcgttaaatacgttaaatgctttttcatatgaccaagttcataattagcccaaaatgaattgttctcggctgctctacgttccgggctcccgaccgcccaccctttcgccgttaccgtccgaccccctggatcagaaaaacttggattttttgaacttttccttcgattaataaatgttagaaaactaaaaaaaatgttattttttgcgggggtgggagggaaacgaactgcttccaccacggcccagtcgtgcgccaaatataaaattacattatgttgccgctgatgtcgatcgcctttttgctcactgtaattggtttggcgattgttgccgccgccgctgcctccgcccattgccgctgctggtggtggtggtgttgttggcgagcgaacgccgccgcattcatcgcggcgacaagcagtgaagcggccgcgggagttgccacagtcgccgcgctgctcctcggcggcaccattgttgttgcaggcgtcgtggcattgttgccggcaatggcatccgttggcggcgcaaacattgccgccgctgcggctgccgctgctgtggccgcaacggctgccagcagtccaccactgccattgtcggcggcggcagaagcgcacgcagccaccgcggcgggcggcagccgtgaaatagggccaactgccgatgccatcatttttgggtccggaaaaatggacagtgcgcggaacgcggacggagttgcgcagtgccgtaatggtgggctggcggcgatgaagccctgctggggcggtggtgccgacgataccgccggagttacggtagttgccggaggcgtcatgccagcgtcggcgagttttgcgtcaagcaagctgttgttgccaaatgcacaggtcggctgtcgaaaggctgctatttgggatgcttttgtccgtgaactttggcccatttttgaaacaagcatacaccaacatttgaactttgccggtcataagcatttcgacattttgcgtcgtctgatttcaccgacaattctcactgatctcaacaaattgaattcaatcaattcggatgatttgttccccgatggaattgctgctgatgatgaatgatgggccaaatgcaactgctggcatggcgttgtccaagtgttgcacacaccgagaaaagaaggtcaaccgaaggaattgcatttttatctaaaagaaagaaaattatggttcgacaattacaaacaggtcgctaacatagaatttttttttcaaaatttctgttttccgttgaccaggattcccgagacaaaagttccgggaccgcgtcgttcctggtttccctcccgttcaaacacaacagttcagttttttctccgtgccaccacttctgtcagttacaattcggttgctccaatgcaaattgttgagccattcgaattggtgaacgaacggactaatgagaagctgattttgatattgatgccatatgaagatgaccgtgatgaattccttggtgattggctgttgaagcgatgcccaattgggaaggcggtggtggttcagcagcagaaagacgaccattttgaaaacaacatgaacaatgtcataattactttgtggcgtcctaattgcattgggtgagcaacaacagtgcaatttttgtatcgaaaaataattcatccaattcaaattgttgtactcaattgtaggccgttgtcgccaccaacggtggatgaagaagggggcaaaagcaatgtgcggaagtgaattaaaaatggcttttgtttgatggttctacactgaatctcctcaaaatgcgagaccttgggatttcacccgactaataattaattgtttccatttttgaggtgcccacaaatttggtcctacatccattccgaaccttgggcctaatacgaaaaattaaacttataaaatttcgcatttttggttccaaaaccggcttagagttgaatttgaagtgtaattaatccatgcattatttgactatccgttttttcttgtccgaaacaattggcacgcccctaaggggcgtattgactaagaaaagttatgtgccaaaaaatccctcaacaggcacatttatggcatttattagcacaaggagcacacacaaatatatacaatactatgcaatggcatatatatatacacaataaatacattatttacacaatctgttgaatatcgttgttgtatgcataatatcgtccatccgatcggtctgacttccttctccggtcgtcttagcgggggcgcgccggtgtccacaattccatgttttccctcagcgtttgtaggttgatcgatgcgtcatcatccaatggcaccgtcatacttgcaatctccgcctcagccaagtcaatagcctgaaaattggcggagaattaagcaagattatatgtacaatgatgaaaataaaagcattcgaattggtcccaccttttttgccaagttgcgcgcctcgttcacagatttcaggagatccgcgaggaacacggagtagttgagtacaaggccaagacgagtcggattgatcgctgcaattttggaggtggcgatatccatggcttttttgtaagcgcgcttt

SEQ ID NO: 536 - DNA, 2283 bp, Heterodera glycines
atgcataatatcgtccatccgatcggtcagttcggcacttccttctcaggtcgtcttggtgtggctgccgccctccggtgtccacaattccatgttttccctcatcatgcgcaagttgatcgaagcgtcatcagccaatggcaccgtcagtgtggcaatctgcgcctcggccaagtcaatcgcctgaaaacggggtgagatttggccacatttcacaataaaaggaaaagcatggtgaaaagcatcgaactggtcccaccttttgggccactttgcgcgcctcgtccaccgattttaagatttcgaagttgaacacggagaagttgagtgcaaggccaagacgagtcggattgatcgctgcaattttggaggtggcgatatccatggcttcttggtaagcgccctttgcgagttcgacgacacctgcggaacaaaaaaaaattatgatacgatcgaaaatatttaattttttgcattttatgagaatcaactttgaacatgctcactttattgggtcataacttttttttcatgctctaaatacaacagattttggtatccattcgaaaaacgctgaaaatgcatgatttgctgaaacatagaaagttatggtccaaaaaactgggggtgcttcaaagataattggactcataaaattctgaaaaaatggcggatcaaaaatgctgttaaaaattgggatcggacaaattctgtctcacccgatcggtccccatccgtcgccacctcggccatgtaacggtagtagtcggctttcattttcaggtagaacaccttcggctccgggtcggtcgctttcgggagcagcatttcgttgatgcacgtctgttgaacggaagagaaattcgggatgtacaaaaaaaatttttttaaacggaaaacccaccaaaagttcttggcaaatggtcaccaattcgttctgcacatgcttacgatagctctccatcacctgtgtttggggaaaaaaggggtcagtgacatttttaacggaaaatgtgccgccggggcctccaaatatcgacggtggcaccacctgatgttgtcgctcgttcatttccgggccggtccgcttctcgatggacaccaacgtgcgccatgacgaacggcgtgaagacatcgcacctctgtaggccagtgccagcgaaacacggtcctccaggccaagattggggtccaatttgatcaactgaaatgggggagaggggataaagcatttaattgatcatcaacatttgtgaaatcctgcaaccacaaccgatcggatgggatggatggccacacctttttcatcgcctccaccatgtcgtcgaagcgtcgcgccttctcgcacacgatgatcaggtagattagttggtcctttgtttcgggctcgtccgtcatggtgatgatgatgatggatggatggagctgataaggcttttccagattgtacaatatgtggtgggtgtactgaggcctttgaaaaatggggttgggatgtcagaggaatgatgacaaatagccgacttttactgtttttagagaaaaattgttaggttttttttgactttacaacattttgaaagaccatgaaatgataccaaaatgttcgctttggtatttggtcagttttgttgaaaggtttttgtggccgaaaaaatagtacaaaaggggaaatttaccaaaataaaaaatatagtgatgaatgaagaatggttggattatgcactgttcccttccttttatataaattttttttgaagcatttcatttttatgagtcaaataagaacataatgccaatattttacaattttcaaaaaattctttcgcgtaggattttttccgaaaatcggacacccacaagaaagccgggattgaatgaaaatagaatttcccatgggtctgaataaatcacgtacgacccaaacaaaaatgatgcacaaatatttcggatggcgtcgaatattcggccttttttcttccatttcattgactttgatgaggaatcgcattgtttttttgcatcaaattttgaaccctttggcatcaaaaagtgccaattttgctcctggcataaatttttggtcgccgtttatttgctttttccaatttgttactcaaaaatttaatatgaataaactaatctaaataaaatttttagttaacgtcatttttcgcaatcacaaacttacgaaaaaggtgctgctgctattgccgcaaaatgaggcgacgtttaaggaaaatgtaaggaattttttaaatgaatgaatttttttggcgcttt

SEQ ID NO: 537 - DNA, 3662 bp, Heterodera glycines
ctcattaatatttttcgcacacacattcttcagctgggtgtgcaacgacgtttggatggacatttttcctttttttcgtcctttccaactcggcctcaaaatggcattgctttcgccacgtttcgatgtgctgtggttgacacgaatttcaatgtcacggtcacggcattggcactttgaaaatggatgataatttgcaatggttttggaccaaagtcgaaggcgtctgtaagaactgatcactattttgtggactttccattgcccgatcaccatccgctgcccaacaaaattcgctttgatgaccttcatatatagtagctttttaaaatcttgtgtgtattaaagctagggttgccaactgaaatttttcaaaatcagctttgggggtcaaaaatcggcaatctttccggtggtttattggtgccgtcgatataatggtacataacttaagacgtgaataataaattaaatcattttgaaaacttcggaaaaaaacacatttggggcatcgtttgataaaatttggatcattattacagaatatattattaccttatcaatgcttaggtgtatttgatgaaattgaaatttttgaatttttttttaatgttcgggttcgggactcgaaactggttgaaaagttggtcagattcgtactcagcggctgaattagccttataaatgtatttttttttagaattttatttaaaaatcgggaccaatggaccggaagaggcgccgcaggaaaattttttttgaaaattttagtgcaatttaacagattttcaccaaaaaatgacctattttatgacaaaacaaaataaattttttgggacactgcggatcatttttttaacagattttcagtgaaaattggcaacaaaatgatgatgataaatcagcagagttggggcagcacccctcggcggattaaagcacttaattacccccctttcacttacattgaccattccgtgctcgaatttctccgttctaaaaagcaaatttttgacagaaggggcaccattttggagctgagtgtgccgttagagcagcacatttgggatgcttttgtccgtgaactttggcccatttttgaaacaagcatacaccaacatttgaactttgccggtcataagcatttggacattttgcgtcgtctgatttcaccgacaattctcactgatctcaccaaattgaattcaatcaattcggatgatttgttccccgatggaattgctgctgatgatgggccaaatgcaactgctggcatggcgttgtccaagtggttgcacacaccgagaaaagaaggtcaaccgaaggaattgcatttttatctaaaagaaagaaaattatggttcgacaattacagacaggcgctaacatagaattttttttcaaaatttctgttttccgttgaccaggattcccgagacaaaagttccgggaccgcgtcgttcctggtttccctcccgttcaaacacaacagttcagttttttctccgtgccaccacttctgtcagttacaattcggttgctccaatgcaaattgttgagccattcgaattggtgaacgaacggactaatgagaagctgattttgatattgatgccatatgaagatgcccgtgatgaattccttggtgattggctgttgaagcgatgcccaattgggaagacggaggtggttcagcagcagaaagacgaccattttgaaaacaacatgaacaatgtcataattactttgtggcgtcctaattgcattgggtgagcaacaacagtgcaatttttgtatcgaaaaataattcatccaattcaaattgttgcactcaattgtaggccgttgtcgccaccaacggtggatgaagaagggggcaaaagcaatgtgcggaagtgaattaattattattgtttgagaaatggccgattttatgctctcattttctttccaaaatactttgttgttggtttttctttagaatataaaatgcatacatttatttgcttgcctttttatgtgcggcatatatccgaacctcggacccgatttagaacaaaaagtcgaaaaccctaattttaaagggcaggtggcttgaaaataccgatgttttcaaaaatggagactggtgtgagaaaattggcagtaacagatgaaagccctaacgaaatcagtcatttttgagttgtgtattttagtacccttgctctgcgtgtataagtcgtagacaccatcattcaaaagtcaattcagtagagtgattcattatatacagttatccacgaaatacaaatattacacagtatgtagctatacaataaaattggtgcatttggcctgcgtcggctgctgctgagagagatgtcaactgaaaccgggacattttattgtacaaaattgggcggatatggtaaaaattgcagtaccgaagcactcataaattctgtgcacatctttgccacacgtcgaacatttgtacaacacttccagcgaactgtgaccatcttcgactgtaacgaagaaaattttcaaacggaaatcttccaagaaaaaatatttgaaaaatttttaagcgattttttttttgtaaaaaagccaaaaaatacgaattgcttttaactgatgacggagacggaggatcaccatttctggattaaaaactctttaaattcgaattcaaatggttcgggtttcatacatatacaaggggtgtctcagaccgagggtcacacgacggacgattgggacagggggggggggtgtctcgggtccgatttttcatacgaagtagagtgccacgggaccgggaatttttgcaaaaaccgggaccgggactttgccgggacctgagaagccgggaccgggactcgatttttttttgggaccgggaatttttaaaaattcaaaaaaattcaaattttaattttttcaactgaaaataatacaaaattaaatttttattttgtttttttatttaataaaatccaaaaattaaagctaaattaaattaatgaaaattttcaaacaaatttctttaattatttcaaacaattaatcattttttggactaaatgattgaatattattataaattaatatttgcttttcacatcacattttttcggcgcgctttttcaaaaaatttttaggaaagaaagggtccggcggtgccgataggcgccgccgggggaaaaccgggaccgggacctgagctgttcaaaatccgggatcttggatgaccgggaattcccggtcggcgacgaccttttttttttgctattcagaccacttttttctggcgaacttttttttttttttgctattcagaccaccttttttgcggcgcgttttttccaaaaaacttagggaatgaggtggcgggcggtccggcggtgccgataggtgccgccgggaaaattttgtgaattttgtattgttccgctaaggaaattgtgcaaattttaaaatttttcccccttcgttaatgtaaggaagaagctggctgggcggttaaaacgcggaaagcgggggttgataagatccataaaaagaaagggcggatgtgcctcggtagcttaatggtagagctgcccacggaaagggtgcatgagtgggttcgattcccacccgaggtttaacattttgcccatttcttattttaa

SEQ ID NO: 538 - DNA, 1432 bp, Heterodera glycines
  misc_feature (1407)..(1407): n is a, c, g, or t
ccccccccccccccctttactaccgcccccttacggcgaacgatggggggaggggtgtccgaggcctcatacgacgaggggacggaggggtgtctcgagactagagagcgggtacggaccggatccgtatacggatttttacggatccgtagtccgtaatccgtatttttttaggctgatgcggatttttacggagtacgggttttccggatttttagtccgtaatccgtatgtgtgcctagtccggatcctgatccgtacaatttttgatacggattacggatttttttaaactgaacttttgttgaatattatttttgaattttcattatatttcgtcaagctttgatataagtttgaattgataactctttttctaaattcttaacttattttcaacaattaatgaattttttgtttgatctttaaaaaactgaatttagcaaagatgagttcaattatttggcaaattgggttgtttaacaaattgcctgacgggaaagctgagtgatgaaactgctttggctccgtcgcccaaaaaacagaagctttctctttttgatgacctcaatgatattgcttcaacaagcaacaaggagaatgcaggcagttaaaaatttgagttttttaataaaaaatcatttaagatccttcccagaattcatctgacattgatgatgagctcaacaaatatttggagtggttgtgtaaattcgcgcgaggatccgctgacagcttggcgacaaatggcacccaaattcccaattttgtcaaaaattgcgcgcaagtttctcactgcacctgcctgccacgagtgtcccaagtgaagccacttttaaagtggcgagagacgtttacgattacagaaggtcgcagttgaagccagaaacagaggaaatgttaatcttattgaataaggcacttccaaatatcaattacagatattaaatttttcattatctcgcaattttatttttctactggtcaaaaaatgttatttaatatttgtaataaaattttgaacaaatctgtgttggtattacatttacaagtattttttattgattaaaaaaatttttcaaaaaatcctttgtccgtatacggatccgtattttttctggatacggatttttacggagtacggattttcaggatttttagtccgtatgtccgtaatccgtatggatgcctagtccgtagtgctgatccttatccgtattttcccaaaataccgctctctactgccaacgatttatcattagggatgggatttctaagtttttacttattttttctccggctttaactcaacgagaaatacacgaaaaacacattttttgtctgaaaattttgcgttttcacgcccttattcgaccttagaaatccttaattgtgatgttcgccctntaaaaatccttattttggatgttcg

SEQ ID NO: 539 - DNA, 5450 bp, Heterodera glycines
ttttaagccgtgggagatcacaatccttgagtaggcctcccaagcagtgtcagtctgtttagttgttattcttcttcttttttcatatctttgatgaacctatcaatgttaagataataattaatttttataattatttcattaatataatttaaattaaagataatttactttttatatcattaaatattcatttgttattcatataaaaattaatctctcagtttactctccattagtccccatccgttaatgtatgcttctccacttttgaacttttctgtgtattagagggttaagcttatatatatatatatatgcttggggataaagatatgggcggatttttatagttttcccatgtctcagttgtttcgagtatatccacggttttgaaaaaacaataaaaattagagggttaagctatatataatattttactatagtcaaagaaaatttttaaactttttaattcgttacattttgatttgtttcatgtttttatggtaatgccacgccaattgatcacataacattggcattatgtattattttgatcaatgctcactgtgtttttgtaactgatcagaaactgtgccattcgcttaagcagaaagtgatcaaatacaacacatacacgaattgttgaccattttttgtggaatgggacgaagcaaattgcttcgaaaagcaattcatttgggagcacaatttttggcttcatttttaatgggaaaatgcaaaattattattatttggtcagcatttttagtaattaggaaactgatgattcattatgttgataaggtaattaggctgggaaattttaattagggctttgcgcgatggacgtgccattcttatctatctatgcctatgccatctcttcggcctctctgcccagccccttcaaaaatgtgacaaaattccccaggaaaacgaataaacatttttttggtcaacaaaaacaaacaaaattattggcattttttagaaaaaataattatttaattaataggcaattaggggagaatttatttagcaaaatgtgagaaaataaatgtgtgacaatgagtttgtttaaagcgtataattaagataaagaaagcgcatagataagaagactttgattaagaatatgatggaagaaatattttggagaaatataataaaaaaaattactataaatgtgtaaatccgtgcaacatcagacgaagttgtttagcattgacaattataaaattaatgatttgtggtgacaacgaattaaattagtgcttttttgttcatctcaaaattgcataatttttaattaaatcatttcgaattttgaacaattaatttggttgatttaataaataaattaacttatttaaattaatcataatttttgcgatatttttgcgataaaatcggcggccaacaaaatatttgaatttcatagaaacaaaattcattcaagtgattttttaggacgagaatggataaattggcacataaaatgccaaaataggcaaattaaaaaaatgttcaacaagatatcttaataaaaattttatttgaatgaaaatttcatcatgcattttattttgggggattctttgcacatattttatgacaatttttaattagtaattaatttgtggcattaaaagcaattaaaaaagatcgatcaattaggtgccacattcaacaccagcgattcgctcaatccaacaaccgtcctgcggagaataaatgctcaccaaaccttatgatggaacaatttgaattaattttcaaaattctttaatttagaataatttgaattttataaatattaaaattgcttttgccaaataaggggtcacataagtgacacttgcaacgccaatttgcacaaaatttgtgccgttgttgcccaataacgcaccgccactgtcaccctaagaaaataagagaatttgagcattcaaggacaacccagcacatgtcctttatgtccttgattatttttttttgcgaaaatttcaatgtttttaaaattattataaaaattaataaattttaaaaaataataatttttaatcgaataaaactgattaactgtctgctgaatagtgttcttctcaatgcaaatccgttgatagccatcatttggcaaataagcgcattcacttaatttggcacttcggcccatcagatttaatgggcttttttggcgaattctggcacaaccatctcaaaaacaaaatcatttgattaattattgaagaattaattcattcattgtgttttaaatgttaaaaaatgatttatttttatttatttaataataatattattttttataattatataattgatacaatattaattaaaaaaaaattttcttttttattacccaaaaatattccttttgctattcatatattaaactttcttattgagacccataaaaatttaatggacttttttcgttactaataagtttttacttgaaaataaaataattttatatttttatttatcataactcattaattaattaattaatttttactctccattagtccccatcggcaatgtatgcttctcctcttttgaacttttctgtgctcttctctcaatgaatacagacgggaaaaactgttgacggaagagtcacccattctttcaactattattaattaattaattggttatttattatttaattatttgagtgcctttatcaatgccaaatcgttaaagccaagaccatttttcgtatattttggatggatgaacacattcaaattgatcacacgcgtcatttttaacaacaaaaccatcataatttgggctcttgaagactcgcgaatttgagccaaatcctttaaaaatgccaaattttattatttcaaaacatttaattaattattaattttgtttacccaataaaaatggctgaaattctttcattttgtcaaaacaattggcggctaacagaacgaattttggtgaaattaatgaagcagtgcatcttctgccgtattcagaatattcggtcaaacttgccataaaataaactgtccatggcatttgctttatgtcaatttgggcaccaccggaaatctgagcaaagttttaattgatttaataattgtaattttaactaattgttttaatacaaaattgattcattattattactactaattgaaaagtataaattaagcataatttgaattaaaaaaataataaattttattttatttttaatgtttatagatttaaaagagaccataatttaggataatttttcgttaaaaaataaacaaacaattcaattaattcctacgagtggcttaatgatttgttggcgaatggcacgtggcttttcaaatgccaaatgatcaaaagttgcgcatttttgaggtgggccatcgacacgaattaattggcatccattcgccaccataaacacaaattttgttggcatttggccaaactttggccaaatgtctgctggcaaaagccaaaggccggcaaattcttccaaaaatgggcaagctttgattcggcgaaaaattctgagcgcaatttcatttgttttggcgacactaaatttaatgtgaaattatttttggcatttaatgagggcaataaataaaatacctgtgttaattatgaatgttttgttcgaatttgtaaattttaattccaaaattggcaatgcgcgaaaaatatcttcagctgatgaattcctaaagaataaaagaatttttgtcataaatatgtcgagaaataaaaaatgaatgaatatcattttaaaccatttgtaatttttcggtttttttaaaaatttttaaaaatttttcctttgttgaaaataagaaaaatattttaaaaatatttttgtttaaacattttttaatctttaattatttttttctgttgttttttcaatgaaaaatcgttcataaaattttgaaatttaatttattttattattcgaaaaattacaaaagttattgaattttttggtgatttttttgtaaactaatattagtttttatatataatttagattgttaaataatttcacttacgccgataataaattgccattttcaattatttcttttccgttggaaagtgaaaattgaattttcctggcacattcttctgcatttgtcttttcagtgaatgttttgtcaaatttaaatcttttcgccaatttccatggaaacttttgttgccaaataataattcacttttgtaacacaatgaaaaacttaattagattaattaaagcaagttaattaataaatgcctttaattagtttcaattaattaccttgcataattttcatgaatttcatatttaacttttaatgtgcaaaatggcttaaattccaacggcactttgcttaattgcttacagattagtaaaagataatttaatatttgataataatatattttattttgattacattgtgccattggcattggaaatagcgaaaagatggacagaaaagcaaaaaataacaaaattggcaccccaaaccattattaattaattaattaatatggcaccaaatcatttttattgcttttttatttatttaattaaaaaataatttgcacatttaattaacataaatcatttttatttgtccattttcccagtaaataattatcataaaaatatttttttttgatcattttcaattagtcatcagcacattagcagcagaaagaagcatttgtgggatggaaagtgaatgattcactaaaaaaaggaaaaaggaaagtgaacaaaaaagtgaaaagcattcattcatttaccatttattagtcaaaacaataataaaataaaataaaacaattaattttcccaaatatttaagataattcaattaattaccaaaaataaatggcaatcatcggcccctttaatcatttggtgtcaattgccttgctgttgctgatcgccatattcaatccatgctcgtgtatcaatgattaattagtccaattaatcaaataatcaaattaaatattatgagattgatgagttcggttgggtaattagtgattaatcaattcattaattaagcattgatgtgcaaaaggggctacaccaatcaccgcatcggtgaaaaagccagcaatttggaatgcgagagcggtgctactcactgcttttctgtgatttgcatggagcgtaagaaaaaaataattaattaaaaatttcaaaatgatagggttagagctcgacaatttgaaaaaaaaactggagagatttatttaaaaacgtattttcttaggaaatttttaaaaataccaaaaaaaatttttcctggcaccacatatcggcatcgcctgacccaaaattccgcttaattttttcaaaatcgaacatcggccaaaaattccgaaataattttcatgaatctctgacgaggaacaaaaattaaaat

SEQ ID NO: 540 - DNA, 3777 bp, Heterodera glycines
ttaattttttcaaaatcgtacatcgtcacaaaaattcgaaaaataattttcatgaatctctgacgaggaacaaacattaaaactggtccctcatagagggggaggggggggggggggggttaagcctccccgaagccaagggtttggccatgcctttcctctgtctggtccatcataatatagaataataatgattactaattatgtaaatatttatggaataggatcccccccccccctcccccggaaccctcattagcaagctctgttttttggaactaatagatttgaatttaattttagaaaattttacctccacggcactgctcacctggggctgtagtgatgaagcggataaaaatgtctgcgaagaattcttcatgaacgcgtccaacaccgcgctgcgctcgacgaagcagcgctgcgagtgccaatttggggaccagggaaaagacatggccaatgagcacgtgaaactgcccgaggcggagaagcccggcccaattccgaccattccgccatcggcactgaacaaaagtgggcgcaaatgccaaaaaatgttgcataaaaattacagggaattgtggcacaaaaataatgagaaaaataatgtcaacggaaaatggatggggggatggcacgtgaattgtgccatggaaaatgagggaaacagtgtcaagaattgcataaatgtcacgaatattctgccataaatgagcaaaatgtatttgagcaatgccaaaaaaaatttgttatgaaaattacagggaattatggcacaaatagtcagggaaagaatgccaacggaagatggatggggggacgtgggtgccatgaaaattgaggaaataaaatggcacgagtattatgccataaaagatttgaccaaaataagcttttctgacataaaagaatcacaaatttcataaagccaagcttgagaaatatgagaatattttaaaatttgttcatttgaaaggcatactctgcaaaattggcacttatcatgggaatggatacggtgggactgcggcgcgggaatgtcaaggcggcgagcactgttacgcggtcagctgcgtatccggtaaatatgtgataagtgataaaacactaattgttatccatttttaatcaatttatttttgaatattttttatattcttaataataattaacatttgtataatcgagcaatttttctatcgatcaatcaatcaatatatttagttggctattcaaaaattttactaattaacacggtaattgaggcaattattactgatattgaccgattgattgattgatcggttgatcatttattgattaattttatccattctctccgctttcacaggctctgacaaaatcagcttttttggctgtcacgataacacggaatgtgagccgctccgcaaattcattgcttatggccaggattgccagtgccgatttggccccaagggcgagaatatgtccaatgttaattatgacctgccaaactatgttccaaaaattggcataggttagaaggggaaatagaatttaatagaccagaattattgggggaaaatggccaaaatttcgccgcccaaatcttttttttttaaatttgcaaacagaaattttacaagaaaaaaatcaaatttttttctataagactacaagaaaaaatattgttagtttttagcgatttttgtaaaattttatgataagttactaatttcgtgaaaatttttcaaatttttttcttataaaatttctaaaaaaaaattttcttgaaaaaatttctaagtttgaaatttttaggcggcgagatttcgagaggcaattttttttgggtgcacccaaattattaattaattatgaaatttatcataaaaatctcaaaattggacaaacagtaaatttcatagtacagaatttaaaattagagagcaaaaaattaaatcaatggcaattctttgattaatcaaaaataaggtcagataatctgtgatctcgagattataacttcttttttgtgcaaaaaatgccctttctcgggacacggatattgaaaagaataaatcattaaaaaataaattaaaattttaaatttggacagacattgtcttcagtgaacttccgatcccgaccgggtacagtacccgtgcaaatgcctaccttttggttgccttctcttcaattccaattggtgcctaatgaacatttgattaattaataatggaaaatatcaaaaatgctattatttctcaataaacaatcgataacttttattttatttataaattaattattatttatttatttgttttaaggttttttgaccaaattccttctccgcgcaatggtgcgtgttcatgaatgaacggcagaagcttaggaaggaagaagaaaggagaagaaatgataaagcggccaagaatttataattaattttggattaaattaattttcattttttaatttgataatttaaatttttaattatttttatttaatttaatatttttaatatttgaatcacccattttcctaatgattattttagcctatcaaaacattgcacagaaaatgaaatctgtcctcccattgtcactcttcttcttcttctactgcctcgcctttccatgcatttgttacggtaatttagaaaatttaaaaataattaaaaataaattttcaaattaatttcgcagggatccattgcaagactggaatgtacgacacgtcgggaaatgctgctattgtcatctctgaatgcgcagcggatcaccacttctgttctgcaattggttgcgcaatcggtgggccactaattacctaattaaccaaaatttgattatttaattgtcacgctttaggcactgaacagatcactgttttgtggtcttgtgagaagcaaaatgataccaaagtgctcgtcaagagagtatctttcgagaaccacacttgcatggctcagattggccagaaggatgccaacatgtccaatgaagagttcggttttcccgaattggtccaattggtcttgaagggtaattagcaaaaaaaaattttttgaaattaaatgaaaaattgaaaaaatttcagatttatcgacctaatgtgagtagtgtctgccctacggatgtttcgtcattgtctaaccgttcttaaaattatgaaccagaaaattgtgatcctaaatcttctaatgtttatttatttgatgaaataaataaagtgatcactgatcgttcgttccattttaattttatttttttgcttaatatgccatgctaaaaaatataatgtcagagatcgaacggaatgccaatttcaattgccagtttctgacacttttcgaaagcagaaattttcggcaatctgctttcgaattggagaatttattaggatgttcgagagtcttgactcgagaaaagtctcgggttttttgggtctcggagtcgagagtctcggggtcgagtctcgagaaatttttggtctcgagcatcactagaatttatattcagtcaaattaatattctatgatatatataattcaaatatgtctttatcagttcgtcaccgtcgggccccgaattcttgagtttttttgaactaacaaacacttaaaatggtaattgcctgataattccctcggcttctccctcaagaaattctaaaaattagcataatagcgagtcaagactcaagaaaagtctcggggtaatggggactaaagtgtcggtcaagactctttagaaatttcggtctcgagatgaactgacgcat

SEQ ID NO: 541 - DNA, 1839 bp, Heterodera glycines
acagtaagtttcatagtacaaaagtgaaaattatcgagcaaaaacttaaatgaatggctaatctgtaattagtgtgatcaaagataaggtcagagaatctgtgatcatgagattataatcttgtcttttttgtgcaaaaaatgccctttctcgggacacggatattgaattgaataaaagcatttaaaaattaaccaaaaatttaattttaaaatttggacagatatcatattcagtgaacttccgatcccgaccggctacagtacccgtgcaaatgcctaccttttggttgccttctcttcaattgcaattggtgcctaatgaacatttgattaattaaaaattcaaaatattaaaaatgcgatttatttctcaataaacaatcgataatttttattttaattataaattaattatttttaagttaaattgcgactttttagacttttttttgctaatatttgaaagaaatgctgtatttttttttaataaaactgcaactcttttgaacatttgttttgggttcaaatagtgctaggtcgtttattcattccgccaaggggggcggtaggggtcaactccgtctggccaactccgtctcagcaatgttcaaaaagctataacttttttctttgttggccaaacttcacaatcatggtatggctaatagagcctgtgaagagctttcgaatgatatcaagattgtttgattcggtcaataacttcaagagttatattgactcaaagttggctcagacggagttggcccgttccgcaaggggggggggtaggaaatcaaaaaatatatcccataaaaattcataacttggcttaaatttagccaaattaatattttatggtataattagtagctctatgtgttctctatcagaatattttttaattacttttgcgcatttggacttttcctagcacctaattgtcaagtacataacgggcattaaaattttataaaaacgtaatgaaaaaagtgaattttcttcaaaattttcttttacctattttgtttatttcaatatttaaatagaaaataaacatggtaaaagtttccatatttttttccattttttatgcctttcttcatgtgattttgattactaatttgaagtgagttatgaattttttaatttttcactaaaaacaccactagaaaaaatcataaaatttttcaaattaatggtaaaatttataagaaaataattaaatatattttcttaacttccatatcattgactgaaaaaaaaatttgaaaatttttagaaattttgggttttttttggggggaggggcttttattcgaagggggcttttactggagggggaggaggccgagaacgaagtttttttttacatcccacatgatttactttttctgataaatttgttaaagtaagccgaaaattgcaattttccctcggcgtttcccttatttaattttaaaggcggacttgataataatgattcaaaaattagaataatatcgagtcaagactcaagaaaagtctcgggctaatgggaacgtggacttgaatctatagtcaagtgtcggtcacgattctttggaaatttcgatttcgagcagaactgacgcatagcttcggagatgaagaacgtcgtacccaacaactgtttaattaactaatttttgcaatatgataattttcatactcaatcactcgtttaattgattaataattaattaattaattgaattaattatttaaaaaaatatattttatttaattttttatttttgcaatataataattttcgtactcaatcattcgtttaactaattaattaattaaagtaaaatat

SEQ ID NO: 542 - DNA, 1039 bp, Heterodera glycines
tttcattttgtccattcgctttatttttgttcattaataaatttatttttcacaattcgtacatttttgttccgttcaattttaataataaaataataaaaaaaaatttttttagcaaaaaacacaaaaaccccccaaaaaaatacccaaaaaaaaacaatgtctcgacaattgcccctaatcatgttcgtaattgccctccaaattgggtttgccgagggcggctttttctcagccgtcaccgacttcttcgacaatgtaagttcggcacttttttaaatgttttcattcggaaatattcattaattttgtaaaagaatttttgggttcaatttttggacaaatttaggtcgcttcatcatgcatctgacatatttttcctataattcgaaccctgccccaaggccgaaactcaatcaaattcaaatttcacttttacattaaagtgtggcacataaaataaacagggacacactgattcgtgatcagcagcgagactcgcttgattaatttttgtttattttttgcggaaaacacaaattttgcgtgaaatacaacaattaaaaaatgccgtaaatgtttgatgtttcctaaatttgagaccggcattttgaaaaaggcatgggcctggacctggattccgtgttcgatctgggcctgagcttccttgataaaaacccatgtccagaggccgatctctaatttaaatcattcaagcgatcgcttcttccgctttgcgttaaaaacggggacataacggcaccacccccctcactttcaggttggccagtcacttgaaaaggcctggaacgatatcaaagaacccatgctggatgccggggctctttatctggcaccactcagctccttactgccggtgacaagttttggtgcattagttgcacttgtgatcgagaaaggggtggataacccacacggaacgggcacagaattcgcatgcggcccgaacaccaacgccattttcaaagttgggaaaaaagcattatacataattcaaaagtacaggattccattttta

SEQ ID NO: 543 - DNA, 5527 bp, Heterodera glycines
  misc_feature (2819)..(2819): n is a, c, g, or t
  misc_feature (2915)..(2916): n is a, c, g, or t
  misc_feature (5316)..(5317): n is a, c, g, or t
  misc_feature (5400)..(5400): n is a, c, g, or t
cccaccaactttcaatgacattccaatcgctgggactcaatccaccagcatttcaatctttagggactcaaatctccggcattccaaacactgggactcaacccaactttcaatgacattccaatcgctgggactcaacccaccagcatttcaatctctgggactcaaatctccggcattccaaacactgggactcaacccaccaactttcaatgacattccaatcgctgggactcaacccaccagcatttcaatctctgggactcaattctcaggctttccaatcactgggactcaattcttatgctttccaatcactgggactcaaatctccggcactccaatctctgggactcaattctcaggctttccaatcactgggactcaattcttatgctttccaatcactgggactcaaatctccggcactccaatctctgggactcaattctcaggctttccaatcactgggactcaattctccggcattccaatcactgggactcaattcttatgctttccaatcactgggactcaattcttatgctttccaatcactgggactcaaatctccggcactctaatctctgggactcaattctcaggctttccaatcactgggactcaattcttcttatgcataccaatcactgggactcaattcttatgctttccaatcactgggactcaaatctccggcactccaatctctgggactcaattctcaggctttccaatcactgggactcaattcttatgctttccaatcactgggactcaattctcaggctttccaatcactgggactcaattcttatgctttccaatcactgggactcaaatctccggcactccaatctctgggactcaattctcaggctttccaatcactgggactcaaatctccggcactccaatctctgggactcaattctcaggctttccaatcactgggactcaaatctccggcactccaatctctgggatcaattctcaggctttccaatcactgggactcaaatctgcggcattctaaacattgggactcaacccaccaactttcaattcatatggtcagacatttcttcttaatatttaatgacaaaacaattttaaaacttacttggcaaacgttaatacaaaaataagtgtaaacaaatagtcatttattaataaaatcacaaatcaaattaaaagtcgaatttttcagattaaaaaatgaaaacaaattcaaaatcctatgcttcttcaatgcaaacaaatcaaaaacacgccgctctttaactatcaaattattttctcaaataacaaattcatttataccattaacaaattcaaatgaaaaacgcgaacaaaaaaatcattaaataatgtagaaaagtaaaagtaatttttctcataaaatcatgaacagccattttcattttttgtttattaattattttaaaataaggaagagatgcgagacaaatttcccattatctctccctttcctttcttttactctcttttcttttccattgcaatttactctctttttttcccactccctccttctcccacacacacgcacgcgtccaacagactgctgctgcacagcagcacgcgtctgttcactgtatgcccctctgatccgccgctgcccgcgtagacagacaatcagacagtgcactattttcccacctttccctcgctctacttttttcaaatcattttttaacgcaaaacaattacaaaacgccacacaaattcaaacactggacacacacaacagacaccaaactttttatataaggattttgttcatgctaaaacaaaccctatctttttgtatcattcggaagcaacaagtaattgatgattatgattaattaatattgttgatcactttcgtttgtaacttcctttaaatgttagcattctgttgttttcccgtattattacattgtttcagaatttgtgattcgaatttcgaatgataaaaaagataagtttagttcgaaacatgaacaaagttattgtataaaaaccaggaatggttaattgattggacacataaaatgcaatagaattaaaattgataaatatgtattatgaacaagattttttttaatatggataaaaattgtatctgttgggttggttagtgattttcgtgttgaattgtatgtctttaaataaaatttgagaacatttatatacagtcatggtttcatatgcttatggacaaatgccaaatcgagaaaagaatgggtgctatgccgtaactcaaaaaaccacatcaaaatgaaaatttttgacccaaaattattcataacttcgtccaaaatgaatcaaaatttataaatcttgatattattcgatagccctaagtgtttttttattatatttcaaaatttcaaaaacttttgctaagttgaaagaaagttatgaccaaaatattgaaaaaactttgcatttgagcatctcaggtcataacttttttaaagcttaaagaattttctgaaattttgcaggataatagaaaacatttggggctacagaataatatcaataaaattttaattgacttaagcaaagttatgggaagttttttgttgaaaattttctatttgatgattttttgagtaacattttgattttcgttatattcggatcattcaaaagtccttgatgctctattagccttacaaaaaagcctaaaaattttctagtatatagaaaagttcttaagaaaatattttaaaaatttcgagtttttagttcaaaacttgggctggcgccgaaacaaccccacaacccgttgccttaatttctgnaacaataattaattttaaaaaatgacaacaactgagtgaatagacatagtgcccatattttatatggtcatctatttatgtataaaatttttattnnttatgaccaaaaattatgaaaaattcctgctaagctaacttttgatgctaaccgaaaaaagccttttgcagaaacttgctcacatatcactccttcatagtgacggatacactgaaaattgggaaattttgcgaaaaaaattctatgatgaccacctaaaatggcctatgcactcacatgttattttgttaatgattattatttcaaaaattgatttatatgataaaatgaccataaaaatgcaacaaaaatatataccaaaacattattatattagttcgtttcaaattcattgaagtcaaaaagcaacaatttttctaaatttagtatttgtccatgacctatgaagatgtctgtagaataaagcataaattcaaaaaaaaatcacttaaatattcgaaagatttttaagttttttgtccgtcgtattcatcaattttttaaccaaattttaatttaaattaattagatgttctgcaccaatgctgtgtaacgcacgatgcgtgagtttgtcaattaattgatgacataattattataataataataattgtctatgtatacaacgcatgaagtatacggcaattattggtgtaattaactaatgagttgtaattattatttataaattgatttttctgattttttaattagtttttctgttccatttagctgctacggtatctgcggtgaatcgcagcaaaactgcgacgaagtcttctgcaagtgcctcattgtatgttcatattttttaattgttcaaaaattaaaaaatgattaaaaaaactgtaggaaagcacaagttttttccaatgcggccccacggcacggtcattttgtgttttggtgagagaactcgggaaaaaagcattcgacgcggggcaggtagtaatttggaaaaattaataattatattattattattattaatattcaatcaattaacatttacaaataaaataattgggaaaaaaataatattaaaaaacaagcccggcatctttagccattttttgggattcttcccggcaccatacgcttcaaagttcgagagtctcgttctcgagtatcgactcgagaaaggtctcggatattttggtcacagtctcgggtgttcagtctcggtcatcgagacttccgagaacgagacattttttacaccccctaatgattggcttttggtatatttaaaattaataatttttggttattttttgtttcttttcctttttccaacattcctggtccggtgggctgtgatgttggttttattcattatttttgcgttgatttatggtgtaatgtaaatcttttaataaataaggccaaaaaattacacacattttcactcatcggcgcctctccctgaatttttcttaaaaattggtctaaatcgcaaaatgttgtcattttttgattaaatctgttgactaagaacgctgaaattttcaaaattttcactatcatcagtagggctgggatttttaggcacaaaaatcgcaaaataggcacctaaaaaggcataaaaatcgcaaaataggcattaagtaggcacaaaaataggcaaaaaaattttttttaacgctttttaggtagcaaaacacgtaaaaacttaagcaaaacatttgcttatatttcatttgttttaaagttttcggataagaacaatttttaaaccaaaaattttaactaaattctggggattaatgaaaatctttttcaattcttagtggtgtattttctgaaaattttccatgtcgattcttaggggtgtatttttcattttgattgcatttttattaaggattttcccgaaaatgctgaaaaggcgccaaaaatggcgaaataggcacaaaaataggcaaagttaggcattataaaaggcatcgtagacatcccaaaccaagcggaaaatgcttttttcgtgcttatctgttcgtattaagtgcgcaaaaattttaagcatttgcctaaaaatcacagccctaatcatcagtgccagatctccaaaattctatctattttttaactgactcaaaaaccccttaagtattttgaattaaaagttttatcgaattaaaaaattgcttaagaaaagactcaaaaaagaagttttaaattttatgcgtataagaaaatttttgaaaaaagtcttggggtttcggattttttggtgtcggcctcagtctcggtctcgagtctcaggaaattcagtcttgagcatcactacccaaccatcaaccccggcattttggccattttcggagtcattcacgacaccggacgcttccaccagcacaaatctcgaccctaaccttcaatccatacattttgccattttcggggttattcccgacaccaaatgcttcctgtcccggcggatcccgcccgttcctctgnnctccggctcggagtcggtgttctctctctctcctttggtgggcttttttgtgtgggtgatgtcgtttggtcttgttcggtggnctttgtttggcctcgttgggctgttggtcctgagtcgttcctttaaagtgcgctgcggtttgccctcctttcgcttttccctattaaaggtactttgttttatatatttttacataaaatatggatg

SEQ ID NO: 544 - DNA, 1821 bp, Heterodera glycines
attttaataaaaatatttccaaataaaatttaattctaaaaatgtcccccaacaaattcgcgcttcttcttttgttgatttgcttcaacatttctgcggccaatggatttaaaagcccattctccgagctcaaaaaattctttgagactgtgagaaagaaaatttgtgagagcttagccaagaaaatgaattagcaaatgtcaaatccaagaaaatcgggcatttaattagaaaaattcacagaattatccaaattttaattgggcacgaaaacaacgaaattagtatagaattttcgaaaatcttgctatagtcaattttttcaaatcattagtgccaaataatttgaccgaaaaagctcaatgatcagagcaaagaaaatttcgggttttcattaaacaaaaagggttctctaaggtcccattttcctcacacttttccccctaatttatgcttggctaagctttcactgatcagaaaggatttcctgatcaaagtctcattctctgtaggcggtctctttggtggccgagaaggccaaagaagcggttgaatttgtgaaatgcactatttgggtaagaaatccacgaccataacaaatcagagatatcgtattaactcattaaaattacacagcattttaacaaaatctcgagaatttctcgagtcaagaatcggtcgagtcgatgataaatattttgaaaaatttttttttttaatttttcattttcatttacaattttattttattttatttaaggaggaagcgtgccagaaattgtgcgaaggttcgtgccttgacccgcaaaaggcgtaagttttgagttgtaatgccaacataaattcaaattttaatgactgaaaagatcataaatggaactttaattatttattcaaatgaattcatttagctgttactcgaaatgcggcaacacgaagcaacaatgtgatgatgagtgcaccaaatgcgcagtaatttttgaaatttaatacattagaacaattttatcaaatcccgggtccactcatcagactataattgtgctaaagaaatttccaaaaaataacatcgtattgtaaaaattactatttttaaaatattgttattttattgcttgaaaaatcaaaaatgttaataataatatgctaattaaggtaattaaggacttttattatttaaatatctattaaaatgaaaatattttatagaatggtccgctatccaaatgtaagggcaaatccgccgatttgtgcttcccgagtgggcatgagaaggcattcaaagatgcacaggtagtaaattatgaatttagaaaaagaatactacgaaaatatttataaaattaactggtttcttgttttgatatatctcttgttaatatggatgaatcggaacgcgtcagatcggccccggcacgtttgggccccaatggcctctcggccatgatgcttatgctcgagccgcgcacagacgatgattttggtacaggggggggggggctcgttgtcaaattgtttgggctcaaatttcggatgttgcattcaaaattcaaaaattctcgagcctcgactcgagaaaaagtctcgggttttttagggttcgagtctcgggaaattttcagtctcaaaatacatagtagtcttcagttgaccgccttcactatttgtacacgcctattgtgttgctgatgttcgctttgttggcatccgccaaaaattatgctggccatccaattgaatgttttgtgcctgcatattttacgcgtgccatggagcagtacagcgagtatgaggaagaggacgggacgggggggggggggt

SEQ ID NO: 545 - DNA, 2751 bp, Heterodera glycines
gaccgtaccggtgcatgtgtgattctaatacatataaagctacaaaatcccccttccagtctattcttcaaaattgaataaaaaaccagggatgtacgaaaagagagagaggggaaagggatgagaatgagcgacagggagtgagagagtgtgagagagagagagagagagatgagaaagagtgacagagagtgacagagcgagagagggatgagaaagagcgagaagaaaaagcaacagagagtgagagagataaagggaaagggtggagaggagctcagaattgcaaaaatgacttttgttcttttttctgggacttaatttttataccgtttgatcaaaatcttttgaaatgaacggagcggttgcgctcctataggctaaaattccaaaaaaacccaaaacttacgagccttaattattataagtttctacaaatttagaaccagagctgtggtgtactgaattgtgaaggtttacaaattatttttctaatttttcaataattttggcaaaaaactagggatatacgggatcgggaccggggcgggaattcccagtcctccgaggtcccggtcccggatttacaaaatctatttcccggccccggtagggcaaacgggaaccgggaaaaataagcactggtaagaatggtgggtctgagtgaaaaattagttacgaaaattggagttaaaggaaataaagttaaaaaaataattaatatattgtaacgctgcaaattgtgcgaatggcctagtggctaatcgtcttgactttcccttcttctttcccctggttcaatccctctacagaaattaaattattttgaattttctttttatatactcatggggttcctatcgacaaaatatgattgctcatttgtcagcgttgttttttataaaataaaatttgaattttttaaatttttttgaatttttaaaaattcccggttggtcccggtcccgaacaaaaaccgaggtcccagtccgggttctcaggtcgcggcaggtcccggtccctgttttggcaaaatttcccggtcccgtacaaccctacaaaaacctttaaaaaattttaaatttctggcagagaattcaatttgattaataaaaagaaattgaaattgttttatagaatataaaagcaagtgccttgctgagctaaaaacgtaagttatcatttattaaatgacttacaacaaaaaaggggattaatcaaattttaattaattttttctatttagctgctactctgtgtgtcgcggcattgacataaaggattgttacgaactgaagagaaactgctcggcaaattttaaatttatattaaaaagataacaaagctaaaacaaagaaggccaaaatttcggtgatttcgctcatttctttcaaacttttgagtggttatataatttataaaataaattaatttataagtgcgaaacaaatctttgcagaaacatttgtggaaaatgggctggcgcgtgtgtgggccagtagttgtcttttcaatgcatgcaaatcaaatgcacgccgaatacgaggtgcaattctctaagaagttttccattgtgatgattttttcctgctgttttgtaattctttaaaactttattttttcaatgtagaaaagatgcgagcagcagaagaagaccttcaaacaaattccagccgatgaattattggttggtttcaattagattcaattagagttgtacggcacatgggtctcggtctggattgtgcccggaaccccggctttttcgggtcgatattctgggcccgctctttccaaaaaattcttaaaaagattaatcattttgtgcaaattttcttagcatttcaataaaatattttttaagcctgccaagaaaccacataaattggcaattttggtgcaaaattgaacatattttttaatgttaaaatgatgcttaaaaattaatattttttattaatcacggaaatacccgatcccggcttttctggtttcggtttcgatcccagtcccgggttttccccggaattccgatccaatgttagggatggtcttggatagcagagtttaatttttcaaaaattttcattaactgtatcgaaatttttaaatattttctttttaaaagcaattgtaatattgcaataatgaaaaaccttttctttcattcaaaccatttacttttcacctttaggagaagcccgaaaatggtcagatggagaagaacgcgggaatgaactcctctgatggtgaaattagatttttaaataatcaatcctttaaaattttatattagtcactttaaaaattagaaattagctttgcatataaaattacgaaacatggccgtaaaaaatagccaaaatccatggatatccaaaaacttggacttaaattttgtataatgccaaaatatggtaataaatcttgaaaaatttaagtctataagcttctaaccaagctaagaactttttatcataccttcgacagtttaaaaaaaagtgggaggattacaaataattttcggttttatattaattagccatttaaaataaataataaacatttatgtgtaaattatatttcagtgccgccaaataccaccactaattcttgatgccattccgttcccctcaagcggaggagaatgaagaaaaggaacaacaaatccaagtcaccaaagccataatcaaatcctgaattcgccataatcatctccaaatccgcctccgccataatcaaatcccgaat

SEQ ID NO: 546 - DNA, 1576 bp, Heterodera glycines
  misc_feature (1476)..(1476): n is a, c, g, or t
  misc_feature (1534)..(1534): n is a, c, g, or t
ttcctttttacttttgtactttttctgaagcatatttttggtccaaattgctaaagctaatgtaaatttggccaaatatcggagaacgaagagaaaagtgagtgccgaaagtgcggccaaaacggccaagtcgaagttgtgcagctgaacccagcccatgtgccgagactcgctcaacagctcgggaaactgacccccgttcatctccaaaaagcgaatgttcttcaacagacgctctttggcggtgaaaggctttaaaacggatggcacaaactcaatcgatagaaaatgaattacaaaatgccaacctttgttgccaacagtcgatgggttctttttgcgttggcagcgtaactgtaaagggaatactgtaatcccatatggtatttgataatatagcgtaaattgcctttggtcttccaacaccttctgaatggctgcacggaagttttcgctgccttccaataattgccgcttttccacaacctttccccacccattgcgctcggccacccgtccgtttcggtgctgatcagcgaaaaagcccatcagaaggacgggcacacccgcattagccgcctccagcagactgttgaagccgccgtgggtgatgaacagacggagacggggatggcctgggaaggaacaatcgaatgggaaatgaacggacaaaatgccgaaaaccaggctaattaaatagtcgttttaggtttatttaaaaattttagcatgatcaggactgagccaaaaaattgagaaccaagaaaaaaacaacatgtaaaaacttaccaagaatgtccaactgaggagcccaagaagtgaagaaaacattgtccaaatttttggccaaattttccgaatacttaaaaagacgagttttctgttcacttcacttcatttttacattgtcatctttctccactttgacaatgaaatggtagtttttaagttgggaaaaagcctcgaaaatatgccgtcgaaagctctcgggcatgtcactgctgcgcataatggaacccatggagaaaaagaccactccgtcggtgcctttgcccatttcggcgagaaagggttccttttgggagtatttgccaatttaaaaaaagcaatcggtacttttagtgcgatttgtttcgtttttccgtcatggcttttctccattccaagaccaccgatataaatgacattggaaaaaaggggacgaggaaagtccacaaattcatcagaagcaacgaaaatgagcggcgatttgctgacaattgaacgaaggtcgggaaaagcatttcttaagcgtaattaatttattaatccttctaattaattactttttttaattaatcatttcttttaaagaaatgaaaatatttaaagaaatccacccaaaatgttttcggaaaatttgtgtcaatgggtcgatgccaaaactgagataattgtagccggcgaatttgtgtagcaaattttggaaccgttgtnaaagcgacattttgtcggaccaatttgaatccccatcatgaggcacgaaactggaggnaaaacgaaaggtcatcagcgaagcaaggtgctcttggaggga

SEQ ID NO: 547 - DNA, 3383 bp, Heterodera glycines
  misc_feature (3306)..(3306): n is a, c, g, or t
cgttaactttttgcttttaagcggtgaattgaaattttggtcatttcgaatctgttgaaatgctaaaataaatgaaaaatttaaaagaaagaatattaatgttaatcatgcatttaaccaaacattcaccaattctcagttcgttcaaaatgactttggccgttgccccgttcaaattggcgccaacgttttgttccgggaatgttggcgtaattattggcattgtgagttgttggcaaattgtcgtgcgcaaatgtgcgtgcgtcgtctgccgttttatgaaccattcccgaaagggcgaccaactcaaaaatccgccgtccctttcataatttatctcggctaattggacgggcaaaggccaattccttgaaagtaataaacgctaatgatgccaattaacaataattgctcaccaggtggaataagtcaagaagaatttctcgaccaaaaaaggcattgacccatttgggtacaaaaggaatattttggttagcattgtcaaaagcattttcgtgttcaaaaatcccatcaaatcgtccaaaatttggttgtctaaatatgtatttaaataataccttttctctaatactcaattaattattaatgaattcattactttttgcccacaattccaaataagcgagaatttgccggaatttgtccaccttttttggcccttccttttccacttttttaaattaatcatttcttttaaagaaatgaaaatatttaaagaaatccacccaaaatgttttcggaaaatttgtgtcaatgggtcgatgccaaaactgagataattgtagccggcgaatttgtgtagcaaattttggaaccgttgtaaaagcgacattttgtcggaccaatttgaatccatcaatgaaggcacgaaactggagggaaacggaaggccaatcagcgaagcaaggtgctcttggagggaacagctaaagtatgactatttacaataaaaataataataattaattaattaatgggctgaacctgctgagcacaatgttcacgggaatgtccagcaaatggccaatgcccgcgccgcaaaagttgagctgctcggaaatgatcacgtcgaagttgcgcttcttaagcagctcaaattgttgcgattgcgttctgatcaatgcttagaacaaaaggacatttattattattatcctattttggcaaagaccttcacatgcgtcattcagagaagcttggaatattttagacgagaaaaagatgtcgaccaacgaaggcttctcaaaggcactgtcggcgagcactttgaaaaggctttttccgccaaaattcacattgaaaaatttgccaggaatttgccaaagattggccaattttgtcgcatttagcgccccaattggcacagcgtactcaatttcaataaaggtctaaaattggaattaattaatcgttccatcaaacacacaactgaccacgtcgtgcccgtcgcttgccaatgcgtcggccacgcgtccgttcgaaatcatatgacttcgacttaatgtcggactgaacaccaaaatattatatgccgtagaataaaaattcattgttgaaacgaagaggagaagcaaaagacccaaattggaagagaacatttcgtaacttcgagattagttctactgaaaatttctttgtcaatttcaaaagaaatatttgctgattgacactgacatttcttggcaatgaacggacgaccacaattatcacattttatcaattcgacgaatgttccgtttttcgctgatgtttccatttttgtattttgtattttgtgatttgatttttttccttttctaaacattgttattttattttttaaatttattttattttattttttgctgatttggtattatgcgatgttttgtgacagtcaaatgttttatcatgttaaaaagattatgtaatccttagagaaaatatcatgtgaattacatcatttaatagtttcatcataatcatcattttattttatcattttttgaaaaaatatttcgttgaaatggaaaaaaatattattacgccccaaagtccgaagaggaataaaataatatttattcaaaagaaaaggacaagggcgaacagggtcaaatattgacggtgggggtcgattgggccccgccggttgggccccggtacgattggtccccatggggcagtcacttttttagtcgacttttggtttactttcactaaagaaaaattattacctatgtatatttttaaataaaaaatggtttttttaatcgttaactttgttgcacattaattaaaatgtatttttttcatgttgggttcgaacctggacctccgaaaaataggaatttaacccactgatccaccgtttttttaaattttccccacttcaccaccttccctgaaggggaaaacacagtcaaaattttgatttttgaggtccaataacttttctatttggcttcaacacaccgctaacattaaaaattcagagtagccggccctgcactatcaaatagttatgatacatgcattttctgacacagttctgacggttcccttgttagatttggcccaagctataagcttaattttgtaaaaaaatgtattgtacgaactgctattgtacgagttattgcctttgtaagaatggatagaatttcatacttaataaatttatgaataatttaatttttttaaaacatgtgaaacgaaaaaagtggctgccccatggggcccaatcggcggggcccaatcgtactggggcccaatcgacccggtccgcatcaacctgtggaatatcctgcgcaactcgtcgacatcgcgcgcttgacgatgctcaaattctcgagcaaaaattgcggcgggacttttgtcatccattcgacacaaagattctgcactgatttttctatgccatatttccttaaaagcccacccaaaatacaaacagaagaaaaagatggcacagagtcaatcacaatctcattctttgtacaatgaaaaagtaagaattacgaataattaaacggtcaattaaaagaaaaacggaccagcgcagtaaaataaacatttttctcaaaaaaaatggaaaatgatggcagattcaatgtcagtcgaacaacgctttgtacttccctttgagcgcgtcattgaaataaccggcgtaccactccaaatgctcgtgttttttctaaacgcatttttacagttaataggtgaacaaaatgagtgatttcttaggataccttgacggacatgtacggatttctggacagtccgttgaccaccaattccatgaagtgngccaccgggcccgaacgtggcaatttgtacttggccaactcagtctccagaaacacgtgatccgcgaaactgtactg

SEQ ID NO: 548 - DNA, 2882 bp, Heterodera glycines
aaatataatataatttaacaaattaatggtcctatcccgaacacctccccctttaaaagtgtttctttcatccgcgcgaataacgatcaggtggacgacggtttcgcttgggtcgttcgttttgaacattctgttgaacggcacgttcttcattgacctcgtttggctgctgtggctgatcgggatgcggagatggtggcgctatctcaatcactcctccagctggttgtgccacaacatcgccaagttgttgattggcctgtgccaatggaagtccaaaggcatcattcaagatgtcgagggaatcttcctcatcaacatcagaatgtcgaaccataagttggttcgcatggaatcgtccaactgatccgtcctgaaaagtgacgtcgtacatcacaccttttttctgagtgatgtgcccgggtcgccaatcctgcgacagtcgatgccgggcgtagaccatatcgtctaagtcgaacgatctcggcctcgcgccatggcgtcgattgaacttacgctccattgcttcatcgcggatgacgattggacgtttttttggtttcaaaaggtccaatttcgatcggattttcctctgcaggaacagttccgctgggcttttgcattcaggcaaagactcattcggcgtgacacggtatgtggctaaaaatgtgtccaacatttcggtaattccttccttctttaatttgcgacacgtccgtttgaatgtgtcaacgaaccgttctgcttgtccgtttgacatcggacaataaggtgccgaaaacaaatggtttatgccgttgagtcgggtgaattccttgaattccttcgacgaaaattgggtaccgttatcggtgaccaacgtttccggaagtccatgccgtgcgcaaagatagcgcaatttaccaatcgtggcggctgaaccggtggaattcatttcgaagatttctggccacttggagtatgcgtctacaatgacgaggaacatcttcccaaagaatggtcccgcatagtccatgtgaacacgcttccatgggccatcggattttgtccatgaatgaagggtagtctttactggtgcttttgcctccgaagcacatgtttggcaggaacggactatttcttcaatttgatcgtcaattccgggccagtagacatactgacgagcgagatttttcatgcgtttgcagaatctgaatgacctgatcaaaggccttctgacaatcggtggaccaactccagaccacatcttgcttaagcagattgtccaaaggttggcagatgaaacgcatgttcttcacgaactgctgataatggtttatcatccccaaaaacgaacgaagtgtggacaaattggttggcacaggcatctcagcgatcgcctgtattttggctgggtccggccttcttccattcttattaatgatgaagccaaggtacttaatttcccttttgaagaaggagcacttctctggcttaattcggaacccaaacttggcaattcgcttgcagacctcttgaaggtgcttcttatgttcttctggtgatcggcttaccacgatcacatcatccagatatgcaactgcgaatgcacaaccagccaacatcgaatccataattgactggaaaatgccgggggcagacttcaccccaaatggcaaacgttggtactgaaaatttcctcgatgagtggcaattgtgcacaactctttataattttcgtccagctcgacttgtagataagcatcccgaaagtcgatttgcgaaaaaattcggcctccattcaaagtggtgaagatgtcttcaggaagcggcaggggatgagaaaacctcaaaactattaaatttgtgtccattaattaattaaatgtccgctttcgctttgcgcttcgcttcgttcctctccctcacggcactgctcgtcgtccgatgctccgccgatgagtcatcgtcgtctgaggaagagcaaaagcgtcccattagcgatgccgccgtgccatcgtcaagcaatgaaatgccgcaagttgtacctgctgcggttgctcgtcgaaagcgaagcattttcggtaatttctttgcggggcttttccatcgcaacaatgagacttcgacggaaggtcgtcgcccgtcgaacggcacagagtcagcggaagaagcggaaaaggtaaaggaaaaggaggaggagaaggaggaggaggaaaaggaggaggagaagaaggagaaggaggaggaagaaaaggaggagaagaaggaggaggaggaaaaggaggaggagaaggaggaggaggaaaaggaggagaagaagaaggagaaggaggaggaagaaaaggaggagaagaaggaggaggaagaaaaggaggaggagaaggaggaggatgaggaaaaggaggaggaaaaggagaagcacaatgcgactgatcagtccgccgttgggcgcgagaagcgcagcccatttggcattttcatgaaatacaaaaagaacggaaagcaattgagcattggtcaacacgcaacaaattaaaaggaataaattttaattgacttgtctaatttgataattagttttttaatgattgattattattttaaaaaaattaaacacacgaaaatatttccacaaataattcttctatttaattgtatataaatattacgaaaattgccattttaaaataaattatttgtgaatattttttttcgtaccacttgacggatttaagctaatttaaaaatgcgctagcattctctttaagttaaatattaatttttataattttcacatgtagcaaatttcgacattaagcaattttaaaatgccaccttaaatctaatcattggcgcttcaaaaagcctcaacttttcaaacccgatacaaaactttaacc

SEQ ID NO: 549 - DNA, 6573 bp, Heterodera glycines
  misc_feature (6380)..(6380): n is a, c, g, or t
atttctttgcggggcttttccatcgcaacaatgagatgtcgacggaaggtcgtcgcccgtcgaacggcacagagtcagcggaagaagcggaaaaggcaaaggaaaaggaggaggagaaggaggaggaagaaaaggaggagaagaatgagtaggagaaggaggagaagaaggaggaggaggaaaggaggaggaggaaaggaggaggaggaaaaggagaaggacaatgcgactgatcagtccgccgttgggcgcgagaagcgcagcccatttggcattttcatgaaatacaaaaagaacggaaagcaattgagcattggtcaacacgcaacaaattaaaaggaataaattttaattgacttgtctaatttgataattagttttttaatgattgattcttatttaaaaaaaaacttaaacacacggaaatatttccacaaataatccttctatttaattgtatataaatattacgaaaattgtccattttaaaataaattatttgtgaatattttttttcgtaccacttgacggatttaagctaatttaaaaatgcgctagcattctctttaagttaaatattaatttttataattttcacatgcagcaaatttcgacattaagcaattttaaaacgccaccttaaatctaatcattggcgcttcgaaaagcctcaactttcaaaacccgatacaaaacttaaaccttagacgcgagaatctcgagcacattttatttaatcaaagtattattccatctatggtttttgacatttcatttatttatttgccgaatttagtcaaccaaaaccgaacgtgggcatattttgtacagctcataaaaaggccaatttctcctttctccaacaaatcaacatgttttttcttctccttcgatgttattttatttgccattttcagcaaatcatccaaagattgcgcaattaccaaaattgcccattcggaaataaaaaattcaatcccaaaaactggtcgagagcgcgcggccaccaaagaccgaccggcaacgagcaaacaatgaaaacaattaaacgccttttaagggtccaattccgaaaataatttcttgaaaaaatgccaaaaacatcacacatccttctgatttgcttgcttttcttcaccacttttctagtaaaaacagaagcaaaaattgaagagacaattgaattggaacgaaatccatcggcggaaaggacagaagggtaaaatggcaaataatatcaaaaaaacaaaacgagtgggctttcttattagctgaatagatcgttaccttctgattgccattttttggcattccgtgcatatttcatcaaaaaaaaaagtttttttaaagaaagcccatttaataacctatttcagcaaaccctcgacgagaagaaagcgccatggctggggatacggcgggtacattatttgttttttattaaacttttatttacatataaatccctcctcagctgttgttgctgcggcggttggggatacggtggctatggcggatacggtggatatagcggatacggcggttatggtgggtacggtggctacggcccatttggagtcggattggtaggccttaccggaggactgcttttcggaggatggggcaaatagagaagctcatgatcgctaacacttttaaaaatataatcgttgaaaagaaaaccttctgctttatgtgacaatggaggatgattggttatttgttagtctctacgacttttataatttaccgtatttcttgagttagaattccccctgaattagaacccctccctccttgaaataaagccccctttcgaggggagttgaaaaagtccctcccacccccccccccggggttttaattcagtaaatacggtaaaaaattttgagtttcgtcctaaatttatttttcaattttacttaaagcttaaaaaaggtttaaaaagctgctcaagtcaactaaaacttagacaagacgcacacatataactaaaaatgtatgtgacatatgtaattactataagattaagttataaacaggattgacagatgaaatttttcaaaatcagcatttcgctaaaaaaatcagccttaaaaaacatattccaaatgtaaaaccaataaaaaatgatcaatattttatttttcattggccaagattgctttcatcttttttttgttcgaaatcaaattttgtaaaattctatcagcaaatacagtagctttagccaacgacttcactaaatttgtaaataataaaaaattaaaccttataaaatctgccaaaattaccaaatttccaaaaaaaaatatagctaacatcagcaaatatcagcatttaaaaaaatcagcttcgaccccttcaaaggcagcaaagtgctaaaaatcagaacatctgctggcaaccccagggttataagctgctcaatgaaattaaattgtgaagcgatgatttattttcatagaaaaaatgaatcaaaatgctcgttttaaccttttgcaagctcattaattaaacaaacagattgaattacattaaaaaaaagaaataaaatatcacattgaattggatttgggcaatagccggacgaacaccccttttttgtgaaaagaaattcagaaaatatttcttagtcaaatcgcctgaaaaagtgtcacttcaattaaattctaaataaaaatgatttttaccgtaatttgagttcatttttctcaacatattctgagaaaaggtccacagcatggaaaaggaaataattaaaagcatttttaacttttgcatcgaaattgcccaacatttgactcaattcgcttctgagctcggaatccacaattttcccgggaagaagctcaattccgacaagccattggctaattaccctaacaaaaacggttaattagttcattagttggtcattaattatttgtttatttaattatttgtgtttttacctgttgctgtgctcgccagaagaagaaccattcactgagaatgcttttgggtaaacgtggaaaaagtccactcgctttgacaacagagaagaattttgtagaaaattatgcaattcatagcgaatgcttttcccaacaaatggcgtgaatttggcaagattaatttgatgcccggaacaaacgaccaaaatgaaatgggcatactgaaaccaaaagaattaaaattttttaagacaattagcgctttttatattaggccatataatttattagttagcagattaaggtatttatttcattaattaatatttatattaaatactccttccatttcataaaatactttttcgttaaactttttgcttttaagcggtgaattgaaattttggtcatttcgaatctgttgaaatgctaaaataaatgaaaaatttaaaagaaagaatattaatgttaatcatgcatttaaccaaacattcaccaattctcagttcgttcaaaatgactttggccgttgccccgttcaaattggcgccaacgttttgttccgggaatgttggcgtaattattggcattgtgagttgttggcaaattgtcgtgcgcaaatgtgcgtgcgtcgtctgccgttttatgaaccattcccgaaagggcgaccaactcaaaaatccgccgtccctttcataatttatctcggctaattggacgggcaaaggccaattccttgaaagtaataaacgctaatgatgccaattaacaataattgctcaccaggtggaataagtcaagaagaatttctcgaccaaaaaaggcattgacccatttgggtacaaaaggaatattttggttagcattgtcaaaagcattttcgtgttcaaaaatcccatcaaatcgtccaaaatttggttgtctaaatatgtatttaaataataccttttctctaatactcaattaattattaatgaattcattactttttgcccacaattccaaataggcgagaatttgccggaatttgtccaccttttttggcccttccttttccttttccttttccttttcgtccgtccaattcccatttaaatattccccctcaatttttgcataaaatgaataatctaaattgcaatttcctttctttttgtttgttttgtgttaaatttaaattgcctgctaatgtttggagcatcactttcaattcttgtaccaaatttctgtcttttagtgtctttcttttcttttttaccagaaaattacaaatttcatccattttttcgattgtttttgaataaaatgaactcatttcatgatttgacacttaattgtttaggtgccacttttagactttgtaaaaaataagtcataatttcacaaaaacaaaaaaatttaaattacctattttttttaaatgttttttttatttcttattgttaaataggtacatactaatgttttttaaaaatattttgttaatttttttcattattttttcccacttgaaatttccatttgcattttcttctccatttctgcccttctcttcgccctgtctttcaagtcatatctgcacattcccatatcgaattggtcattttttatcagatgttctattttgtttccaatttctttttgtaatttttcaaattctcgccaattatattttcctggcggtaattggccaatgtttggcattctgaaaaattttaattcgaacaaaatgtccataaatttgagtgtcattcgtggaatagacattttttgcatcgtggaaaatttatacaaagaattgacattcgaatgctgaaattgaattttgaattaattgttggcaaagtgtttgttttttgttcccatggcattctctgctcaccctgcaaagtgtgcagtggagggattggtccgcgcattggtcgccccttttggcgtcgctttggtcgcattggaatttgccgaggacatttcgctggtcaaagccatgcggcaaaatgccaatggcgtcgatttggtccaattgcatttgcaaatgcattaaacttgagaattgaattcgcacctccgccgactaaattggcaaattaattactaactgtttttccaaatttggcccttccctttctctctcacccaattttgaatgattttctccaatttttccgtcaaatttttaagcgtttcttttgaatgatttattttttgcgtctcttttaaaatcttaaatttggctaatgctttactcaatattatgcaataaaacagcaaaacctgctttgttttttcctcatttatttttgaattttctccgtattttatttcttgccatccttccggaaattgtgccaatttcgtcaatcggaatttctcacgttctttttcctcaaccatttcaatcaaattcgcttctttggtcaattcgttaaacaatgtttggtctaaaaattatttttaattcaaaaatcattgaatttggccaaaaagtaaattaaataaaatccaattagtaatttaattgcctaattttctctgcccatcaaagtgtttgacggcctttaattgctcttcgaattccgctcggtgctttggcattccgtcctcgcgcccattgttttccgtttgaattagtgccaaaatcactttgtccattttgcgctttaattggcgttccgtttcgctcttggccattgtcttggccaattttctcgagtgcagctgacttttcgtctccctaatctctgcccataaatttgtgccgttttccgcacaaaatccgtccattgaggccacaattttcttcagcaacaaatgcaatttggccatcaatttgttcctctcgcatctgctaattatcttgcttaattcaaccattttaagcttttcccattgcttttcaatttccaatttttcgtttttgccaattattttcaattcctccaaagtgccaaaaagtccaatccgattcgaaatttcgttggcataaactccaagatggagcgtccaacacaaagttttgactgttaaagcatcgttttcctcgtcattttcccaactttctttgcttactgcccaaaacagttcgccatatttcaaactcagcaaattatcgtctgaaaaatgcccgattttcagatgaagcaattcattttggtccaatttgtcctcttcttccgaattttcttcactttttgtttcccaatttgccatttcctgttcatttctgttcggcactttgccatcaaattttggcattttgccattgcaattttcttcttcttcttcttcttctgattcgtagttcgcttttctctcactttttaattcgtttaaatttctcttcaaattgtcttttacttttgagctcagttcttcttcttttgttttccttttttcttccgctttttctcctcgatttccaattattttgttaccatttgtcgnccctttcgtcactccctaatgtttgatcatttgtcctactttcatattgatcagctgcatgaatctgttctatcatttttccacctcttactgattgaatgtcttctaaattttgaccatcaccaatttcttttgtcgtcactttgccctcatcttttggcgttactttgtcctcctcttttgtcgttaattt

SEQ ID NO: 550 - DNA, 12232 bp, Heterodera glycines
aaaaatggacattgggccccggatttttggaaatggtattatttttttttacaattatttgtttgtttgtttgtttttgatcaattcccccttattgggatcgtttttatagggcagaaaattcgttttgcgagtgatccttcgcgaaaagatgggcgatgggatttggaagaatcatgccaattgttttgctcttaaattgaattaattattaattcgttttgttttttactaaattatttaaaaagataattaaaagtctgttattataggcataaataaataaacgataaaaaaaggttcaaaaaccctcaaataggcgtaaaaaaaagctaaattaaaaacagattaaaaagctaaataatttgaaatcaaaaatatacaaaaaataaaaatcttttgaaggatttttctgaaatttttggtcaattaacttcttagggggaggcattttgttttttttcttatgcaattttgcgaaatccctaaaataaacattaaaaatggcaaaaaacatagacagaaaatcggcgcgtctgggcatttgcatctagaaatgccaaaaaaaagaaaaagaaaaacttaataaatcaccaattgggccgaaacttctttgtcatcacgaagcgcagcacttggctgcttatccttgccaaatttgatgaaaaaaagttccgttattttcattgcctcttccatggcattcactgtgtatgcgaagcttttgttggattcgtagcttaaaatgtaattcaattcaattttatatttatttaattatataatgccaagcggcaaatgcctaatttgtcatttaatttaattagtctaatttcattagccctgtccttaattgatttggtttgatcacttttaaaaattaaaatatttgcaaaaaatagaaaaaaaatcgatatattaaaaaataataattaatattagcctaatgattccattgtagcggcgaattttccaatcagtttttgtgattgattctatttgttagttaagtacttttgatcagtgaatgaaaagtccagcttggattccaaaatgatccgttgcttttccgcttcgcgatgtgtacacaaacggatgcgaaatccgtacgccttttggcgcgcgttttggagatgttcttggcaaaaatatttaaaaaacaattggagtggcaaaaataggaaattataatatatgattaaaagcacaaaattccatttttttcaatgccttaaaattttttgagcactttgaaagttttttgcaccaaaaagaacagtttttttaaatattcaagataatgggaaaaataaggacggaatttctgaaaatttaaaatcatagaattaaagaccaatgacagtcctcgaatttgtacattggttatggtttttttaaaataattttatcacagataatgtgccaacttctcgcagttcggtgttgttggcaccttttgacatgcatcaaacaaatcactgctggtccgagactgattgaacatagtcgagggatcaaatggcgccttaaattgttcgcacgcaataaaatagggagaaacggacacattcagccaaaactgtggcatacggtcggcaaacacaatttgtgtacagtttgtgcccaaatggtcaatgtttgacgctttcggcacaggctaaagaaaataaaaaactttattaagagaaattttcagggcggccacctgcatatcgaaaaggctgacattagcagggacggagaaaagctaacttattacaggaaatcaagcaaccatttggattacagtacccattcatcaactaattcgattgtcgtaagtatactatcattacagtacccaccattgttttgcacattttcgttccgtgcatttgtccaatgcccttggtaagttccagtgccacaattcgcaacgccattccgtcaaaatctttcataaatgagccaagcggaagtgcctcttcaaattcagctgcagaaagtgacccattttgctgtatcagagctgaaaagggaatagaaaaagcttcagaaataatgtattttcaaaaacggggatactgtgacggtataagggtactgtattcttcttctccgtccttattattttgatagatttataaaaagtcaaacatttaactttttattcataatggtaactttagttgtaaaaatgtaggaatgaatttgataaatctatagtatcacatgtaccttttactgtagccaattaaaaatattcttgataagattggacctttggtgaaattgagctctcagaaaaccggcatcgctgaagaaatctttgtccaaattgccggacaaattggcgctaaatctaaataaaatatgtaattagcccaaaaacactcgcctgagggatgaatggaatgccaactgcccgtcactcttcttgactatcattaagctgtgccatccgccgttgcaatgatttggcccaccattttcggcacatttcttactcaattcctgcaagtccatctttgcaactctctcatacgtccattggctttccaatttccgaaatttttggccaatttgctcgggtaacagatcagataactaatatgaaattaattttttttaaattaaaatgccaaaattaaaaattggtacacactttttgccgcctttttccagtctaattgcagtgccattttcaatcggttcacatttgtcccaattttcataatgaattctaaattttaataaaaaaaatgccgccgttaattaatttttttatataattagtagaagttaaacgaaattaccctccataaactgcgacagcaatcaaaaaatgatcagcggacggaagaacattccaaagtttaaggcagctaacaataagcaaaaagtaaaaacagacacaacaaattaattgatagttcggtttcaaattacacagttaatttaaaatggcatttttaattgattcagagagagcgactgggacgtacctttgtcggatgaggccaagaagcaaaagatcagctgaccaacgaaaatggcaccgatcagtgaaaaattttcttctgtaaaaataaattgaataaaattgaaatactgtaatcagtgatagctgtgcaacagaagcttaaatttgtaggggaaaatgcctacagtatgatcaaatttttcattttttgtatggtttgccttggttcgtttgcctttgttcgaatccataccgataccgtagtccatgtacgggttgccagacccagtgccggttccgtgtcgtgcggttgcggggtgtgacagctcgaccactttgactgatgaagcggcgcccgttcgcggtccgtttggcatgccgagttcggggggcagggcgaatttgaacgaaagagcggacaatgaaacaagtaggaagagcagtggtcggcacattatgatgcagagaatactgtggttgggatatggaaaaaacagacaattcaaacaagagcatttaaaaataaaaccacaaatcccatttgatttttgtccgtttacaacaaaaagaatgaactgaaataaatgatggactaattgatggaataaattttcatcaactgctgtggtggtggataatggtgatgattcggcgtcaattggaagcagaaaacagaaattgtgatcgaataataaattaatgaaaacggatgactcatctttcattttttggtggcttttttaaatttttagctttaattaatattccataatttactgagaacgaaactgcaaaatttagctgatagattctaaaaacgaataaccttttcggtactcttgggggtttagactaaatcagaacaaattttagaatgtgtaattaattttttaaattcattaggtgatggtgctgaaaatcttcaaacatcctaaaaatcttctataacaaaacccggaatcattctggagaaaaatattaattatatttttaatattttccagccttttcttgaataaaagcgaatttttgaaagttttcgaacaataaatttgtctccttagatttaatagaagaattagaatatcaatgagaaaagggctttaatactgtcaaccttttttttgcctgtagtatttattctcggatgatatgaatcatagaaatgtgaattgtagttttaaagtttggttgcttttgagcaaattcataatagacgcaatgaaaatttttattttcgaaaattttcaaaaattcggttttatttaattttggacaggagaatattaaaaatacttttatatttttctccatttgttttaagttgccttcaagagtttgtgcaccaacacctactgaatttaaaattaaagacgcaacgaaaatatgcttcttaatttagctaaactcccacgattactcaaaacaatttattcatttttggatatacaattcacatttgcatgtttcctattatcagaggaaaattattattctaaaacgcaaggggaaatttggcaccggaaagtttgggcattataaaattgggcaccaaaaaatttggccatcaaattaaggaaataaaaatattttaatatgtaaataatatagccgtctaatttaaaagcatagttgtaaattataatcaaattcgagctgtaaagtctttaaaaaattgcccagtcaattaaccatgtttatatggttgggattcattacaattctttgtatattaattcatatatatgtattatttgtagaaggctcaatctgttgaagactaccggccttgatattttcgttcccatataatctaagtagtctaaacccaaatataaactggtatgcatcgaaccctaagtatttaatgatcaaatcatagcgtaatttattttttaaatttttcaattttcaaattaataacattggtgcccaattttcccggtgctcaaatttctggtgccaaaatttcaatttcaggtttggattttttttgggcacataaaatccgaaaaaaaaatagtttatgtattaaatccaacaggtgacacgcaaacctttttcgaatggtaatttttcttttcaatataaattaaggaaactcttttcatgcttttcttaaaataaaattcttccgtgcgatttaatgccattttaaaaaatgccattcggatcttttggctcaattcaaccgtgccacatttttacttttttagaatttctgttaatacaaaaaaagatataattaattcactgaaatgtgcatcttaatttcacacacgcacaaaattttttgccgtgcccattgagataaaaaaatttcacattaaatggcaattagtcaaaggcatacaattaatggagaacacaatttgggtacaacggcacatcagagacggaaactctctctttaaaggcgagttgagaagttataatttgcttcttatgccggccctccatttaaaactccgcacaaaatgccattataattaaaagttttagaatattccaatttttattacattttttctattattgcatactgtaaccgtaaaaaaatgctttttagagaaagaaaataatgatggcttcttcctcagccattccgtcgcccatcgacaattcctttccgaatttttccacaaatgtctcagctgcttaccaatattttgtccaattttgtgacgacccaacgcggcgtgacctgacgctgacctcgtccgccatcactttgttcatcatttacgcgcttggcattgtgtcccaattggttgtgctgcccgccaattggcgcctctccaaacatcgctccgcctttctgctgctcctttacattgtgcgcatattttgagtttcaaaaattgaatttacaattaaacaagagcagtgacgggaccagtacctgtttttagtaaaaaataaactacccggctcgaatcttgcagtaccggcggtaccgcaactaaccgtcctgttgatatcgataccggtcgtaaacttgcatacggtatcggcataggtgatcgcagtaccggcatctgctttagtgaagaataccggtgccgctctattcaatttacaaaattagttgaaatcttttcaatattctatattaaaatttgttaattattatagaatttaatacacatggcatataaaatacaaaatcatttccatatgtcggttttatttcaagattaaaaataaaatattttggctttagaatctcttcgaccttatttggctgctcgaatatgtttggctttccttggagtttctcgttggcactcgcgtacatgcaaaatacccatttggtgcctatctgttccgtttcgtcaatttttgcattgacactttttacatcgaattggcattcaatcggtgcaccgctttccttttcccacgtctttacagcaaaatttgcacagaaaagtttgtccatttaactaatgagaaaaattgtatttggtgttgccaagtggacattttttgccttcgagggaaacctttggggtttttagagaaatttgaatttaattaatctataaatatttaattaacgtcatttttagcgtatatctgatgaaattcataattcgagaaaggatttataaaatgccaaaacatttaaataaatattttcgaaaaatggtttaaatatttacaaaaataatgactaaaaatgaaaatttcgagaaaataatgaacaatgcattgaatattatgaaaataaaaacgaaaaaaatcggttttcactttgcattttccaaattttaaataatttaattttaaatttatgccgccatttgttaaggaacatgaaaacttgcgttgtgtgcacatgtatcgtgtcaattgtttattcaatttacatgaattggtttccggagaggcgccctttccattgtctgattcagttgggctatttcgaaccgatgacatccatcacgaaagtgtgacgaatgctcgcttttagcttaatcattttaattatatttaaattttaattaataactatttatttcttccagtatatcaccgcaacattgccggacgcggggctttatgacgcggttcaaatcgctgaattggcttccatttgcactccctttttcctctatggcataacagtaatcaaaatggtgcacgatcacaagaagaatccctccacaagcataagtatttctttttttattgtgtggttttttggttgcgaaattattcattaattaactaattaatgaccttcggtaaatcccggtgatatcccattaacggggggggggggatgctaaagagagccagcgaaggaagaatcgtcttgtgtgggtcttttgaaaagggtcacttctcgttctcgacccaagaaatctgagaagatttattgtattgtattattcattttaattaattttatttagtccaagttgcgactgtgatgccgcgcgggagccaatcgaacggagaggagcgtgccaaatttgtcaatttgatgcaggaacgcactcggctcttctccatgtgcttgctcagccaagtgccctactatttgtcccacgcgctttaccaatcgtcccgaatatttgagctcagcgaagacaccgttcaggtggaaaaaaattggcagaccaataaaattttgaaattttcagattttggccatcctttggcaacttctcggcacaatttttcatgtccaacagcccattctgatgctgttgctcagcaaggatttgcgctcatcagtgcgcaacgatttgacaaaaatattcggcacaattttgtgacccttaagagcaattttgattataatcatatgtagatgtccatttttaatgataaaatgtgtgaaatagacaataatgaactgcaaaattgatacaaaaggctcattacagtaactttaaaatggcttgtgtaaagtgcataaattaattttcagctttttccgtcaaaatgtgatattttttttttttttttttattcagaagaaataaaaatatccaacgaaggggtgaccacttacacgttagattttagtaaagtaatatcaagtccaaggagctcttttacagactaaatttttgtttaactcaatccatttatttattcgttttttgaaactgtcaacagatggagcatctgttatatctttgttgagtttagaccatattaaggccgttctgttgataaaagaatttgaagttttactggattgtggttttaacacaactttacgtctaagattgtaagggatgtgaccagaaaattgggggaatatgtcttttttaagatgagtgagaccattgatgattttgaatgcctgaactaaatcaattgtttttctcctttcttctaaagtttgaataaatcaagtctttgttcgtaaggtatatacggaagcctacatttaaataaagcaatttttgtaaaatatttttggcatctttccaatttatttatatcttttttgtatgtcggattccaaatttcgggcgcatattctaaaagaggacgaatgtatgtcttgaatactttggtccaaatacgtatagagcgggtttttaaaattttggcaatattgcgaatccttaaataagcagctttaataattttagtataatgatttgaaaatcttaatttattatcaattaaaatgcctaaatcactaatagattcaacctcattaataatattgttgaaaaatttatattgttgttttgaattatttttgccgagaaataatataaatgttttattttgggagatgtttaaaccaaatgaattagcccattttccaatattgtctaaagcaacatttaatttgcttctttcattttagggggggggggggttcgcagcgaaggtttgacgcgaattactggtacaatcgttgaaatattcttggtgaactcgaaaagtaccattaataatgcctaagtgcattcgactaaaagtttacagccaaaggacagcagaaattgttgtaccatgtatttattgtgttgagccactgcttaaccaaaatccgttttatcattagccatttttatcaacgatcactcataatgaattaattacatacacataaaatacaatggaaatggtcgcatttgcgagcaagcaaaggtcaaatacaaacaaacaattggcaatatttaaatggcaaattgccaacatcatttcggtcacataatcgcaccaattaattaattcatttgttctgctgttattgatcagttttcactcggcccgggagaagcggcgtcgaggagaagactgaaaaaaacattgttcaattgttgattggatcataaaatcattaagcatttttaattattcacccgtcgtcgaatccgccatctctgatccgaatgtaaattgggttctgtcgaacatacatttcttcccacacattgtcccattttcttctatcccacgcaattggacaacggaagaggcaacaatcatgtgcatatatttccagtgccaattgctccccagtcacttcgttgatccgatcaaatggcacaatgaagtcagctagagaagacatcggaaagtaaatacaaaaagtaaccggagaagaagcattggaaaatgcctaaaaagcggacaaaaaatcatagaaaaaaaacaattagggataatcaccgctttgaattgttccatcgttgacgaccattgatccggtgaattctcaaagcatctgagccacttgggcagaccatccggacgaggcgtgaacaaccattttgccaccgcttggccatccgatgcattggcactttcatcgggcggaaattcagggagaatgtcgccatagaaaatgacagcgcaaaggaatggacaatcgttgagaagtgacggggccaattggcgcaaacggcgaaaagcgatggagttcaagaacatcagatgcattgaatggcgaaacattggcaaaatgttgagcaaaacaaattccaaaatgcgaacattttcagtgcgaatgtacaaaaccgttgaacaaacggcgaaaaaacggtgaaaacggcggagaaatgcgatgacattttgatcgatgtagctgaaaagcagaaaattagatgaaaaattaaccaaattaattaattttttacaatatattaatgtgtctgaatccgatgactttgttgggcaacggattttgcgggattggcaatggatttccatcggaattgacaatttgcatttgcttagtgccattctctccaattttgtagcaaattcgaatttcgcccaatttccatttgcgtgtcttgaagtgttcgtcgacgatgcagttaaagcggcggttgatcagtgcaattccaaggccgagttgagaaggcgcaagaaaatcgaacaccaaaagccaacaatctccgcagataaagctgaaaaattggggagaattttttcgaaattttcaaattatgattatttattttacatttcttttgtgtgagggcgtcgtcgttttttggcattgtccaaaaagaaccaaaaaagaatggtggcacagccgaccaacagaagaagaaacacggcacaccatctgaaaaatgaatttgggaaatgaatgaattaataattgaagagaagggaaaagtaattaaaggatcaaagttagctagtaaatacaaatgtgaagttatagcatccaaaaaaagctaatctttcaaaattggttttgaaatttaaatgcgaaacgttagaaaaaaaaggaaataataaacgtacagaatttctgaagacatttgcagcaaaaaaatgaccgggaaatacaggaagaatacctaatgagagaatggaatgatgcggaggaggagaaaaaaacacatttttatactaaaaattttagcgtagcgccccgagttgtagcataattttcgtcaaaaagtcacaaatttttgccaatttggggtcacattttcagaaaaggaaaaaaattttggaaattttaatgatgtatgcccatcaaaattcgctttaaggagcttcggataaagcaattttatacttttgtatatattaaagcaatttttatatttcttcagttacatcgaccattccgtgatcacatttttgagttccaaccagcaaatttgggacagaagtggcaccaaattggaattgtctattgaatattgtgaccagtcaatttgggatgttttgtccgtgaaatttggcctatctttgcgccaaacattcgcaatttggtctttcctaatgccgatgatttggacaatttgcgtcgtcacatttcaccgacaattctcactgatcttgatcaattgaattcaatcaattcctattttctggtgcctgatggaattggtgatgatgggccaaacgcaactgctggccaagcgttgaccaaatgggtgcacactccgagcaaaaatgggcaaccgaagcgattgtgttgctttaatgctaatggtccacagaatctcgaatggatcaacaacttcaaagaggtgtgtctagccatattttcgtcaatttgtttttgttttaccaatttttgtgtttaggcattccgtcgtgccaccacttctgtcagttaccatattcaattttatttttgggtggaaccaatgccaattgaacaatttgaattgatgaacgaagtgacgaatgaaaagctgacattgaaacaggagatcgacgaattcgacgtaaatgtgtataattgtgagctgcggtatgacaataatttgggcgccaatttgaacaatatccgatttgatttgtggggtggaaatagttgttgcattgggtgagcagcaaaagcaatttttgattgttgaaaaaataaaaataattttaggccattgtcgctgccagcgaaagaagaagaagcggatgaaagcaatgaaaaataattatttcgagaaatgatcgatctcaccaataggaatcggatttgatactctctttttctccgaaatgtttttgctgattatttcgttcgaataaaacgtacatttaatacagtggtgtgatctgctgttcttatttctatgaaatctgttaaaaaatgatttcaatcgatgctagtattgtggtgcccgattggattgctgatgatggaccaaatgcaactgctcgccaggcgttgtctaaatggttgcataccagggctggacgtaattacggattacgtattacggattacggaaattacggcctttttggagttacggattacgggttacggatttttgggatttttccggaattttgatccggaactggcttttt

SEQ ID NO: 551 - DNA, 3921 bp, Heterodera glycines
acatagcacccatattagggttgcgacccggccccgaccccgaaccccgacttttttggccattttcggggtaaaccccgacccccgacgcttccaaccccgaacccgaattttccaaccccgacgtcggggtcgcaaccctaatacatatgatccaaaaaatgatgacaatttgttttttgttttaccaattttgtttatttgttagtcattttccgtgccaccacttccgtcagttacaatatgcgaatttctttttataagacaacaacgccaattgaaccatttgaattgctgaatgaacggaccaatgagaaactgacaatgatgaagaaggatttcggtggtagtgattggctgttcaaacggtgcccaattattgaagaaacggcggcggttcaaaaagacaacaatttggaccatttgaacggagttcacttcagtctttataatgattgctttgggtgagcagcaaagaattggccttacttttgtataaaatacggatatgacggtgtcatggcaattcgtacaattttaaattgatgtggccataatttttttagaattttggcagagctccaggagttcctgctaaaacagcagaggacttcattcagtccctgtcttgtcctgctggtccatctaggaaacgctgctggcccgggtttttaaaaataattccgggttctattttttcaataaaaatgtttcatcctttcaaactgcatttctttagaccactgtctccgccagcagatcaaaacgacaaagaaagcttctcgactcccgggcccagtgatcagcagaagaaggagcgatcatttaaggaaatgaccgatcatttgagttaagatgaattggattgaatttttggcatccctgattattataattcagtatttcttgaaagggaaaagtgtgctctaaaattgcattaaacaaatgaacagacggtaaggaattgtttaaaaattacaaatttccaagcttttttcccccattttttcagttggatttgtaacgacgtgtggatggacattctgccatcttttgaccatgcccaactcggcatcaaaatggcactgatttccgaccgtttcgatgttttggtggacgcgcatttcgatggaaaaacaacggaattggcaatttggagaaaaataacaattcgcaaggacattggaccaaaagcgaaagtcaacaacaggtgctgctgcttatgacaacaaacaaattaataatagagatacaacaggctccgtcggaccaattctaccaacggcaccagcacaaccaaacggcaaagcatttgaagaatgctcaacgactcaaggagaagcaaaatcggcaaaaacaacaatttattgcaacaacaagcacaaacattcccgataaattcatttcgacctttgcatggcaatgatctctgccaatatacctcaacaaatgttgaccgacttattgccaaaacaaaagccgtttttgtcaaatcgccttacagagtgaagacatttcgagacaaaatgccagatttacccttacccccaaaccagtgtttgggttacttggatgtgtgctgccgcttattactgggagtattttcaatcagtcaaagcggtcgtttttcaattagggttaacttttttaatttaaattaatttaggtagtggactcgtttgatccgaatgatgctgcctgtgttgaggactgtcaagaatgttttactgattctgtgtggcaggatttggcatacattcaatcaaattttggacgtttgagtcatgcaatcacaaagttggaaacacagggccttaccattcaagagtcgctggaaatttttgcgggtgtacaaaacgaaatggacaatgcaattggtgaaaaagcagaaagaatccgcgaaagatttgcttttattgtttcgaacaacgccggtcttgaaacgtaagaaacagagcaaaattttcaaaaatttacccggcggcgcctatcggcaccgccggccctcactattcttgaaactttttttgaacaaagccaactatcaatattgtgcgaaaacaaataaaaaagtcaagtttcaaggatgaccccatttaaataaaaaataattaaatttctttaaaaaacttgctcgaaataaagctatttgggcaagatcagttaacaaatcccaacaaattttcaaaaattttccacataaaacacaatttttcttaaaaattgggtaagtatttctcatatttccaaaactcaaaaccatttaaaaatgattggattcaatttagaacgtccacaattatgcgaaaaatgcaaattattagcgcgcttgctaatggacacttcagtacccgatttttttaacttgaaaaatgcaagcgcacctataatttgtacctttttgactttttagaccgattaaaattgcaaaatttgctggttttagggataaaatctgttagcaaggttaacaaattgcactcacattttcaattttacctccggcagcgcctatcggcaccgccgtgccccaaaaacttattatttcataaaattggctcaaattcgcaaaatggggggggggggccggcggcgccgatagacatcgccgggaaaaatttgtaatttttaatccgatttgtttacagtttttttttgtcaaaaaatgaccttttgggccaatcttttaagaaaaatggtgactttatgccataaaatttcaaattgattatttttccattttttaaatgctcatttccaagtacgtccttggcatccaaggacggttggcagccctgttctaatcatcaagcaatagccaagaaaaagcttttaacatgtgttaagctttcgaatggtatcaaattgttgaatttggtcaaatgtgaaaaaaaattatggctccttaaacctctttggcacggaactgagaccaactgctgtagtctaagtatactgtattacaagtttttatgatgttatactgtatagtacagaatattgcatatatatttcactgtatgagtgttttgattcaatgcagaaatttatcaaataatgaaaaatttgcattgttaatcaattgaaaaaaatattttagttttttactattaatttttgagaaatttattagaaaaaaatggcagaatttttgcttttttagataagaggagcaattaattgttcttaagaagacaaaattatttagaccaaaaaactcgttatttagctatttcttgaaataaaataaaaattacaattttttaaaataattttatttcgccttcctaaaaactcacagccttattaaataaaaattgtcatatgaaaaaggaattagcatttaaaataaagcacaaatttatgaaaaatatgtggatcacaacaaatgattaaaacatattaaggaaaatttgtaatataaaataaaattttccatttttgattaatccccatgatttggggtgtgccaaggacgtagcaacaaaaatttttttttgtgaatggtgccgtcaggaaaattttaaattcgtttttttgaatttttcagaatcactatgcccaaaagtggcaaatttagtttaaatttggctgaattaaatgcatcacattcatgaacatctgctgctcaacaaaacccaccgaaaacttttgttttagcgatttaaaatgtttttttttcgaaaatgggaaaagtcgaaagttcattactatgctcatttcttacagcccttgtccttttctggatcacatgccacacaatgaatttcttcaatgcgcatcggcacaatgtctttttgctgccagtaataccagaagctttccgcgctgccttcccgtttctgttgagaatataaaaaaacaaaaaatacacacaaaaaaaccgcaaaatgtgacaaaaaaatccaaaaatatgtgtaa

SEQ ID NO: 552 - DNA, 2026 bp, Heterodera glycines
  misc_feature (1981)..(1981): n is a, c, g, or t
ctgcctttttcctttcgacccctcccccctccgctccgtccgcaaactcttggctttggttgttcctccatccgttgccacacacgacaagagagtgcgcatcattactgattatgaattgaagacgattatttaaattttgatttttgttaattttttgtgcactcccccccccctcacttccccttccccgcttcccactccttactttcccccttcccaccccactctttccaccaccctcgctgctctcttcccttcttccttccctgccccagagttttccttttttcgtttgttgtcctgacaactgaagcagtctttttaggcttttcctctctgatcaaaacagcctatcagcaaaagacagtgactgtccgcgtttcgtagccttcgccatttccttttttctccaattgtcccttcaattcaatcgattccgcggttcttttatttggtacgattttataaattaaaaaagacaaacaatcacccccccccccctccacagctgacgacaaatgcccagaaaaggttgtttgtttttcatttcccgtgtttatacatatttctgccgtttggcacttttatcgggcaaatataagccgtaaatgcacgtcaaacattttaccataaaatcttaatttccttctcatttggcagcagatgttcaccggtctctggagctgctggaggaatatcatgcggaattattcagaccatcggacgctgagttgaaaatggccattgaaagggtggcctaacaaatgtatttggacaatcacatttttgtatttaaggtgatcaatatcttcaaacattctcttttcaattctctttgtggtacttcgggagggccaatcgctgaattccctcctcccccccccctcacagatatccacgaattctatgaaaatgttctgctgaatgaaagagtccccctgggcgacaaagtgagcgttgccattcgccctttggcgtttgcctttgctcactcatttaattttcgatatttgaatcgcgtcagtttgtcaagcgttgggagcgttctcccgtcggcacttccttggccattcctcacattcctatggcggtgccttccatttcgcccctcgggcgtccccatcctccgccccctccccgctctccaagtcggccatcgtccaaacattcctttgcaggcgaccacggttcattattacaaacttctccggttggttttgtcactgtcgctgcttaagtatatgtccaattcccctcgtcagatcaaccgaattgtggacgaggagggccaagagtgggaggtggaggaagtgcagctggacgtgtccaagacgggactcggattctcaattagcgggggttgcgaccgcgagcctgacttgatgtataacgaccgatacattcgcgtgactgacatttcgaaaggggtgggtcggcacgtacactgtcacgcgttggggtggcactttagggcgccgtggagacggaccgacgcattcgcatcggtgacgtgattctgttcgtcaacgattgggagacggccaacagagagcacgacttcgcagtgcaagcactgaagaacgcgggcacttttgttcgactggtgagaattgtgccattggtaacaaatgggcagaaaggcaacactttcagttagtcaaacgcctcaaatatccgccgctgcaaaaatcgctgagtcaaagccatttgagtgagcccatcgccagcggcaccttccaacggtcgttgagcggagtcgcggccgacagccgaacattgcctctgcagccccccgtccgttcccgtaagagaatgaatgggatggctgtaccatggatacaacgattggactgatcattttagaatcattgcaccatttgccgatgaatgccgtcgcaacttcgcccaatgttgtcactgcgatgggcactttgcccaaggcgggcgaatgtacagcagcaatttgcaacgccactanatgacccgggcagacagccgagatggtggcgaatttggggggggg

SEQ ID NO: 553 - DNA, 1622 bp, Heterodera glycines
atttgcaacgccactaaatgacccgggcagacagccgttattgttgcgaaattggggggggggacggcatttgaaccgattgatttgagggttgccatccgaaaaggcgaaatgggcttcggttttaacattgtgggcggcgaagatggcgagcccgtgtacatcactcgcgttgcacccggtggagcggcggaccagaccggcaacattcggatggtaaaaacgaattgtgaccatcggaaaacaaatattgactttcccaagggagacgtattgctgcgtgtcaacgatgttgacctgtcaatggctacccacggagaagcagcggtcgccctgaaggcgattccgcagggggcccaagtgaaactgctattgcaattcaggcctaaggaatatagcgaattcgatgaacgattgcaacagcagaactacagatgatgttcaggaatatcagtggggggggggagtaaggaacctaaccaaaagtggcaataatgctgtataaatctggatgaaatagctgtgaaagtgacataaaataacaaattaaacatttttggcatttaaaactgagaattaagtgcttctttcttgttcaatgcgagaatgttttgtcagcagttctttgttcaacattctttgttgtgtttggtccgattcgggaggaagcacttttatcgcgtgaagcacatacccaccagaaatctgaattaattgcagaagtatagcttaatcgttgttttctaaccaattgctgcatgatgggatgcgttcggtcggggatcacttgttggaaacggaagaattgctgactcaactgaatgtccacggccgagccaaccgaccggagccatttccaagcattgagcaaatgctgaaagaaaagattagactagaaaaggattaataaagtataggaacctctttcactggcgaataaatgacgattgtcccagacaggcgcagtccggcgaaaacttgtttgagaatgtccaatgggtcaacggtcctattacaataaaaataaacgaaaacatgtttacagttaagtcaaataggtaggtgacccagaaaacaatcggaatttgtggaacgaaccaatggtccgcaccacatgaggcggttccacgccaattaccgagtggccatgcaaatcgagtcgatttgtccgctgtgctccgccgtgggtttaatcatttccatcgctcgccgttctctctcctccctctccactctcttctgtatttgctgttcccggcgttcctggagtcaattccaacattttaaacaaatcgcaatgcaattgcctctgccacatcctctcgcttgcccggatccctttcctccgtgtttttcagattgttcgttttctcctcgtcccgtccattgtttcgctggagcagtgttgtgattcgtaatgtcaaaaaccctctacttttctaaaatgtaaaaataaaatattaaatgatatgtagcttatgctttgcccctttgcttaaaatttaatttaaatagccataaatttagtaaggatgaaaatagcgggttaatcaccactttttattattgaatgttgtttatttattcataataaaggacaaaaatcggagatatcgtataac

SEQ ID NO: 554 - DNA, 2732 bp, Heterodera glycines
  misc_feature (44)..(45): n is a, c, g, or t
  misc_feature (53)..(53): n is a, c, g, or t
  misc_feature (57)..(59): n is a, c, g, or t
  misc_feature (62)..(62): n is a, c, g, or t
  misc_feature (68)..(72): n is a, c, g, or t
  misc_feature (85)..(87): n is a, c, g, or t
  misc_feature (89)..(89): n is a, c, g, or t
  misc_feature (92)..(92): n is a, c, g, or t
  misc_feature (95)..(95): n is a, c, g, or t
  misc_feature (100)..(100): n is a, c, g, or t
  misc_feature (104)..(104): n is a, c, g, or t
  misc_feature (107)..(109): n is a, c, g, or t
  misc_feature (113)..(113): n is a, c, g, or t
  misc_feature (123)..(124): n is a, c, g, or t
  misc_feature (126)..(126): n is a, c, g, or t
  misc_feature (129)..(130): n is a, c, g, or t
  misc_feature (133)..(133): n is a, c, g, or t
  misc_feature (138)..(138): n is a, c, g, or t
  misc_feature (148)..(148): n is a, c, g, or t
  misc_feature (154)..(156): n is a, c, g, or t
  misc_feature (158)..(158): n is a, c, g, or t
  misc_feature (163)..(163): n is a, c, g, or t
  misc_feature (165)..(165): n is a, c, g, or t
  misc_feature (171)..(171): n is a, c, g, or t
  misc_feature (176)..(176): n is a, c, g, or t
  misc_feature (178)..(179): n is a, c, g, or t
  misc_feature (183)..(183): n is a, c, g, or t
  misc_feature (186)..(186): n is a, c, g, or t
  misc_feature (188)..(188): n is a, c, g, or t
  misc_feature (190)..(190): n is a, c, g, or t
  misc_feature (194)..(195): n is a, c, g, or t
  misc_feature (197)..(197): n is a, c, g, or t
  misc_feature (200)..(202): n is a, c, g, or t
  misc_feature (208)..(210): n is a, c, g, or t
  misc_feature (213)..(214): n is a, c, g, or t
  misc_feature (219)..(221): n is a, c, g, or t
  misc_feature (224)..(226): n is a, c, g, or t
  misc_feature (230)..(230): n is a, c, g, or t
  misc_feature (236)..(236): n is a, c, g, or t
  misc_feature (240)..(242): n is a, c, g, or t
  misc_feature (245)..(245): n is a, c, g, or t
  misc_feature (251)..(251): n is a, c, g, or t
  misc_feature (257)..(257): n is a, c, g, or t
  misc_feature (264)..(265): n is a, c, g, or t
  misc_feature (268)..(268): n is a, c, g, or t
  misc_feature (275)..(278): n is a, c, g, or t
  misc_feature (281)..(282): n is a, c, g, or t
  misc_feature (284)..(285): n is a, c, g, or t
  misc_feature (291)..(292): n is a, c, g, or t
  misc_feature (294)..(296): n is a, c, g, or t
  misc_feature (298)..(300): n is a, c, g, or t
  misc_feature (302)..(303): n is a, c, g, or t
  misc_feature (306)..(306): n is a, c, g, or t
  misc_feature (309)..(309): n is a, c, g, or t
ttttaaacaaatcgcaatgcaattgcctctgcctcataaaggcnngcccggancccnnnccnccgggnnnnncacatttaacgannncnccncgncccgnccanggnnncgcnggagcagggnngnganncgnaaggncaaaaacccnctactnnncnaaaangnaaaaanaaaanannaaanganangnagcnnangcnnngccccnnngcnnaaaannnaannnaaanagccanaaannnagnaaggangaaaanagcgggnnaancaccacnnnnaannanngaaggnngnnnannnanncanaancaaggacaaaaatcggagatatcgtataacaaaaaatccaattttggaaataggcgccagtctgctcatgaaataaattacaaatatttacagttattttgacctgagcgtcagtagtgaatgagtcaaggcatggaatggattggggccaatcgccgcggtgaagaaaaatgcagtggccaaaagggtttatccgttccaacacagcagcgccaagcaatccgagaaccgaaaggaagaaagtcatcaaatgggaatcaaatgcccaaaaataaggtgaccaacttggtcgaagacaaaagcattgcatttgccggagtgaagcccggaaagctgaagcatcagtccgagctggtcaattctaacggctcattgttaatttgattaccagtataattcagtaaattttaacctcaaatgtccgagtcgttcggggtcctttcggtagtaacagtcggccaaaaggcgaatattgggctgcaaaataacaacccggtcctaaaaaaacaaaaaagctttggaaagaaaagaacagtcgcaaaccgaatgcttttgaactttctttcgcatatatttttcttttgaaaattttgtacgagattggaaatggcaatttccgctgaccaatttggaaaccttaaaattgaattttgctgaatattaatgaagaggaaagttaaaaaaaaagatgtactaattcgtttgtagtgattccatcctcttttaagctcataatttgattgcttgtaagttgttgagtgctttctgaatattattaaaaattccaagaatgcatgttagatcggcgtttttttttaatttccattaccatttccgtggcccctatctcctgctgaattcccatttgaaaattcggttttaaatggctttgaggcgaattcaatggggcaaagcatgtcaccaccattgctgaccttaagcagaagtgtgttgtcagactgatattcaaacaattattgttatatgaaaaatacttcgaaaatcccataaaaatgtccaattgcgtctttcggattaaaactcagtcgttcaattagcacgcgttgcccacttatcaaacggcacaaacgaatatgttcaccaccaactttacgaacaatagcaaaaacaccttcgtgaattttagagggcttttggtgccaattcattaataagaataggaattttattctgaaatactaagaaaaactccgaccagcagacaggtaattactttattcactttcaatatttttccgttattcaattcattgcattgaactcgataaatctctcctttcctctctctttgacgttttcattgaaattgtttacttttgtttgatctttgagcagttgatgtgttcctttctcgttctcatttcacacccaacctccgtgctttttgagagaatgaacaaatcttaatttttaaaatttttttttgaaaaaaattttcatgaagaatttggctgatagaattcttgggtttccatcatttaggtaaatgtagtaatgatatatatataattaccaaatctaattaaggaaacaaaagacaaagtctaaaaatgaccatcaacacagacaaagcgaggaggtggtgggagagacaaaaggggcatttgttatgttgataagagaagttgagacgaaattgcaccaaacggaaagaaacaaagaattggaggagatgcgagaaaaggaacatgacgagcatcagcaaccccgaaaagaggaaaaagagaggggtaagtctaacgaagcagaagtagattacgcacctttataagggagacagaacagtgcaatttacaggagatgaagcagaaattgggctaaatgacgaggaagagagggcgacatggacaacggaagatggggaaaacgaagagatggatgaagcgaggaaaggaaggacggatgagagcgaattggaagaaagggtagacgaaacggaaaaaatgaaccaggagagagaatggcttcataggcaaagaaatggagaagtggaggtgggcacatcggagattagtccaaaaaatcaggatgtgaatggtggatgtgacctattcgcgtcacgaaagccataatttttcgcaaatggaattccggtacctcattggaaaacaaacgtaaagctgcaccttactgacgtacaaaaattcatttccaatatcccttttaatgccaaggtccctttaatcaaactttcttattcggagctgtttactattttatcgacttatctctcatattgttgattaatgattgcaatagagcgaaacagcccgttgttttcatcaaaaggtggatgagagagagagagggtggggagcgaaacaatttattttattgcatttgatatgtatgtaattgaaaaaatgtaaatgaactccctgattaggtacataattaattaa

SEQ ID NO: 555 - DNA, 1773 bp, Heterodera glycines
atgaatgagacagggattgcgaccaatcggtcggttgccccccccccctccaccagcaatctcctccaaaaatcattcgattatactttgagtttttatcctttttccacccgttctatttttacgctttaagtcgttcggtggccaaaactgtgcgtaaccgttttctttttgccttcctttccatcaattcaaaaggagagggagggaagaaacgcattggtttaactttcaaatggaatgactgttttatatgcatagtatgtgtacatacataattttcatttaatttagaaaaaaacgcaattggaaagaggccaaaaggagcacaattttaaattcaaagacgaagaaaaaaaggcgcaaatggcggacgaaaatgaaagtgagcagcgatcactggagagaatggaaaagtgagaaaaggcaaagagaaagccaagcgcattttaaaatcaaaaaattcagagacatggaaagtgttcaaatgaacggaggacaccagcagcaggaggaagttgaggtgaagcaatgggagaattgttttgcagtcaaagcattgctcaaaacaaatcagaaactgcaaatgacactccgaacattggaagagaaactgcgaaataccaaccaggaaaaggactattacaaaaaacatttcaagggagagaatggcggtttgtgtctttgtcctgctcatccgacaatttattgttacaaatctttggctaatctttagggactcataatggcaattggcgtggacaattgacagacgactttggcaaggagttgctgatggccaataagagaaagtaccagctggagaacaggaccaagcagttggagttggaattgagagagacgcagcaggtgggagtggaaccacttttgtggaatgtaactgattcatacatttttttggggagggtcgcaaattttgaaattttcttaacaaattcattaaaaatccaaaaaattttccccggcggcgcctatcggcaccgccggcccccctgtttccttttttggaaaaaccgcgccgaaaaaaactgttttttgaaatgcaaaaaaaaggtcttcggcggccgaccctccttcgcaaaaattttggccgacccacccccctttatgtatgaactgattagcactcattgattggcaaagccaacatttcacttttttaagaggtgccatcatttgggggaaagtgtgaaaagcatggagaaattgttgtggctggagaaggaacgcagtgccacgttggaaagagagagggaacagttgaggggcgagttgggcgagctgagaaggcacggagacgcgttgaagagggagttggccgaactcagcggagaagaaggcgtcgggggcacggaattcagcaccgaatcacacaatcatcaggtgggcatcgacggagacaccggtaaggttgaatgagttcattctgtaggaaactatcaatcgaatgcatgccgaatttgaacagcagtataacgaaatgcgagatctgaagaataaagtggagtggcgtctcggagaagtcacgcaacaataccgtatatctgtaaaatcggctttttcttttcatttccatcagatgacaccaaatggcgcttggggggaggtggagtccaccttggcccaccgggactgggaattagagcaagcgaacaaccgaatcaaacaattatagacatcagttgcagcaacgtaattaactctttagcttatgaaacaaaaatatcttttctttcagtccatccgcaacat

SEQ ID NO: 556 - DNA, 1824 bp, Heterodera glycines
  misc_feature (37)..(37): n is a, c, g, or t
gactgtcagatggcgaacatctttcctttcgaggatntgaggcgagagaaggaacgctgggagggacgagtggccgaactcaccaaagccactcgacgacgcaaaatggaggttagacaatcattgacaaggcgaatttgaaagaagccacacaaagggtcggagaattggaagcggaaatgacacggaaggacaacttcgaggaacagaagcgaaagttggagtggcgacttggagagatgacacagtggtggaacgacgcgaaatggaggtgggcacaatgcacacaacatgatacccgaaaacgcaccaccaacagaatcggcgaattggaggcgactttgggacacgagggaaacgcacgcaataaccgaggggaaggcaatggagacgacaagtgaaagggaagggacggcgaaaagcaattggtcggtttagcttagctgagactttgggacggttcagggaactgttgagggacggcattttgctcatcagaaaacagtcacatttggacagagacaagtggaagatgatgaaatagtacgtttttagggggggggggaagagactcaccctttgggtatgaccacttgcaaatgaattgaataattaatgattaattggccaattacagtgagcatgcactggagaaggatgttcgtctgaggagttgttggttcgaagtcgattctgaagggcatcaggaagtgtttctgattgtgaggatgggatgggctgaaatggacgttcaattggctgttctgtattcagggcacttttgtgaattgggagtgcgctttgttgtgtgagcaaattcctgaaaagccttcacgtcggggcatttggcttgaccttccccccgggcattatgagtttcgctttcttcgtgacggtttgtggcacacggaaagcaaatacggcgaatgttggaacgaacacgggaccaagaacaattggataaatgtcgagtgatttttcaattttgacaaaattctattaaattcttaattcaatattttgtcagatttattatttttcatcaaatgacttgttttcgttaaattaataataaaaatttaattccattattctcttcacaatgttcggaacaaattggaagagtctgaaataatcagaacataagggtttttaaatgaattagaagaaaaaaacattcttgaggagaacccaatgtaaatgccgaaatgaaagattttctctccgtacctatttcatattgtaatgattcgttttgggagttaatgcgaagtttgaatttctccagtttaaaatgttcgatttcgcgtggagtgaaatgattggtgaaataaaactaatagaggcgaccaccgatggattggctttgggattttggacgatttaacaaagggcggggggggggagaggcggacaatttccaccatttgttctgccaattgttccgctggttcttccgccgattgttctgttccaacgccccaaaacgaacgaaacgtcgcgcgatttgagcagcactaatccgccgccaaaaaagcataagccaattgggcacccgccactgatcaaatgaatggtgtgaaagtgaaaatgcaacgattatttgttgtaatttatctgtccgccgcctttccttccaattaaattaactaattaattaattcaaacatttctctgctgactttgagctgatggacttccccccccccctcaaatcatcgccatattttaagatcactccctccctctcccgcatttgttcgttggtttttagactgatcggaaagtgaatccgtccaattgcccaatcgaaaacactgataa

SEQ ID NO: 557 - DNA, 3217 bp, Heterodera glycines
gccaattgcttaataacgccctgcctcaccctcctaagttcttcttaatggatactgcccatagagcgaatccacccaagagaccaaacgacacccctgaaaaccgaaaaagaatgactgaactgtgggcttcccccgcatcctccacccaacaacaaacataccctctctgattggatctgttaagagtcactgaattggccttggctcggtatcatttacaaacaacacaaagggaagggcacttgagtttattcggacaaccaaacaaacattccaaatgcaaatggaaaattacggcaaatttagccaaatttaaggggcaattaaacccgctgacagataaatgagcaaaatgccctggggccaaaaggaagaaacgaacgatttgccatcgacgtcgacgcagagggaaactaatggcgaaacgtcgccgacgacggaaatgccgtgctcaaagggcttttgcccgagtgccaaaacgaaggtacaaattcaaataaatggtcaccgattcgtcgctcgtgttctggctaattcccttccccaaagacattcgtcggcgacggtccgtcgtcgtccctccgttgtgggctcggcttttgcactttcgattggctccaaaagctgcacaccgccaaatggttgttggccattttgtgcatgtaattttggatgattgccttggggttcaaatgcgcttcttcagatgcgccttcaaccaatccttcgttatcaatgcaatttttcccgtgggcctttcgacgttagagaagcgatttcaaatgagcaggtaaaaaaggtcagcagaggaagcgtacggctaaattcagcacgaggaccggcatcatctccagttggtacgactttgccgttctgatcgccgttttccccgtctgttactacggaaattacggtagggtacggtagaagcaaaggaagggaaacagagccaatcagctgctcggttgaggtctgattgacaaaccataatccatttcaggtcataagggccgatggatttctgtcggcagtcttataatggcattgggctcggctgtctgcgttctgcctcacttcagcagtgccccttggcacatggaccactcacagatggactccaataatgattttggccaatgcgccctcaggcaattcccccctctccctcgagaattgtctttaaatttttattttactatttgctgcctcaggaatacttctcgaccggactgtgctccttctgctgctgtttggggagcatccgacgcatatttcgttatgtttttgctcgggcaaactctccacggttttggcgcgacgccgcttttctcactcggcacggcttatttggacgaaaatgtgtctgaaaagtcttcgcccgtttttctcggtcctttcgatcgatcagaaaaagcattgccccattctgacagttcagccattcactcctttctgaccagcgttggccccatcgttgggctgttcgtcggtgggaagttgctgactttttacgacgatttcgacagagtctccggcagggaaaggtacgccgaagacggcacttggcacccgcgaccattggccactcgccgtttgtttaggttggccatcaaagactcggccgacccgcgttgggtgggcgcctggtgggtcggattcgctgcgtgttccgtcgtttctctgatcatctcctttccgatcatggtttttctttctttgtgttttcctttttcatttgggcattttttcaaatgttcgcccatgaattgcccgaggcgaagaaacggcgagaaaatgaagttgatttatcagttattttattaggcgggtatttcacattaatccattcagcagatgcacaccgtcacaaaaatggtcacaaataacgacattttatgcaaaaaaagcttcagacttttgagcaaagacattttggtgggtaaaggcactcactcagtgatctgttccaattcgaatcattttgatcacaaatctcattttcattgttttatcaattcatccatggacactttttaggtgcttttaagcagtccaacttttgtcgccattatttttgtcggcattttcgagtccatcgtcctcaacggcttttcctctttcatgcccaaaatcctggagataattctgaatacttctccaacagttggctcttatttgtcatgtatgccatctttcccattcagtttaattttgccatttagccgttataatttttggtgccgccgggggagtgatggtcggtggcattttagttcgacaattgcagttgcaagtgggaggaatgctaaagatggttttgctttgtcatttagtgagtttttgaggccgggtgtacagagacttggacaatcaaccgaatttgtagaatatcaagctttgaaggggggggggtgccatttgacccttttgtcgtttgtcccttttgacgttttgtccgtctgtccctccctccttctgtctgtttgtctgttccatgtcctttttatgggccgccctttctctgatctcctgcatgcttctcaagtgtccctctcgcgaattggtcggtatcaccgtcgcctacgaccacaagttcgtgctgttcttctgttcccttccctcctcttatccctctgatcactttttctgatcagttcgtcgtccctcactttgcttgaaaatctttgtaattccgagtgccattgcgacgccaattttcgccccgtttgcgacagaagcagtggccgaacgtattactcggcatgttacgcgggctgctcccttcgacaggaagaaattgatggaattgtgagttccaaaaaggaggtgggaagcattgacccatccgtccctccttttgttccttaattgccgttaattgctttttcccagggcactctttggggcgattgtagctgcgtacgaaatgtttctttgccgaccaatgccaatttttcgtccgctcgccatttggccaacggtttttgccccgttgattgcggttggactctttggctgttccttttcctcctctttttgtcggttgtcgccagttttgcggccggcattccgacccaacaggcacattccccaccatgtcatgcttatccctaattgcctcattagattatgctcagagtcattcccctccagcaaaggactttgggcatagcagtcaattggacttttctgcgccttcttggtacgctctgct

SEQ ID NO: 558 - DNA, 3168 bp, Heterodera glycines
cgccacgcacggcccatgccaaaggcaattccattgactctcctgagtctatggcactctaacggaagaacattttgagaggaaaagtggtcattcgaacactcccatttgaattcattgtttttttaatctaatgggttcttccccccccccccccccccctcccattgtttgtccgtcgttccgtcccattgttcacccgcaaaagtgggggggggggaggaggaagacacatgaactatgtaatgtttgtgcagctttacgttatggcttaatggttacataaaatcaatcgaattgaaatttaaagtattttttacctaatttaaataataaaaaaacatacgccaaattaatgttacttgcgcaattacaaagaaaaagcagaaaatgaatgatagcaaatggaattttgttaggaaaatggtgggtgatgactcatcgctcatcaccactcggtgactcatcccatcttcatataataatccatctcatctcgtttctcccattgactttcccaccctttgacccttttgctttgacccctctttccgtcccccgtccttttccctccgttctccgttttctgcgacaatcaatttacgttttcgctgtctcttctctgcccaagccaatacattttgttttcttcaaatggccacagaatgtaaaactccgtccatcggcggtcccttcgttcgctttttgtccgatcaccgctcactcagtccatcctccgcattttcttccgtttcctttgattagatggatgaccaatcaatttccttccgctgatcgtcgcttcccactttttggccgtcgttttctcatcgtttctttctgacaattgtcacttttctggccatgttaggcaacggaaatgacaatgcgtcgacgtcatcctttgctcagaattcgctggaggaactgctcaccgccactgatttgctgaggtttttgttctgtttttcttggccaattgtcctccgttcttcattgtttgtcagttaccacgacgcactgaaaaatgtgctaaaattgcgccatgccggagacataggggacacggacagcgcggatttggatgggattggcatgagcaggcccgagcagaggcgactgatgcgggaatacgccaaacactacgcattggagcaacggcagcagaacggcgtcgtttggaagaagttcagactgaaagtgtttggggaggcgaaacagtgcaaacagcgaaaagtgacgggggagacggaccattggcaggggccgggaggggaggcggagacggcgcagcagccgcaacaccacatcatcccgccggaacgcgtcactctgtgcaagaaaataggcaccggcgagtttggccacgtattccaaggtccgctccaaacatctccccgaataaaaggctcttttggtttaagccgcttggcgagacgcaacaggcgatgggaaaaaggcgattcaggttgagtttgggggggggggagttgaccagcagaagccaatcggcccactctccaaaggtggcggtgaagcggattctgccggagaagctcatctcgcaacacgcgtcctttctgcaggaagcggccataatgacgcggatgcatcatccgaatgtaatccgattgttcggcgttgtgctggagacaaaggcggtgatgctggtgggtgttggctcgcttttcgtctcccattagctagcttattattaggtgtccgaactcgccccctgcggctctctgctcgagtgcctccaatgtccgtcgtggagagagcccttttcggtcgctgtcctctccgattttgcgttgcaaattgcccagggcatgcgttacctttccagtcacaggtccctccccccccacccaattttccaattccttccgctgaccgtcgccccccaaaggctcatccaccgcgacctcgccgctcgcaatgttctcgtgtgtactccaagcaaggtcagaccagcgagtgttaccctgacaatgaccggcgcctgtgctttgccaggtcaaaatctccgactttgggctcagccgttgcctgggccatggcgaggattactaccgcagtgagttcactccgtccatgaaattgcccatcgcgtggtgtgcgcccgaatgcatcaattttctgcgctttacctcagcctccgatgtgtgggcttacggcatttgtttgtgggaaatgttttcttacggcaaaactccctgggaagggatgagcggctcacaggtgagcagaggacgaggaaggcaccgcagggggagggagggcaaagatgggaatgaataggatttggcaaaaacacagggggattggcaccagcaagggttgagcgcactgcgattcgcgtttttttcccgcgatttgcgaccgcgggcttttctgtatacgttcacctctgattgacacagttggggggatgacgagaacgaaatattttattttttgagtttgaaaaacgccgccgagaaaactgacagattttatttccacgaagattctccattccatcgacacccaacgcaaaaagttgcactgtcccgaggcgtgtccccgcgaggcgtatttgctgatgctcaattgctgggaatgggaggcgcatttgaggcccacttttgaacaaatctgtgaccgccttccttcgatggttccccctcttttggtgacaatttgcgaaagtggcaccgccaaaagtggccaactcaattacggaagagatgaaaccatcgcattgattgacaaaaagtaaggccaacccattaattacttaatgtatttccgaattagcccttgcgggaaggagggcttttggcgaggaatttcgaaggcgggaaaagtcggactgttccgtcccgaggacacaatcgcatttttgggtgcggaaaacccttcggcaaagggcgacgcgctttcggaacaactaaggacagaaaaaggcaaaatgaaaaagcaattggacaaagaaaagaagcggaaaaaggcggtggaaataagcgagccgaagggcgacttacggcacacgtgccatgtgggggcggacgggagaagttttggccttttgaatgtgagtggacattcgattggaaatgttgggggggggcggcatttctaatgcatgtgccaattccgcaggtcaacaaaagtgacttggcc

SEQ ID NO: 559 - DNA, 2860 bp, Heterodera glycines
atgaccacttcgatggtttcactgccaccgccaaggccaccgaaaaatgggacaaaacagagaaaaaagacggaggcggaaaatggggatgaaatgacaagaagtgtgtgcattggccaaattaacggttagaggggaggggggggaggggaatggacaattaaagcaccgaaagggcatgccaactaatgagcgtggatattggggcagttggcaacgagggaggggggggggcgggtttaaagtgtcacattcactaataagcattcgcctaattcaatgaatttcattttccttttgttgggcaaaatttatgggtcacaatgtatttcagaaaatttccaaataattgcttctctaaatgcaaaataacataattaggaaatgatcaattgcttctaatctctgccgctgggcattgttccgtcgcggagtatttaaacgcgtcgtccgccgccgcttcgctctctccgcccgcccttcccccgaaaccgccgcgcttccgctcgtttgccaatttctccgattggccttccccctccgcgcccagcgccagcccaacggacactttgagccaaccgaaatttggacaacatattcaatcaccaattaaccttcccgatcaaacgcatcctcctgaaccgattcatcacaactcaaaaccaactgaagaagaaaggaaacggaaaaagtcaaaggaaacagaggaggacagagggaggaaaagcgacgaagaagcagagaaaagaggaaagagcaaagaaaagagagaggggaaagacggaggaagagatcgggaggggaaggaggaggaggaggagagagagagaggaggaaagagagaggaagagagagaggaggaggaggaggaaaatgaggaggacgaatcactgatcagacgaccgtccagcgtttgctgcgagttcagcagcaaaggcgaggacggggaggaggagaagcgcattctgcaggtgctcactgacctccaacgcgacctcacaaacttttcgctttgttcgctggacgattgctcggaagggcggccattgctcgacggggagcaaaggagagaaaagtccgtccgatttgaaagtttaacggacgaagaccgattcatttaattcatttacaggaaacttaccgaggaggaggagaggaaaaggcacctcagggaattgtcattggaacggcacggaattgtgacgggacattcggcagaaattgtggggatggaccgagccgaattggagcgaagaaccaacgaggagcggaggagggtgctgaagaagctggtcagggacggcggcgaggagagcgcggacgaaaagagagcttcttttgtgggcagcttcatctcttcggcaagcaaaatgcttgtcggagggacaaatcacggcacaaacggcgggtaggcaaaagcaaaagccatgggggaaagtgaaagccatggaagcaaaagcaatggggtgcctttgggaaacagccaatccgaatggctagcccaactttggcatgcttaaatgcccctgtttatttattcctccaatgatggcatttccgcacttcagcaaagagccattggcaaattggccccccgaagcgcaagaagcatacaaactgctggtgcaatgtggccacaatctcaagggaacatcaatcaacgaagggcattccgagggaaaaaagccatcgccgaaaagcaacgacggaacacttggacaaactgcggaaatgatcgaactgccaaaaaaaattgaatatatcaattcgatgttggtcggctgggaaggagaaaaacgggggaaacgaagtgatcggaaagacacattggaaaggagaagtgatcgaaggaaggacgaattgcatttggcggaagcatcacttcaaaatgagtcgccaccaccagtgccaccaaagccaatggcaagggcgaggtgggcacaaattgggaacaattttgatcaagggaagacagaggataagcaaagtcgatcatttgattaattagcagggttgaacagcagtagtaaatgaaaatgcagagaagaaacgaagctacggaagcaggtgaacgaagcaataaaagaacgaaggcgcaaagccaagggcatttcaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaatttgatcggttattctctgggcatttgaatgccaagac

SEQ ID NO: 560 - DNA, 2006 bp, Heterodera glycines
cgattggaaagtctgataattgagtcttagagattgaaatgctgatgggttgattttcagtgattggaatgtcattgaaagttagtgggttgagtcccagtgtttagaatgccggagctttgagtccattgtttggaatgctggtgggttgagttccagcgattgaaatgctggtgggttgagctccagcgattggaaagcctgagaattgagtttcagagattgaaatgctgatgggttgattttcagtgattggaatgtcattgaacgttagtgggttgagtcccagtgtttggaatgccggagatttgagtccattgtttggaatgctgttgggttgagacacaaaaatcacaaaatttaaattttttctgggggttttggagtcgttctgcacataattctcccgacatctttgagctccccacaattttttgtgcgatttcactgtgtaatttcggcccacaaattcgccgccctcctccatttggtggtgcaccatttcacacagctgacaaaaggcggaagtcttcacagtcggcacccatcgcttctggtagaattttgtccaattgaaatatcttaaaaattaaaaggcattttttggcgaaatgtttgttggcaattaatggcattatactatttttaacaattttaaaatttataagttttgccattgacccttttgtccattaaatactgaccccaaatatcggtccttgtccttgtgcaatgccttcagatggtcggccaatgccgtggcattgtcaaaatcgtccgctgcgatgtacaaatcgtccggaatgcccgactcgcgcaccacttccctgcacagcacaaccggcactgtcaaactgcgcaaagcgttccaaaatttctccgttacatattcggagcacaccgtattttcaaaggccaaatagaaaaagtgggattttgcaaggtgaaatttttgttgatagaaaataaaatcctatttaacaggactccgagtccttcagtcccatcaaatgttttatccccaaatcctcggctgcgcatccaaaaaaccttatcccaaatgactgtgccacccaatcaatcgatcggtcgtcattcactcacccatttgctgctgataacatttttgcccatcacagtgttttccgctgcacctgccgaacatgtccaactcaatgagctcctgcaattgctttgtcagcacgtctctgccggagggagccccgcaatgggacacaatttggagggcaaatcgttttttgcgggacattctctcgctgatctgacaaattgggaaaggaatagaggaccgaataatgggtgaaaagataaggctaaactgtctaaattatatccacaaataatatttttgaaaaattttcgacaaaaaaggataattagggcgggcgttgaacggtataagaatttttataattattttttttcgtggagaagttgaaacgtatcaaagtggcggatttaaaaaaccaattaacggctcgggaaaattccaaaccctaagcatttttaaattacaatatttaattatttggatgagccacaataagcatatcccaaccctttactcacttccgcagcgctccaaatctcttccggtgacgtcagtggcgtaattggggtcaattggccatacggcactggaatggtactgtcgcgattgtacgttatggaccagggctgaacgtaactgattttcagttacggtcatccgtaatccgtcattacggcgattttttcagttacggccatccgtaatccgtcattacggaggtccaaaaaggccgtaatttggcgtaatccgtaatacgtaatccgtaattttcaaaaattttttttaatttaaaaaatccaatctaaaaattgttaagattaatttatgatcagaatatctgcttgttttttgaggtgaaaatcccaaaatagtttttttcgcggtgtgctttttccaaaaaactggggaatgtggggggggggggccgggtcag

SEQ ID NO: 561 - DNA, 2041 bp, Heterodera glycines
aataagtcaggttaaattgaaaatatagggtagcttttaaataaaaatagaaaaaaaaaattcattttataaaaaataatcttgcaagaaatcgtctcgaaaaataatttaaagagccagttccggatcaaaattacggaaaatcccaaaaatctgtaccgtaattcgtactccaaaaaggccgtataattaattaatggcttagatttaaatcaaaattgcagcatattaaatctgtaaaattcatctgaaaaacagatacatacgaaaacttaactcattaccttggttgataattaagcacaggaagatgatttaggaaattttccttcacctattttcatattaaaataagagcgtaaaaacaaaaaccaatatcctgtcctgcaaaataatatgaccgaaaaatttacccatttcaaagggagtgaattatgtatgggaatctgtttctgaaatttcactttcacaaataatgtttataaaatgccttcgtagaaaaaatttgttttcttctaattttataattgctttggaataattacttccaacaattatcaaaagttagtgaaatttgttgaaagaattaattaatggcttagatttaaatcaaaattgcagcatattaaatctgtaaaattcatctgaaaaacagatacatacgaaaacttaactcattaccttggttgataattaagcacaggaagatgatttaggaaattttccttcacctattttcatattaaaataagagcgtaaaaacaaaaaccaatatcctgcaaaaaaatgactaagattttggagctaatatttaaaaataattatgaatttttggggcgggcggtgccgataagcgccgccgaggataattttttttcagaattttaacgaattttgttaaaaaatagccaaatttttagcatttcctcttttcccctttgctagcttccccccccccctttatgtatattaataatactacaaattaccaagaataagtcagattaaatcgaaatataggtagccttttaataaaaatagaaaaaaaaaattcattttataaaaaataatcttgcaagaaatcgtctcgaaaaataatctaaaaagccagttacggatcaaaattacggaaaaatcccaaaaatctgtaacccgtaattcgtaactccaaaaaggccgtaataattaattaatggcttagatttaaatcaaaattgcagcatattaaatctgtaaaattcatctgaaaaacagatacatacgaaaacttaactcattaccttggttgataattaagcacaggaagatgatttaggaaattttccttcacctattttcatattaaaataagagcgtaaaaacaaaaaccaatatcctgcaaaataatatgaccgaaaaatttacccatttcaaagggagtgaattatgtatgggaatctgtttctgaaatttcactttcacaaataatgtttataaaatgccttcgtagaaaaaatttgttttcttctaattttataattgctttggaataattacttccaacaattatcaaaagttagtgaaatttgttgaaagaattaattaatggcttagatttaaatcaaaattgcagcatattaaatctgtaaaattcatctgaaaaacagatacatacgaaaacttaactcattaccttggttgataattaagcacaggaagatgatttaggaaattttccttcacctattttcatattaaaataagagcgtaaaaacaaaaaccaatatcctgcaaaataatatgaccgaaaaatttacccatttcaaagggagtgaattatgtatgggaatctgtttctgaaatttcactttcacaaataatgtttataaaatgccttcgtagaaaaaatttgttttcttctaatgttataattgctttggaataattacttccaacaattatcaaaagttagtgaaatttgttgaaagaattaattaatggctaagatttaaatcaaaattgcagcatattaaatctgtaaaattcatctgaaaaacagata

SEQ ID NO: 562 - DNA, 7868 bp, Heterodera glycines
ggatagctttggcgaacatggaaaatcactgccgatgccgaactttcacttgaattaagcatataattttgcacggatttgttggcgcgtgaagctaatgaacgggggggaataaacagacgggtataagtcagggcttgtcctaagctttgtgccggagttctgaatttcagtacctttttatgtttgctaatattaaaaattacggtatggaatggcatttattggaccaccagtgccatcatcggccaacagcagatggaaactgaaaatctttaattaaaattacaattaatgaagcaattacgggttgggctgagacttttcaacataaaacctttaaaattagaaataaaatagtattctttatgaggattgaaccaagcaatataaagatagactgaagtttaacttctaagggcatgcaaatcttttaaaatcgaaaaaaatacaaatcatttaactgttctgctgggcatttagaattgcttatatttgtttgtttccaaaagtttcgatcaaaaattcattttgattaattttttgatataaattcaaaaaaaaattgaaaaaagatcgtactaattgagccggtctataattattaacataatttatttttattttggttttttgaatgaagcactgctgctttaacaaaaaacattctacgaacaatttttacgaataattattattggaaatgtgaaactgagagagatgagctcatcttttttacttaatggaaattcagcaaacaaatcaaaaacaacaaaaaattatttgcataaatgaaaaatataatcattcttttaaccgggatcacaattactcccggtctcctccccttccggcctgtactgtgtaattttaatgcaatttgttaacagatttgtccacaaaataaaacctcaaatcatcatttcaaaaaaaaaaatcctcaatgacctatcaaaaaaccacaaaatgaggataaatcctcagatctgcgagccctgtgtatcaggggtgtgacttatctcagaaaagacgagagcgagagtcaaaggatttttagggtccagcgatgccgttaggcaccgccgtggaaaataaggacaaagggtaaccctgttctaagcctattttggtcctttttatggcattttgtgattagttcacttcttacgaagaatttttttgtttatacatatttttatttacataattcgcaaattttcttacataaaattagcagtcctatttattattaatataattagtagggagtccaattatatggaaatccatattttttttcctggactgtgggaggcctgaaacgcacgaaaaacatgtttttagcttggtttgaagcttctaggaaggatttctatatccatattttccatattttaccatatttcgcgatttatgtccatatttccatattttggcatttttcaaaaaaacctctattagaacggcccccagcagctaaattagcctttttgagcccaaaacccgaaaaaattttcaaaaaatcattttttcgccaaaatttctcgagaatattgaataaatttaaattttcttaaaaattaataaatttatgtcaaaaataatcaaaaaagcgaaaatttcgcttttgtggttgattttgcgctaaaaaaattaataaattttagctttcatgttttttttcttctaaaatgattgcacagaattgccgaaaaaattcgagaccaatttccgaatgttgaccgactaattgcaaaacgaaagccgtctttgtcaaagcgtcttaccgagtcaaaaaatttggaaatgtatctcatatgcaatttcaatcaataaatttgaagaaattttacattcaattttgaaaaatttatgtccatattttgacatttttgccattttatgtccatattttgcgatttttgatccatattttatggccatatttcgcgattttagttgaaaaagtaggtgaaaaattattttgtggggtattttgaggtgctgatcgatgaaaccatcaccgagttatgaatttcgaatattcgaccaaatttctgagggccaaaaaattgcaaaatattttcgaatttttaaaaaattctaaaatttccgaaacaaaaaataagcatcatattcgtgctcagcaccgcaaaataccccacaaaataatttttcacccactttttcaacccaaaaaaaaatttcgaaaatttctagggggcctagctcgaaaatttttgaaattttccgggcatatagcacaccgttcgatagagcttaaaaagctctacaattttgctctaaggcaatttttcgctaaaaccaaccctcacgagttatgggccagggactcaaatgtcccgctcaggccaaaatttttttctatttccgggaaaaaatcgaaatttttctaaaaataccaccaatcgatagagctcgaaaaacgatgttttggaagtggtctccgttttcccgggaaaaatcgttaaaaaatcttaaaattcaaaaacccgaaaaccgttttttaggcctagctcgaaaaattttgaaaattttcgaaattttaaaacttggttggatagcctttcaaatactatacatttttgctcagaaacaattttcgttcaaagcaacccctggcgagttattcgcctggtactgaagtgtacacttttgggtaaaaaaaattagccaaggctacagccttgggcgcccaatgtagggcttaggttttgctggcaaagttgtcggggatagtctgacttaaaatcctaccagcaagagctaagcgatcccggtccaaagaaaaaatttcgtagaagaaaaactgcaagaaaaagtgagaaatccgtccctgggactcagtcgtccgcgctgaatttttttctatagttttcccggatgcgcctcaaaaagttgtaagacccttccactactttcagggcgctcccggccttcggccaggagaaaatggttttagcaacgaaactccttgtcaatataacataaatagtaactagcgggtgcgtgaaccgtcggctatttcgctgggaaaaagcgcttcgcgctttgggagcttcgctacctaggcctgatcatgacttatagggtgagaaggttcaaagaggtacaacagtgactaaaagaggtacaaatgtgattagaagaggtcaacagtaattagaagagttgtggagtaattgttagaagaggtacaacagtgattagaagaggtacaacagtgatcagaagaggtacaactgtgattaaaagaggtacaactgtgattaggagaggtacaatggtgattaaaagtgctacaacactgatcagaatccgaagcatgttaggggtttttcgggcgcttcgcgcccgttttttaaattttgttgggcttggacgggcgcttcgcgcccgtttctaatttttaaaaaattgacagtgattaaaagaggtacaaaagtaatcagaagaggtacaactgtgattttaagagctacaacagtgatcagaagaggtactacagagattagaagaggtacaaaagcgattagaaaaggtacaacagtgattaaaagagagaggtacaacaattcgcggccttagtcgggcgcttcgcgcccgtttttcaattttattggccttggacgggcgcttagcgcccgttttttaaattttgttggttcagatgggcgcttcgctccctttttaaatttgttaaactcatacgggcgcttcgcgcccgttttttagcttgttatgccgttcgcggcctcagtcgggcgcttcgcgcccgtttttcaatttagttgggccttttcgcccgcttcgcagcctcagacgggcgcttcgcgcccgttttttaaacttgttgagatcgcacgtgcgcttcgcgcccgtttttcatattttgttttgctttgacgggcgcttcgcgcccgttttttaaatttgttaagctcagacgggcgcttcgcgcccgtttttaaatttagttgggccttttcggccgctttgcggcctcagacgggcgcttcgcgcccgttttttaaatttgttgagatcggacgggcgcctcgcgcccgttacaacggtgttagaagaggttcaatagtgatcagaagaggtacaacagtgatcagaagatgtacaactgtgataaaaagggtacaacagtgattaaaataggtacaacagagattagaagaggtacaacagagattagaagagttacaaaaatgattagaagaggtgcaaaagtgactaaaagaggtgcaacagtgatcagaagaggtaaaacggtgattagaagaggtacatcagattagaagaggtaaactgttattagaagaggtgcaacagtgattaaaagaggtacaacaatgatgagaagaggtacaacagtgattataagaggtacaacagagattagaagagttacaaaaatgattagaagaggtgcaaaagtgactaaaagaggtacaacagtgattagaaagtgggcattcaaatagagcatttacggtaattaaggaattgtttttattcaaaatagataaaaaatcgatgtgttatatttttcattttttaaaatattatacactttttattaatgaaaaacaaattatgaaatgtataataattgaatagttatttaaattgaaatgaaaaaaattttacaattaaattttaaaataatagctgaaattctttaattaaatataataaataatttaaatgaaaatcattattcatcaaaaaataatttaattaaactaaaaaaatttattattaataaaaccaaacatttaagtttattaaaagtaatgaaaattaacccaaaaaatacaaagaaaaataatgtacaccgtccggcttcgaactttgccccccccccccaaaaaatgatgcctcagaatccccaatcacacagggatcctgaggtcttaacgatgtcaaaagtaaaatctgatcacgtattcgtgatcagcggcccaaataacccctaaagacatgttttttgaagatttttggtgaaaaaatttttcaactcaaaaatcctatgctcacccctttggtcccgaatctcaaaatcacttttatttttataaaaattcttaaaaaagtgatacaaatgccaaataaaatttatacaatagagaaaaaaactgcggatttttgtagtattttatttttccagaatatcttttcagaaccgagttatgaatttttttctgaaaattcgaatttttccagaaattctggaataacttttttccttttttagatagaaattccaaataaagtccataaaattctcctgatttttctctatttttaaggctttattcctgtaaaattgatcaacccttcgatttgttatgaattttcaaattttaacccaaatttccaaggaccaaaaaattgaaaaatattttcgaatttttaaaaaagttcacttttacaacaaaaaacccgaattttgcttttaagcaaaattcgtttgaaattggaggccccttttcgcacaaaatccttaaaaaaacccctaaaaaatcactttttttgccatcaaaatatttgtccactgaaacatcgaaacgggcgaaagcagtgccaatttgaggccaagttgagcatggtcaacagttggaaaatgtccatccaaacattttggcggttgctgaaaatcttaagaatataaaattacaaaaaaaaaaaaaaaaacactaaaatagttcacatttacaaaaaaaccgaattttgcttttaggcaaagtgtttgaaattggaggccccttttcgtacaaaatccttaaaaaacaacaaaaagcataaaaaacaatcactctttaccatcgaaatgtttgtccaccaaagttcgaaacatggcgaaagaagtgccatattcatttacaaaaataaatttaaaaaattgccaaatttggaaaatttttatttttagagcaattttgaaatgtaggcccccgtttgggcacaaactgcttaaaaaatattcggcgctatattaaaagtgggcctttttgaaaattttttaaaaggggggacacacttttgttttgcaaaatttttttgtgatagtcataaaaatttattctctggggtttttggggtccccgatcacgaatccttcaattattttgatcaattccgatttcctaatctaaatttgaacaaaaaatcataatttgaaaaattcaaaataatagaaaattcctaaaaaaatttcactttttttaagtgcaaaccaaaaattgtagagcttagaaaatattttaatggtcaattaaaaaaaaaataaaacttacgacttaatccactttcgccatcgaaatgtttgtcgaccagcgcatagaaaggggcgaaatcagtgccaatttgagttcgagttgagaacgttccaaaagggggaaaatatccatcagaaatatcgttgcatacaaagctgaaaaaagtgaaaaaaattgcatgaaaaaagccaaaaaatgaatatggatattttaaaacaaaaaattttttgcaaaaaaaaagctaagtaaggcattatcagactgtgtttttattacttacacaaacaaagggtaaaaatcaatttttcaatagacgtaaaagttgagtaaatcaataacgcacaccatctcaaacatgagaatgaaataaacagatggcatataaaaaaatacaaattatggacaataaaattaattaatttgaaacaaaaaatttattcatcaaaaataatttaatttaaatttaaaattatttattaatttttaataaaacaaaaaggttaaaattaatttaaaacggtgaaaataacttaaaatgcattaattagaagaggtagaggtacaacagtgactaaaagaggtgtacaacggtaattagaagaggtacagcagtgattagaagaggtacaacgatgattaaaagaggtacaacagtgatcagaagaggtacaacagtgattaaaagaggtgcaacagtgattaaaagaggtacagcagtgattaaaagaggtgcaacagtgatcagaagaggtacaacagtgattagaagaggtacagcagtgattaaaagagctacaaaagtgattagaagagctacaaaagtgattagaagagctacaaaaggattataagaggttaaacagtgatcagaagaggtacaacagtgattagaagatgtgcaacagtgattagtagaggtacaaaagtgattagaagaggtacaactgtgatcagaagaggtacaactgtgattaaaagaggtacaaaagtgattagaagagctacaaaaggattagaagaggttcaacagtgatcagaagaggtacaacagtgattagaagatgtgcaacagtgattagtagaggtacaaaagtgattagaagaattttttaacaaatttaatttaaaaaatacatgaaattctatcaattaaaaaataattaatttaaacttataaaatttatttatcaaaaaaaaattaaattaaatataattttttatttattaactcaacaaaatattttaaattaattaaaatcattgaaaataacgtaaaaatgcacagaaaaataatgttacaccgtacggattcgaacttcccccccccctcaaaatgatgcctcagaatccccaatcacacagggattctgaggtcttaacgatgtcaaaagtaaaatctgatcacgtattcgtgatcagcggcccgaataacgactaaagacatgtttttggaaaatttttgacgaaaaaattttttcactcaaaaaccatgtgctcccccctttggacccgaagcacaaaatcacttttatttttatatctttttttagactc

SEQ ID NO: 563 - DNA, 1525 bp, Heterodera glycines
agcagtgattagaagaggtacaacgatgattaagagaggtacaacagtgatcagaagaggtacaacagtgattaaaagaggtgcaacagtgattaaaagaggtacagcagtgattaaaagaggtgcaacagtgatcagaagaggtacaacagtgattagaagaggtacagcagtgattaaaagagctacaaaagtgattagaagagctacaaaagtgattagaagagctacaaaaggattataagaggttaaacagtgatcagaagaggtacaacagtgattagaagatgtgcaacagtgattagtagaggtacaaaagtgattagaagaggtacaactgtgatcagaagaggtacaactgtgattaaaagaggtacaaaagtgattagaagagctacaaaaggattagaagaggttcaacagtgatcagaagaggtacaacagtgattagaagatgtgcaacagtgattagtagaggtacaaaagtgattagaagaattttttaacaaatttaatttaaaaaatacatgaaattctatcaattaaaaaataattaatttaaacttataaaatttatttatcaaaaaaaaattaaattaaatataattttttatttattaactcaacaaaatattttaaattaattaaaatcattgaaaataacgtaaaaatgcacagaaaaataatgttacaccgtacggattcgaacttcccccccccctcaaaatgatgcctcagaatccccaatcacacagggattctgaggtcttaacgatgtcaaaagtaaaatctgatcacgtattcgtgatcagcggcccgaataacgactaaagacatgtttttggaaaatttttgacgaaaaaattttttcactcaaaaaccatgtgctcccccctttggacccgaagcacaaaatcacttttatttttatatctttttttaaagaagtgataaaaataccaaataaaatttatataatagagcaaaaaattgcggatttttgtagtattttacttttacagaatgacttttctgaaccgagttataaaattttatctgaaaatccgaatttttccagaaattctggaataactttttttcttttgaacattataaaaccaaataaatctcataaaattctccttatttttctttatttttaaagctttatttcattaaaattggccaacacaacacattgttatgaattttcaaatattagcccaaaatcccaagggtcaaaaaattgaaaaatattttcgaatttttaaaaaattctaaaatttccaaaacttaaaataaacattatattcgtattcagcacctcaaaataccccagaaaaaaaattttcacccccattttggcccacaaaaaaaaatttgaaaatttctagggggcctagctcgaaaaattttgaaattttccagacttatagtacaccattcgatagcatttaaaatgctctacaaaaatgttctaaggcaatttttggctaaaaccgatccctgacgagttataagcccg

SEQ ID NO: 564 - DNA, 1024 bp, Heterodera glycines
ataggtgatgtcatggcaaagaaggcaattgtgtaggccagggctaggcctaatattagctaggcttgggcctaagcttcaattttctaaatttatttttgtacgttttgccattgacccaaataggtaaccagtcataaaactaaaaaaaacatacgaagagtcaaattgtccacggtgttcaccgacagttttttccatggcggttgatgttcatcaacatccatatcggccccctgttggttgtctcgacgtgggaactttttgcgccgattactccgaaaaggatatgccggtaggcaccgcggatgtgcgcgagtcggactccgtgttcaaaggaacggacgccacccagatgactcgagtgcccgtcaactgtctcgagcttgttcttccgaccgtgtgcgtgtaggtatggtcgcgtgcatgtttgtttgcgtgatcgcccgtttagtgatttggtgcaccactgtcccgacttcgctgctagtgatgatgaagatgaacaggacgaatatgaagagaaataagaacaaacacaagaggatttcggaaggtgaggaggaggaggaggatgagcgatatgataaaaacaataaaatgtagaagataattacacccgagtaatccatccaagtttatcgaacgaaaaagaaaaaacaaaataaacgacagacaacagaaaaaatcacagagtcataatacagagaaaacggtttttcttttttcttatagttatatagagaactgtttgggatggtgtgtgtgttatggtcacgtcctttcgatggtctcatttcgacgaggtgtatttggtcacgggtttggtccccctcaaaaacggcatgctttgccaactcgcccggaaggatgagacgcgacccgccgcctgaatttcacgtagaacagattgccgaacgcttgttgtaatgggtcaaaccgaatgtttcggcagcaatgggtttcaacccatcattaccaaacctaaaaaaaggcaggaaaatttgaattgattaaatttggg

SEQ ID NO: 565 - DNA, 2823 bp, Heterodera glycines
gtcaaattgtgcactggtgttcgccgacagttttttccatggcggttgatgttcatcaacatccatatcggccccctgttgtttgtctcgacggtggcaactttttgcgccgtttactccgaaaaggatatgccggcaggtcggcggatgtgcgcgagtcggactccgtgttcaaagtaacggacgccacccgatgcgcagtgccctcaatgtccgagttgttttccgccgtggtgttaggatggcgttgttgttgctgctgacggcgcgaggaatgttcaccactgtttgccatcggtggatgacaatcaatttttttcattggagtaaaaggaatggcataaatcccgaaacaggagacaaaaattggatttgaataggggtaaaattgtaaaatatgataaaaacaatacaatttagaagataattacacccaagtcatccatccaagtttatcgaacgaaaaagaaaaaacaaaataaacgacagacaaaagaaaaaatcaaagagtcataatacagagaaaacggtttttcttttttcttatagttatatagagaactgtttgggatggtgtgtgtgttttggtcacgtcctttcgatggtctcatttcgacgaggtgtatttggtcacggctttggtcccctcagaaacggcatgctttgccaactcgcccggaaggatgagacgcaccgccgtctgaatttcacgagaagagattgtcgagcgcttgttgtaatgggccagacgcgatgcttcggcagcaatgcgttcgaacacatcattaacaaacctaaaaaaaggcagggaaaattgaattgcattaaatttgggtgtcaaaatagttaggttattggaaattagcgaaaaattgcttggaaaaatgcatttagttgaataaaaatgcaatattagctattggatttggttttaatgtataaattcattcatttttgaccgcaaaaatcccttttttgagcattgaaatgtcaaatattgaaggcgtgattttctcgaaaaagaattcatatctttgagccttaaatactgaaattcctcttaaaagctgaaaagaaaagcgaaaatttaaaaaattcataaagaccgacgagttcataatagacatggccttggacgagatgccggtgtcagggtggacctgcttcagcacacggtaaatgtagacctaaaaacaggggttttaagtgctggccataacactcagactcacgccccggggcacaataaacttactgagtacgactccttgcgagacttcttacgcttcttgtcagccgtgcgcaccgtcttggtggacttcactgcctttttcgccccttttcccgatggctttggtggcattttatttgaatgaaagaagagagaagatttgttgagagaagcaaatgattgattttctaaaagcaaaatgaagatgagagagagagagagaaactgtgcaaattttatattcaaaaatgaggggatccgcctactcaacaaaaagcaaacagggaagaagggcacgacacgcccatccaaaagaaaaacaaattgaaaaaactaaggaaaccatgaatttaaatattttggtattcggaaagaaatgagcaattcaattctttaaaaggcttaaaagatttggtgtttttctaaaaagtacatgtaactgacgaggtacatacaatcaatgcaaattttatattcaaaaaaggggggaggggactgcctattcaacaaaaaccccaaaaaggaaagggcactcactcactacacactcatccaaacgaaaagaaatgaaaattataaaaaaaaaattatgaacgttagaaatgtaaagaaacattgaacatccccatttttatagacaaagaaaacccccgactgtttttcacaccgagtcaaaaaacaaaaaatgaaccaataaatagagagactgcagagaaaaacacttttcattttcgatggaattttatcgagcggcttaattgtctaacaacaataagcccgatctcgagcattatatgtagtttagcttcaatctccagggctctagtgaaatgcttgatgtttgatcattcataagtttgttgatttgatcgttgcattgtgatttaatggttggttagtgcattaatcgatgtacttaggtacatatctatctacctaattaagtaattactttttattaccaattatgcgtttttttatcgccctttttgtttttgctgccttacaaagtgtgctttggtcctctaagacgagctcattatcttttttgaagtccctttcccgttgaataaattgcaacaatctttccgattccgttattttcaaagaaaatttttccattttaatgtctgcaatgtttgattattgtgtcgcttcttgctctggcgaaggccagcagaaaaatgacggcggtccaacaacagtttcaacgagtcataataccccatttgatggccatgtgcttgtactttccgagtttgggaaaccaattttttcgaggtttttcgcacaccataatttgaaaaacagcagatcacatcatctccctttttttggattcaagttatggcaatgaagatgaattgtgcactgtgttcgcccttatttctgtgattgtccgtcgttttcattcattagcttttggcgaggaagaagctggtgaaactcaggtcccgaggaaaatttctcattttttaaagtcggtgacacgacgcaaaaattcccaaaaattgcagaaagattcgttgttgagcatccaactgggaatcgcgactttcaatttctttacacgaagtcccattgactctaga

SEQ ID NO: 566 - DNA, 2170 bp, Heterodera glycines
  misc_feature (2055)..(2055): n is a, c, g, or t
tgcaggtcctggttcaattgggataccatttataatcaagttggttgctccaaatttgacaatttttggatgaatttttattgaaaatattttagggacgaattttgaagattttttaatttcagataatttcgatgttttctcgccaaatgctaaagggatattatgcaaagcgtggatataactttgatattagaacactttttggtttgttacgcttttggactagggttgcaacttcaacgtcggggttgggaaatatcgggggtcgaggtcggagacaaatttcgaaaatcgccaaaaaaaatttcggagacggtttgcaaccctattttaggaattattgcatcaaattacactttttttatctttttattattttaagatggtattgataagcgaattgatgcatgtgccaagggattcaacgaagatccggtggtgctttatggtaaaaaaaacaaacaattttttaactgatttattaaaaaaacaaaaataattgttgtttttttgggctttcgaattttgccactccatcaggcggacagagactttcttgtacaaacaatgggcacagttatcaatgaattatgtccaaatgtaattctacaaaaaaaaaataccggattttttttttttaatttttcgatagataattgcatttggactgctcatcgcccaccgtcaactcgtcacattagtacgcatgaaaaaactgaacttggacgcgccagatttcaacacaattgtggtaaataataaaaaaaattctaaattttcaacaaaaaaaaacaactaaaaatttcagaatctaattgaatgtcataaaacgaatctcatgcaaggtgatcaccaagtcagttttggtcaaaaccttgtgataaattaactaacatgtttttctttaggtgccaatatgtctgccaaaatttaaccaaaagttggttgatttatttatttttttgtttgtaaaatattttagtttaaatttgaattatccgcgaccccgaaaaccgtcagaattatctttttgacactttttttcgcaatttttttaaaggagagggttcaaatattctcatttaatataaaaacaaaattttttttttgattccatgccaataaatcttgtttgtttgaagctccttcctgtatgcctacatctcacatttgtgggacggcactgggccatgcatggtgttgctgtcggtggccaaggaggcggtgcaacaaatgtccaaggttcggccccgactggaggaagcgcttgacgcatacaaacgcagcgggccattgaaggaggcgttgcaacagccggagggattcacattgaaaaatgtccgagtttttaggcacaaatctaaatggcattttaaaattccatggcattgcttctttttttcagttacattgtggaccacttctttggcatttcatgtacaaaaacatttcaaatgctcaagttcgtaacgaaaagggggacaactgggcgccagtgacagtttttttttcatctttttttgtattcaaaacccacgaaaaattgttttcatggtcgttgatcacgtttcaattattaatccgaaattcggaacaaagaagaaattaatttttcgggttagagattataggcattggtcgaactggtattggattcgttgatcaacggctccgtaacccacaagaataagttatcacaaaacaatagttattcagaaaaatccgggctgtccgcccagttgtcccccaccggttcgtgtcctgtaaacacaattcgactggtcttaaaattcatttgcatcttttcaggatccgacccaagtgtgctgttcgacgcccaagaaaccgttaatttcacgagacgaactgaacaacctgtacaatgcctatgccaaattggctgatttgttgcggaaggggcgcggtggaataaaacaaatttttgtgatgttggaacggcactccatttttgcatgggtattcaaaaaaaaatttttttggccattactgtaaaaaaatatttattgttagataacgccaggctttgaactnttttgtaagttatttgttgccccagggttttgctccgttatttcccccaattttttaaggtgcattcaatccgcttgtagcaaaaaaggagtggtgggagctgctgaccgattgc

SEQ ID NO: 567 - DNA, 3164 bp, Heterodera glycines
gataatgaatgaattctttcatcaattaatattagtcagggaatttttgcaaaataaagttcaaagtcgagctctaatttaatgttcaaaatgggttcgaaatatatattcaattgctagtgtgatggtgagcgcactttaattgagcctgcaaattgtaaaagtacaccaaacataattgaacaaaacaaaaaatggttgttttttttgcatgcattgtaccaattgcgtgccggaccgctgaagtggagttccactttaccacggcccgggcacagcacaattcgcaacatttttttggtgtacggtgtaaaaaaacacaaccatttgaaaaaatgcacaaacaaaaacaacaagcagacatatttatttcatttctgcttcgtgcaccacgtcgccgtcgtcctcgtccaccgttggccattcattctcatttatcggcttctcagcctgtcgctggagttggtcgttgagtttcggcaccgcttggtatttggcccactgttccgtggccaaacatggcgcaaaaacctgtgcacatttttgtttgtttgtttattataaatcaaaaaatgttcacagtgagcgatttttttaaaataaaaatttgtcattatttttttaattggcgttttaaaaaatttcaaagattttcttccaaaaaaatttctgtttgagaatttaaaaaaaatctcaggatttacctgtgccatgacaagcatagaatgaatgcaacgttcgaattcggcactgtgaccaagcacaattgaactactaccacctttcgacagcgcatttgcttcggtgacgagcgctttggtgaaatggtgcagccgtgtcaatgccatgttgtgggattggaaaccgtccaaataagagctaatctgtaaaaaaaaacacccaaattataattggtcatgaacatacacccctttttgcataaaatgtctgtgacaaaataaaaaggggtaaaatgtttttgcattcaaacgttgaaatcatggccccccccccccccgctttttgttttcaaattcagcacaaacggccttggaattcaggttttgagccaaacattcaatttttttttaatttgggaaaattttgaaatttgggtggaatttgactcattatgaagcatactcttttttgaaatagcctccgtttttcaacctttttcacgtaatttgtatgatggttcagaaatgttcggtccgcttgctcaacagcattttgattgacggcatcgtttgttgcaattgacaatgcccgttggcgttctgtcacataattgtccaccactgttcgcacacgcaaaacccatcgattgatggttttcaactctggcaaataaaaataaacataaaaaatatgggtgcactacaattaacccaggtgcgcaccccaaaattttgccgggaaaaatttcaccgccaaatttttctcaaaaaactttttctagccttctcaaaatttaggatgctaacatacgaaatgtggggtacggatagggccaatcaatctgatagttgggcctcgcttcgatcaacaattgcatccttgtctcgtcaagaccatagctgtcgatgacacccatgggatcctaataaaaaattacattaaaaaagcggaaaacaattaggccccgaattttcgagaaaattcaattcatgttcccaataaattttcccaaaatttaccacgccattatgcttcgactttgacatcttctcaaactccttctgtacggcttggccgctccctttgtgcaccagccgagaattaggcaattctgtgagacaaaaagtaaattaaatattttttcctgtttttagcccaataaggccgtctgaccaattttcttacaaccctttaaattttcaagaaaagagtgctctgtttttagaatgttcaaaacacccaaaaatcgttgggtttgttcagtaaaaccaacttttgttgccgtccacctccgagtcgggcacatatctgccgtcaggcaatttgtaggtgggcgcccggacaacgcccaactgaatgaaatgcgcgaacggctcacggctgggcaccatgccaagctcgtgcaagaaatggtagatgaagcgggcgtagaacagatgcaccttggcatgttccatgccaccaatgtagatgtcaacgggctgaaaattgtctaatttttcattttttggattttgggggacggggtgctcccctcccggaaaatgcgccagcaatacagtatttttatatagggtactgtagaattaagtattgcactacaaaaggccaaaattatataaaaactttgttctaaattctccaattaaatttttttaaaggatcaaaattttttgaaatttatccaaatccatactctatgcttatgatttcaagttcaagtcgtctccatttcatgctcaccatgtgtttgctgacaatgtccgggtcgaacggcgcattcgaattgtgcgggtccaaataacgcaaataataccaactggaatcgaagaatgtgtcactggaaaatgggaagggaattaaaaggaatgaaaccggtggaagggaattaattaattgatcatttatttcttacagagtgtcggtttcgacgcgaccccagccagagggaaagctgaaaagtaaaaatcagttgagaaaatgattgagggattggtaattcataaaaattttcggttacccgacatttagtcatccatacccaagtcatccatccccaacttatccgtacccaattcatccatatatccaactcatccatatatccagtacccaactcatctatatatccaactcttccatacccaactcatccatatatccagtacccaactcatccatccatatatccagtacccaactcatccatatccgactcttccatacccaactcatccgtacccaactcatctatatatccaactcttccatacccaaatcatccgtacccaactcatccatatatccaactcatccatacccaactcgtccatatatccagtacccaactcatccatatatccaactcttccatacccaactcttccgtacccaactcatctatatatccaactcttccataccccactcatccgtacccaactcatccatatatccaactcatccatacccaactcatccat

SEQ ID NO: 568 - DNA, 1052 bp, Heterodera glycines
tccgcaaatgtcggtccgcaaatgtcgatccgcaaatgtcggtccgcaaatgtcgttgtccgcaaatgtcggctttaaaaatccgcaaatgtcggtccgcaaatgtcgttgtccgcaaatgtcgcgacacgaaattttcaaattaattaaaaaataatccatcaactgccgagcggatccgaaccaatgataaaagggtcattgaaatgtaagaggagaaaccgcattaaaattaattgcctgtccgtctccatgcgttgtccgcgcatttcgatgagcactggcagctgttgttccgcaacgggtgccacggcactgctgctgctgccagcaccgtcttcgtcggccaacattggaatgggtgtgccccacccacgctgccgtgacaccacccaatcacccaaccgtcggcttgtcagatagccacccaactgtttgtcctgtggaacaagaaaaaaaacaataatttagagtgcggataaaatagctagcgtgaggtgaggaccgaaaagattgactggaaatggaatgtgtgccgtcaaattaaagttcatgtcagggcaatggttaagaatttgtggtccctcggcggaggatgcaaaatggaaaatgaaaaaatgaggggaaaggaaggatagagaagattggaaaatgaatgaatgaagggaaaaggccaatgtgtggtgtgtgatgatttgaccggagaggatggaaaatgaatgatgaatgaagggaagagagcaatagtggagagagagtgggcggggggaggaagggggatgtgtaacacttttattggcgatggaagggaaaaagtggacacaaaaaataaataaaaaatcaataattacggaaaataatcttcgacggcgcctgtaggccggtgcaccccaaaactcagctgccgaaactcatccgaccgaaattcagccgaccgaaactcagccgagacataattcagccgtgaataaatttttaaaaaattttcaaacttagaaatttttcaagaaaaaaatcttagaaaaatttttcatagaaaattctatgaaaaa

SEQ ID NO: 569 - DNA, 4924 bp, Heterodera glycines
ttgggaaacattattttatgacgttttgggaaacaaaaaaagaaaaatatattcatgtggcctaaactacatatatgagtgccgtttggtgttaaatcccgtaaaatcaatatgtaatttcacatttttggtgtacagtgcacgtaaaagaaaatcattttagaccttcattgtaattttatttttcttggtgtgcaaaaacctatttgaatttgtaatttcacattttaagtgtacatgagcgcgtaaaagtaaaatgtttagacccaaaaaacgaattgtatttcaccttttcttggtgtagaagtgcacgtaaaatgttattgcaacttcacgtttttcttatgtaaaaaagccaaaaaatgaattgcaatttcacgtttttactgtacaaaaagccagaaaatgaattgtatttcacgttttcttgatgtgcaaaagcagattatttattggatgtcatattcgtgatcagcgaccccaaaaaccccatggttacattttttatgtcttttaacaaaaaaaaaatccatgtggcctaaactgtataagtaagtacccaccaaacaaacgtgaagttgcaattaattttctgtgtctttgcacaccaaaaacgtgaaattacaattcattttatgccacttaaaacgatttcccttttgtggtaaaatcgccaattttggcataaatttgtcttggacaagcatgtttgcgacgagcagccacatccggtggacaaacaaacaccccttttggctcagatattgcttaaattgaagcatgttgaagggagtgggaaaaatgttaaaatacgcgattgtttgatgtaggaattttttgaaaatttttaaaggaaatttagtcaaccaacttatatcgtttttttggcgctatatggaaagtcaccgattttgaaaatttttttcattttttttggtcaattttttttttttgacacataatgatgaatattaagtattaacagcataattatggcgaataaaaaatatattcacgattttttatctcaaaaaatttttgcaaaacaatagggtcccccctttggtttttgataaaactcaaaagttgtcaatttttaactagcgctaaattttcttttaaaatgttttttttcagtttattaaatagtatgcaatacgttccatgttaaaaaaacaaattctgcattaaaaataaacaaaaaaaaattgaccaaaaaaagtgaaaaaaaatttcaaaatcggtgactttccatatagcgccaaattttttatggtggagatgaaaaaaaacataaatatttgtaatattgtcctccatcgtctgctccctcccaaaatgagttcacaaataaacaaatgatttcccactcactgaacggttcgttgtgtgacaatttgccgtgcttggccgcttcttcggcaagcgaatgctctgttgtgatgacgacaaattgtgcggtgccaagttgggtcgggtccgtcagacgaaggtcaaactgttgttgttcaacaccatgcccactgctgtgctggaagaaatttctattaaatttgttgaaatgattttcaaaaagaaacaaaaaaaaattttcccccatttttttcacgagaatatagaacaagatttttttttcttcaaattgtctactctgtcagattgtggaccacccaaaacctcttcaaacctatgacactttaatctgatttataaagtttttatttcattttccactaccacatccaaatctattgtgtacacttatattaataaattgtacaccacctccgtttggaggaggaatcggtgcacgtcacaagtgccaatccaatcggcctgagtgccgaccacaccgccccattccgcttccaatgatgacagtccgtccaacaaacgctgaaaacaaattaagaaaataaaaaaaatttcttgagattttttgaaaaatttttggaaaccgagggtaaggggaatgaaatgcacccaacataatgtgcccatagaaaaattgggtcagtgcttcagcaaaacttttttttaacctttgcataacgcggcgtttcaatggcccattggcgaagcagtcgtttctcaattttggcacccgagcgccatgaacaaccgttgtcatcaatctttaatgaaaaaaaaatattgtaatttgcggtggtagagaatgaagcaaccagaaattgaaaacgaaaaaatgaatgggaaaaaatggggattttttaaaattatacaattttaaaacagacttcgtcaaaatttctcagaattttctttctccggcggtgcctataaaaactaacaagggaacctcgcgagctgttagtcggaaaatgcatatgtgtgatataccactggatagagggtcgatttaattaaaaaaacggtcgctcgcctccccccccccctcgccgaagcaataagggtcttctgggtacggcactttaggtcacctgttcatcggccaacacagtgccgtcaagtgggtcccagttcacttcggaaagcgtcttcctgacgaagccatgcctgaagagttggataaaaatccactgggtccagcgaaagtaatctggtcggcatgtgaaaatctcctggaattgaaaagggggagaaatcgcagtttcggcacaattggacgagtgacagaggagggcactcacgcgattccaatcgaaattgacgccagtttttgacaactgtatgcgcatctcctcaatgtttctagaaaaatttgtttaaattccgttacaattgtgcatagcattgcaagagtgtagacattttccccccgccctccgattttttttttttttttttggaaaaattgtatgaaattaaaaaatatattagaggaattccttggaaaattggggtggaacgagctgctccaccagaattgtattgtttccttaaagactcccaaaatttcatttttggtgtaaacgttagtgccaatttggcataaaacattagtgccgccaactcacttatacgtccattcggcggggtcaattccacgctctcgtgccgcattttcggccggcagtccgaacgcgtcccatccaatcggatggatcacttggtgtcctttcaacctgtggtaacgactgatcacgtcggacagtgtgtacacgcgcagatggcccaagtgcagccgcccggacggatatggaaacatgggcaaaatgtatttggaccgcaaattgcgacacaatttcatggtaaaagacaaaaaaaaagctaaaaattgaagcgtgattagactgaaaaccgaaattttttgtttaataattttcacaaaatagcatggaagcttttttcgccgattttttgaaaaataattcatcataaaatttaaaaacgttagaaaaaactttctttaaatttctcggcgcggctttttactcggcaccataccaatttgtttttaggctcgtgccgactttggtgttccaaaaattggtagctttgcaatatggaaaaaagcggaagtatccaagatattaaaatgaatctgtgtgcatatttgtttaccgtttgactctctttttctatcacctgtatttattccacaaaaatacaaaaaaaatggctttgcttttgattttgtcacaaaaaaagggggaggaaaaagagtgggaaagaaagtgtcgccgtcgtcgtctgtacgttttcttttccgtccaagcaaacagatcacatatccacgaattaattcacaaaaacaaaaaaaagatgttcctccgcccctctagcgccagccaagccaagtcctcaccaactcacacagtaatcaggcatgcgcatacaatcgggtccactgaatttgcatggctcaattatacaatttttaggcttcaaatcatacataaaccactcaatcagaaataagcggcaaaggttttccggaaattataaaaaaatagtgaagttgtcgattttcccaaaaattgggtcacttttggggatttttgacaaattttgaaaatctaatattgctcaatatatttcactctccttcgttttcaccatttgacgtaaaatgtgtctcatttgaatttaggcgggtgatgatagcccaatgcgcaattatagtaaagtttggtctaaccaataatgtcacataatgtgtgcaccccatcatccgacctgttttgcagtttgaatcgcttctgtttcgctgtttttccactgttctgccacatcactaaacaagaaaatttgaaaaaccggtcatcatagagtgtgtcatgaaattccgaattccatgttgctagaattcattcaaaacgaacgttgccaacgggtcgtccgggttcggagcagacagaagcgcctgaatggagagaagaacggtgcgaatttgcaaagctggtgaccatttatctgaaaaacaattccaaacaacaaacaccatatttagaccaaaaaattttttcaaaaacaatcccgacggtttctcgatgataaaatggaagagggacatgattttttgctcgttttattttgagtaaaagaaattttacgaaattcaatttttgaaaaaaaaataatgtaaacgtagcgacacgcacctttgagtatgtcaagacaaattcgcccaagtttgtcaatgtttggatgataaatctgaaatcatatattatttggtacaaaataacccgaaggaatcgcaaatttgaaatttactgggattataaaaaacatacctttgtcataaaacgaactttcggtgcagccattggatactcctccggcagaaacaattccaacttaaacacgccccctaaaaataataatgtgtgtatctgttggacggaaacaacatgttgaacaaaccggcaaatggcgactcgtccggacccgcgattatcacatgaaagtaccgtgcctaaaaatgaaaaactttttg

SEQ ID NO: 570 - DNA, 3458 bp, Heterodera glycines
atttgtcatgataaataaagaaatgaataatagcacttctacaaaaatggaaacaatgccataaatgtagtatagcaaaaacagtaattcacctcagaatgaaaaaaaaacaggtaaaataacttagaaatacccacaaacaatgttgttgtcacagttccaacaaataatcaatcaagcaacaatacaaaaacaatcaaagttctcctttcggcttcggtttgagctcattgatccgcgtaatgtagtccaccttctccgtacaaccctgaaaaaaaacattggaattttgcgaaatttattcaattttaagaatcaaatcaatgaataatgtaagatagcatccaacaatattgaaagccatattttccccctggattgtggaaggcctgaatcgttatttccatatttttgcattttttttaaactattagaaagttggctttttttaatctttaaagttttggatgcccagtcaaaacccaactaactcatgcatacataaaaatgttactaattattgcgcaaaaaatgcacgtaagaatttcgaccgacagtgaaatttcctcaaaaaaaagtgaggcttaaaaagagttcattcgatttccgaaaaatttaaatttaaatccgtgccttgcaggaatcgcccaatttaagcaaaagttccttgagctgtttgacacgcattttctccagcaccaaactgtcccaatctgaacaaaacaacacaatgacagaagcaattaaacattaccaccgccaaaacagaagcataaactcaccaattggcttatctgaaagtgatttaaattggacagattagaaattttttaatcattttaacagtttttacaaaaagatccacccgattttaggggacaaaaataaacaattatcatccaaattcacgttacgaaaaatgcaaattattttaatagtgaagttttaggttgaattttagacaaaaatgtgaactcgttgccagtcttattatttttattttatttatgatatttttaccatatttcagtgcgcagatctgagaatccctttccttgagttgagagcatacctgaaaagcatataggtatgtactatatattaatataatttaaaaaatatgaaaaaaaatcaagccaaacttctacctaattaaaaattgtcaatcgattttgttcatttgaatacccatcagagtttgaataaaataaatccagtctttaatgattacaaaatctcacttaaatattagccctattatactttattcggcggtttatggaagctcaatggtttcgcaatatcgcccaggactgaagtggacgagtcaggatgagcgccaataaagaagcactgaaataatcaattgtttttttcattttttaaaagaattaattgaaaatgccaaccaatttttctttcttatcatccacacctttgacagacttgcaatgctcaataatcattttcctaaaaaactggtaattttaagaaaaaaaaaaaataggaaaattgttgaaaaatacttcactgccggctctcccttttcaccagactcatcaacctttttcatcacctccgtaaacagatcagtgcaaacttaaaaaacaaaaatggggattgaaaaaatcgaattaagaaaattttgagagaaaaaatttaaggaatatacacttatttatgtgtcataaaagaaaaatacttccgttataattgccaatatttagtgatggtcccaaggattggattggttcacggaagaggccaaactcccaaaaaatggggtacccttatcataaatgaatttcgatatttattgtctgtcctttccgggaataaaactgatcccagcaaatactgcatatttaccttcacattcatcatactccgcagatgcgtaaaccaacgcaataatacaagttgaaatgagcatgagaaaagttggcttcataattaatgccatggtaatctattcaaaaaaaatgtgcattaatttttaaataaaaataataaatgaaaattacatataggtatgtaaaaaagcatataaaacagtataaagaaaaagaaagctatgcatatgtcatgcaaacgtttatgtgttatcgctcgttcgcatatcaatgtcaaccgaaaggaaaatcgttgtgaaaaaaaatttaaaaaaattatgtcgtggcaaaaaatcaaataaaaaaaacaaagaatttttagcgtgtggatttcggtaagaccttccaaaattacgcatcgactaaaagatgaaaaatgatcacatttccataattgattacagtagtttcccaattctgggataggttacaatacaaaattgtatttggctttacaaataaacacacagcaaaacgtaaggtttgttcatgtgtataaattaatattaaaaaattgtttaaaaaactctctcatcactgtgccagtggcatgggaaatgccataaataaaatgggaaataaaatcaaatcgtcgccttttgtccgatcacatcattctcatcctctttccagaattaacagcaaccagctacaaaaatcccatcaactaatccagtttgattctggagtaaattttatgcacaaaactggcgctcgacacatagccaacggtgccgcacaaaaggccaagtgcgagcgcaaacagcagcatgtaggcaaaatagaaactggtctggaacaagccgtacatccttcaaacaaacaaaacaaattttaatgaaaaataggcaaattcaaatttgtcccatttaaaaaagaccaattcaattgcacacactttgtcttgaagaaatagtaatagaacgcgtagttgtaagtgtaaaaagcaacggaagcaccttgaaagaaaaaacagaagatatttattgtcgaaacaacaactatttttttttaatttaaatggctaaaattaaatcaaacatttttgggaagtgaaaatctttagaaatttttaaaatcttattataaaaattttcaaaatttcatttctttatacaaaccagatgcaaagctcgtccatcgcctaaaacataatattttttgacaattaaaaaaaaattttactcaccaacgatagtcctcagcattaagcagaaaataagtgcccacaatgctcacacaggctgaaattgtgagatgaaacaatttattagtcaaggcttgtaacaaaaaaaatatataaaaaaattaattaccagtcacaacaatcaaaatcagtgcaaccaacaacatgaagccgtacacataataaattttgtaggcccaaaagctggtgaaaatgaaatacctgtgaaaacaaaaagaatctcaaaaattaattgcaatttcctatccccaaaaagtccaattagagtaaaacacatacatttcaatgaaaattgaaccaaatggaagaaagccggcagaaagtgcgatgacaaccggctcaaggtaccattttttgtc

SEQ ID NO: 571 - DNA, 10505 bp, Heterodera glycines
ctgctactggcacggatgtgagagttgcttcaaacctgtcgacgaactggttgacggaaaaacatgccgagaactcaacgatgctaccaaactgcgtttgctaaaactgcaggagcctgttccggctgaggatgcttacggtggagaagatgaacaaggccttgacgtggaagagatttgggagtgtcagatccgagaacagctcaaaagagatgatgaaatgcgagcttttttcgacgacttggggaccgaccgggggcccatcgacccacgtcaaacattctacggaggcagaactgggccgcttcagctgattgcagagccaaaggaggatgagaagatttctgtcttcgatatcgtcagcctctacccgtgggtcaactatgccaccgactacccgatcggaatacccgctgtcatccaccccaccgttgaggagatgatcgtcgactggactcgacctgagcatttacaataccaaggaatttatcgtgtgcgggttattcctccaaaagggctccgaattccggttcttccactaaaaatcgacgaacgcctactgttctgctgctgccatcgttgtgctgccaaatttcggaagttgaacacacgacgagtgcacaagtgcccacacacggatgagcagcgggcttttacaggaaacttcacacatattgagctggcaagagccttggaaactggctaccgagtggacagattctggagagcttggcactacgatgaatggtatgagtttgttaagaaatcttaatatttttgaaatttaggagtgatggaatattcaaggactatgtacgtttgttgatcaaattaaaggtctgaataaccttttttttttaaagtcaaataatgtccaaattgcaggtggaggccagcggttttcctgatggtgccaacactgtggaacaacggcaacagttcgcggacgagtacagaagaatctacagtgtaaacttggacctggaaaatgtgcggagaaatcctggattgcgcttcatctctaagctgatgctcaacagcctttggttggtaccaagaattttagcaaaataaataacaaatttaggggaaaattcggcatgcgaaatgaattaggcgccaacaaagtcctaacaaggccacaggaatttttcagcctcatcatggatcataaaattgtaagttaaatgtataaatgaatttcaattttgtacattgtttaggaagtgtcggctgtcatccctttgtcagacaccgccgtccgtgtcatgtacaagagcaaaaagaatttcgtcagcgaacacacgtccagcaacattgtgataagtctgtggacgaccaaccgtgctcgcctcaagctactcgattttatgacacaaatcgatcgaacagagggagccaaactgttatatacggtaaaaggtgttttaatattgccaagtacatttgccccaacttttaggacaccgacagcgttgctgtgctccataaacgtgacatcgtgcccatccagacaggagaatacttggggcaaatgagcgaggagtatcttgactacgagatcaaaacttttgtctgcggaggtaaaaaaatatttaatctttttaacttttttattctaaaatttcaggcgcaaaacaatacggctttcgaatgttgaacaaaaggacaggagaagttgaatacgtacaaaaaattcgtggcattacattcgacgtgaacaacagtaaggcgctgcagtttgatcacttcctgcaaaaggtgaaaaattacggacggaacactggtgacgacaacgatgatgctcctgccgtgttttcctacgacaaaataatgccaacacgagacagccgaatcatcacacgtgagctacgtaaaaaatacatgccaatatgtcaaaaaggaatcatcaacgagcaatacgaagtctacccatttggatatgaataatgaatttaaaatcatattgtattattagtcaaaaaagaaaagccaatataattaacacacacatttattcgtcttcaaaatgtagcaatacaacaattgtttcagtgaaaataaaaatacttccgttttaaaaggtttcagttttggagacacgtaacaattcaatggggaaaatatcgcggtggtgaccaccaccaaattgaacaacacacggaagggttgggtactttaacatgacacgatgacgagtgtaaaggtgctgctgaaccgtgattcctaggaatccccggtatgcaaacacctgatttgcaccgatggggcacaaagcatcgggaataatcttaatattttttctaagatggacagtctcaatgtccaattggctcagataggcaaggttctcagtccgtcgtttctgtagttgcttcgtcagtcggtatgggccacagttgttgaatcggcacagcactctcaccaggttgtagtctcgttttcgcgttcgccgtcgctccaatagttgatcagatccagctcgtccactatcaggttcatgttgctgctgttcgatagttcgcaatggcgtgacagacacagcggcgagtctcccgggcaaatcttcaagtccttcagctccacatacagaggttcgctccttaaaaaatgtaaatgaaaatattaatatttagaaaacttaccacactatcccctcgaacttcttcttcggatagcatgttgagtacagttcaacgtcagcaatcaattcgagcgacccgtcgatatgcacaggttggttcggatggtcagcgtttgcgatgtgtacacagtcgacagcacaaagtgggttgggatagagacaattcccaccttcaggcccacttttaatttcgtctttcaaacaggtgtacagatcgtctacactgcttagcccgtaactgtcgatcaaataacggattgccctttgcatacaataagtaggtaaatatggtgtgtcagttttggcaaatgaaaatagcctttattaaaatttaggaaaaaagcggaccaactgaatgcaaacaacaaaaagcattctttaaatactccggctactggctccacccctttgatcactcgctgtcgcagtttcatactgtatattcagcaattgttgatgttgggacgaataggcgtcgtcaatgaacgggttgctgtaataaccggtgctaccagacccattaagtggattctttcggttctttcgccgtagctgtttaagtatgtatgtgcacagtacgattaggaacagattgaacagatatgagatcgacatccatgcgtcagacatgcgtagatgagcaaaaacgccgcggttgatgttttggtctttaggtttataaattagataattaaagcggacgtcactggaattggctacaaaaatgagcgcacgattcccttttacatagtcgtcaatgtgaaatttatagatgcgttggtctctgatcacaaacacatggttgtccaccagagtatagtcgcttttatcaggcggaagaaaagcaacaaagttgctcttcaaaatcgtatgggcggaagactggtttgttcgaagccaccaaagctccaggtattcaagctctatttcactaattcgcctctgatgcttatcgatcagaaataatcgacccgagaggtggtcaaacacaacccgtccatgttggataagcctttccactattttctgctgacgaccacggaagatagcagtctcacccgattctctgtcttcaaaaaaggtaaaactatgcccattgtattcaaaacaggccaatggtgacattttcaccaatgatttcatttcaaaaaacacactctgatagttgtgcaaagtatacacattttgaagtgaaactgcccattcgctgttacgctcacacttctctattcggcacgctgtattccaactataaccaaagtgttgtgctgtcgcatcctttgaaaaggtaagatatttgcctctgtctaaatagttttggttgtcaaccgtcaaatccacatttatcagctcagagtgcaacagtaacggcacatagctgaggactagacccacgtaaaaaacattcataaaatgaaccgtcatttttctcactgttcaggaaacgtgagcttttatagaccgttgaccaagtttctgacaaaccatttcaccaggtaatctgccatacttcgagtcttgcgcaaagtctcaatcacatggcagaaaggaacgccagaacatcggcttgccaaaaaatatatacaaaaatggccacacgtatcggatgtgggaagttgaatttggtctttagtgaccagcacctctttaaatgtgttgaggtaggcggctaaatcggggtttgggtactcaccaagactgtcaaaatattccacccctcgatggcttgaagcatagcaagccacccaatgctcacctcgtgtcccttctttgcccgtattcacgaccatacaatgaggaaatttagaaacacgcttcggaattcgatcagatgggaaaacaccaatgaatttatttttggtagggcgcaaccttttcagaattatttccaactgagctgaattcattgatgttttcagtgtcaatcaattgcaattacacacttccgtctgtactcagaacccggtctgcattaatggacaacacagaatcgaattcgccaaggacaagcatctcatatccatccgcttttataggctgctcaaattgcacctttatcgtgcacgtgccttgtctgatcagctcaaaaccaggtgtgtcctccagagtggaggtcagcggaatgacgaaaaaggcccaaccattaagaaaacgctgcatcccaatcgagaccgttttggtgtcggagtcatccaaacccaggcctgcgtacatgtctacaaatgcacgaacaaaacggggctgtgcaccatcgaaggacagcaaatacggggtgctgggaaaggtctgtccgttcgcttcaacactaattgaacgtacattggcgtgctcaaacttgtagggcgacatttttcggttaccggaatatgcgtcggttgaaacaaaagtgcaaattaggcgacgaggcaacgttgaggtgaacacgttgtgtgccaactcggtccggcctgtgccaagaaaaatagaccgcatctcaattttacgcaacggatattttgctgaagtggactccaattgtcggctaatggcaaggttaaggctcggtgtgacgtccacagtgcgcacatagagacgcatgtcatgcacacgtatacggtactctttcttattttcctgcagtgtaccatctggttttttgtatgggggcgtaagcaagaggaatgaatcattgttgcggtgaatagtgaatattacatcctgattgttcaacatcaatgcattttgacgtgccaaatcaaaattcagttttaccattgtctcacactgtttaccgcctgaaaaccgtgccgcacgtgcggtaaaacctgggtttgttgcgctgttctggtcatcatcgtcggggtagtagcacgatgcctcgtggaaagccttacgaatttcctgtgaatagcccaactccttcattatgtagtcacggtagtgataataaattgaactgtcaaacacctcaatacctgaaatgttgaccttcagcgagcggacaaagctgctaccaaagttttggatgaccccaacatgtttatcatttgggtccgtgtcactgagtgctacccattctcccgcatcattcttccgttcaattgagctgagcaggtacatataggttttgctcaagtcacaatattggctgtccgagaacaagcgaaacaaatagggacctgtttgattaagagcagacagaggcagcaattcacgaacgtttgtcttgtttatggccacatttgttggcggtagagaaaataaagacagacttccttctagaccctcaacactgtctttgtcaatcttcttaattacgctcattttctactgttttttttttgttatttatgtttctctcaaaaatttgaattttggtggtgagaatgtagttgatagtgaaaaactcaaattatcatacctatttataggcttcgcgggggtgccaacattttaatgtgcaaatgtgagctgatcgatgatctgtcgtttccctctcaatttgccagttttgttattttttctatgagtgattgctttgtgccgttgccgcccaccttttccacactgattgagtttttcggccagattctcaaaaccttgcttagcctgagtttttagagactctttaaacgcctttccctgtgcgagatcgtcaagcattcgtgttcctgccgaaatgccctcctttgaggcagactttagcaggtttgtggctacaggcatcaggaaccgcgaaatattttgtaacaggccgccaccacgctgaaatttactgcctacaaaatactgcagctcaccacttccctcctgctgctgttgtaactcaagaaacgcggaccaattgacgttgtccggattaaaaacaacgtgcgtcataactgtttttttctagaatagtttttgtctaaaatgtaatgtgattacggtagttccccaaccaaattttacgtaacgtccaaatgctgtctgaatttcaatgttaatttcagaaatgcgtttattttggagagaatgaaaaatttcattggtatatataacctctggcatgtccaaccccggtgtccctgacacgttgacaactcgcagcaacggtgccatgcggtcacctatgatggaatcctccaccagtttaggcgcgtaaacgtacagctgacggacaccaccagacagatcaggtggatattttgccgactgattgttgtaaatgcgtgttttgtgatcaaaccccaacacataggacagctgtttgctcaaatcaacgtgcattactccagggcccattctaatgccgaatcgctgagttatttcattgtaagcaaattcagctgccattttggattcacgttgttgtaccattaactgcccatgctctccgtggagcacttcttcgatgagtttatatgttgaaatgcggtgttcactatcgttgtctttaccttcttcttgtaacatcttctgctgtgcatgtgttccatcgaccattcggtccacttgttcgtcaatcagcttttcaattattttctccttccttctctctgtcgctacggttgattgcttagcaacaaattttgggttattggaagacaacgcggctgcttgaggtaaatttccaccatcttcagcttgagtcactgatgtagcagcatcaccggactgttctaatccacttgatggcggcgtaccgggttcatttttatcagcaatactattatcttgatctgctaaattttgttcagctggcgtctcggatgataaaatagcggtggcagtagtggtggtgttttggtggttatttttactattgatagcttcgtctgggtttgcgggctcatctggtgaaaaggagtctgttcgagtggagctagtcctatttgacccctcagctacagcactgaggcctgagttagctttccctgtctgcgcatctctttttttagcctcgtattccaaagctgcaaaccgtttacgcctgtagtcaatcagccgttgaatgctctctatttgtcgctgcagcgaatccctttccgttgcgtcagtttcaaattcaagcttttccctcaattccctcttcttagtgtactcaagttgaagcgcttcataatttttctggattgcttgccagtaattaacgggattggcttgaaagaattcttggacgaaggttaggttttgttcatggcttaaccgttcaaaatcctcttgagattttttctgatcacgttgcaatgctgcgttgtttaatatttccatctttcttccaaaaacgtgtatggaatttctcattcgttcagtttgtgaattgagctcttcaagccttttcaaatctttaactccttcatactctcccatctttgtctgtagatctagcacatctcggaggtaacttgacctccattcgtccagctgctctctataattgtcggggtatcgggcaaagaaacggtcaatgagtctttgttcattggcttcttgctgctcaccgtcccttctcttcgcctcttcttcaatcaaatgcaaatgttctttcagaaaagtttctcgcccctggaagaccccgagctccgtcgaaagaagtgtttttcgttcgtcatccgctgttgaattgtactcctttgtcattttttcaaccctttctctgagctgatagtgcttttttctcagttctccaatctgttgccagtagtcaaagggatttcgagtgaagaaattctctacttcgataactccagcgcctgattctgacaattcggtttgtcgtttgactcttttgttgggtgtaccatcatttaatgatgatgagccgccaaactttgtatcgtaagcattctggattatctgattcagtgttttttgtaaactttgtacactttggaattgtacatttggaatcttcactgacaaattgataaatttttgcgattcctcgtcagaatttccggcatcttccctgtagttaggattaaccagtttgacagagatagagtcatcctcgtccacactgatcgatgggaatgaatatggatagattattgctgataatgcgacggaccatttggagtcaagctctaaagtgtgcggaagtctaaccgtaaaattagaagcagtatttcctggaccaggtgtgtttgagggaagtacaatgtaaaaagcttccattatttagctttattcaaatgttcgacgtttcactaggtctgagtcacggacccagctgttgtatttgtctgacaagccaacccaacgaacgaaatgttctttgactccgtttcgtgtacgcgattttagcacttctgcgcgatgggtaccgttttccgttgtctttacaagttcttgatcgtaaaaaattccctttatgtcttctccgttcaaatcacgtattctgtacgagtgcgggtctgtgttgtttacacgttggaccctaaaaagttcgtcagtaaaattgggatagtaaccttttgaaaattggcctttctctttgctaattcttacaatatcgccaaatttgaattttgcgtttactttgatttccttgtcaccggtgtgttctttatataggcgttttcttaaagccggagcattcttaaaggttacagaagctggacttattccaatggtacgatttgtagtaccgttcacattatttgcgattttatctatcacccctaaccaccttagagtgttattttcgctaaaatatttgtataagcgctccttgagtgttcgattcgcccgttcaaccacacccgcatgcaggctaggactgtacattacgtgtttgattatgtccttttgcttccagtattcaatcatccgttttgcttggaactccaaacctgcatcactgtacagtttgttaggcagcacaccggcttttttgaacaccttttcaaatgcttcaatcatgtgttcgcttttcttcgactccgactctgcggtaaaaatttttctactaagcacatcgacacagaccaaaatgtagcggtaaccgtcattatgcgcccttaacgtatccataatgcacaggtcacattgccaatctgtatgcagaccactcggcaccgttttgagcctaggaaatttgtttctccgtggcttaaacagtgtgtaagtgcgctggcggtgaagaaattcatagacattgtgtaaggaaattcgaggatttcttctcttggcctcctcccaaacttttagcataccagcatagctggccggtgagcgtaaatcgtaataaatttgttccaataatttatccacagtcggctgctttggtgctatagtcttgcccataattcaggtttaaatttgcgttttggttccgttcggtgtaatccaggggtttttatagacgatgaattcatcatattgacaagcactaattttttctttcccattttcttcactgtgctgcgtcgccgacattctcgcgtttgtggtattttttgaagcagtttcatcattttgggcttttttgagttttcaacgcccgctggcagacttaagaaacgcgtatgggtttcggaatttaagcaacccgctagcaccattaaacatgcgtagattaattatcttttattgcttactttcattggaatcatttttcgattcatctgtgtatttaatatggttttcaacaaattcaactccgtttaattttggtaaatcagtgatcgtgggcaaagtattccaaaattcatcgccaagatcatcaatgtaacttttaatgttgtcattagctttatattgagttgaattgtctccatttttgtcgttattaccatgtacattaacgctgatcaacaaaatagtaataataataagaatgaaattattaaagaaaatgaagaaattcatttttgcaattttctaaaaaaatatgaaa

SEQ ID NO: 572 - DNA, 2565 bp, Heterodera glycines
gttaagaaaaaataatttaaaaaattttaattacatgttttcctggaaatcttattttttttgggggggggggattcccacgccgtggctatggacctgactggtgggtaatgagtaaattcgaattcagtcgccttttccccttccgttgccttaccttttcctcctcgcccgccatgtaatcgttgtcgatgggatatggccacatcattccgcgctctgtccactgaatttgctcttcccacgcgtttttgggccctaacccttggcccataattcggctcctccgctcgtcccaatccctccaaaagcgcagcggtcgctctttgagtgcgtcgcgtcgctcctccgcaaacagcggacggaagccgtcgggcggtggcgacgacgcggcgaacatcgcgcggtacggcgcgctgcgcccgcccgtcttcgttttgttttcagcatccgtctgctgttgccgcgtcctccgctcgacgaagtgccgttgaaattgttcagcctcggcggaataagaatccacgaaatctttcctactttattaaatggcatataaatgtccccaaatggcaattgaccgactttatagccatcgaaatggacattttgcactgctccgccagctcctccaatcgttcccatttttcgccggccgcaaaaggcggcggcgttttcagcgaacgtcccccgtccgtgttgggcgcggtctgatcggaggccatccgcgtgaattggtccaacagccctttgaagtcactctccgcccgttggtgcgcctgaagcgcgccaattccctgctgaaaagagaggggaaaaattggaaaatggcggaacggcaaaagtctatttgttgtgattaattgtcagtgattccaattattttgccagaaaaatcacctgaacgtagcgatagaattgctcattccgtgccgcaaccgccgccttttccgctattctccgggccgcttggtgcctttaaaatgggagggagtggaagcaaatgtttataaattgtgataaatgaattaatatttacggttttttgttggtgtcttcgccggacgaattggccgacgcgtcgtcagaacaaaaatggcacgaaataaacggcggaccaacgaaagggcaacagggcaaagccaaacgccgctgacaatggccaaaagtaacgcgttgcatcatcaaaaaacaaaaaggacaagaaaagaaaaaggaaataaaaaaggtaaaatcgaaaaaatacgaatgacatttttaaaaagggaaaattattagaatatttatttatcaaagcataaaattgtaaaaaattagaacaatgaacacatgattaaataaaataaaaaagcgggaaaacgccaagggatttgaaaagagaaataattcacaagaaatgtaaaattaaagaaacccttatgttcataaattagccattggttaaaatcccttggggtaaaatgaaattaagaaaattatttgttaaatgtaacaagtcgatgaaaaagggttaattcgcttccgttttaattctgagtgatgccttctgcacaatgtccttgccgaactgctcgaacagtttggggtcatccttaaagccaaaaagatcacaaatcaagtcaaaaatgaggaagagactgaccaaaaatgggctggccaattctctgagtgtaatgaccactcttcggccgaaaatatggcacgggaaaatgccgtggttccattcggagcgcacttcaccggacaaacacaaaagggaacggcgcgggaccgggacgaagacgagcaatttgcggccggggtgttcaagtgtgaacacacaatccgagttcagagagacactgtaaaagcagcaacatacagtataggaagggggaatacggtagaaaggagagaaaaatactgtaatacccggatgttcatcaaatctacctgacaagtcgctcgccccatatccattcgtcatcctgagaagcagagagtgcatttaaccaattgcaacaataaaaattcagacaatttaaagggtccccagcccgacattccataaaattcagtggcaatgttctcatttaacttatcttgccaattaaacgccaaaacggcttattccaatttgtcggttttcggattccctctcaaacggataacccttcggttgttcgttaaaacaaaggaaatgagcagcaacaacgaccaccttatgcaagtcaatggatgaaagtcgctcactggagtagtccaaattgcacaattccaccggacggaaaccatcgaaaagtcgcgcgacgccctccccccgcatttgacccatccgaagcaacaaatggtcaacatagtcgggcaagccgaagaatttagcactgttcacgcgttggtatttgaaattgacgcggggcccgtaatcctatgaaagaatgggggatttaaatgtgaaaaacccaaatatatgtattaaattggtgggaaatgtccgaagactctagaaaaacccggaaataacaaaatttgaagacgaactatgttgaccgtttagacaacagaggacatgctcccgattaaaca

SEQ ID NO: 573 - DNA, 1830 bp, Heterodera glycines
ccccgactgcgacggcgtccattgggcctcatcgatgcgactcaacagaaattgctcctcactttctgtgacaaaatcgggcaccaggcgaaggccgggaagcgcaaaacagcggccgtcctcacaaaagtggggaaaagcaaaagcaacggaacggacaaacgccgcttcggtggacaaagcgacgggggaagtcaaaaggacggaactgaggagggaaaaggaaaaagaggagaacatcaattagcatagagaggaagagaaaaagcaaagagccaaaaaagaaaatttaaaaaacaaaaaagggaatctctgagagtcgagggtcacaacctcttcttttattatttgcggattctgtccaatttcattttcatggcaagaagtctgagaccaattggcaaatttttttagcgacaaatggaaattttctctgtaatttgacattccgtcctcttttggtcaaatgtcagatttttaattttttttgagtcattttcgtactttgattcggcacttttatgtgcctttccgtccgtcacattgaaaatgctcgcaaaatgttccgaaaatgcgttcccttccgtccgtacgtcgcccctccttttcctcactctctccgtcccctgaaaatgccaaaatatgcagaaaaatggaacagcacaaaccaaacaaacggcgcagtagcgcaggcccctgcacgaacatttttgaaaatcggcgactttttcaggcaaagagcaatcggacatcaaacgaaaaactgcaaatttgaaaaaatgaaacatttgtgaatgtaatattcggtgtttctgtgtatccttttctcccacaaaaaaagcaaaagcaaaattaggtaaatcttattaaaattttttgagaaaaattttaatgttttttctgcaaaactgacccatttaaagaccgtttttttctttgttttcttgctttttaatcattccaatgctttttgtttgttttgagtttggtcccacaaattcatatttaacatttttatgaattacctaattaggtaattaatgcattttttcttatttatatgtacgtatgaaaatacgataaataaattcatacgaaagtgcctttggcatttcgagaatggcaggaggaatttgtacaaaaaaaagaagaggaaaaggatcacaaaaaaaggaggaaaaaagaacggaatcacacaaagtgacaaggccataaatttacaggaaaataaattaattaacggtaattaatgaacaattaaacatgattaattagttaggcaaataaagatcgtttaaaagtgaaatccgcggggcttttcaattttttgccgttggcggcgccgaagggacgggcaaaaaattgccaaaagaattccgacgaagtgccaatggttcaatgttgtgcattcgcatgtacgaagtcactgaatttgatcgacatattgacacaacacattttcctgctatccaaacagtgagttgttatattcgaaagtagaatttcccaattttccaccggtttcgggagagcccaaaaatcgagtcggaattttcgtctcatggatctcgatcactaccatttttgggtccctccctccctctcttttacaccgatctagtgatctcgggtttagtgtgtgcccattcgtcctccgtggcacaattgtccacccaccttggtaagggatctcttcaaggacggctttggcaagttcggcctgcactttcgcctggtgttcccatgtcaatttgctgttcggcgattggacggcgccgtaatattcgcgaaaagggacaaactgaacaaattgggggggggggggggggg

SEQ ID NO: 574 - DNA, 1245 bp, Heterodera glycines
  misc_feature (1118)..(1118): n is a, c, g, or t
  misc_feature (1168)..(1168): n is a, c, g, or t
  misc_feature (1181)..(1182): n is a, c, g, or t
  misc_feature (1198)..(1198): n is a, c, g, or t
cgtcgctgtccattcgtccattttggaaaagtcttcgtcaccaatgccaattatctgaaaaaggaaatctaatcccaaagaacaggtcgagaaaaggaccaggacaagaagccgatcacttacaatgattgacaatggcagtgacgaagcctaaaattaaaaaaaagtggcaaattggcatccaaatgggcggagaaaggcacctcaatgatggccaatttggtcttcaccatgtcgtaaatgagcccgtccgtgattaagagcagaatcttaacggcaacagcacataagtaaataaacgagtcttacaatacggtacaattaccatacccctaacaaattgcatgacccaataggtactgtatctgtgcaaaaatttgcacaactttcaacacctgatatcgtgatccatcgcgtggaaaattggcgcatttctgagaggcgtagcgcaccgtcggctcaaaataagtggggccatacagcaaaacgctctgaaggggaaatggtgtcaaatatacggtacagtacggtatattaaaaattttgttttttgccctcccgcccacttgaagcgtcgtccgataggcgtccatcactccgtcgacgccacgtgccgcgggttgggcattcgcttgcagtgggaacaaatggctgaccgtcgtctgattgggtggcactttggcgccgaatccaaacgcctcgaactgcttggagtcgttgtaatgttggcaaatttccaacaccgatcgaatggcaatttcgtattggttgaggcacaaatggtcgatgaaatggcgtgaatttggcaagcgaacgtcgccatttgaggcagtgaagtcgatgctgaccatgaactcgagttgcattctgtgcaaaacgaaccaattcgatagtaatcgcctcattcgattagggacaattaaatatatggtaacaattgcccaaatgacagcaaaaatcgcaattaaaattagcgtaacttttcgatccaataaaatttaatttacaattggtaaaatgttttttgcgcgtaccctccgccgacaaagtcgagccaagtgtactcacgacggcactcagccagcagaaagcgcaatgtgccgcagctgaccattgangggggaaggggcgggcggtgtcttttttttgaggcgtttttttgcctccnttttttccgttcnncacgggaaactgtgcntggcgtaaagtgacgagtttctgggacggaaatgagcgcagaaccaa

SEQ ID NO: 575 - DNA, 2228 bp, Heterodera glycines
  misc_feature (2172)..(2172): n is a, c, g, or t
  misc_feature (2211)..(2211): n is a, c, g, or t
tctccccatttttgtcctccactggaatttaaataattaatcgaaaagtgactcacccgccggccaatttgtagtcgaaacattccaccaaaaagtcccttaaacaaataaacaccgtgacaaatagacgacccctctcttttctcagcctaactccacctgtttttgtccccctggcaaaggtgccgcaccgaaatttcgatgggcttccattcggggtccaccgtccgagtttggacctctgtccggtagacgagctgtttcctgtcccaaccgatgtgggggaagtgaccaatgggaacagaaaacccacgatccgtccgcgtagaggcggtgaaattcgaggaaagggtccctcgcggaaaggcaccagcaaatgcccttggaggccacctgctgcccatggcacaccatgcgcaccatctctttttggccctcgtcgacttcgtccgctcggatgatcaatttgccctcttggcctggctcatccccaaaatttggtacttttttcatgccctctttccgcaatttgtgctttttcattacttcagcttaagcgtcaatacgccgtgtgcggcggccacaatgtccgccaaatggcactcacagcggcctgaaaagcagcgtgttcagtctggtccgaacttagattactgcacagctgctaggccatgcaattgccaaaatccgaaaaatcagtctaaatgcacgcccgattcctaggacaaaatgccaatacatgctgactcgaaaaagaggggtgaccaatgcgcaattggagttgtaaaagcattgaactgcttcaacacgttgggatttgagttttgtttcggagatcggcggagttaatttccacgacaaatgtttataaaattgtcgtgccattcccttttctctgtcttcgcattcttcgcattgtccgttcccaaactcgaccactcttcccagcacagaacacacccaaaaagtcctggctgctcaagtcgcgcgtgttctccgtgtcgatgtcgaacacgtcgaagcgcaactgctgcttggtctcgaagaagtaattcagcgtcactttggtgttccatcgcgggttcaaattgttccaaatcacttccgttcgcccgatctccacatactcaggccccgtgccgcctttgcccggcaccagcgaataaatcacacacattgggtccgacttggacaacaaatccttgtccttcagatccctgtgaattttttggccactttttcgtactctctccggcggtactcacctggccgagagcattaactccacccgcgtgtgcggaatgtcgggctgacccggcagaggcactgaacaaaagtgggcggactaagcattattagaaaacgaaacattaatgagacaatttagaaattgagtacatggtcaaaaattaaaagtgcgtggtaataaaattaatcgaaccgacattttttgtaagtttatttaattgcttatttttccgcctaattggcccttttgccactttcccttttcacctgttccgccttgggcatgcatttcccttggcttttgtgccaaattttgccgcatttcgtttctcttcctcactttagctgatgattaaatgtcggctaaatgattacaggctttttcaacggtgctgccgatgtccaaactttttaaatagtttattataatgcgcatttatttgttatttttcaaaatttgaatgaatgccaaaaaggggtcatcgcaaaatgctcgtaaggtaagaaattggcaataaacttaaaaaaagagattggtgggaaagggaggggggggggcaaagaaagggcgggaaaaggaaacgtaaaaaaggcatcaattttcgggggaaaagggggggggagggaaagaacacactttcttctcatttgttcgcctctttgccgtcctttcctttgtttggcacatatttaatggacatattttacgtttcaagagatttttttgggattgtgcgttaaaaatgagaatttccttcgtttcgaaagatatgaaaagggacagcgccaaggaaaggaaaggacgaaaaaagggattttatttatggccaagtccattcaaagaacggaaagtgtgcccagcggggccaaataaattatgccttccggcggcggaggacccacgaaagcgtgtccaattcattngtcgccgaccaaacgcgtcagcagcaaccgacaaagttncgttttttaaacagctg

SEQ ID NO: 576 - DNA, 1384 bp, Heterodera glycines
  misc_feature (61)..(61): n is a, c, g, or t
  misc_feature (1357)..(1357): n is a, c, g, or t
  misc_feature (1368)..(1368): n is a, c, g, or t
tcatttcatttgtcgacgacccacgccagggaattgtgagatgattgattgtggggagaanggcacagacaaaagaacaaacaaaagagagagagcgtctttattgacttttaaattctttgtcagtagcaaaaatataataagtgaaagaatacggttttgagcaattcattcatacatgaactcaattagtgcttaaaatctcaaaaagtaaaaaatcatttaatttaaatatcaaaaaaagaattgagcggtttgtttttgtccatgtatgggatgacacattacaatcgattgcactcgttatgaagtgagaagtcaatgtgcggagaaagaaagggtgggcgctgaacggagagaatggaaaatgaaaaacatccaaattaataaataacccacaaattaggaaggattttattgcaatagtccgtccattcagaacccattcaaataaattatgtgagcaaaaataatttaatgagcaataaaggaggaattaaaagtctgtaatatcatttgaaaaattaaattagtccactggcatataattaacgaattaatggtttgtggtttgatggcacatttttttctgccaacccgccggtgagaagatggggagaaagaaggaactcagaaacgtcgacacatgataataaatttcgaatacccaattcaaaaatgagcaatggtcagattctgccgatgcgccgcgtggagttcgggatggtgcaggaagtaccagtcgtgcacgtacatcagaatggccatcggttgtccgagaatgagcgaaagccaaacgacaatattcccggcacgaccgccctggaaaaacggatgaaaaatggtcgtattatgttttgaaatttgttaaaattgtccggaggcatttttttaattaaaaatatttttatcaaaataataatcggcaatttctgtaattgtttttttaaatatttgttcaaatgggatgcaaattattaacaaattcaacggcaccttcaagtattggtccgtgaacatgccaagcggaatttgggcaagcattccagtgcaggcccaaagacgaaacattttcaacggaatggacacctaaaagggtatgagaaaactaagtgttaattgaggagaataatggcggatgacaaaccaaatattcgtgaaagaatgccgaggtggcgaacacagccagcgaagcgtgccatcgaccaaatccattgcgcacgaagggcttgtacatgtggtgaatagcccaccggtggacgggaatgttccacgtcttccaaaacgtcgacactgactccgagttccaaaagtcccttaaattcaaaataatataccagtggctgaatttcctcanaatttacaaantaaaattctctgtcag

SEQ ID NO: 577 - DNA, 1273 bp, Heterodera glycines
aacaacgagtcgcgtgcgacgtgtacctgacggttcccctgcttgagaaactgctgcgactaattgcattgtcgcaaattatcagcgtaaaatataaaatataatcaatgagctcaataaattcaatgagcaactgatgaaacaaagaaaaaaaagcagttgaaatattaaatttggaaaagtgcgtaaaacaaaacacgtaacggtctaacaaaaatagaaggaataagaagagagtgttgccgtgagccaacacccaatcatgccattggccgcaacaacaaatcgggacaaaatgtcaaaatcaacggcgccctttgttggtcgccaaactcaaatagtcttcgtcggccaagttcaagaaaagtccgtccgaaggcaaatagacgcggtttgacgagttggcaatgaaacgcgcaattttctgagccgcacggatttttcgcagtttgaggaagccggggtcattcttcatcgactcgcccaacttaaaaatgacagagtatttaagtgagtaattaagaggggttaggagagggtgtttaaaactcaattaattatggtatgtctataaaacgcatttatttttaaagggcaaaagaccccgccagaaaaaatggcaagcgaaaattgtctttttcaattaatggggaaccggttttatagccaaaggggaacagagacgaaaatttatgaaagacaataaagaaataatatgaagaaacgatttgtttttggaattaagaaagtacatggtcatgccaatgtaaaagaacatttttataaatttttggaattccatcacaggaaatgtttattgttttttacttggtacggtatgaactccttatgtataacccatttctacgtgtaaaacacccaaacaaaattttttggatttcttattttgtcacaaacaacgaaaattatagttggaaatgccgtcctttttttaccaatttggccgcttgcgcctctccctcggcttggacaattttctcctggcgctgttggatggccttctccaccatgaaactggcccgctgcgcctcctgtgccgccacttgttttgcctcaacggcggcactgtattggggcgagaaggccaactcggtgatggccacatcgtcgagaatgatgttgaagtccaacgcacgctcaatcagaccctttcggacgagcagagacacttgctgacgttgggtgatcagctgggaggcgttgaacttggccacgacgcccttcagcacctgcggggggggggggggggggg

SEQ ID NO: 578 - DNA, 3962 bp, Heterodera glycines
  misc_feature (15)..(15): n is a, c, g, or t
tgcaggtcgatatantttctttaaattatgttgtttgagtctctccccattattacgccatctgtgacctcgttacaaattgacggaagcactcgctcctcccaattggtgccgagcatccggcagatcgtctgcagctgccccgggtccggtcgggacagcacacgaagcccgatgttaaccatttgcaaatccttgctgccggtcggcgaccgaatttggttgggacgtgcacgaatgtcgtagacaatcggatattggaaccatggaatgcgaaagtgcagtccttcccggtacacctcgtcgccgagcccaccgattcggttgaacattatcgcacgatggccagcctcaactgaaacacacaattatacttgtgtaataaatttatgagaagcattaggagccattgtctgcgcaaaaactcactcgtatacatcgacttgtacagcgcataaccggccaccgcagctgcagtcatcaagccagcgccgactccggcacctttgctcggtttggcaaacttgttgaagaaatccttcgggtctatagaagccatcggcaaaattgtaagcaattaattgacaagcgttataaaaaaaattaataggaaaaagaatgaatgcatattgaaaataatgaacgattaaaacgaatggataattaaagaaaatgcaaacgcaaaaattttcagcaaacaaacaaatcgagaaagtctcaaacaaaaatggttgtgctggtaacgataacaaagaaacaaaaaaaatctcctttaatcgccacgggtccgccccaatcgaccatccatcggtcactgtgtcatttatcatccgtcactctttggtcagttaatcctccctcctctgatacgcctccacttccagttcagtcaattctccgccaccggcatttgccctctcttcttttgctgctgttttcgtctctcccttttccctctttttgtcctcctcgtcatcttcgctctcccaaagttcaaacagttttgcacattctatcgccgtgcgttcatccaatcgttgagcgtcgcggattaatgtacgagcccattcttcacccattcccaaaatgttgtacagcagcacgccaactacaacatttgttgttggttcggtgtagaacacaacagcacggagctgaaattcaaataacaaatggaaattattgtctcaatctactctgatggatttatagtccaaaagtggaatttgaagagggaaggaaatacaaagattctatggtagcacaaaatttaaaactaaaattatacgggtagccaaatgccaaatgtgagtcagtgccgaattcaaagttccgtaaaaaattacagcaaataaaaaaaagaatgaaaggaaggtgccggctaaaaaagggcaattcaaaccatagattcattcacctcatcctcagcatcttccgcaacttcttcatctcgttttgcaaatattgttgtcgtgcttaaactatgcggatttacgtcgccaactccacagacatgagcatatgggccgaacattgagacgaacgctcccttaccattcgaggaaaaatgaaaaagtacgatagtgggatgggttaatcaatttgtggacatcggttccaaaaagcccaactgaccacaatccggttgtgtctctattaccaaaagtatcaatcacctgatgggtgtacgttttgtgtccatccgtcatattttctccggcaatccgtcccgtgatttgtgcgtgttgccaatgggtacagcgacgtcgcctttttagaactgggtctacgaaagaacagacatcgccagcggcccacacattgtcacagacacgcaaatgctcatcagtcataacgccaccgttcgcctgacaaagaacgagcaaattaaaaatgaatttgatgcaccaattgtccctcccttccaacaaaattgcaatcaattagtgaatttactacggatcactttgtccagtttaatgctgctcttttcgtccaccaattcgatgttcggttcggcgcccaacgcaatgattacaaagtcggccataacttgcttcctttccttcggaccgtcgcttgtcgttgctgcagttgtgttgagacaaattcggcgccttttctcatcccttcccttaaccgatgccgaatcaatgcgagtgtccgtcagcacttcaattccttggtatcttagcatatccgttgaataatcgctcagagcatcgggcagaatttcggataaaattcctgaaaaagcataaaaatgaatcaaagaaagtataaatttagacccaattaaactccaatgccctccgtgaattacaccgattctcttccccaccgggttcttggcacagctgcacaattttcagcgcagggttttcctggtcacgagcgtaccgtcggttcagcgagtaggccaattccgtgcccaaaagaccgcctcccaaaacaacaataacattttgtgtgccgttttcagcgacagccattttgtcaactttggaataaattttccgaaagtcggaagccttaaattcgattttgttaatttcttctcactaatcaacctttccaagtgttgtgacaaagtcatccagttcaggaaggtgttcaagctgtgtgtgcaaccacgcgtcactccctgagcattaatttggcacaatttgccaacagtttgcgtgccctcacctgtcgcgataaggcatttgccgaattcgatcttccgtccatcttccaacagcacaaagcttccctcggtgtccaccttgacgacctttgcgccacgtattagcccaactccgccatgttcccactcatcaagcttgtccggtggcaggtaaaagccgtccgcctcgtaaaaagcgtaacgcctccgtccggtgctactcgtcggatttgtgtgggacagcgagtcaatgctcgcctcatcggcaaaccaccaaagctcttgaaatttagtgttgaaaaggttattccgaagctaattgtcccttcccaccctttcattccctgcggtgtttccccatacctttggacaatggtcctcttttgtacggtgtttcatgctcgtccgttatgatcaaaactcttgcgtccgggtccctcgcacggattgacaacgacgcgtaataactcgcagtgccaaaaatattttttcataattcgaactaatagattttataaattgtcgccaccctcccaccaatatcgtggtgaacatgcttttagcttgttgccacccctcaccctaaatttgtaccatttgaggctttttatttctcgattttagggtcaatatatccagaatcaaattaataccctatattctactaaatttttatgaggcacgaaattggcaataaccatgacttaccaccaccaatgaggacgtatgggacgacacttctcaacacattattcctcaggcgtgggaaattaattgaagcaatgaaagcacgtctcataaaattcatttgtgcaaaacggaacaaagtctggaatttcaaaattattataccatgttaaaagagtgaaatactacaaagaatttcaacaattaattcagtcgtaacggcgatttattcgaaaaatttatcctttaaaaagcttttgttctccaacttatcctatcaaaatcaacaatatcggaatcatcgtcatcagacatttccacagggtcaaagttcggcttttgctcaaatttggttgccaccgactcgacaatgttttcctttttcttctcgagttcgttgaccattttccaccgctcgatttgttcgtcaatcatttcgatgtccgaacggagtgccgactgttcattctacaatgactaatcattaaaaaagcaattaaatttaaacggaccaattcctcgtgttcatcttctcgctgaacctccaattcttcgaccctcttgtaaaatcggtcaatttcactggtaaattttcttttgtttttca

SEQ ID NO: 579 - DNA, 2962 bp, Heterodera glycines
  misc_feature (2362)..(2362): n is a, c, g, or t
atcaaaatacttcgttttattttcttttcactcctcccataatccgcaacatcaaattctgtcggttgtttgcgctttaagtccgtttcggcaccgtttctgctgttgatggcatttacttcgcttgttgtttcctttgcctttttcagcgaattgtctttgtccttcaattttgacaatacttctctgtgcttccgtccatttatgtgtgccgtaagtgtctgaatgaaatttgaaatatatttgtccaaggaagtgccaaatagtcaatcgtctttcccctcccttaatctacaaataaagttgctgggatggattagttatttcataaattgctagaactctaggaaatgatttcaccttagttttaaattgcattgaacaaagttgacaaaaagaattcccattctttaaatctttgacgcatgatgatgatccggaagacattaccaaaataaaatacctacttttggtttttattaatgattagaattgtccggaaatgtatacgaatcagacaaataacatcatcacaaaaataaacaaataaattttaattttaaaatgtgaagacgatatctttaactagagcccggattttgcgggatcccagtccgcaatcattacgggattatacgtcccgcaaaattttgaagttccaattccgcagcggcgggacccgcaaatttgatttttggtgcgggatcacgcgggatcagcactatgggtcaactccactgtgcagatgctcatattcacaatgccaaggttaaaaatccgcatatccctagctgtagctatggtagctgcagatcgattaatctacagctcaaaacccgtattccgaactctgaatacgactggggatagttcgatccccagctacctatccaaaagatacggataagccgctacttttccctttgttagtgtattctttgtctagtgggtagtttgttagttttctaacaatatctatgcacctctaagaattgaaaaattttctcaaaaatgaattccctaaaatacatttttttcagataaacttttgtttaaaattttcggcgcccccacaaagtgtccaagccacgaattgtccaagccacgttttgtccaagccacgaattgtccaagccacgaattgtccaaaagagtaaaaacccacgaattgtccaaaagtctaaaaaactcatagaaagccggagaatgggtctattttagggttttcggggtcgctgaataccaatacgacatttatatagccccttgcctaaccctagacccaaatataaagattaaatagcaaaaaaatattcaaagctcttacaaagggtgctgatcaaaattcgtacaagtttagggctcctatgtgatccgaattccctctatagacccaccctcagcttcacacattgaaaaaataattttattaaacattcaataaaattcattacgggacatggacaactgaatcatcaaaattttcaaatccttcaattttcctgcatatccctcaatttgagagtgccggcggaattggaaaatgtggtgcccgaacgatttcgtcctcccatgctgtaaatgaatctttttattgagtttaaacggtttaattgattaaagaattctgcctgaaggcgctgtcgaagtcgatagcgaactcaacaaatattgaacaagctgctcacgtggactcacagtggttggccatgtaagagttgatggtgccggtgagccggtgccgaactctaggggtagccgcatagcttgttccgagttgatagtcaaaattattgtcccgagtgtagctaaaaattttaatttttggaaataaatgcataaatctaacaaacaatggttgccggtgggtgaaaattgagtggattatctcaaaatgcgttaacaccatccaacatctggcgctgtgtcaagccgatatatgttcgagagaagtaaaggaagaacattggcattccaggagaagacggccaagataattgagaaaaactcgatttgtgcatcttcagcgatttcctgagtggtgtgtgaatctaaatcctgaatagtttggaaataaattttttgcggtgcttcaaacatacctttcaaccatagacaatctcacccaaaattgatttttccgcgctcaaaggtcattgttgaaagttcagcctcgttcaaattcggttgttcaacgctgtcagaaattctcacggcattcggttcgacgaatttcactcccaaattcacgtcctcctcagttgtgtttgaaatgtctgacaaataacgcttcttccgactttcttgtagactttcaagtttattacgaatcattttgttcgatcattgaataacaaaatcntgaagacaaacaacagcatatattttaaccgagtttttagatttttcttattcgggtgggtctagggttaggcaaggggctatataaatgtcgtattggtattcagcgaccccgaaaaccttaaaatagacccattctccgcctttttatgagttttttagacttttggacaattcgtgggtttttactcttttggacaattcgtggcttggacaaaacgtggcttggacaattcgtggcttggacaattcgtggcttggacaattcgtggcttggacaatttgtgggggcgccgaaaaatgagttaggtaactttaattaaatttattatttaatttatttaaaattatttggcattctatcttagaaaaattttcaaaaaaatcaataaaatcccgcataattccgcacaaaaaatcaaatttgcggatcccgctgcgggattggaactcaaaattctttgcgggacgggatcccgcgggattaataccgaaaatcccgcattttccaaaaaatgcgggattgcggactgggatcccgcaaaatcccgcgcggcactcggtctcgtgtcggcatctactttactctccgagcttcaaa

SEQ ID NO: 580 - DNA, 540 bp, Heterodera glycines
tgatcagagaggctctagaaccaaataaaactgatcggagaatgaaagagcgggagtttgcagtttggtggtcaaacggacatttcttatgtattttctcccgtgaatacaaaatttaattgacaaattctacaataatattgttaaattaattttagttttcatttaatcatccacttggacgaataaaataatgcatattagtcagagcaaacatttgccacatttatacgggcctaaaaggcacttaaaagctagagaaagccagcaaaaattcagtatacaaaaaagcaacagtgtgcgatgttttgaatttcagaaatattctgatttagatggtccaaatctgacaaaaaaacattgataaatccgaatcctgtgtgagtttatacataaaagacaatgcattcacatgtagcgatataatggaatatacaatggaatacagcagagaattacatattatgctttacatatatcgtttcatcgcattgactgttttatgacaccagcatcattcttcattccactcgtcctctg

SEQ ID NO: 581 - DNA, 2580 bp, Heterodera glycines
tcatcttcccgtcgctggtcacgtgatcggtgttgtaaccggtgccgaagcgccataattccaaaactgatcggcccgttgctgtcgttgtcacaaacttaacatttccttgcatcgctccgaaatgttccttcattttgaccaccaattcttcatgttcgaccatcttctgcttgatgaatggtggtggcagccaaaaaaccggcacatgactgaaccgcttcagcagctgctcaagtctccccactcgctccatcacgttttcaatcgtctcatctcctcttatcgagtcccgcccaaccatcacaatggcaactttcactttggaggagagaatggcgccgtcaaacgccctgatcacttcggtgattgttccattttcggcaccgataaattgcgatttgggccaaagtttgaccagttgtttagctgaggaatcgccgatgatcacagtcgccgtctcgaccaacagctgtttccggtggatgattgtggcacgcactttttcgagaacgaagttggcccttttcagcatttcgtgccatcccatcttctccgattcgggcaattcggcgacaacgttcggcagtggcacttcaattggcgcgtagcccgtcttcatcagcttctctcgtgtgaccgcacatcgttcgacccatgccgtaaaggcactctcaatgtcattttccgtcgggaaaaagccattcttcacaaggtcttcgcgtccgccactgtatgcgatcagctcgaagccaacgggtgcactgatcacaagctgcgtcaacttttggccgccggcgactgatgaaactgcgcccgatttcagcaagaaattactgaggagagccttcattggcgtgccgatcaccttaaaaccaacttttccctcaacattttccatcttttcttgtcttccaatcactttaaggcctaggccggccctctcaagcactgggtcgaggtcggcagccgttaattggacacaatttcgatgttccgtgccgagtccgccacattgcatctcccagaccaaaggatggtcagcgttgtccttcgctctcacctcgccgtcagctgaatttgcaattgtcctcaattgcccaataaaaagctggcccatattttccgttttttgaaattcgtccatttttatggttccatttccaaatttaacactttttgtttgtgtaaattgtccattttcttcacacgtctcaatatccatttcacgatacaccaaacaaactacactcagcaatgcgttcaattggtttttgaagggatttttaccccgagggagagtactaatatccggtacaccttccggaactttcactagccgctcgattggaacacttataggttcaaaattcggtttatcgactggaaccaattttgctgacgaatcagagagatccaaaattttatatggaccgaactgattccaaagaagttttcggtgggctgcgcgggtatttacgcccggaaatatgaccattactctctcgccgattttgaatttgtctgctgtcacttttggttgtttttcatagtgatttttcatctttatgcgagcaattttcgagttttcctgtgctaatttgattagctgcgcaatattttcgcgaaaaagttgaatgtaagtgtctacatcaactgtatagttcgggttaactggcaaaaatatctcagttggaaaatttgggatttttccaaacatcaaatggtaaggcgagaatttagttgtctcggatggagtaatattgtacgcaaaaatgacaaatgggagtctttcgtcccatgtccagttcgatgccgtcgaccgttttaacattgccaaaatggtctgatttgcacgttccgtgattccattcgcctgtggatcatatccggatgtcagcgatctctcaactttcaaaattttcacaatttcgttcagagtttcgtttacaaactcttttcccctgtcgctgtgtaactttttcggagttccaaaaatcaaaataaaattcttgacgaattcgctggcgattgtgtccgcacttttgttaggaattgggacagcaaccaaatatttagtaaagtggtcaactgcaaccaagatatatttgttcgacgaataggcaagcccaatcgaaagcacatcaatgcacactaattcaagtggttccgacgtttggacgattttcattggcggttcatttgctcgtggcttccgcgaatgcgcacaaatccggcatttttgaaccattttaacgcagtctgcgtacatgtttggccagaaaaattgttgagcgagttgaacataaatcttttttccgctcatgtgtcccgcgcaacttcctgaatggcgctctcttatcaatgcgtcgcgaaagatgaatggcacaaagaggcgtacttttccgtcgttttcgcacttgtagagggagtcatccaaaattgtgaaagttggaagaagcgaaataagcttttgcttattttttgggtcctgtggcacaattcttttgttcaaaagtcgtagatgaagtccaattcgctttctttggtcttttcatccattcctgtcgatttttgacc

SEQ ID NO: 582 - DNA, 8633 bp, Heterodera glycines
  misc_feature (57)..(57): n is a, c, g, or t
cagttggaaaatttgggattttcccaaacatcaaatggtaaggcgagaatttagtgntctcggatggagtaatattgtacgcaaaaatgacaaatgggagtctttcgtcccatgtccagttcgatgccgtcgaccgttttaacattgccaaaatggtctgatttgcacgttccgtgattccattcgcctgtggatcatatccgggtgtcagtgatctctcgactttcaaaattttcacaatttcgttcagagtttcgtttacaaactcttttcccctgtcgctgtgtaactttttcggagttccaagaatcaaaataaaattcttgacgaattcgctggcgattgtgtccgcgcttttgttaggaattgggacagcaaccaaatatttagaaaagtggtcaactgcaaccaagatatatttgttcgacgaataggcaggcccaatcgaaagcacatcaatgcacaccaattcaagcggttccgacgtttggacgattttcattggcggttcatttgctcgcggcttccgcgaatgcgcacaaatccggcatttttgaaccattttaacgcagtctgcgtacatgtttggccagaaaaattgttgagcgagttgaacataaatcttttttccgctcatgtgtcccgcgcaacttcctgaatggcgctctctgatcaatgcgtcgcgaaagatgaatggcacaaagaggcgtacttttccgtcgttttcgcacttgtagaggagttcatccaaaattgtgaaagttggaagaagcgaaataagcttttgcttattttttgggtcctgtggcacaattcttttgttcaaaaagtcgtagatgaagtccaattcgctttctttggtcttttcaatccattcctgtcgatttttgacctcgtccaattccgtttgaatttggcacatttttatgtgcgcgattcttgaaatttcgatttcagccggtggatcgggacattttagcgctggtgagcgtgacaagagatcggcgatcacattcttcttcccaggctgatattcaaccttcagtatgaatctcgaattcagctgcatcagccatttatcgacacggctgtttccggtctcagttttacttttgaacatgtggacaagtgcccgatggtcggtaaagactcttgttggtggcatggtgataaactgtgaaaattttttggctccgaagcgaacagcaagcgcttctaattccgttggacaatatttgctctcgtaagagttacactttctcgaggcgaagtaaattggcctaacatttgcgttttcgtccggttgacaaagaattgccgcgattccaattttactggcatcagtcatcattatgaactgacgtcttggttcatttttggccgcttcgaagtttggaaagtgcaaaattacgtcgtcaaaaattttttgctttaaggcctttattgcctctttttccaatttgccgaaagcaaattccgcatctttcttcaacagtccgtacaaaggcgcggcaatggctccaaaaccaaaaataaattttcggtagtatgccaaaaatccaagcagtgattgaagtgccttttttgatgttggaattggcaattccataattggacgtactttgtttacatccatttttattccttcagtagtgagaatgtgcccaagaaacggtagttcgtttgccgaaaaatggcacttgctgatttttaattttagtcctgcttcccgaattcgttcgaacactatttttaagtgctcttgatgcttttcccacgactcggaggcaattaagatatcatcaatatagatgaagacaaaatcgttgattaatccttcgaaaagctgtgacataaatcgttgaaaagttgcaacggcgttgcaaagtccaaacggcaaaacgacgaattcatgaagcccaaattctgtggcaaaagccgttttgtcgatcgattccggtgacattttaatttgccaataaccggaaataaagtcgagggtcgaaaaaattttcttgcctcccagtgccaataatatgttgtcaatattcggcaaaggatatgcatcctttacagtgactgaattcagtcccctgtagtccacacaaaaacggagcgtgccatccttttttggcacaatcacaatcggtgaagcccacggagacgaagaaggtcggatgatgccacgccccagatagttttggatcatttccgcaactttttccctgtaggcataggggacgggtcgtatccttgaacgtatcggtgccgaatttcccgtggcaatttgatggctcaccaagtccgtttggctcaattcctcatcggaaaaggcaaaaatttgggtaaaatcattcaacaaggccattagtttggctttcgcttcatttggaatgtgtccaactttcagagacatttcatctccaaattggatatcgttttcaccttctccaattagaaagtcctttgtcggcaaaaacgaattgccagaatcataagacaattctacctcttcaactcttccgatcactgtgttcccatcgatttgctccacatttgaactcaaatttgatatttggcagacaattttcccattttcgacttttccaatggactgatcaattctgactgctttttcagcaggcactggacatattagcacgtcctggccattccattgttcatcgacctccatttcgacgaatttgctagtccttggttggaatttcatgttgaaaatcatgcggacggtgtcttcgctttttgtcgctttttcgaaatggatcatttcattattgggttcatcgtaaagcgagaacccgagtgctgacaatgaattcgttccgaaaagcatgtcgaatccgaacggtgcactggttacgtaaaaatgtatggccacttgttcacagcctttacggagaattggcaatgtgagtgtgccaaaacatcggagttccttcccattgacgtcggcaattctgtcatttgtgcgtgcaaaatttgttttttgcaaatccaatcctttttctctgatcagcatatacagaaatgaggcgccaaccaacgaaatttgcgctccaccatcgatcatcgcttccgtttttgcaccaaatgtttcgattttgatgaccaaaatttttccaactctgtcggaactcatttctcgctgattgtttccgtctttcctttctttgaactcgttggcgaaaaattcagcgatttctgatgaaagctgaacaccacggcaaaaagcttccggtggtgcttcttcttgcacgacaatgcaattttgcttcaaaaagttttgtgaccgacgttgatcagactcttttgtcgaagtctgtggaagtgctcgcttttcaggaccatttggccgcatctgaaaactattggccccagcggccggcactgcatggctttggttagcccttccatcaaagtattgctttggtcgtcgacattcgcgagaaaagtgccctggttcattacaattgtaacaaacagtgttttcacgcggttgaaaactttgtgaaaaattttgcttttgttggggttggaattgttgcgcaaatcttgaaaagttttgctgcataggacgggttctttcctcaatatttcgccgttcgtttggcacattttttgttgccttttgaattgactccgcacgggcagccaatgcgacaaactcatcgaagcacatccccggtcggcgtgccatttcaagggacaaagacaaatccggatttgataaagcacgaatcaaatgctttgttgcatattcatcgaccaggttttgcgttaggcctgggtaggcacgcagaacgacattctgaacccgatcggcgagttcgtcgagtttctcgttcggtttccgcttcagaccattcataagttcgtcaaaagcccccatttctctacaatcggtttcctccaattgtgcttgtacagctcgtcggattgcatcaaaccgataaggctgattggccaatgcggcattgaatgcgcgctcggctcttcccgagattttggattcaagcgatgaaatccgcttgttgtcgggccacccctccgttgctgacacaaattttttgaagaaatagcgcactttgtcagcgccttcattcccttttagttcgggaagtcgatcgagaatgagcacgtactccaaattgctgatcgggggttgtgcccctccttgctgattcaccataacatttcccgaagttccatacccaaaatttgggttcgcattttcgtaacgcgcgggttggtttctcacgaacaaatttcccgggttttgttgacggtaagcgcgttcttcaaattgcgcataattttgttgatgcgttagccgcggttgataatcggcgttttggcgttgctgcacattcattggccgacgcgccggtgcgaaatgaatttgccctcgctgttcgaggtgttcggcaacaacatttggatgcgccgcaaaattttcttccgaaaagaaatgctgttgaaatgccagttgacgatttatcgccaaattctcttcttgctgacgaatacgtgccgccgcaacatttggggtcgaggtaagatgagggttgaactcccaattatctaccagatccaaatgggcgattcgctggtccaaatttatccccaaattttgttgctggatgtttcgaccattttctcgacccaaattttgttcttgggagttttcgtgaaacaccgaattaccatggctgtccaggagagcactttcatccaattcgcctcgattttgcgcgtccattccgtttcgtggtctcggaatttccaaaagtcgctgatgaattgcttcgggtcctaaaacagacgaaactgatgaaactcgactttggcgatgttggttttcgcgcaatggagcattttcaactacgaagtgctgttgctgaactcgctgttctccttgcgtatctcctatgccttcatttcgcacttgtatgccaaggtttagcgccctttgtcgcgttaacggcgggcttcgcattaccggcaccattggtgtgtgagaatttgttttctcgttttatggttcaaagctttttgacttagttgtctgcttttccttcactttcgtagggatttgtttccccgtttttgcaaattttcaattcacacgatttcggcgagtggtgataagatgaaaaggatttgtttcctttttaacaaattcggcgatttctcttccactgtctttacgggatttgtttccctcttaaacaaattcggagattctttcttccacgtttgactttagggatttgtttccccgttttacattcaagcactcgtaggatttgtttcccgttttttttttgttgctccttttcgcgctttacaaatttcgaaattgccgttgatctcacctcttttagcaggagcgccacgtcgtacaaagtggagcacgtagtagagcacacacacaattaggaacggggaattgtatcccaaaatccaaacacaatccaaacaaaaatccttttacaatcaaaagtccaaacagcgaagaaaattcacaaacatttaaaattaaccaaaaacgagcgaatatccaatctgaatgcaagtgaccaggaaaaaaaaagtcggcagcggaaaacaatcgataatgaaaaggcgggagattcaaaattgagaacgaaaggacaaaaataaatgagagggaaatacaattaattaattaagtcaaaaattgggaataaaagaaattaacaatcttatcacattctacaccgcgtctgaaaccttcaaatctgtaagtaaaatattttccaaaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaaccaccttttcattatccattttctattaagatcacatgaacttcactatttccttaatttttatcgcgtaaatcttataaaagatttaaataatattaattttttaagattctacaccgcgtctgaaaccttcaaatctgtaagtaaatattttccaaaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaaccacattttcattatccattttctatcaagatcacatgaactttactatttccttaatttgtatcgcgtaaatcttataaaagatttaaataatattaatttttaaagattctacaccgcgtctgaaaccaaatcttaagtaaaatattttccacaaagtgctaatttttccgtttctgttgaatccattatcaaatgatttttttatcagagcattaataaatttcgatttatcatttatataactaaaatatttttaatgattaaaataatattaatttatgatgggatgcactggttgatccaatcaattaatttaatattttatttgggatggggcgacaaaggacacaatgtggaaaatttggtagatttctgatcacaattgatcaatatccgcgatgcttcgaatgcccgagttgtgatgtattcagagcgagttgttgtccggcttgttgagtgaagagaaccgataggctaacagagtgaattggttgaagcatgcttaaactgaaaacccttcccctttttataccaaaattttttggttatttaatagcattcaaaatttccacattatctttttatggttttttcatttctaaattattttttatcgttttagttttttcttcccttttatttaagaaaggaaaacttttcataaacaattttaattgcttttacgttcaaccgttttattgtggaataaatttatttattatttggggcgttttattagattatttttagtttttattgcgagaagcatttgcttcgtttttatgaattcattttgttttatttatttattttattttacttttattttatattcctttatttatttaatttaattttaaaaataaaaattttatgaaattttattttattttggatttatttttattaatattttgtattttcatgtaaaattcttattattttaatttagttttgtttttattaatagttttatattttttcggatttaatccgacaatttatttatagattctgcacgcgaattaacaccatttttttcaataaaccaccttttcattatccattttctattaagatcacatgaacttcactatttccttaatttttatcgcgtaaatcttataaaagatttaaataatattaattttttaagattctacaccgcgtctgaaaccttcaaatctgtaagtaaaatattttccaaaaagtgctaatttttccgtttctgttgaatccattatcaaatgctttttttatcagagcattaataaatttcgatttatcatttatataactaaaatatttttaatgattaaaataatattaatttatttatagattctgcacgcgaattaacaccatttttttcaataaaccacattttcattatccattttctatcaagatcacatgaactttactatttccttaatttgtatcgcgtaaatcttataaaagatttaaataatattaatttttaaagattctacaccgcgtctgaaaccttcaaatctgtaagtaaaatattttccaaaaagtgctaatttttccgtttctgttgaatccattatcaaatgcttttttttatcagagcattaataaatttcgatttatcatttatataactaaaatatttttaatgattaaaataatattaatttatttatagattctgcacgcgaattaacaccatttttttcaataaaccacattttcattatccattttctatcaagatcacatgaactttactatttccttaatttgtatcgcgtaaatcttataaaagatttaaataatattaatttttaaagattctacaccgcgtctgaaaccttcaaatctgtaagtaaaatattttccaaaaagtgctaatttttccgtttctgttgaatccattatcaaatgatttttttatcagagcattaataaatttcgatttatcatttatataactaaaatatttttaatgattaaaatattattaatttatttatagatcttgcacgcgaattaacaccattttttcaataaaccaccttttcattatccattttctatcaagatcacatgaactttactatttccttaatttgtatcgcgtaaatcttataaaagatttaaataatattaatttttaaagattctacaccgcgtctgaaaccaaatcttaagtaaaatattttccacaaagtgctaatttttccgtttctgttgaatccattatcaaatgatttttttatcagagcattaataaatttcgatttatcatttatataactaaaatatttttaatgattaaaataatattaatttatttat

SEQ ID NO: 583 - DNA, 7982 bp, Heterodera glycines
gcatacggccgattgcgtcacccatacaacataaatgtggctgcccatttttatgcgcggcatcgcataaagctgcatttcccgtatgtaccatgcattgttgaacacttttcttgtggaggagagaaccgacactaccccatggagctgcttgagcttgtcaatgacgacgaaaaccggggaccacaagagcgctggttgggacgacttttcacagagattagcgacagtgaccgactctctacgagttcatcagacaaaaccatgcttttcaaattaggcgatgatgatgatgatgatggaaataaaaattgtggacgtgatgaatgtagccaatcctccacttattggtaacgcactcacacgcacacagtattcgcactaattcgatgacacttttgtaacttccaactcttaattatgcaatttccttctttaaattgttatcttctctgtcttaattatgtcataaccatttatcttaatgactttataattttaaattgtatcttccatacactaattctgcgtttttcttccaataaatgacttcttcttctttctcttattttatcattcaaaattgacaaaaaaaaaaaaattttacaaagtatgtccaaaattcatcactttaaattcagctcctacaattcctttgcctacaaatggacggtaacatttttgcattggcatggaaataacccgtcctccttccctaatgtttggtcgaaggaagtttgggtaggtgacagtgatcggttcaaagtctccggtggttgcgtagcgtactacctcctccttgaatgtgtcatatctgagcccttggttgttgatgacatcgtagttgagcgtcattccccgcaccttcagcacatattcctttacagtatctgctcccgcttccttgcgttgtaggcatagtccatactatattatggtaataattaatttaatttttgtcaatcaaaaatgtttacttgtttggctcctccactacaaaattcaatgatgttgtgctccggatactcgtcagtgaactgtccaagatggggaccagttttgagcggacactgttcatcggggtgaaccaggataaggctgtcagtgtctgtggacaaacaaagaatttcacacaaaattggaagtccccatctttacctgtatacaatagtgcacatcccggtgacctgacaaccttctgcatggccttgagcagaacaagacgcgcggcagaagtagtccaaagcgatataactaaatcataaaagttttaattatttataaagttatctcaccaatattggagcactcgtgctcttccacccagtccttcttgtgcaggtagctgatgagaatgtgttcagtatccagttcatcgattgatgtcacatcgattgatttgttgtctaaatattcggccaaagtggcagggtcgtcggtgatgagggtttgggagagaccaaagttccgtagagaaaatctaccccctgaaataaatttgattcagaataaacggaaaaaaggtgaaccatacataaattattcagacacaattttgcaagggagcgtttgcctttgttcacgatcattttggtagggtcaatgcatatgccaaacatttctgcgcattcccgaacaaattgctcctctttgtcggactgccctttgatgtttttgtcgaagccgctcgcttgaattttttgtgccataaattcagcaatgtacggtctgaacagttgatcatcgctgcgctcatactccaacacgcggaacagtttggtgacgcgatatccctcatccaacgcggcgttcaactcaattgatgtgcacgtgctgacccagcctcgttgttggtcactgtggtcgcagtggtagtcaaagtcaacacctcctgttggccattctttggcgcacttgatgcacaatggaaagcataggcgattgtcaactttcacaggcaaaaccggaacatcaatttgtcgaggcggaataacccagactttcagcagagccagtgggtaagggttgtcgttagaactgtgccagtcgacctgctcgttgaatacgtgcacatttggctgcccaattgggtagctcgtgacaaagctaaaataataataaactcattttgttatacaaaataaatataactttatatgagggtagagtgacgtgaagtcaaaataggatatcttttcaccctcgcgcgctttgtgcaacaatttcaatggtcccgtccttccgcccataaacgcgtcacgaataaccaatggcccgtcatcaacatattcagcaaaactctgtctcatctctctgctcctctccaacattctctcaatttcgcactcccagtacacatcaacacgccctaattggcttctcagatagtctagccgtttggcatctcgttccctcacttcgccggctgtctttccgttaggcagaagcatattgtcgcgtgggtagcatttcttacagccatgccatgtgcaaccttaaataaataattggaacttttacacataaatgtatggtattaccattgacttcaattgcacgccgttccgtttcaatccacccgtccaatgagtaaggtccaattcgtttctctcctccaggcgaatgtgcagtttgaacttggaccccgtgctcctcggcgtaccaatgaaagaagcgaagtgcaagaaggctctgattttgagtgttgtcgtacccacgttccggcacaatagcaagatgttctgtgggcaggtgattggtgcggaagggtcgcatgcatgccccggcaatggtcatgcactcccgcaacacgtctatgccgtcgtgattttcgcgctcatcgattccatcaacatattcgttacgccgcgaaatttcaaaaaattccttacggaaggcgacgagtgctgccatcaatatctccacatcatttgtacaataactgtataaacaaaacaaaaatttgtattttgaaagttaaattatttaatacctggccaaagcctcgtccaacaagaatggttctgcctgatgctgttcataccatgcatcaaactgtcgtcttttctccggcatcatcccttcggccaagtaatcgtctggtgtggggtagatctgcctcccgtaattgtccgggcggtttgccaaatgcgggaaaaatggcttctcttccacatcgagaccataagaggggacgagcgccgcgagtgagcacggcatcaaattgaagctgtcccggaaagtaatgtttgggttccttttcttttgtttgcggattttcatctcatacattttattcccctgaatattcgtcatcaattatgttaataattgtcactgatacgattacccgtctcagcatctcagggttgaacccaatccggaagatttcgcggaacactaacaccatgtcgaaacgaccgccaaaatgggaataggcaaaggtgtcatgcttcttgggcagttgaaagacgagccagtcgacaaacgctgccagtgggttctcatcaatcacttgcttgtccacagcggtgtcaacaaaacgacgttgacaaaaggtaactgtgcgatacggcccacaaattctgcacccggctgttgctcgcttccaatttccgttatcaatacaatcaggacatgcaattcgcgcagcaatgaagtttggctggtgttctcttctctcaggctgctgtgcgctcaccggctgatgctgcatggtctccaagtcgaacgccacaatacggtaggggtcatgctcctttggctgcagcggctggatgaagcagccccggtccgggttatgataggacatgcagagctgacagtaactttcgtagcatttgtgtccctataatcaataagaaataattagattttaccgaattctattatgtatactttacgtccgttgcggttactgtcccgaacattccacatcacaccacagtctttgcattgttttgaattggcacaataattggaggccaaatgatgctggtagcactcgttgttccggaattttttgttacatcccgcacattcattgaaaaagccagctgaaggtgaacaaggaaatgatggtccgatgcgagagcaaaatgcgcagcgtgctttgcacgattttagatgctcggacggtttgctatagggacgttcacattgcaaacaatagggcttcccaaacaatcctccttgtttttgaacgccatcaaagtgcccgttgttgaaataaagcaaaattggagtgtcataattgttgttagcgctgatgtatttgaacagaggtttgtactgtcctgttgagccaaaaataaacacagcaaaatggtgttgctgctgtgtgttgttccagtggtcaaccactcgcggtacaaaagtatccgccgaatatgcatcacggccaagcggggcgccaatctgccgcattaattcggttgtttcatactgcatacagccgtgctgtccacgcctactgtgcaggtagtcgtaaaacttccaacgggcccacccttttgttttgtaaaccattgtcgcttgcaaagcgtaaaaaaggcaatagttcctttcatcgggatttcgaatctttaaccgatagattatgatttttcttattgattggagcacacaccttaatcaaacattgatcgtggatacgatgatggacaggtgccaagttccgacgtgcaccacctttgaggtttcttttgatcggaaggctggagcggtcaaccactgtgatgatcactttgaacggttcaccccaaagcgtaacattttgctgttgcttactctgtgcaactttgttgaattgattgagaatggtgttcacggtgttgtcggtgatttggcgaatgggtattggaatgtcgccgctcgtcaacaacggactactaatcagacaaccaagatgtgtaggctcaatttcgcgctctctgctgtcctgcatggattggtcaatgcagtattgaaaaattccggccaatagtccttcagggttggcgggcacatcttcaatgttgaactgattcttcactttgatgtattgaaaacgcggaacgtgttcaacacttgagcccaattttttgacgtagtcatttgcagttttgtttgttgttgttgttgaaacaccagcaccctcttgaattacgcccaacaattgattgattaggaagccgtggcgtggctttttgttcgagtaaagaatggaatcaattgaaaagtttgtggggcgtttgggaggttgattttgcatttttaaatctaatgaattaaatcaatgaataaatgttatttaaatttcaaataaatctgagctttcaaaaattgtgataaaaaatcaaaattgtgagcaatgagtaagaatagaatgagaataatttaaaaaaactgatgttttaaaccaatcttggcctgacgagcagcgcactgccacccatgaagcacaagacgacagggcaactaaactactcataaaattattaaaagaattttcaacgaccattgaagagctaaaagtttgttgacaggataaacggagctttgacatcaaccgccctggttaacattagaaataaattcgaataagattgtccccgaaaaaagccttttaatgagatgatccctagctttattcaagattttatgaccccgattattcaaattaagggacaatggaaggagggaggaggggcagatgagcgagaatgagcgaagcaaatttttaaaatgaatgaccggctgcacgaaaggccatcgaaatggcttagaccacgcccaattgaaactcaattagtgccaaatcgtatggaggtcgccgggtgcttgcactacagcatccatgcgataccctaacatgagctgtactcatttcattttgcgattcccaaataatactgatttgccaaaatggcaggcaagagaagccaaggcaacaacaacatttcactggcaaaaaaagccaaattgcataaacaactgccgacagagttaatttgggaaatgatcgattttgtaccaatgatgcatttgtttggcggcatttcatgcaaaccaggttctcgaattctgacttttaaatttttattgaaaaattaggaagcaaacggccaccaactggtattgcggtcattaatcgattttttgaatttttacgcaacaaacgacactgcaattttgccacaatggtacaaatgtttattaaacagttaaatgtgatttattaatatttcagatgagaattcgtttgaattttgaaatgcaatgtgcgaaaagaaaacttgcatgtggccaactgtgcatacagtatcggttgcaatacaagcttttggactccacatattttgccgattttgctcgttatctctgttatgggagatcgggacgtatcgaatgcactaaaatgttggtcaactcgccaatggagttggtgaatatttatttttaaatcaaattactaaatgttcaatctagtcttgcacaactggggctttgtgcactgctatccttgactacatattgcgcagccaaaatcctctgacaatgaagaagagaacggcaattgctcttgttcagcgtgagcacttcccaccaattttgagaagcaatgttcgcgaaatggccgaaatgggcattgggcaaatgccttgttctgatgtaggtgaagcgtaccgtctgatcaacccacaccattcaaacgatgtgggctatcttaaaatctatgctcgatcggatcttcgtgaaacttttgttgggatcgattttcccgaattttatgttttttgcttttctcttgactaaacatttcaaagaaacgatgctcaaaacttatcgatttaacattcgtttgagaataattaatgagaacatatcggggcttgtacaattactgagtgctttaagaaaactgtcaaacgaattcccaagggacatgtagtaaatgaacacaatgcagtgggcaccacaagtagacaccaacggggattgatatggatttttgttctttctcactccctttggaaatttgttgagaaataatgtggcaatagtggatggaatgggctgggcgagactgtcaaaatagagcactggtgcatccaatcccttcgcatagacagcgcaccaatgagagccgtccttgtagtgtgcgtctctgttcacaatgagcgctgcgggatactgtagtgcggagggagatggcaattggtcactggcgtaacaaccccgaaatattcgtgtggtcaacggatttcccctcaatatcgttgcgatttgcacgctgtccattcttcagccaaaaaattgaacaaagttgatgcaacactagactgacaattaacatcaaatataaagcaaagagtgcccaacagacggcttgttgaaaaaggttgctttcctctggtctatctttgcacagttgaattaggggtggaaggagagcagatattgactcttgttcgtcaattaatttttcactttttggagtcgttgtggaagagctaaaggtagttggggtaaaggttgtgatggaggtggtggtgacagctgatggtttagttgatcgagcgaatattcttggatttgttgttgttgttgcagtagtagaaagtcttgataatgataaactttttaggtactctgcataataatagtcaggttgtttttgcggcggctgctctggatataaacagacaacgggaagagaaactcggagaatgaataaaataaaactcactttttttgaaaacatttttatttgtgcacaaatgaaatgataaaccgtttaaatagtagtgtctgtgcttattgatctatttttgtctaacatcacaagtgaatcacattctcccatcaccaccagcattattccaccttctggcactggctggttaaattttatgctcacagcggtagtcccattcttgatcaaatcaaacaatgtcgcttgatcgtctccgctgttggtcaaatgaacacgtaaatgcagt

SEQ ID NO: 584 - DNA, 7841 bp, Heterodera glycines
tttgatttggttttcgcggcttccgatgaaagtgatcagttcaaaacccgactggtgctccaatcactgattgtgcaactttctgccggctgcagatgaagaaatggcgttggtttttacagaaaagtggccaacaaagccttcaacggagttccgacgaccttaagcccgaattttgcattttgtggcttcagtctgctttcggccaccttgagtccgaatccggccctctccaaaactgggtccaaatcagcggttgtcaattggacacaatttcgatgctccggtccgagtccgccgcactgcatatcccaggtcaaggcaaagtcgatgttgtccgtctccattacctcctcggtcccttgaaaaacaattgtcctcaattgtgccacaattccgcgaattttcccaaaaaatccttaatttccgttcccatcaaattttttccgtttactttcggacttttttgagaatccattctatctccctggaaagaagtatttttgctgatattttgaggatggtccttgcctttaagcaggttataatccgtctcattttcaagtttttcgttgtaaatcagacagacaatgcacagaagcgcattaagctgatttttatacgggtttttgcctttcggaagcgtgcttatgtccgggactccgtccggcactctaaccatcctctcaatgggtactttcaacggttttgaattcagtttatcgattgggacaacagacgctgctgaagcagaaatttccaagattttgaaaggaccaaaatgattccacattattttatgatgcggcgaacgcttatttgtgccgggaaagataaccattactctttgtccaatttcaaatttgttggcagttacttttgcttgtttatcgtagttatttttcatcttctgccgttctttttctgagtgttctctcgccttaacgaccaaatgggcgatgttttctcggaacaattgtatgtattcgtccacatcaactgtgtactgtggatttacagggaaactgacatcggacgggaagttggccggttttccaaacatcaaatggtgtggcgaaatctttgtcatttctgatggggtcgtattatatgaaaatacaacgaacggaaggcgatcatcccacgtccaatttgaagctgttgagcgttttaacatgctcaaaatcgtctggttgaccctttcggtcactccgttcgcctgaggatcatagcctgacgtaaggctcttctccattttcaaaactttggcaatttcgtttagagtttcgttaagaaactcttttcctctgtcgctgtgtaattttttcggcactcccaaaattaagataaagttcttaacgaactctttggcgatggtgtcagcacttttatttggaatggcggttgccaccaaatattttgagaagtggtctacagcaaccaaaatatatttgttgcacgagtgcgcgggaccaatcgataaaatgtcgaggcagaccaattcgagcggttctgccgtagctacaattttcagaggaggctcatttgacctcgggtttcttgtatgcgcacaaattcggcattgaaatgcagatttaacacagtcgaaatacatattcggccaaaaatacttctctgccaactgaagaaagattttctttccgctcatatgtccagaacaaacacccgaatgtcgttctcttatcaacttttgtcgaaaagaagacgggacgaaaaggcgaagttcagcgtcttttccacatttataaagaagttcatttataattgtgaaattgtgaagtgaagatgccagtttttgccgacttttcggttctattgggagtacttttgttgtcaggaaatcatatagaaatccgagctcgctctctttcgttttcttcacccattcctggtgcgataagatttcttgaggtctttgaccattttcagatcggcgaacctgtccgatgatgactttttcggcttcacttggcgaatccaaacattttaaagcgagagagcgtgagagtacatctgcgatcacatttttctttccggcatggtattcaacttccaaaatgaatttcgcattcatttccatcagccatttgtccacacggctgtttcccgtttcctttttacttttgaacattggtatcaatgctcgatggtccgtaaaaatttttgtgggcatcatggtgataaattggctgaatttcttggtaccgaatcgcacagccaaagcctccaattctgttgggcagtatctgctttcatagtttttacattgtcgtgatgcaaagtaaataggccgaatgttgcctttttcgtcgggttgacaaagtattgcggcaataccaattttacttgcgtcggttaagagaataaattttctcgttgtgtcatttttcgctgcttcgaagtttggaaaatgaagcataacatcactgacgattttgctttttaacgtattaatcgctttcttttctaagtcgccgatcttgaaatttatgtctttttttaaaagtgaataaagtggagcagcaattccgccaaacccgtagatgaatttgcggtaatatgcgagaaaaccgagaagagattgaagttgttttttggtggacggaatgggcagatccaggacaggttttacttttgccatgtccattttcaatccttcacgggagagaatatggcccagaaacggaagttcgtttgaagcaaaatggcatttgcttactttcaatttcagtccggcattttctatccgtttaaaaacttctttcagatgttcgatgtgtttgtcccatgattcagatgcgattaagacgtcgtctatgtagataaagacgaatttgttaagacattccgcaaaaagtcgggtcataaaccgctgaaatgttgccactgcgttgcaaaggccgaaagggagaaccaaaaattcgtgaagaccaaactctgtcgaaaaagccgtcttctcaatcgaattacgatccattttaatctgccaatatcccgaaatgaagtccagagtcgaaaaaaccttctttccgcccaaggctaaaagtgtgttgtcgatgttgggtagcggaaatgcatctttcactgttacagagttaagttttctgtaatcgacacaaaatctcagcgttccgtcttttttcggcacgatcacaatcggggaagcccatggcgaatttgatgagcgaattattccgcggcctaagtagtcttgaatcattgccgataccttttctcggtaggcatatgggactgggcgaatttgcgatttaattggaagcgcatttcccgtttcgatcttgtgacggattaagtcagtttggcttaattcctgttcagaagtagcgaaaatttcggtgtgttggcttataagttccaacagttcggtcttatgatgccccaaaatttctccgatgtgaagatcagcgcgtccgagtttcccactttcgtttttgccgtaagccattgttgatgaaatttcagctgacaaaattgaattttcggtgtcaaaaatctcgtccaccttttcaatcatgccgatataagttttttcattgacgcgttgcgaaagggtcgaataatttgtgatttgtgcaatcactctgccatcttcaacttttccaactgttggctcaactttaacaccgctttcgatgtttgaaggtaagatgatcacatctttaccattccattctttgtctactccaatttcaattaatttggtcgttcgaggttcgatttttgtagaaaaaataattcgagctgcattcccatcattttgctgcccttcctcaaattcaatcatttctttgttcaccgagtcgtatagaagaaagcccaatttcgacattgagttcgtaccaaacagcaaattgtagccaaattgcgccgttgttatatggaaacaaattggcgttttctcgcgtccttttcttgaaattggtattgtaaccattccaaaacatttcaattgttgtccgtttacgtcagcaattcgtgccttcgtacgagaaaaaccggattttctcaggtccaggccgtgctcctttatcaatttgtaaagaaattctgctccaatcaatgaaatttgagcccctccatccaacattgcatccgttctaacattgttcgtctccactctgatcaccaaaatttttcctacatggtccttttctttggactcttcactctgatttttctcatgcaactcattctccaaaaaattcgaaacctccgatgtcagttgcacaccacagcaaaatgcatcaggtggttggtcctcctgcataacgatgcagttttgtttgagaaaattctgtgatttgggttgaaaatttctttggttgttttttggcgactcttcgttgttacgaatcgctaaagaattcgaacccgtcgcaaattgattgcgaattcgctcattttcgttgctgttgactcgctgccctttgatctgctgattacaatcccgagaaagatgacccggctcattgcaattgtagcaaacaatccttcctcgaggttgttgtgagtatccttggaactcagaactttgcggtcttgagaaattattcgaaaaataaaagcctcggttccgattatccgagtatttgttttcattggatgacactctggtcgcccgctgaatcgattcggcacgagctgctagtgccacgaattcatcgaaggacattcccgatttccgcgacatttccaaagttagagatagctcaggatttgctagagctctgatgaaatgtttaatggcataatcgtcgcatagattttgtgtcaatcccggataggcacgggagacgaggctttggattctatccgccaatgcgtccaaattttcattcgaacgacgctttacgccgctcatcagctcatcaaatgctcccatctcacggcaatccgtctcttccaactgattctgcattgcacgtcgaattgaatcgaagcgatgtggtccagagcttattgctgcattaaaagcacgttctgcacggcctgaaactttcgtttctaatgccttaacccttttatgctcgggccattcttccgttgcgtttgaaaattttttgaaaaaattttttactttatccgctccttcatttccttttagctctggcagacggtccaaagtcaaaacatattccaaatttgcgatttgaatttgttcagttctttgctgaccaaaattttgctgttctggatgtccgaagttgaaattgtcgccataattttcagggtgaaaatcatttcgtaccgcaacgggacgaaaaatttgttgattccctacaaatccttgattttgtcgcggaatttgttgagggttaacctcgccgatttgcgggttgtttgggtatgaaacatgctgaatttgtgcgcgccaaacgtgttgagcaccagcgataggatgaaacgcgttaaaatcgcggtcgttgttcacataatgggtcaaatttgcttggcggtgtctaaccagagccgcttgtcgttcgtcttcatcaatgaaacgctgttcggctctttgccgttgattgccgtttggatttgcggcgatattttgttgaaaactattcagaaacatcgcttggggacgaactaagcccgggtttaagggttcagagtttggtcgcctttgtggttgcaccgcatggggcgtcgaagtcacaacaggccgtaccccaactaactcatattgcctcggaccattttcaaaattttccgaaaattgcaacggcggttctctgaccaccggttgaaaaacgtccctctcaaaattttctccccgattttcattttgaaacaagtcgttaccatgctggttcagcagtgcgtcgaattgttgctcatcttgcggtccgttctgaactccagcagcattttctccaattccagacatgagcaggcgtcggcgaatttcagttgggtccaaaagtgatgaagcaactgaagagacagaattatggcgagcctcgttttccaaacgtcggtctgctaggtgctgtggttctacaatttgttgccccccctgctggtttgcgttgttatttagacgaatgccgaggttgagtgctctttgacgagtaagcggaggcgaccgaagattaggcattacttcgcccttttccacaaaatttcacttgtcgaattcggtgagaagaaaactgatgaatttcacaaaatttccgttctgtagaagatgaaatgtcgatgggaattactttaccctttttgtcgaatcagctttgtagacggaattactttaccgagctgacaaatcgttggtgaatttcttttcactttttacttttttgtcgccgcagtagttgaagactttgtagaatttcctacttctacaattccccgtataaaacccgcgtcgaccacacctttttgcaggagcgccacgtacaaataatttaattttactcagcagcacgtcgaacagttcagcacttacacacaattgaagcacacaaaataaagccttattattttatgtcaggcaattccaaattaaagtctgaggacaaaaatgaaaacaaaaacgaaatcacaaacattaaaaaaaatgccaaaaatatcataaaatcaaaaataaaatgaggtcattattaattacgacaaatatgtagtaggaaaatcactttcttttttgtgtttgcaaacaaaagttgggacttttatgaacgaagcaacaaatacatgtgaggagcaattgacagatcattttccattcataataatcgattaaaatttctcatttcctaataattctttcactttttcttccgctgtccgctgggcccggcattcattttcagcagaggaccttttgcgttcatttgccccgcctttggtggagacaatgggctaagcgaaagcgcaatttgtgttagttactcaaacaaaagaaaatgttgttgccacgcacccaaattcatgcagcgtaaagtcgacattgttcaaattgtccgtctttttgttctcccattgaattgttttcccaatttggcagcgcttcaacagccaatcaaaatcagtgtattcctcaacattttcttctttctccattgtcagcttttcgttggtccgtccattcaccaattcaaatgactcaattggcgtttcttcatcaattagtacaagtcgaattatataattggccgaagaagtggtggcatggagaaatgcctaaacaatggaaatgaaaagcaaacgggcaattaatccaaacattatgaaaatgtagccaccgcacctctttgaaagcgttgacccatttaatggttgctgacataaaatcacaatggaattgctttggctgcccatttgttgtcggagtgttcaaccatttggccaatgcttggcccgcagttgcatttggcccatcatcactaattattgcatcgggcaacaaatattcgtaatcgattgaatccaattgatcgagatcggtgagaattgttggcgaaatgcgacgacgcatattgtccaggtgatcagcttcggaaaaggccaaatggcgaatgtttggcacaacaatgggccagattttacgagcaaaaacatcccaaattggctgcgcatccttggcattcttatacaagaaatgaacatccaaacgcaaattgatgcctttgtcaaaaatttgcttgttgtaacgaagaaacgtgatgacggagtggtcaatatatctgaaaaggaacagttttatcagttacataagaattaggtatttatatgttatctgcgtccagcagattttcaaaaaagtttatgtttttggatttaactttttttatgttgcc

SEQ ID NO: 585 - DNA, 1146 bp, Heterodera glycines
  misc_feature (100)..(103): n is a, c, g, or t
  misc_feature (105)..(106): n is a, c, g, or t
  misc_feature (109)..(113): n is a, c, g, or t
  misc_feature (115)..(116): n is a, c, g, or t
  misc_feature (118)..(121): n is a, c, g, or t
  misc_feature (123)..(123): n is a, c, g, or t
  misc_feature (204)..(204): n is a, c, g, or t
  misc_feature (206)..(207): n is a, c, g, or t
  misc_feature (242)..(246): n is a, c, g, or t
  misc_feature (336)..(341): n is a, c, g, or t
  misc_feature (343)..(345): n is a, c, g, or t
tgtccatccaaatgtcgttgcaaatccaacttaaatgcgggaacattaattgaattagaaatttgaaagtttaaaaaaagattttcttaccgtcgactgnnnngnngannnnngnngnnnnangcgtttcagccgacattgttcaaccaaattatcaaaaaacagttctgttgatttgtatcagttgcagaattgcgccgatgncnnagtggagaatgttttttcttttttttaacgggcgnnnnngggcggccataaccgggtgtatatgaatccgttttgataatttataaaaaacaaaattcaaattaaataattgtcaacaacttatgccannnnnncnnnagcccactatcaaattatcaaatttaaaattgagatttccccaaaacctcaaaatttctcaaaaaaccacaaaaagcctcattttctataataaagacaatttttgaaaaaaaaaattaacaaaaaaatatatttttgttgagttgtgtttcatcctataaaaacgctgcgccaggaatttacataataaaaagtgaatgcaaaaaaaagaaaatcgacaaaaaaagacaccaaaaaagacggaacgggtcaactgcgtcccgccaactgcgtcccgggccaactgcgtcccaaaataattttaatttttttttgaaattccattgaaaaattttttaaataaaaatcgaaaataataataattagggctatgtatgtttttcgtatttttctactcttttgctatgaaaagagctgaaaatagcatttctatgttttgatttggagaaggtttagtgcattgcatgtacttacagccctagtaataacactatcctcataagcagattgaaccgtgaataagtgtggaacaattataaacatgtctacataactaactagactacctaatatatgccatatatttagaaaacaaaatctcgtttttaagtgcatgaaaaatttgaagagttcctggttaatggacataaaacaaaaatgttttccaggtcctttcgtccttttcctttttgctgaagacaattttacaccatagaaccgaaaggacttcgatgggtttggtaatccatccggctgtcacaggagatttttgaaaattttggagaatttaaaaaatcctag

SEQ ID NO: 586 - DNA, 5910 bp, Heterodera glycines
  misc_feature (5831)..(5832): n is a, c, g, or t
tttaatcccattcgtttttccatttgtaaattaattttcgatttgttcctaaaattcttccaattttattctcaatttttacacggttttttatttggtatttttctttacttttcattctttcattaattgcgtcaaattttcggataatttcccttttctgctgatcattttttaacgtccatttctttttttgatcatttaaatcggcgccattttctcctccattttgtaaattatttgctgaattgtccctttgttgttcttcttcttctgctttttcttcccatcctttgccaaatatttcgtcaaaattttctcggattttttttacagattcaatgtttctttgtgaataaattaatgttaatataataagaaacaaatcaattttcattataaaggacaaatatttatatgaatcttaatcataaataaataaatgtaaaataatttgttttgtcctctcatttcaacatttggttggacggacggacactccttactctattgatgcaaatgacttataattaaatttatacatggaaaattagtaaaatctctccaccatttccctcaaaagcaaaaaagtttacaagttttaactgatttatttcatcaaaatttatattttaattgtagaggaaataataaaaaaaataatttttgaaaattttttcccatttaggcttaatagattttggctttgtcctacccttgttggctaaaattactccagtgattgggttaaatttggaatatgagcacgaagtgaattcttacgctattttacaccataattaaaacttaattagtgtacgcgtttcactttttcgactttttgggcaaagcttaaaaagagggccaacatcaggaaataatcagttaatttgatgggtcctcccaataaaagtgagttggatttggctttgattgattgccaattttcccctctccctcatccctcattatcattttgtttagtcgacagtgggcctccccatattttcatcctttctctccccatttgctccacaattattaaaacgtttagtgccacgtttggtctgccatttcatttacgcaaattcttttcccacttcaaaaacgggtacttgtactgttcacagcccataggattttttttttaattttcaaaagccatggaaattgtttccaatgcttttcggagtcgctgatcacgaatccagcatccatttcgaccaatttggaacaccggactagaactcgaacaaaaagtcgaaaatttaaatttttgaattcaacatttttgtttcaaattttgtttgaatactcggaaacgaagttgaaaatgatcattggttcaataaaagatcatttaaactatttttatattaaaaatgtgaaatttgaaaatttaaattttttactcttacaaattagttcgaatttggatccgggtttcgaaattggtcgaaatggatgtcatattcgtgatcagcaaccccgaatactcatggaaacacgttttatctttaaatataaaaaaatttaggtttttcggtacgtgaatataaattaagtcataggaaatttgaagaaaaaaggcatatgcctcaaaaccgggtccctaatattgagatgaatagagactggaaatttaaaaaaaaattgaaaaagtttaaaaattaaagacataaaaaagtttggtcttgtcaacttaaaaattttcaggataattaattgcattaattgatttctgaaaacctgcggaaatgacaaaggtagcttaatttaaatgaaaaattaatcaaaggttaaggttgctgttgtttttttgtaaaataattggatgaagttatttacatgaatgaataaatgaagttttcctctttattcaatatcaataaaacaattggaaatttttacaattttttatggtccttggaatcaaattttttacaaatattcttaattttaaaaatgatcaaacgctttttttgtaaagtttgaatttgttaatagtttttttataataatttttttaaatttaaattttttgaaatctccttatcccccatgtgagcttagattagcaggtcccgcaaaaacatttatcaatttccaaaggaaatttgatttttccgtctttagctcagaatctctactctttactaatttttaatgattttccattcaacaaaaacttatataaaattccatgaattttagtggttaataggcaaacaatggaaaaagtcaatcagttaaaagcaaaaatcatttaaaatgggaaataaatggtttttggtcaacttttaatgccatggaaatgtaaatttgtccgacattcttttggcaacaaatgagggttatatgccataaaaatttgctcctctttcttcttctcttttcattcgttcctctcatattctgccatcttcggcttccgttttgtttgctcaatttggcctaccgtactctcttagtaatgagtcatcagtgtcgccattactgtcttctgtcccttctccttcccaattgatcggactttctgtcgtagtggtcacaaatgtctcttccgcaccaacaaatgtgtccgaaacagggtcatagtgttcaacttgtttacggtcatcatttccattgttccccgtcggtgttgccggagttgttgctgttgttgtgatatccgcgctcctatccctattccagtctaaaaaatttattaatttattgttctgtcattttaaaaaatgaaaatttaaaaaaatgacgaattagttgatactgtaattgtaggctttacgcagaacacgctataaatcttctgattgatccacctaatatttaaatcacagtatctttccttaaatacagtatcactgacaaataatccatgataaaatatcccattgccattttattcatatttcatcgacatttgctattcatttgatttttcgtgcttttcccaacctgccgacggcgccgctgtgttggcacgaccattcattgcgttgaacatttgcagcatcgcaagcaaatgttgtgcccggtaatcatcccctgccgcaggtggtcgctgtgctgctccgccaaatggcatgccaacaccaatccacgtttgaaccacgggcaaaattaaattgaaattcagtgaaaaatgtatacttggcggtggcggttggcccggaatttgaacacgccaaatgaaaaacatggtaaaaaaagcggtaaacactgtgacccaatttgcatcgcttcgagaggcatcgatgccaactacggcgattaaagacatttgcacaatcagcaaaatcatcataattatgttggaatgaatatgaaatactggaggtgcgcgtctatgacgacggtcttgtgaacggtcggcgccggtgccattgagttggggctgacaaataaaggtttaatggtattttcactattcttaattatgtgcaatttagttccttaattgtatgtataaataatattatgaaaaaataaatcaatttatatgagtatcatttgggttattcgggcgtaaattttatgataaattattaggtacatttataaatttcaaatcaaagtaattttcatgaaattaccacccaaaatcttttaatttacctgcagataattgtatttttcttggccggcattagcaattcctttcaaaattgtatttgtccaaagctccatgatgatttgtgtcaattcacttggcattaaggttactgtatcgccatcgtccgaagctaccgtatgctttttcaacgttttcgtcagtgcatctttggttgttccaggctcaatttcttggctaattcggctcaatgctttcatcgcttgcgcatatagaagcagagatgcatcattcgggtactgttttgctcgtggtaaaatctcagccattgtaccgtgtactctaccggtaaaaattatttccgtcgtttctgtttttttcattgcttccacaatttttggcaaatctttttcaatgaaatccgttaaatgttccgttagtttttcaattgtgtccaaattttgacctgtctttttgtcacaaaattttgccaaataaccattggtcgggtaacttgaggatgaatttttgctagcaattttggctaattggcattccgttttcaacaactcaagtaccaattccaaagatttgcttaaacgatcaattgaaataagaagagaagttagcgatacgttaaaattcgggtgccccgcttttaaggatgcaaatatgcactatttcttaaagctataaatcaattaaaaaaattgaatatcaaaatttccgatttacttaatttttttttcaattctttgtattaatttttggcatggttttagtgccaaatttatggtgccaactttttcggcatttatataaaaatcgaaatttactttgcattgtcaatcttttcgccattcgtcagttcctctgtatttgtatgataaataaaatgattatttaattaatgggcatttaattattaattttctattttcaccgttaatttgttgcgacaatgcttcacttatttgctccagagcaacaaattcattggcaatttgatgatggttgttgcgtttgtttgcggttccgcagacaatgccaaacaaaagtgataatttaccaaaaatacaataaaaaagtagcaacttttggttatccattttctaaaatttttctcacctttacatactcattaatttaattagtttaagctattagagatgcgcgtaaattcacgataacggtcacttaatgtgtcgctggcaccgctttttggcattacaaattttgctaaattaacgaccaaattttccaagtggcgccaaggcaccgcctgattctctcttattaattttttgaagggcataaatatttgaaaagttttcttgggaccaaaagaagagagataacttttagattctgttcctaaacgcttgaaaattaattaactttatctggatttgtttttgaattattgcaaaatatacgctcaaatatttcgtgattaaataaatatgtaaaattaaaaactcaaatattacatgtaaatgaaatgttaaatgaataaaatctgaattttggggtttaaatctggaatttagtgttttgtggcctgaatttgaaaaaaaaacttggtcaccctgagattttcctaaatatattttcatgtaaggataactgaaaacatgtattttggggttttcagggtcgctgacgatgaatatgacctaaatttttaatttatatttcgccgggacactaattctccagtattagcccaaaattcatacataattggaaaggatcaaggcaatttcaaagtttattgctcgatacaccatcatatgtacacatatgtatatacaataactggtagatgatgacaatacacataatatgtacaacagcgaacaaaagtagggcaaacgaacacagagagagagagagaccattaatttatgaaatgatcggacgacagacacatgcatacaatacattacatatacataactatataataatatcatcactcagaggcatcacgtcacatcaaaggtaccattcgcccgtttgttgttgctgctgctgcgcttcttgcccttgcggcggtgtcgctggcggttgcggcgtaccctgctgctgttctcccggcggttgcatcccctgtccgtccggcggttgtggcggcgtcccctgctgctgttctcccggcggctgcgctaccggcggtggtgttgatgacgacctcgctcgcggtgtcgatgctgatgccctctccacgcgccgtcgcacttccttcctgtanntgtggcggtcgttgcggaacaaatctggaaaattggacacaaaaattaatgatgatggtcaatcaaaaatgtgccgac

SEQ ID NO: 587 - DNA, 1624 bp, Heterodera glycines
cgggagcagctcgtttcccccccccccgcatcgtttccccccgagaaattaaaaaaaaattttttgctaacttagaaatttttcgagaaaaacatcttagaaagttttttcataagaaaattctaacaataagaaaaaaatttttcgagaaattttcaccgattttttggaaaatcttagtaattcatcataaaaattttcgaaaaattttttttcttagaattttcttattaaaaaacgttttaagaattttttcttgaaaaatttctaagttagtaaattttttaaaaaaatttctcggggggggggggggggaacggcggagggggaaacgagctggctcccattacttttaatgtaaaacaaaatgcagattttaccaccaaaaaatggaaataagtatttaatttttataaataaattcttaaaaaaattaaacattttttcttttcttttgtgtttttatgctttttaaaaatctatttacgcatattttaatctgcattctgcttaataaaaaaaaatgtaaattaattagcaatcaataaaatgcaaaaaaataatattgggacattaattaccttttttgtcgtaactatcaatgcccaagtagatttctggtgctcggtaaattggtgttcccgcttcggttgtcagattttctggcacaatatctctggcaataccgtagtccaaaattttcacattaccacgctcattcattacaacattagtcggttttaaatcctaaattttagattaaaaaaataaattgatataaaaataagttaaccttttatagttaataatttaattgttaagtaaattacccgatgcacaatgccagaattgtgtaaaaaattgacaccgcacaaaatttgaatgatacagtaggacaattcttggtgcgtccacagcgtgccatttttcaacttttccacaattctttcgcgcaaatttttgccaaaatattccgtcaccaagtgtaaatcatcaaattttttcaacggctttaatttgggtggcaaacggacatcgtaaagagcaattaactgaaattaaattaaaaaaacaatttaataaacacaatcctttgagagaaattattttaataaaatgcataatttattttcaaatatgataatttattaataaaaaaactgaaaattcttaaggagtaataatgcaataattattttctattttaatcagaagaatatttatattactttaattttcatttaaaatttaaattatttttgataattataaatttgtttatttattacaatattttagacattcaatactttcataaattacattcggatgattcagtgtggagagcagtgccacttcgcgcaatgtgtatttggctgtgccgggtgaatgaaacggcgcacgaagcaattttattgtcacattccttgttgtgccatcctcctccgtggcaattcttataattcatttaaaattatttttttttgaattaatttaaatcaattatttgaattttacgatttccacacgctgccctgttcacttctggccaacattgttttctctccatatgcggcattccgtaggcttttcatatcgccattcactaaaaaatttatatttt

SEQ ID NO: 588 - DNA, 1031 bp, Heterodera glycines
  misc_feature (38)..(38): n is a, c, g, or t
gtcaccaagtgtaaatcatcaaattttttcaacggctntaatttgggtggcaaacggacatcgtaaagagcaattaactgaaattaaattaaaaaaacaatttaataaacacaatcctttgagagaaattattttaataaaatgcataatttattttcaaatatgataatttattaataaaaaaactgaaaattcttaaggagtaataatgcaataattattttctattttaatcagaagaatatttatattactttaattttcatataaaatttaaattatttttgataattataaatttgtttatttattacaatattttagacattcaatactttcagcaattattaaaaataaattacattcggatgattcagtgtggagagcagtgccacttcgcgcaatgtgtatttggctgtgccgggtgaatgaaacggtgcacgaagcaattttattgtcacattccttgttgtgccatcctcctccgtggcaattcttataattcatttaaaattatttttttttgaattaatttaaatcaattatttgaattttacgatttccacacgctgccctgttcacttctggccaacattgttttctctccatatgcggcattccgtaggcttttcatatcgccattcactaaaaaatttatatttttaaaaataattttaaaatttaatttaatgaattatttaattggattttaaatattaaatttatgctaacctcgctttatgtcatccgattgttgttgttgctgttgtcgttcattgtcacaactgtcgtcagatgaatttgttgatggagttgtgtttgaagtggttgacggcgatgaaattttgtaactttttaacaaactcacaacacttttcaccatttttttattaataattgcttaataatttttcttttaaatttttaaataaaaattcaatcaaaaattattattaaaaaatcaaaataataatatttcattaagagaaagttttaaaaaaacattaatttatgacagcttttaatgaaaa

SEQ ID NO: 589 - DNA, 7544 bp, Heterodera glycines
cccccccccccccccccgcaaaccaatcaatttttaacacaatttttccaacgtccgattcatcacaaatacgggccagacgagcgctgagcaacaacaaacaatgcacatgatcaatccctcaataatttgatcaaaaagaaacgccaaattggcatggacaaaatgattacaatttgtttaaaaaaaaattattttttaaatttattataaatctttttgtgtttgggaagtatataatattttagcataaatggcaaaccttgaaaagagactcaagaaaagccactttttggatttaaaaaacaaaagaaacaaattttagaaaataaccatttaaatttaaaaagaattcaaaaatttaatgcattttttgctacatatgttaagttcaattcttaaatattatttttttaatttaattttaatttttaatattatatggacaattttgatgtttcttggaataatattttaatttttttacaaacatattataattattcttttgccagcgtttttccccaaacattttttttgattttttccgagaattttggttcgtaaatttttatgggactcagttgaaccgcgtccagttgttcaacattattagtaataataataacatcatcaacgatagaatttgttttcgaaatcaccagcaaaatccccactaccatcagcagcagcaattttgcgcaattttccattagtgatggtattagtgatttggacgggaattatttcaccaaccattcattcattcattgatcgcaagtggacgacaatccaaaaaaccatcgccgccctccacactctcgacacccataaatcatccaatcattgcggaaaattctttttttgttctcgagaatttggtgaataagcaagcagcaaccaattttggcggactgacaaataaaatgtgtacgacagaaaagaaacgattgtttgtcgaattgttgggggggggcaaaagtgaaaatgtttcataagagaagagccatttgcttattataccattgcatataaagttaaaactttttccaatgtgctttaacttttaacaaatattatttttatgatttttaaaatagtaaaaacttttattttttttttgcagaaaatgcgtggcaaacgctcgacaagccgaaactatgcttcaaacactggtaattgtttttcagcttaattattatcattttaataattatgttgtaaaatatgaaatgttttcactaatttttttattcataaattattggattattatgattcttattatttaaaaatatttgatgtagacaaggaattagcatttggtaagaaccggttttaattacgtatagttaacttacaaatattgttaattgttttttgactgtgtccaattgttttgacaaatcttcgttaattagttaaaagttcatttttaggtgtgcctaacacttaaattaattctatcaaaattccattcgtttttaggcaatatttcttttttttttaaaaacctagaaatattttttccattcattgaaactcaaaaatataatgtttataaaatatttataatttaatattttatcaattactttaagaattatctgacgacgcatcagccggtgaaatggaacgcgagaatcggcgagtgcgatcaaacagactcagccagcaaagataccgcgaggcattcctttgaaaattcataattcaaacaattaaaccccttataaatacatatttaaaagggataattatgcatttatttaaaaactaacaattctttgatattataataataagtctccactctttttagtttttttaatttttaaatcaattatagtgaatttttattaaatgccccaaaaatcaaaaatttcgcatttttttcttacattttaaattttttacatatttgagaatttatcaaaatttctcgtgaaaaaataaattttttttgaaaagtatccctaaaaatacgtttttttcaaaaaagagataccaaaaattattttaaaatactaaaatgtgattatagcctatttggtatttttatgattttgcaccctttatgaagaatttttttccaaaaaataactatattaaaacatgaaaatccttttaaatgcatattaaaagagatgaaatgataaaaatttatttaaaataatattttttgataatttaaatttccacgcctttttaatttttttttaaagccaattattactaatattcctttttagaagggtaatgaagcacgcaatttgttgcctcagctgtacagtcgaattgctgagttggaacgggaaaacaatttgttgaaggatttgttgtggagagaacgcaaccccaacagtttcgcggtggcacaacagcagaaaatggtggaaaagaaattacgaaaatgaaaatgaaataatcgaattctcaaaatgcaattgtaatttttaacaattttttttactcattttttatttaattattcgtattttctcgattatttgaattcttccaaaaataggaatggaatcgtgcaaatggacaaacaatggacatggaaaatgcattcccacaacgcgcgatgagcgaagcttcggtcaattaatgctaattgataaaataattaattggcaaaaaaaacatttacacataataaaaccggaaattcttttctatttttagattccttcaatgtttaattgccaaacagttcggtcaaataatttaattttcaatggatggcctttactgaatcggaataaaaaatcaaacagaaaactgaactgaatttaaaaacgattaaaggcaatgccgccgggcaatgaaatgttggcacccgattggcaaatggttaatgtgaatggtgccaatttttatgggaacgatacatcatcagcagttaataatgccgcacttgggggagcagtgggaagtggccaacaacagcagcaaaacccacaacattttgtggccacaaatggcattgccattgcacggactcggcccatcaaacggccgagtgttcgccgttcggtgtcggcgctgaacatcccaatgaaagtcgtggcgagtgccaacgccacgccaaacgcagcagcggggggtgccaacaacaacagcaacaattgtggccaatttggaacgccatctccggtacggcacttgcgagcggaggaaaatgagcaaatgtccaaaaacgggaattcttaaatgccaatattcttaactatgaatcactatttttgaactttccgccactaaaataggtaattacgttcattattttggcattttgtcatttagtattttttagaaattccttaataaaaacgcaagaatcaacaatatcccttagaattgaattccgtcaaaaattcaagaattgttccctaaatatttaaaaatttgaatttggaaaatgagtttgaacatgtaaaagagcatcttatcgagaagaaaaacgcagggtttgggagagaggcaagaaaagtactggtttccgtttctgctggtagcaaggggaatttttgttgctaaaacttgattttctaagactttttaattgagttcagcgatttttccgtgaatctttgttttttacgtcggttttcgaacttttagcgcaaattaaaatcaatgaaataaatattaaattttaattgccccccgagtttagcaaccatcccaacaataccttacggctggcactgccaattttggacggcccggtccaagtccaccacaacaacagcaccaacaactttcgtatggccaagtgcaacaacagcgagacggcggccaatggttgagcagcgcaacaaataatggcggcacatcgcccgaatctccgctgtcaaatcatcaagcccaacaaacgcaacaacagtcaccagcaacaggtggttatcggagtcgatcggcgtcgatgaacgtgttgaccacgccgacaatggaaagtcagcagcaattgatgttcaacacgtcaatgggttccagcactaataataacaacaacaacatctttgggcacagcatgcaaagactggtgattaacttatgcccaagggttttaatacgttttttcctgacaaatgagttcccagatacatgaaaagcgtgaaaatttgttttagcgactgatgttaagctattactttttattattttaacattataaagaattctttaaaaataatttttaaaaatattacatataaggagaaagataaaataaaattttattctaaaccccaacccattgatcagcagacttcgccggatgagagtccgttggatcatgtaaatgtgcatcaacagtatgcagtttcaacatatgcaaataatgagcaacaacagcaacaattgcttttatctccgtcaccaccaaaacgcagcgcatccttcacagatatgtgcgcttcctatcagcagatgaacattcagggtgggataaatttaaattaaatttaaaaatatatttttttatgtaatatatagcatttatatgggttctgattccagaattttttggataattttttgatgtttttaaaaagatttttaccaaaaagataaaaaatcaatttatcataataatttatttatgttaaagtaattaaaaagaaatctcgcttttatggatattaaaaatttaaaagggttcattatttaaaaaatataatctaattattttaattcaattaagaaaatatgcaaacaaatgtgcaagtgactgaaatgcaacagcaatatcagcagcaacaacaatttcaaattcaacagcagcagcagcagcaacaacaccttgaagggttttttgcgcctccttttgcatatggtaattttttaaaaatttattttagattttattaaatcaatttatataaataattggttaattttatgcattgaacttgatccggatggaccacagccaaaaatatctttggcaaatcagcagcagtcggcagcacattttgccgcatttaaaggcataaattaatttagaattttttaattttttaaaattttaaggaaatgaacttactccaataaatgaagacacgccacgcttatatttggaacattagttggcctggcatattgaaaaaaggacattttgtcaaattaattttaatgagaaaatgtttcaaacagtacaattaacattaatttaaatattaataaatataattaattttaattacaaataatattgtatctctctcttctgtctacaattaatgatgattatgatcattcttcgttggcattttgctcatctattttttgttaaggtcattataacaaataaaaaagcgcattatcctttttatggcttttgttgttggtcaaaatgatttctaattattaaaattaataaatattctgaaatgctttgtcagtcgttttagaaattttagcaaaaattggaaattaaaatataattttttttctttcgaattgtgaatttggaaaattcgttcaaaaagacaccaaaactccctaattttttgctattacattttatattttacagacttttttatttaatattttcatatgatagaaatatgtatttttagttttaattaatttttacagttgggcaaagggtttgagaaaaacgttttaaattgtaacacaatgggacataaatgaggggaaagaaaaaaagagattttttgagtaatttaatattttaaaaatttttaatctcttcaggttcaagagtttcttcctgttccattttttccatcaaatttttacatgaaaaaatgaagacaaacaaaaagaacagtaaaatttatttgttaacaaatacgcatgataaataatataaaaaactgaaaataaatgtgaaaaataaagtgaaaaatggataatgaattaattaattaaatgagtaatcgcccttccgttggttcttcagctttcttcaaagagtggccaaattgaatttgaaacttggcccaaagttcgcctcaattttgtcgccagtccacagagaaacgctatttcattctgattgattgtcgttgaagaattttccatttaattcactgatttgtgaggataacacttggtcgcttaaatcaaaaatggacaattgatagggcggtgagttttaagaaaattcgacgagcagcagggagattaatatttttcattgcatatgaaaacatttttacgcgtccttgggtttcacgaatttttcccgttgtgtccttggaaatcagtatacctatcgttcattggaaagcgaatttttccaatggcagttcgaactaaattaaattcttgaattactcgaaagaaagctgaatttcgtcttttctcaatgccagagtatttactttttttttatatctataaaattgatgcccgaatgttggtctgtaccgtttttcggtggccccgtttcggcgccagcccaagttttcggattataaattttttttgttgttaaccattcgaaagcttttcatgctttcgctctctctagccattctacgcgaatagacaattaattacccaacaagttataacatgtaaattgcaaaaaaaatcgtttataacttttttgcttgacaagaactttcgaataataccagaattgttttggttgaaaataaaaaaaagttaaagctaaaaaactatggctggcaccgaaacctgggcgccgaaaaaccctttccctcactgggggtggcaaaacgaaaattaaccaaaatgccaaacaatccctccctattaattcggaaaacaagaatggcccagaattaaatgctaaaatgcgagaattgagtagaaaattattgtagaagaaaaaggtaaactaaactataacaatatttttttgcgaaaacgacctaaaaagccaattaaccatttagctgatagggccgttctaggtaaatattgatcatagtccccaaactcaaaaatgcttaaaaacggttagaatcgatgtaatagtggggcgagacggagggcggaggaaaaagtctgacgagcgccacaggcggttggctgccttcggggccctttttggaacaaaagttttttgaaaatggaaccgatggatttgcggagaccgaaatagtcagacaaattcgaaatctgttggaaaattttattacggaaccgcagcagaatggcggaaaggaggacaatgcaattgcactgatatttgttagaattggcttcagcctcaaaaattgcccaatattagcaggcgaataacgcaattgaaaaggtgaaaattataaggtaagagcaatgaaaacgaaagaaagagcaaatgagcatctttttgttgttactttttaagttactgttgagaaagaaaattttcaacaatttcattttccatattttatgataaaataaatttctttcaagggaatgattaatttaaaaatggaaaaatattcataaatttattttattaaaaatggtagataaattttggggttgggcccgggcagaagacacctttgtcggtggaaaatttttctaaagtcagaaaaaaa

SEQ ID NO: 590 - DNA, 2715 bp, Heterodera glycines
atcaataaaatataagatttatgacaaaatttggttatttttttaataaaaatctgttaacaaatcgattaaaaatcacaaaaaattttcccggcggcgcctatcggcaccgccggaccccctgtccatcctccaaaattttttgaaaaaatgcgacgcaaaaaaagcgtttttaaagcaaaaaagtcgtcgcttgacttttaatcggaagggacagaaaaattttggcataaaatgaccgattggaagaggaagaaaaagggaacgcaacagaggaggacccaccaaagaggagaatattttgctaaatgatgaccatttgccgggcgttttaccctaccctccaccaacaaatcaatcaaataaataatcaatttgacggataatttttatccaattcatttgtaaaagttaaatccacatttttcaaaatttgaaaattgactaacgtaatgataaaagtcaaattcctaaatgattaaaatggaaaaacgtaactcgtgcgcctgcatgaattatttcaggatttttatgagcattttgaaatagtttttcaagtttggtaaaagactttgacattatgccagggcacccatcgtccatgctccgtttccaaggacggtgtgccgatttgcaaggacaagtgggaaaaattcatgaaatccaagaacatttaaattttttattttctacaatgaaaaacggttaatatttattcattcaaatggcttgtagttttcatttttccaacatatttttgttttcacgggtcattttcctcatttgcgacgacttttattctgctttaaaacgttttttgtggtgcgctttttccaaaatatttccgggaaacagataaaggggtcggcggtgccaataggcgccgccggggaaaaatttgttaactgattttcaccaaaaaatgcggattttgcgattttgagataatggcgatgaccacattttacttttcacaacacttcttgcgggcgctttttgcgaaaaactttttttggggatgggagtggagaaattattaacacttttccaaaattgatcatttttaagcgtcaaaatttaaaaatagaaagaaaggccctggcggtgccaatatgcgccgccgggaaaaaaattgggaatttttgtgcaatttaggaccagattttgcaccaaatatgttataaattaaaaatttatcaaatttctttgaatcttgttaaaagttttccaagtgctcattttcaaggacgtcattgccattcaaggacgaatgggaggccctgcattaccgtaaatatttcataggaatggctgagatccaaccctttgttatttgagaaattcgttgattaattttcttttacctttggtaaaagacttttttgggtgagtataaatatgtaatataagcaataaaatttcaaaggaataaaaagatacacacagaacaaaaacaacacatcgtcctaatttgaaaatttggtagcaattttatataaaaacggctatttttgaggatttttttccaaaaatcagcatttcatcaaaaaatcagctttgacccctagaaatgagcaaaatgcttacaaaatcagcagagttgggaaccctgtacatacccaagggatgcgaagacattcacaatgagaaatgcacgagtccaaacaaaggagaagcagaagctaattaaattttaaattatattttagaataaaaaacggtaaataaataaaataaataggggagcaaaatagaatttagtgctaatttggattttggtgatgaatggatttggcatctttcatttgtgcttttatatgccatgatttccctgcccatctctgctgttcccattttgtttctcttctctcagattaattgccattgattaatctgtccattgattttccttgggttaatttgagtggcttaatgccctcctctgccagtgaatgggaacggacggcattttctttgctcgcacaacggcactttgggaaaagcaacctaatcctcaaccaaaaaatgaaaagcaaaatgaattgatttgatttatgctcttctgaggccgaaagtgatcagaatcagctaaagcttataaaatcttttgagaaattatttttttatgttttaaaattggtaattccaggcaaaatatctgctaataaatctcaaaatttttctcaattttatttaccttttttcttaatcactttttcacatttaatcggaaattttagtcagttagacaaaacgaaaacaatttaagtttaaccattttatttttccattaagaaatttctttaataaaaaaattcaaaattatttattctaacaattcaattaggtaatccagaaattgacaaaatgtgaaatatgcgtcaaaatccaaaaatactctaatgacctccctaattggttccgcgattcggtgataattaatcttccatcatatactatttgctttggcaccaaaagtgccatatttgtttgtcttttgcttttctccttttggccatccctattcgtttttacatatcagctgaccgaaaaatgagttcaaaaaagctcgataaatttctcattcgggaatttcagcagtatttgtttcggaatcatttgatggacaaattgcacattttgacaacggcattaatgccgtcgtccacctgctgctgaatatctctggtgaatggcgctggtcctccccccccc

SEQ ID NO: 591 - DNA, 2296 bp, Heterodera glycines
  misc_feature (2241)..(2241): n is a, c, g, or t
  misc_feature (2259)..(2260): n is a, c, g, or t
caactttttcaaaacagggtcctcgaaattccatcaaatttggggagtggggccaacaatgaatattaggaggggcatgccatacatagatagatagcttttgtggaattagagccaaaattaaaaatttttgtccaaaaattagggggaaaaattaattatttttttatttataatgttttaatcataaaataatttattttgagtcggcacgacggtcaatcacatcactttgctcggcggtaaattgctgtggttcagttttatagatccagatgtaagtggtgaaagtgataagaatataattgtttttcatttctttttatgttctattttctaggctgtattttaaatttttaaaaaaagtatattttaaaattttattttcacctattttggcgttttgcacaaatttccttaacaaaaaagcaattcacccataataatggttcgaattttgaaaaatttattttttgtaaaattccttataattttgattcctttttctaacagcaaaaaaataagttaggttaaaatttaaattgaaattatttattttttccatgaaattggtgaatggactaaaaatgataataaaaaaaaacttcgaaaaaatcaaccattttgcagacataaatttgtgactttttagagcatagtttcccgcttttggtcataatttgctttttttagattatactttttactagaaatagaggccctagcaataaacaaaacaacgagaattgaaaaaaacgcattttaaaaaacttttagttttaaaaattaattaaaaaattttagacttaagggcactaaattaaattcaatttttcttaaattttttgcccatgtaatattctgaattgtagaagaacgaatggcggatgaaagtaaaatatactctgggcaccgtaatcgacgaacatcatcccaatatggtgacacaaaattcggctaatcagcgcgccaatcataaagcggctgatgatcatgaaccactggacaaacagattcaactcaaattcaagatcacgatggattcgagaaacggaaagattggcgtagaatttcgactgaacggtcaacacattacaaaagacataaatggcactgtgcttacgtgctgtccagcagaattggtgccgtttgaagacatccaatacattacggtaattgagtacacattactgtaatgcaatacaggatggtaaatttattgcatacatcaagtaatcaaatacatatttgtaatccatcatattacggtaatcgaatacttttctataatccaatacaatatggtaatcaaatgcatactgtaacccagcaccttacggtattcgagctataaacataacaaacgaataccacattgcttttgatgatattgatgaatggagcccttttcccctctttttatttggcgctaaatcctaaccgattttgggtgatttttggggtccataaaaattcgcttttacatcccttttattataattgttttaggcgaaaagttttgacatggaattgtcccctgacacggatgtgcagatatattgtataccaccagagaaatgcattttaaagacttaatttatatggatggatggatatcaatcacactgtatttagataattggcatatgaattttcaaataaaaatttaaaaaatgatccgaaattattctaaattattacgttcaaaagaatatttcatagtataaaattaaataaattttggatttcatagcctattacattattaaataaaaatttattttccaacaatttctttatcatttattttatgtcttcaattaaaatgtcgtgtgcactttttttccgccaccaaaaacattaattttaggaatatattacatccattcacttataaggtagccatataaaaaatatataattagcatagcctgaattatttccactttttaaattaaataaaaattttaatcatgtgacataaaattttgtgttcttcctcatcatgcggctgccattaaatttaaaaaaatctaattggtaatctgtgggaatttgtctacttttctgtactcaaccatttcccacccaaattatgaaaatgtacttttgttttatgggcattaatagccaattatttcctgtctaatggcctttgatccgctattttaccgtccgacgatataaaaggcgtgaaacattgtgattattattaaatttgtgtcccagttcatttaatanacatttaataataatttnnataattaaaaaatgtgcgtcattaaaaaactcgcgc

SEQ ID NO: 592 - DNA, 2137 bp, Heterodera glycines
cacatcttcaaaattaacaacaacgacaactactgtcttttttatgccttggaactgatgcgctactattctctctacaaacgtgggatcattaccgaagacagatggaggtggattaaagaccgacagactactgttctccaacaaaaagtactacttttactccgagaggcagggatcccgacaactgaaccggaatacgacgcggaaatttacatccatcaagtgcaaggattgtggagcacaaaatatcccggtgattatttttaaaaaggcatttataaaaatttatttattttcaaatgaaaaatagatttatatttttacaaattttcaggcgaatataaaatttttattttcaatgattaccaaactcgtccaatcacaaaatcagacgtcaccgattaccaattccctattctgctctaccaccatgacaaacattttgacggcattaagacaatatcaaaattttggaacaaacgttactactgcctctcctgtgaatcagcattcagcaataaatcacaacactcaatgaactgcacatcactctgccacggttgccgggaggtgggcgtcgactatccatgcgaatcccaacaaggatacttcaaaaaatgcaaacattgtaacaataatttctacaacaacgactgctatgaacgacacctccacaaggatttgtgctcgaaatttcagcgctgcgaagattgtggagttatttacaacatcaaatatcacggaacaacaggtcaccaatgcggagaaaggttttgtcgtctatgtaagcagtttcatgtaaaagaggaagatggcgagaacccctgcaaaagctgcttcatacaaccgctgaaactacacaaaataaaaccataccgcattattgcatacgactttgaggcgacacaggacaagaaagtgggcaatcgtttcgaacacgaggttaactttgcagcggctaccatcatctgcaccgactgcatcaacaatggggaatggaaaaattcactgcttggaaaaaagtgtcaaatttgcggtccaaaccgcacaatcacattctcgccatttgactacacgaatacaaaagttgaccaaaaaatcatcactcaaaacccactgcgtgattttgttggatggctactcttcgatcacaacaaaaagttctcaacagttgcctttgcacactttgggggccgctacgacatgacgatgatcatcaaggaggttttagcgcaaggtataaacttaattttaaatttaaattaattctttttaaataaaggtattcacaaccctgaaatcatcaagcaaggaaatcgtctctacgagttaaaaatcaaggacaatgaacattgcccactcacaactctccacgacagctataatttaatgcccatcaaattatcagccctcataaaatcctttggtctcaaaattcaagttagttttatttttatcaattcttgttttaattattttacaaatttactttttaggacaaacaacattttccccacatgtttaataaagaggccaactacgacaacgtcctaccgcaccttccacctcgtgatgactactgccctaaacaaatgaaaaaacccgacctacaaaattttaacaactggtacaataacaactatgaacaaaaattcgacctcaaagaaaaactccccgaatactgctgcaatgacgtccatatcctcacccacgccctcatcgaactgcgccgggaattcaaacaactaacgcaacggaacggaaaacacggaggaatcgacattctttggcaagccatgaccatagccagcgcctgcgtcaaaaactatgcactcaaccatttgaaaccaaactcgcttgccatcgtccccgaaaagggctacactcctcaacaaaatcaaagtgcattggccatcaaatatctcgactggtactctcacaccaacaacgtcaacattcaaactgctcactcccggtacggcgaatatgtgttcaagcgcgaagggcaggtatatcaagtagacggttacattaagggaataaatgggaggagggataaaataattgaagtaaatggttgtctgtggcacgggtgcgaggaatgttttgatgagatggacgaagaaacgaggat

SEQ ID NO: 593 - DNA, 5360 bp, Heterodera glycines
aggatacttcaaaaaatgcaaacattgtaacaataatttctacaacaacgactgctatgaacgacacctccacaaggatttgtgctctaaatttcagcgctgcgaagattgtggagttatttacaacatcaaatatcacggaacaacaggtcaccaatgcggagaaaggttttgtcgtctatgtaaacagtttcatgtaaaagaggaagatggcgagaacccctgcaaaagctgcttcatacaaccgctgaaactacacaaaataaaaccataccgcatcattgcatacgactttgaggcgacacaggacaagaaagtgggcaatcgtttcgaacacgaggttaactttgcagcggctaccatcatctgcaccgactgcatcaacaatggggaatggaaaaattcactgcttggaaaaaagtgtcaaatttgcggtccaaaccgcacaatcacattctcgccatttgactacacgaatacaaaagttgaccaaaaaatcatcactcaaaacccactgcgtgattttgttggatggctactcttcgatcacaacaaaaagttctcaacagttgcctttgcacactttgggggccgctacgacatgacgatgatcatcaaggaggttttagcgcaaggtataaacttaattttaaatttaaattaattctttttaaataaaggtattcacaaccctgaaatcatcaagcaaggaaatcgtctctacgagttaaaaatcaaggacaatgaacattgcccactcacaactctccacgacagctataatttaatgcccatcaaattatcaggcctcataaaatcctttggtctcaaaattcaagttagttttatttttatcaattcttgttttaattattttacaaatttactttttaggacaaacaacattttccccacatgtttaataaagaggccaactacgacaacgtcctaccgcaccttccacctcgtgatgactactgccctaaacaaatgaaaaaacccgacctacaaaattttaacaactggtacaataacaactatgaacaaaaattcgacctcaaagaaaaactccccgaatactgctgcaatgacgtcaaaattctcacccacgccctcgtcgaattacgccgagaattcaaacaactaacacaacggaacggaaaacacggaggaatcgacattttgtggcaagcaatgaccatagccagcgcctgcgtcaaaaactatgcactcaaccatttgaaaccgaactcgcttgccatcgtccccgaaaagggctacactcctcaacagaatcaaagcgctctggctatcaaatacctcgactggtactcccacatcaacaacgtcaacatccaaacggctcactcacgatacggcgaatatgtgttcaagcgcgaagggcaggtatatcaagtggacggctacatcaaaggcacaaatgggaggagggataaaataattgaagtaaatggttgtctgtggcacggctgcgaggagtgttttgatgagatggacgaataaacgaggatgccgaatggaaagacgctaggacaattaagagagagggaagtgaggaaacacgatatattgagccgttacgtcgacttggaggtggtatgggagcacgaaataaatgaacaactaaagaaggacaagcagatgagggaatattttgaaaactggaaggaccgctcaccaataaaaatcagagacgcttttcacggaggacgcactggaccgatgaagttactccacacagcaaagtcaggccagaaaatcagctacaaggacttcaccagcctctatccgtggaccaatttttcgaccgactatccccttggccaccctaaaatcatcagttttccagtaaatgagcagacggtcaactggcgctctccatccgacaacccctacaaaggacttctcaaagtgttgcttctacctccaaacaacaacataaacgtcactgttatgccaatcaaatttgatgagcgccttctcttccctctctgtgagaagtgcgccaaacacatcaccgcaaaatatcccaatggtctcaaggacgacaactactcctgcccgcatttcaaccccaacgaccgagcctttgtatcaacctgcacccatcttgaactaaacgccgctttggaggccggttacaccgcccgcaaagtcttccacgtcctccaatacgaccagtggagtaacaatgtcttcaagtcctacgtgagtgaaatgatggccctaaaaatccacgccactggcttcccgtcatggtgcgagagcgaagagcagaagagtgaatacattgaggagtgctgggggaaatttgcaattaaacttgacaaagaaaagatgaaagctgaaccggggaagcggtacatcgccaagctctgcctcaactcactctggggccgcttctccatgcggaaccttctctcaaaagcaataattgacaacgacgaaagccttattcatcagtataccgaagacaaaaagattgagctaatcgacttggaaatgatggatgaggacaacgatgtattcatgctcacttacaaaccaaaggaggagtttgtcgacgaaaataagtactccaatgtagtcatctccctcttcacaacatcaatggcgcgtctctacctctacgaagctctgaaaaaagtggccgacactcccggatgtgaaattctctactttgacacggacagcatcatctacgttcatcccgaggacaacgacccactcccaacaggaaagggacacctcggtgagctgacggacgaaaatccagaccacgacattttggaattcatcagtgctggctgcaaaaactacggactgaaacttcaacggaaagacaatggtgaaatttgcttcgacttgaaaataagggggttcactctcgacgaacagactgtacaaaaaatacactacgacacagtaaaagagcaaattttacgttatggttccgatgaccccgctgaccccataattgttacatatccccattttattcgtcctaatcttatccaaggcaaagtgtttactcattccctcacaaagcattatcaacccatattcacaaaaggtattattaatgattcattccaagtcctcgaatttggttatcgaaaatgattgtataatttttttctgtgtatattagttttcttattgttcccttcttttataaaacccatgttgggacggaatgacccctggttgatcctctctaacactccaggccatccatctgagatgaaggtggacgagctgttcattattgtaatgcgcagcctggtgagtgagtgtttgattggggaccgaagggtgaagccgttccctgggtgtatttgctcacttttaagggaactctaaaaattctgatatgccttcaaatctatcaaaagagtctttcattttatcatttttctatcctcaattttacatttgtatttttcatttgaatatttattcagaaataaatttgaaaaatatggcattattaatattaaaaggtataaattaaccaaacaaaaagatatttaaggagagaaatagtcagggttttgtaactaaatttggtaaattataatgtcttcaaattcttcaaagaagactctccaatctgtagtggagcaagtaattcaacaagacgcagaaataaaaagcagtgagaaaccactaaaacagaatgagttggaaaagagtgaacggaaatcaacccacaccgtatataacttacttgaccaccaacgatccttttggaaattggcccggccaaagtttgcagtgatcaactttctctgtccagggtgtcgtcgaatcaactataagcacaaggaccagttcaagttgatgggagaagatgagttccactttacccaagtgatgtgtcccggttgtgtaaagtacaatatgatgcagactgatatctataacaaacacacaaagaacccccactaattgtatttaagattaaaacttaacattatatttataattaataaagatgattgatgaaaaattttttcacttgaacgatttgaaattaaaattgccttttggtatggtaattagtggaccatcgagtagcggtaaaacaacatttttactaaaatttttgagagaaagagatgagttaattagcccacaaccaaaatcagtgctttattgttatggtcaatttaatgatagtattcctgtactacaaaaaatgggagtgcatgtgcacaaaggacctcctagggacgaattgctgagctctctaaagaagcctctcttattaattctagatgaccttttaacaataattgatgagaaatacctatctgaattattcattaaaaaagctcatcatcttaatatgggtgtgattttcataacccaaaatttatttgaaaaaaagatgaaggtagcccgaattaattcacaatatattgttttaatgtctgctccgaatgccgcgctacaaatacgtaatttgggtgttcaactgtttccaaaaaatcttgcatttttcctaagtgcgtataaagatgccactttatcaccttatgggtatttatttttggatttacacccggcatcgacccctttactgagaatacggacgaggatatttaaagaagatgaagaaaaagcattgtatattcaaaatgattaatttacctaaaaatgttattcaaaacttggattttttaaagaaattggtaaaaacaaagtcttttaaaaagagacaacaaatatttaaagaagcgactagtgagcaaattggattattaattgaaattagttataatatattaaaggggtactttccgctcacgaagagacaaaaatatagacttttaccatacgcaaattttgtaagaaaattagcaaaagttagaactgagacgggtgcaaagaaagtttttcaacaaaacggtggtggttttttcgttaatttgactcctttattattaccagtcattattgccgccttaaaatatggagaataaatttatactcgttccatctgacttgtataacaatttattaaagcctgacactggggagattaatgttgaaaatgctaaaaataaattgaactcacttttgaagcagcgaaaattagattcgggtacaaaaaatttactttataatcaggaattgaggcgtttcttgaaactaaggaaggaaattgaagacaaacccgtaaaggttgagctttcagatggctcattaatggtgtttaaaccaaaacagcgtgaaagagatagcaaaattcctactcaaattgttaatgatgaagaattggatgaaacaggctctattccaacacttgaagacccttacactactgctgaaga

SEQ ID NO: 594 - DNA, 3670 bp, Heterodera glycines
  misc_feature (3648)..(3648): n is a, c, g, or t
tttttgccaattcagggaaaaagttattcgtgccatttataggattgtcggttgacacagttagcaaaaagaacacaaaactaacattttttgtctgtttgatctgctgaaatgatcctaattttggaaaatatcaccgacaatcctatcgattggaactgttagtggagcagagaaagaagaggaaatgaacagagattgttagaggaaatgtaaaatatatttattaaaacgaagaattaatttgtaaaagaaatgtgctaaattgagggggggggggaaaagattggccaaataattaaacccagaacaatctcttggctcttggccacatcacgtggataatgattgtttcgcggccgcattggcattggcactcgagattggagaggacaacagtttgacacatccatttctcgagacaatggctctgtttttcttttatccaagatcatgatcaaagccctgtgatccattttcaggttctacgggtgttcgatttttttatgggtccgtatcgttttggcgccgacgttttggcgccagcccaagttttcggactataagtgttttctttttcaaccaaatccaacattgttggtatcattcgaaagcttaacatgttttgaagctatttataagctattgattagtgattagacaattaccaaaaaagttataacatgaaattccaaaaaagtcgaaaattttgagttttttcctaataacttttttagaagctaaatttttttttttttttgtaaggctaatagagcttgtgaagggctttcgaatgataccaagattgttagatttggtcaacaataaaaagttataatcaaaaaactgaggctggcgtcaaaacgacccagtccctttttaatttgttagtttttattggccaacgaaaacatttttgaaatttacatttgtttaaaaatgaccattttgttaagtattattattattttaattattgtatattattacaatattattatttatgtgttgcacatttaacaatctgtgaaattaatttgtaaaagaaaaaaacagagggaaagaaaagggaaaagaaaagaaaggacagaaggtaacacaagaaaacaaaagacaaaaacaaaacagtgatcatcggttcaaatcagaaaaagttacggggagcacagagaaaaaaataggggggaacaaatcaactgatcagaaaggaaaaaagcagggacagagacacagagagagtgatcagcaaggaaggatcgatcagaattgccggcttttcaacaaaagtgccaaaaaatgttagttcaaaatatgtacaaattgtgattttccgacaaccctataaatgtgtgtgtgttattttgatcagtttgaatgatcgatctgtcggtccgccgtatgtccgtcgaccaacaaatcaatcagcggttaatcagtgatcagaatcaatagccatcaccatcaccaccattcgatcaccacgtcacttgccttacgcgccgtgtgccctcctccccctcctcctcctcccgatcagtgccgaagaatatttcgtcaatgtcggccggtacagtgttttccagccgctcgatcagtgccgccaacatgcacaactgccgactccaatacgcttggcggttgtccagcactggccaccgggagtagctcagctcaagcagtgccaaattgtccacacgtgcgatttgttcaatttctgcgcgagacgcaacgctaaaacataacacaatgtgatcatcgaattgatcatggtaaattttggcaagtcctatcctaattaatacataataatgatgctctttggcaccaattgccattatcgttgttgtcccaaactttgccaacttactcgattttgtgccggtggattagcatcaccattttgttcgctgtcggctccgattcggtgagcatttgctgcgcactgcgcatacccatcacggcattggcagcaccgcccacaaagtgcatgttctgtgtacacacaatgtatattcacaaaagccataaacgatgccaaaattatggaaaattgcctttgatcataattttgatcggcattttccataccattagcatttggttggcattttccatagtttatgcttttgatcaatcggctttttccatcgttctccccaccctccttctctcacttgcagcgtctcttccaactcgtgccaactgccgtagtgggccaaatcgacgcccacctccaccgagtcgccgtagaaaatgatgccaattttggtatcgctgtgctgcacgtactcgcgcacaaaatggaccaatgattgtctcaactcctcgcgtttttccgcggtcgcttccgaagtctcaaccagcaaaacgaggcgagtgcggcgctgcaactcggcacagtcttgtgccgacttcggcgacacttctgaagatgggaagcattgttatgtgccaaaactggaaggataaatatttgttgtgcctgagaaagcggttgtgccgcgttggacagatggagtcggtctgcctgtcatcgaaatgtgtttttcgctgacaaatttggcacgcgacttgggcagcgccaaagtgccggcgcggcattgggactccaaaaagtcggccaactgagcaccgctcaattgggcccactaaatggcaatttttaaggaccttttaagtggaaaagtagtgaataattggccaaatgaaaaggaagtgactttgctcaacaccgctaacagtggtggaatgactcatcagcagaggtgccattttactccttttttcccatcacattttttacggccataaaatgaccgatcagaccaaatcaggcaaactgccagacactggcttacattttcaaccaaaagatatgcgcgaggtgccgattcttctgcaatttccgattcatagctggacgggccgacgagcactggggtaatgccggccgcagtgagtgccgaccgaggactgttcggtactctgttgaaaatgtttcaatttcagttcaactttttctgatctcgtccaagaatctcgactctcagcagaagggttagttccggcgccatgccaaaaggcgcagccaaaattgttttaatgaaatttccaataaaaaacattggatttgattttggagagggatggacccccggccaagggcgcaggcaggggggggggctgaggaaaaatgatttttttggaaaattttctggactttggggaatccaagaggctatttaggtgattgggttcgtgtaatagaggtaaatcacaaaatatggacataaaatttgaacaaaaatgcaaaaatatggaaatatatcgcgaaatatggaaaatatggatatagaaatccatcctagaagcttcaaaccatgctataaacatgtttttcgtgtgtttcaggcgataaaaacccaactcgtactgttttttggcaaaaaatcgtcataacttttgttaaagtctaccaccttgaacattcttggtatcattcgatagcccttcaaattctctatctacccactaagtttcaaaaagttttgtcatgtttgaacaaagatatggatgaattgtttttaccatatttgttcataactttcttcttttgaaatgcaataaaattttcttgcattttaccgncccctgaatgataccaagaatg

SEQ ID NO: 595 - DNA, 11289 bp, Heterodera glycines
  misc_feature (359)..(359): n is a, c, g, or t
ccccccccccgaaacccaaaaagtaaaaaattttcactaaattttttgaaattttaagtaattttcttaacaaaattgcattaaaatactcaaaaattttcccggcggcgcctatcggcaccgccggcccaaatggagactaaaatggcaaaaaatattaattttttggcgaaaaacggtgaagaattttgtaaaatacacccccataattcgggatttcaaaaaaacaaaaaatacacccctaaaaatcgattttttgacttcagccccccccccccaaagccaagggtctggctacgcccttgccccggccttatccgagacctatcctccctaattatacctttgccccccccccnctctaaaatccctttgcccaaacactcacatatcctccccgctggaaaccaccagcaacacttttggtacatttccgccccggccgaaactttcgaactgttgtaagctcgcttcgtaggcggccgacaagtcgggcagtcccaacgagttggaggcagtggagcgcagttggccgagttggtcgagcagttggtcacgctcgtggtaaccgcccagactgaccggaaccgccacacttttgccgtattggagcagtgccacgcgggtggcatccgccgccaggtccaaatgctggtccaaaaggtcgtccaacgcctggcgcaagcggtccccatgcgcttggagcagttcgtcgttgactgccaccaccaggtcaatgaccgcctcctgcacgcggcactcgcccttctctacacgcgtcggcacgcggtcatccggaagtgccgccaccggaccgccttcatcagacggcacaagttcagccccgtccacggcgtgatcgtcgtgaagtgtggcagtggtcgcttcggcaccgattcggccgcccgccgtccgtgccggaagcccgtccggactcacaagaccgacatccagccacacgtattcgtcataaatgtttttggacagtacgttgccgctacggtccaacggtcgtccctgatcatcaaccgcaattggtgtgccatccgctgggtccaagtaacgtccgctggccgggtcgcgtgccaacggcgtcccttccgcatcaaccaccggcatcagcagatgtccactcgagtcggtcaccggtgccaatttccgctcctgctcctgctcagcggaccatgcgtagacgaattggccctccgcgttggtgggcaacggcgagccgtccgggcccagcagcagtccgtccgcactagtcgccaacggtttgcgctcgcctcctacgcgcacccaaccgccttgctcgtcccggtccagcggttgtccggcactgtcaaccaccacaatttggccccgggcggtcgcggccggttccaatgtgccgccgccgccaacgacgccaccaccggcaccctccggacgcgtgtaaatgaattgtccttgctcgccctggggcaagaggtggccggccgagtccactgggcgaccaaactcgtccgtctcaatttgtgcaccacccgcgtccacgtagtgtccagacgcgtcggttggcatcgcgatgccgaactgatccaccatcgggtgaatgtcgtgcccgtagtcgtcggtaggcagcgtttgcggcaccgtttcctccccgtcaccggcgccgcccggcggcacagtgacatgtataaaacggcccagcgaatcggttggcaacggttgcccgtccgcgccgatcagcagcccgtccccgcgcgttggcagtggactgcccgcacggtccagcacgagtccttcccgcgtggtcgacaacggcagtccgtccggcccaatcacttccacaacggttggacgcgctgtcgacgttgtcgtcgccttcggcactgacgttgggggtggaggcgcttcggaagaggtcgtcaaaatgggcggagcagtcgtttgggcggccgcggcaccctccgcctccggcacaaattccgacggtggccgggggaatacgaacattccctcctcattctttggcagcgttttaccctgaattttacaaatcctttggtctaagctaaacaaattttaattaaaaaattccaatttgttcccagacggcgtttatcggcaccgccgtcccctcccctctttaaatgttgtgaaaaccaagaaaaaaaaagagttcgttgatttacatggcttgaactccttcacaatatgttggttgccttccccccccccgtgccattcattttgtccttttttgccaatgctttacatcggtgtccaccggaatgccctgctcgtcccgttgcacttcgtcccctcgttccgagtccaggaaaagcccggaactggcagtgggcagcaattgtccgtccggataaacgattgggtaaattgggaagcccattgtgtcggtgggcaacactttgtcctcctcctccagccgttggccaagcacaaattggccatagaaattggtcggcaatggcgaactgtcgggccccatcggttggccgtaagcgtcggtcggcaacggtttcccctcgtggtcgagaattttcccctgagtaattgtaaaatattaggcaattaaagaaaaattatcaattaatgccacaaaaaatgacgataaaaattaaattatgccgctcagaattaaagttaatttgcatgtgcaacggaaaaagtatgccgtaaaaaatgagaatgtgctgctatttggagaatccccaaatccgcacctcttcgtctcgtctcattgaaacgccgtcgtcgtccaccaccgagtaaatggggtacatgttggcaccagtgggcatcggctgtccatatctgatcagtgggtacggtacccaaatcactattctctctccgtttctttctcttcccctctccctttttctctctttatgctttctccgccccttttcgtgccgtactcacttgtccaacggcgggtacacccaatttccgtccgagttcatcttcagcacctgtccgtccggcccgagtgcccgctgctcttcgtccctttccaccttccgttccatggcgtcgtaataattgccgtgcccgtccgtccgcagcggagtgccgttgaacatcaccactggccgaatttctcggcccaacgagtccgttggcaacacgtgcactgttgcgcccaggtcatcgccggcctcagttttgaacgtatcggtcggcctcagtgaggggtacggctccgcttcgacagggcccgccggcgttggcggcggcactctgccggttggcctcggcttcaacagatcgaactctttgggacgttgttgctcaagttcgaatgttggcgacacctgaatgggccgggttagtttccgatgcattcattgattggtttttagggagcgtttgatcagcataattaactcttatgctctaattgtctccaatttgtcacattttttgtttaatgggcattatgaaatgtttgtttgttttaattatcaggttttaagttttctgaacctgacggaaagaagcctgatcaattattgatcatttttctgatcaaagtttgcgtctccagcgaattaatgatcactttttatgtatttctaattggtttatttcatgcgctatttttgcttattttctgctgatcagttagttacttcgattgctctattgtttctcacctcgaccactgtgccggccccgccggttggctccacttggctgcacgtcttctcgtcctcgtccaacaaccacccgtccggacagtaacactccacgcgcacctgaagcgggatttaattatgcgctttaacagatgtttgcaaatgaattattcagctcattttgttctcccccgcgggggagatgcgccgttcccgtagttaagtgcaataacgggccaacgctcggtcgagcgggagcaagcccccgacaacgaccattttccaaaaattggttaatctcttggaccccggtgggggtcgttacggagattaagccgtaaagaactgtaactacactttgatcttagccaaaaggccgagaagcgatgccggaacagcaaaatggtacgtgaaaggggaaaagaacgaaacgaaaatatatggggagcattttcctggtcaatggtgtgcagagatacgcatgaagggagggaaaatagtgtgcgaaatgtgaggaaaagaaacgagagaggaaagatgagagagttagtggataaaaagggcgaaatcgttatttaaaaaaaccataaatcaattatgtattttcatcaaaattaatttatgtacattaaaatattcatattaaattaaattttaaaataattgtttttgtaatgattttgattaaataaatatataatcgatttatggttttttattttattttattaataatatgtttccctttttatttatttcattttccagtgccaaattcagttccggtccttccctcccccccccctttttttcacctgcacagagtccgtctccaacagtttgcacgcgtgcgaacagtcgcagcgaatttctttggccggcgttcggatgcgcaccggtggcccggccaactcttggccatcgctcagctcggccaccgcttggaaatagaactcgacatcgcggggcagatcgggcacgcgaatgccgacggtgcggttgccctccacgcggattgtgctcatttgtgccgcgtcggcggcagcagcggcggccgcttcgtcccctgccgctggtgccgcttcgtcctccttggccgcttccgcgggccaatagcgtaccgaatactcgcgcaccggctgctggggaccgctgatggccggacggaagtccaccacctgagaaagtgagttgttaagtgccggatcaaacactcctatttaaaaggcgcctaacggcaccgtcggacacccattttgccatatttttgaaaatggaccccaaaatggcacaaaaaaatagtatggcataaatgaaagaattgcggagaccaacatcagcacaaacaccgaccatttcgtcattgatgttcgacccgacgcggagatcgccgggtgccttgggcaccaaaatggtgaacacgggcgagcgcactccctcgttggcattctccaccacgaggtaataagtgacgcccggctccatcggcgctgccggcgcgcgaattgggatctccttaacgaagaatggcatgatttaatttttgacaattttgtatgccaaagatttgtcttggattgactcatcccttggacttgatcataaattgacaaatttgggttttccagggtatgccaaagattcggaggatagaaccgatggggcaatgaagttggcatcaattttgagagttggccgacggattaagcaaaacatggcatttcccccgagagtatgccatcaattggggtcgatatgcttcggctgatcagggattaccctccccccccccggttcacctccaacgttcggtcttcgctctccaacacactccacagaatgcgctctttgttcgggtcgtccgtgtagcgaagtgtccattggttggcacggcgcaacgaattgggcaaagtgtcggcaaagtgcaggtaaatttggccccgtctgctttccactcggaccagctgatcgcgccagtcggcggacagatcagacatcatttccagccgaatggtccaattggcgacgcccagcggattgcgagccacgcagttgaacgtggacggctcagtgatgttggagacgaacagtgaccttaaaaacaaaagcatagagaagggggagagagggagaaagagaaaaaagtgatcggaaagagaaaaaggaagagaggaaatagtgagaaacaaagagagagagaaaaaaagaagagatgaatgagagagagagagaaagggagagagaaacaaagacaaaaatattcggctaacgggatgatcagctaatgccatgtctgtaccatttggtgcccgtgtggtcctccttcactgtggacggatcaatcggaatgtctccgccgcggatccatcgcaccgccggctgaggtcttccgctggcacggcagaatacagtgtaatcacttccctgtgggcgggaggaggtgatttcggatattaattaatccctatttaagccgtctccaaacttccggacgtatttttttagatcattgggatttgcccacccctcctattttcacttttgagttttaatgcttaatattgacttttcccttgctttttgctttgcttttccccagttttcctacgggcagcagctgaatgacgctttcgcccgcagtgcctctgctcccggaggacacgacaatgaacggcgcgtcaccctccggcaacgttttggcaatgcacggctccgagaaaatgccgggtccactcggatatctgatcaaaaaaatcagtgtaaaacgtgggataagttagacaaaaagaagaaacaaagactcacaatgcccggattttgaagacgtattccgtgtccggctccaacgcgttccaaatgatgtgactgtttttgctcgggtcgggcacttcaactttcgaccattttggcaagctcagcagctcgtcctcttcaatcttcttctcggctggcacgtaataaatctagaaggttttcgttggttttgaaattaatttgatcagattttttaattttttatttttggggcccctaaaaataaataaatttttagtggaaaatgattaaatgtttttaaaatttttaaaattaattttccacctcataactgagcggcgactcctccagcacttcggccggtttccaatgtacttccaccgacgtttgattgatcggctccacctgcagctgtgttggcggggcggcacgcgctcgagacattgtccggatactgtaaatagacggaatacttactgtacatggatgagagaaaacggtatcgaaatgggaaagccgagattaatgtcaacggcactcacttgtgctggttggagtaggggccaggcccgtcttggttcgctgcttgtaccaccacagcgtatgcctataaaaagcaaataaaaaatgccatccgaaatcagacaataacttcttctctaactctctcccctctctctctctctctatctctctctctcttctctctccccacctcttgtgttcttaccgtgtccgcctccacaaagtcagtgatcagtgcctgcttctcgcccactcccaagtccttgcccatcacgtggttactcatccattcgctgatcggtttgctcggcacttgaccgaccagcaaatcgcggctctggtcatcaagcgcaatgtagtaaatgctgaatggggaacattgtggtcaactgatcatagtttttgtgatcgactattacgcaacagaatctcttcctagccgtttggcactaattgtgccaaacttgttgactcattagttaactgttttgctctcacatgtatcgtgtgatgtttccgttggcaatttgcggtggatcccaagtgactgaaatgctttttggcctcgtcgccgccagtcggatgttctccggcgcactgcccgggccggccacaaaaattgtgaatccgttctccgtgcgtccgccctcattctccgccacacacacaaagtcctttgcctggcgaatgtccgacacgcgaagcattccgccctcactgatctgtcaaaggaattaagaaagtgatcggatatgacaagctgatcatgagtgatctgatcagattgacaatcaaaaaagaaccgccaggatgatcaaagtgatcggtgtaactagtggaatttaatccctttttattatcctcaccaaattgccctccttgtccacccattttatttgcggtgccggaaatccgttagcagtgctaaaaagcattattttacccattgtgccatttttgagcttgccatgccacggtgtaatcggtgccggccggcactcggagaatgttgtcctccacgtccacgtggatcatcggtttgtctggtgccacaacgcccaattttgtgtcaaagtctttgggttgcgacggcggtccttcaatctgcaatggataaatttggctatcacaaccactgctttggtatatccaattaaggtataaaattttttattttaacgaaatactaaaacgattagaatttgagaaaaaaaattcaagctcattttgttctcccccgcgggggagatgcgccgttcccgtagttaagtgcaataacgggccaacgctcggtcgagcgggagcaagcccccgacaacgaccattttccaaaaattggttaatctcttggaccccggtgggggtcgttacggagattaagccgtaaagaactgtaactacactttgatcttagccaaaaggccgagaagcgatgccggaacagcaaaatggtacgtgaaaggggaaaagaacgaaacgaaaatatatggggagcattttcctggtcaatggtgtgcagagatacgcatgaagtgaggaaaaatagtgtgcgaaatgtgaggaaaagaaacgagagaggaaaggtgagagagtgtgtggttagagagtctgcctaagtaacagaaaaaaaatgggagaggattgtcccattcttctatgaccaacccttttctattgtgagcgtaaaatgttatgtttctctcttttcttccttttctcgtgtcttctcatttggttttttaaaagtcaattttttttctgggtaacccccctttggcttttttctcgtcacaatttcgagactctcttttatttacaataatttaatcccgagaatagattgatcttcaaagccaaaactgagatttggtttcaagcttggggcagtgatggctttgaatggttctattaatccccgtgagcttaccacgccaattgggatgactcgcacgtggtattttgtctccggctcgaaattctcgccgtccaaaaacacattcatttcttttgttgtgtccgcgcccgggggaattgaccaagtcatctattaaaaaaaacgttttttagctattttggcacaatttatgatttttggactcaatttaactccgccgaatattttatcatcaattcaaatcaactttgattgattaattatcagtgataaattgactttcccaattgatcagttctttctccatcagtcaattttcattagaattcttaaaatcaatgctcttctctttggcttataatgagtcaacaattcacccctaattgcgatggccaaactgatcaaatttagctttaatgggttctaagctaaatatcctctccccctgatcactcttctctgatccctttttcattcccctcttctccaattcttttctccctcccccgatcacttctctctgatcacctcattccattgggcatcctccaacgacgggtcgcctttggtgtagtgtattctgtacgtctgcaccttcttgccgacctcctccggatcgtcagacggcaaaaattggaccatcacagtgttgttgtcatgcaccatcaccggcatcactgaacagagagtgccaacaaatcatttgctcctcccagtcaattgggcaatttactctcgagaaagcataattaacgaccttcgggcgcctttggtgccaatggcaatgtgcgtgccatcaccggatctgacagtacacccgggccacggtcggagaccgcttgaagccgtatggtataaatggtctaaacagacaatggcattcaatgagtgggataattaaagaaaggtctcttccgatcaacagtacccacttttggtctcaattctgtcagtcggtgtctgttcacgtcggcgcccacgcgaatttgttgccaagcgtccgacggcggctccaattgtccgtccgccagttcggcataatgaataatgtagccgaccagctgaatggtcaaagcaaatcacaaatgcttgatcgggactcaacatttaataaattgtacgagagtcaagagcggaattacaatcacaagtggaccgtctttcaaagatttcacctcctttacccaagaatttgttggattacagaaatctcttgctttatgaaataatatcgagactgaaatctcccgttagtcgagaattggtggttttggcttccaagactctcgaccatcacccgtcattgctaatttgtctgcccccacctttccgtttggttcgtccggcgctgtccactcgacgtttagcacttggtcgggcatcggcagcaccaccaattcgttgggcggtgtgccggggccgaggacgcgcaactgaattttgtaatttcgaaatcagactaaaaagttaaaatactaatagaatttccatgattttgttgttattttactataaacaacaaagtccaagctgttattgttcacctccagcaccagctgcgctttccccgcattgttttccgcgtgacacgtcgcctaatgaggggcggtgctttttgtaattagcaattgataaaattaattaattaccgttgtatctttgcgcaatttgcgcaacaaaaggtgcgcgccgcccggctgccgttcctcgtcggtgcccaaagtccaccaaagggtgggcggcggaatgccaccggtggcatcgcaatggacctaatatgatcacttatcacttcaatggtgcctaaacgcctttttctgaaacccggccggcttccgatcaatcctaattcatcgactgatcacttttgtgtcagttccctaaccaattgaatcgatcgactgccaatcacgtttcttttcctccaaatcgcaccgaatagtcatctaatggttgcacttcggccgggttgtccgccggcacaatggccactgtcggtggcgtttcgcctgtgccggtggtaaagcgtgccaccgcggaaggcggcccctcgttcatgtcgtttgctgcggtcacacgaagccgatattcacgttgcgcgagaatgttgtacgtctcacggtccaacaccacctgaaaaatccgattttgtgccaatctgttgcccctttaattggcctaattagtaaatgattaatccatgattggatatcccatttctatcaggaaccattaggtttcgtcgaattgggccaactcagcgcccgaggactgagtcaggcaaatgccagtcatcctcctcgcccgtgatcacctgtccgcctccgtccgcccgcaatggcactgtgagccgagtccaccgcttgtaactgtcgtcatcggccgcttcgtcgtccaacgcgaagtacaccgtgtaatggtgcagcggaccgttgggctgtgttggcg

SEQ ID NO: 596 - DNA, 2305 bp, Heterodera glycines
tgacgcggttgtccccatccacctcagcggacacgtcgcgcggggcaccgcccggcttcagcacctgagcaccgggacaattggcaaatgatcagaaagaataacgagggcatttgccaatttggcaaaagaatggcattttccaaaagtgaatgaaagttataaagaaatggttaggaaaagggaggacaaagtcaaacgttggttcgaaataagagtctagacttttttgtggccatagatcccaaattggaggccaagtcatagttccgagccttgagcccaagtcacagtctcaatttttcaagatttgtctttttatccattattccctgcggttatcatccctccctaattacccccactgtcaaattcatttttgtgtcatattacgacacagtcggccaagcacaacatgcctggaacagctgttccgcctggacttggccttggtcattgcgcgcttcgcacaacagtctccgctttgtattcgtccgcgtctccgtctccgcgctcacatagcgatgggcttcgccattcgagtccggctccgtgcttagttggaccggcccttcgcccggctcagcgctggctgcctcaaatggcacccaggagaaggagaccagcggcttcggtcgtccgaccgccacgcattggaagcgaatggggccgcccggctccaccagtgtgccctccggcgcaacggagggcggcggagacagcacgcggattgtgaccgcgagcggaatgtgccgtaggccggtgaccacctcgtagctgggcgagatgatgccgggcccggccgagccaatggcttgcacacggaacaccttcagagggaggggaggggaaaggtttgacaaatgtacggataaagggggagggattattgagtgatcagtcccattgttgatcagcttgagcattgattaatcggtttctgtgatcagtatcactgtcacgcaatcaatttaaagtttttgacaaaccgatttaaattgccactgatagtctaatgagcaatccttggcttattggtgataaactaattaacccaatttcgataatttccgaactggttattgataaatttatttgatcattaattatatcattgattaacccctaaggaaattgttggctttaaacttacgtaaggcgtctgctcctgctggtcactgatcagcacattgtccaactcggcgcccacagttttttgggactgaaatattgtaaattttttcaattagaaaatcaagcggacaattcagtcccacccaatcggccaaatcagcttccgcatctttgttccagtagatcacgtaattgatcacatcgccgttggggaccagcggaggcagccaattaacactgatcggggacaggaaaatggggtgatgaaaattgctattttgggtctcaaatggcccaacctgaacccgtcttggaccgggctggaactgatctgggacggtggcgagccggggcccaaaatacgcacttccaactccttttcagcagtgcctttctcattgattgcctagagaatgagagaggaaaacgaatttgaaatctctgaccgatgaagcaattatggcagggggaattacggtaaagggaattactgtggaatgggaccggtgagggaattactgttggggcaatacggtagatcaggcggaacagcagcagtatatacggtaatcattttttgagtggaaacttctcgagaccaatgaacgagtcagtcccgtgcgttgttttttggcactctctttgctcacctggcacttcagcgtgccggaccgcgtggtggactggaacaacaggcgttgccgcgtgcgcactttctcgtccagcgctgtgctgtcgataatccgcatttcgtcctgtccgtccgccaccggtcgtccgtcccaccaccacaaaattcgtggccgtggcacgccgtccgcgtcacagaacacttccatttcgtccggacttggccgacgctccaggcgctgctcaggcgacatggacacttgtggcacacgcggggcgagccaagtgcggacctaagggaagatgatcaactgatcggagaaaatgaggagcaaacttatcagaaggatggataaagtgatcaaattgaaacaaaaggaaaggtaaaaaggtgccaaaaaatgccaagaaatattcaaatgaatcaaataaatgaggaacggtaatagatttcaaaacaactgatcagattggttcaaaatgacagataaaatccaattacaaagcgtgaaaggcagactgaacaggccaggtccgttca

SEQ ID NO: 597 - DNA, 879 bp, Heterodera glycines
ggggccatttgggcttcaattatcggttaaaaaatatggtcccccgtttaccaattttttttggttagagagattccctttttatacctctcacacccccgcccccattctcggcttacattacgctgagccaagacaccaccactgccgccgccgtccacatttggcaaagctccatccacgggcgtgccatgagacgccgaattgaccgccttaaacccaatgatttaaaagacaaaattaattttgttttccgaaaattattcaaatttttttgccaaaaatttcagaaaatgccaaaaatatatttaacagagtgccaaaatgacttttattttaacgagtcccccccccccccaatttgaactcaccagcatttgtcgtccattctccgtgccagttggtcgctgaaccgtctgagcatgctgcggttgcggtgccgtactgtttccgtcttcagtgccgccgatcaacagcagctccaagtcgttgtaattgttgtgttgctgcggttgccgagaacggcttgatacggcgcgcacggttgaagaagtgtcgccgcccacaaaaatgttggcgctgttgctgccgccgccgccgctgctgttctcgtgcagccgcttccgaccggtccgggatgggggcggttttcgtccaccgttattgctgccaccgccattgttactgttgttgttgtggttgtccatattgttggtcgacgcactttttgctgttgatgaacaaatcgggttgaagtgaactgcttaaaaatgtgggaaataaataatttaatatttatttaaaatgtgtaaaaaattgaaggcaaatgaatgaatgatcagaggggatggaacagaacggggttggggaggggggggg

SEQ ID NO: 598 - DNA, 8601 bp, Heterodera glycines
catggaagttgacccgacaccttcaacatcagccgcaagcagcagtggacttataaacacgctgatggtcatcagcatgttcgcgctgatatccttcagccaacagcagcggcaccgttacgcattcatcgagcctcattgagccaaaatgcacaaagattccttcaaatggtttccgcccactacagcacactcacaaccgcaccgccatttgaatcgacgagcactttgagcaccgcagtcccatcagtaacttcgtcatggtacagcacaataactcgaactgaaacgatgacaaccacgaagacaaatccatggacaacaacaacatgggcaccaatgacgaccaccaagcaaagatggactccaacaatgtcaaacagcgcatcaacttggacgacaagacgaacccgaatccaatacgtcacgaaagcaagaagccaacaaacggatgcaacgacacctcccaacacaattaaatcggcaaaatcagcgaaaagagacttgggaacgaatcgtgacggcgcggacgttttctggtgttccgacagaggcagcacgatctgggagctcaagggccccgagaattcaccattctgtcgtcctccaccatcactcaccgcggaatggcacaatctcgcaattgaactctacgccaaaagcatcaggccagagcagattgattccgcgtggcattgctccgtcaaacgaactacggagaattattataccaatttgttgggcgacaagtttgtgaccatcgtaaaagaattcccaccggtcaacaagcgcatctgcaagcaaatggcactgcaccaggaatgcccatacgccaagtccgaaatgatcaaccacgagggacagctgtggtcaactaatgacgaactgaacgtcaatttcccaggacccatttccggactcttcaagggtgaacagacaagcacagctacgaactgttttgtgcaaccagcaaccatattcgtcaaacggcagactctacaaatgctttcgccagtccaccaagtccaaaactgtcaatactctgcggaattctgtcagttgccagacaacacgactctgatatggaaatcaacgtgctctggagatgaatgcaaaatgtgcgactacgatcgagcggaaatcatcagcggaaaatttaccgcagcttatggagaaacagtagccacgtggatatccgacgatcaccagaaggccttgacattcgccaaaaaggctcccgaactcatcgcctgcgacggcgtacgcatcgtcctatctgaacagaactttgggattgccaaagatcaatacgacgacataacttcatccgttgatcttccacgcatggcaactcgacaatgagtctgacgcgacacgcttcccgcacatcaacgaattcatcaactcggagcagttcaaggacaagctggaacagcacattacggcaaggactgaagctttgggcgcgttgaagggcggaatagaaggattcaccatgcgctggctaaaaggcctgatcgacgaagcaatcacatggtggattcgagtcgcctgcgtttattcaaccttcctcatgctgcgcgacattgtactcccatgcactctggcgtatttgctcaatcctaccgagtgactcttctcagcctcgttggagtacgcccgcagtcgacattccgacccaccgttagcaaaccactcgggatcgaagagggaatgccgctgcgtgaactgccacgaacccccaaaccaccagcgcgcagggcagagcaccgatccatgtcaccaatcaaattggacatgattgccagaacggctcggtaccaacaaccacgaacacagtgccatctcgacctcacagaagactcgccctttgggaggccgagacgaaaagaattctgacgggccccatcctttttcgcgccggaatgtcggaattttttattcctatcgccgatcaatgatcggcggaattaagagggaggaggcccttcaccaatcccccgtccgccgcgcgacatgttttcgccgttccattcctctatcccccatttcccttcaaattgtcaattgtttttgtgtgttcctcccccgccccgcgcacaaattaatgaccaatttgtcaaaccgcaacttttcgccgccgtccccaattcggcgaatgagactccaaagaacgatgaacccccaatttcccgttttcctcccaatttgttcattcgttcatttttgtgccctctttttcaattcatgcccaattttcggcccattttcgttctgctcaatttcgccactttttgttcaattttgctcgtatttaatgcgacaaatccccaccaattcctacaatcagaagcaccagcaaaggcaagcaatgcctcttccgtccctctctcagtccccctcatttcattgtccttttcccccggcccaattgtccgttccatttctgtcattcacccggtccccctcattcaatgatcagtgattggcccttcacttctatcccatttcgctgtgatttgccccaattgtgataatttccagacccccggttttggtctttgttctgtggcgccggtggtccccttcaattctttcccatcccggtccccaaatcatttgtgattaatcccccggtgatggcttttttcctgtgatcaatttgtgataatttcgttcaccatttcaaatatttggtttaattacccaagttcgaggtcatttcccggaataaattttttattcattctgtgtctcgtccctgcctgcccctgaaccccgcaccgtggaattcatttggcccgaccccagagcaagtcgggacaaattggcgctcctgggtggattggctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacgaagtacttgccctccgaggaatacttcgtacaaaagggtgttcaagcgcgcacaaggccattgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatctcggaaaaagacacaaaacaacaagtgcaccacaacacacacacacgcacaaccaaactgcacgcaatgtctgggccaatacaaaaagggatcatcaatgcactcaaaactctggacaatgccaaaagcgccacctcactccttcaacaccccgacccggacctgtcaaactgggaaaatgccatcaacttggaggctcaatttgatcgcgtcgtcaaggaaatccgtacaacggaaatgcagatggacagtctacgagacttatccaacgcttggattgaacttctcgcccgcctgaccggagacgacaaagacaacgacgaaaaagaatacatcaaattcgacaaaaatgagaaaatcgccgaacgatacgacgcagcatcaaccaaacttcgggatttgcgagatctcgaagcaacactcagtgccgcagccaaactgcacagaggcagagccgacagggaagcaaaggcggatcaattggccaatccgcagcaacaaccgcccatgccaccagcaatggcagcaccaatgacaatgccaacattcacagcaccgctctaccaattccagccaattcaactggataaatttttcggccaaaagcgaaaatggcccgaattctacgaatccttcaaatcggcaatcggcagtcaatcaatcagtaaagcgcagaagctgaacttactccgcaatctactgggcggagaagcgcgagaactcatagcgggcttccgactggaagacgcaaactacgagacggtccttcagctgttaaaggacacgtacggagctccggaggaacacatcagaagtcttcacttcgaactggccaatctcaagccgtgccgaagcctccgtgagaccaaagactttctgcttcaacttgagcggcttacaagggagctgaacaatgccggagaggacatcgaaggtcctcaagtgttcacttccactgctgctgctgctgctgcccaaatttgacaccggcggatctctgctgtcgcgcatcggcggcgctccgctgacgtgctgttgatggtcggagcgattggtgctgctgctgtcgtgatcagactgatcggtgaacgagggccggcctcgcccaatttgacgccaggcattacactataaatgcaaaaagccatttttgcgcatgtccctattttccaattttgtgaaagcccttccaatataatggcaccatttctctcccccaaagctctagcgcttctcattttctacaagcccccccccccccggccttaatcacatcaaaacacacacacacacacacaaagaaaaatgaataaatttactgaattttgaaatataaaaatgaataagttctattaaaaatggcagaaaaaatatataaaaattggcaacaatataaaatatgatagaaagaatggaatgaatgagaaatgatgaacaaaaaaaagcaaaaatgcgaaatgaagaaaaaattaaaatgttttttattttttaattaatttattttgagcggtcattgacgtcctccacccgaaatttggccctaacgactcattctttttccacttataaaatgggcagaacaaatggggcacactcgccgcaattttgcctcacgctcaaaacagcaagcatggaggaaatgtccacatgacgggcgcaccacccgttggccaccgccgaccatccattcttgacatatacaacacatcagatttctgcgccccgcttcgtcgtgctcgacaatgcccttgaccgatgagggcagcgtgctcatctcaaatgcggtcccgatcatccagacgcggtcggcggcagccagcgggtggttgcccatcatcaccacttcgttggctgcccctcgacgagcccttgcgcaatttggtcttcaatcaacagcatctcgtcgtcgtagaaatgctggtcttcgtccgcaagcggctgttgttgcgccacgcccagcgcctcttcttcggcatccgactcaatggtgatgacgttgtggggcgggcgcggtgacaacgtgttgcgcccgcgtgaagagcggggcgtcgagagtcggcgaccctggcgcggctgggcattgagttgacgaagacggcgacggtcgcgcgaacggctctcgtcccgagcaaccgccgcagcgtttgtattcatttggcgaacaattgccgaaatggagcgttgtgcggtgattgaacaaacacggacgggaggcggcgaagagcgaggctgctgctgcatgttgtggcgcgcgtgggcatttgttgatgatgacgatggaccaggagtgggcgggcgcgttgcggaaagccatggctaaaaaatttggaatcatttttttaaatttttgtaccgaaaaatgcatgactttccgcaaaaaacacgcccgcagacactcaaatcccccccactatgtaacaacacaaaaacaacgacacaacaaaagaacaaacaacattgtattttcaaattcaatgaacaaatgtatgtgtgcatttatttgtgtgtgtatatgtgtatgtgtatgatgatggtatgcgagcgcgttttttctttctttgctttttctttctgtttttgtctttcttttctttctttttcttcacttcctcaccgttgacgaaacgccggtctcggttcgcggcgcaacagtgcccgcagatgtcaatgcaaaattcgctgccggtcccccgtcgctgccgccactcccgcggatttgttcgtcctgctgctcctcgccgtcataatcgtcatcgctttgcatgatcaggcggtgctgttcgcttcctgctaaaagcgggggtggggaatgatcagatgatcatttttgcggggtggggaatcgcttcacataccatttgcactcatgccggactgctgatcagtttgatgaggtgccgccatcacattgctgccgccaccgccaaacaagccgtttccgccctgctggcttatcgagccgctgatgacaccgcttggaatggaaatggcattgctgttgctgtcatttgcttcaacaattattggcgtgtttgttgacggcggattgaacacttaaaatgggaaaaaattattattttttaaaatcaaaaatgtttttctcaaaaaaaaaaaaaatagggaaaaaattattatttttaaaaattaaaatgttttttttccacctgtagtggccaccgccgaagagctctgtccaacaatgcggtgccgcgactccgcattgtagagcagggtgaacggaaagctgcccttcgcattgtgaccttgggcgcgcactttgaggcgtgtgaattccacaatttgaccggcacaaatgttgctcatgcgcggcacacactcctgccagccgtgcatcgccatttcgtgctccaaatcgtggtggtcgaagatgatgcgcacgtcgtagccgctgatgtcggtttgggttgtgaacgggccggccaggacgacaaggcccacgacgcggctgaaaagcgggaaaatggaaatgctgaaaatgaaatttaaaaaagcactcacttcatcaccatatctggttgccactccaagtaaatccaccacaggtttgagaaaccattctcaccaattgccggcacaacagacgcaaattcgggctgaatgttgttgttaaccatcttctgccgctgccgtgcatgcacaagtgcaaccgcttcacgcacactgggcgggagcgcctttaaaagaaattaattttgaaattttaaatttttattgccacctcccttccctcaacattggcacaaaaattttaaaaaaacgccacctcaagtccgcctccaacagtaccgcgcaccatcgaaggcatcccaccaccgggacgggctgcacatgaaccgtcacccccgccggccgtcatcagagcggcaaaagtagcagcagactgcaaaaaataaaaaaataaaaaccattaaataagatatattgttcgaatttgtgccgttttacaatggcaaaaatcaagggccacccgaaatgctagtaaaagccctgctaccctttgacattcccccctccccaaaaaacgtacattgttcaaactccacatgggcacatttgcgcccgaaacagcaccattcggttgctgcacaatgccgccgccgttgtccaacgaatttgagacctgtgttttgaaaaaaacatgaaaaagcataaaataaatttcctcctccaactcccagcaaacttacggtcaatgccaatggctgttgtgcgggcagagcgacggcatgcaaagcaccggttgcatcagcaacaccaccgctgccgccattattgttcaaattacgcaccttaaaggattaaaaaatgtaaacaccatttttttgcactcaaataagaagggggacatttggtgcttcatttatcggttaaaaaatatggtcacccgtttaccaagtttttttggctagagagatcccattattatccctcacacacacccgcccccactcccggcttacattacgctgagccaagacaccaccactgccgccgccgtccacatttggcaaagctccatccacgggcgtgccatgagacgccgaattgaccgccttaaacccaatgatttaaaagacaaaattaattttgttttccgaaaattattcaaatttttttgccaaaaatttcagaaaatgccaaaaatatatttaacagagtgccaaaatgacttttattttaacgagtccccccccccaatttgaactcaccagcatttgtcgtccattctccgtgccagttggtcgctgaaccgtctgagcatgctgcggttgcggtgccgtactgtttccgtcttcagtgccgccgatcaacagcagctctaagtcgttgtaattgttgtgttgctgcggttgccgagaacggcttgatacggcgcgcacggttgaagaggtgtcgccgcccacaaaaatgttggcgctgttgctgccgccgccgccgctgctgttctcgtgcagccgcttccgaccggtccgggatgggggcggttttcgtccaccgttattgctgccaccgccattgttactgttgttgttgtggttgtccatattgttggtcgacgcactttttgctgttgatgaacaaatcgggttgaagtgaactgcttaaaaatgtgggaaataaataatttaatatttatttaaaatgtgtaaaaaattgaaggcaaatgaatgaatgatcagaggggatggaacagaacggggtggggaggggggggg

SEQ ID NO: 599 - DNA, 6429 bp, Heterodera glycines
  misc_feature (6343)..(6343): n is a, c, g, or t
  misc_feature (6380)..(6380): n is a, c, g, or t
cggcacaattaatgagcaatgccgttaaaagcagtgacacccgagctctgctgatgacaacaatggccacgattttcaacccgtcgaggccatgccatagcatgatggcaaccatcttcattgatccgggaagccaccggtcattcatttcaaacacggcagccaaacaacttgaactgaccgtgctcagaacggaagaatgcttccttacgagctttggagaacgcgaaccaaagcgttacgtcagcgaccgagtcgcaatcggctttttatgtcccaacggggaccgactcattttcaacttgaacgcactcaagtttctgctcaacaatttgcctgtcctacaactgaacacattggacaagcagcagcttcaacagaagaagctttttccgccgcatgagtcacgacaaccggacgtcatgctcggaatggacgtctggcatgacttgcacgttcagccaattgaacaattgccgagtggatttacgatttgtcagtcgaaaattggcaaaatcatcagcggcactggacgaattgaactcagtcaaccgtcaaatgtgacattcgtccttacggtcacagacgaaaatgtcttcacagcggaagaagacttgaaggccaacgaagaactcaacaagttctacggcctcaacatcattggcatggacgactcttcaacgctaatcgaccgggatgaagtgatgaaaaatttcaaggaaaacttgtcgttcgtcaacaacaaataccaaatcgcattgccatggaacgacagagtggcacaattgccaacgaattatcatcaagcaaaggcaaggctcataagcctcatcagaaagcttcggacaataaacttggtcgacgaataccaagcaattctggatgaacaacagcagaattccatcatcgaactggtcaattctgatcattcttgtggtccagtccactacctgccacacagggcagtcatccgaaccgacaaatccacaaccaaaatccgcatcgtgatggatgcctctgcaaaacccaaatccactccgtcggcaccatcactcaacgaatgcctgcacacaggcccgctacttttgaaagacctgaccggcattctccttcggttcagacgcatggaaaaagtcatccttgctgacattgaaaaggcattcctacaattgggcgtcagagaacaagaccgcgatgccacacgattcctttggcttgctaacccaaaggaagcaaatctcgaacagctgaaacgagaagacttccgcgttttccgattttgccgagtcagtttcggattaaccgtgtcaccatttctgctcaatgccacaatcagggagcacctggcacttcacgacacggatgttgcacaacgcatcagtgacaatctttatgtggacaacatcatggtggaaatcaaaccaagtgaaaacagcaatcaactggtcacagaagcaaaaatcatttttgaatcagccggaatgcggatccgcgaatttttcgggagtcacatcgacgagctaaaagagcttgactcatccgaattggcccaagacctcgaaaacacaaaggtgttaggcatcgaatggaagccaagacacgatcaactgatcttcaaaatgccaatcttcagcagtccaaccacaaaacggaagattctgtcacacatcgcaaaagtgtatgacccacttggacttatttctccagcactgttgcccgccaagcattttttgcaaatcgtccaaaatttgaatttcaaatgggacgatcctctgccggaaaaaatggcacttgactggatcaaactaatgcatgcgtgggacggattcggcttcaacttcagggtggaattccctcgtcacatcgcgacaagtcccaacgaagaatttcattgcttctgcgatgccagcaaaacgggactcggtgtcgcgctttatcagctcgcggacagttcttacggaaaaaaggaaagcaacttgatttttggcaaaagccttgtcaaaccgctcaaagtggccgaccacgattcaacaattcctaaattggaactgcaagcgttaactttgggagtcaaagtgacaaagttcgtccaaactcaactcaacttcgatgaccaacaagtcatactttggacggacagccaatgctctatcgaacgtctcaaggaggaacggaaatacgacagattcgtcaacaatcggctgaagaaaatcagagaagcacgtttcaaagtcagacacattcgaacggatgaaaatccggcagacatcgcttcacgtggaacagatccacagagtctccaatcatcattgctttggcgatttggcccagtgtggctaaccaaagttagccaatggccagaatcaaacgtcacttacaaccccggcgaagaaataaaggaagtgacggaacctcccattgtcgaatggagtaatgccgtccaacagcgcgaagaattcgttcctgcgatccaatttgagcgcttctcaaattggaatcgtctcagagcaacagctgctcacgtcatccgattcacagtggccatgcttcaaaagagacaaaattccgagccgacgagcagtccgcttctcacacatggacacccattggaaaaagggccattaacagcaaaggaattggaaatggccgacgaatggattctgatcgaaactcaacggcaaaattggccctcagaatccgtcatcactaatttgaaactcttcaagacaaagcctctggaaacattgaagtgccaaggacggctaggaaatgccaacctgcccatccatagcaaaaatccgatatttttgccggctgaggcatggacaaccaaactcatcattgtccacaacgatcggattcacaatcattgtggaccgaggattcttctatccaaaattcgcgagaaattttggattccacgaggcagacaaacggtccaaaatgccctttactcaagtcgaattggatgtttggaatgcaaaagggaaaaactgaaaccatacgcttatcccgaggctcctaatttgccaaaggagcgagtcaacgagacacgaccctttaacaacaccggcattgactactttggtccactaaaagtgaagagaggactcgaaacggtgaaagtgtatgtcgcactttttacctgcctcaccatccgagcaatccacctggaagtggcagaagactattccgccgaagcctttctccgcgtgttccggagatttgccgcacgacgcggcgtaccaagagtcatcttgtccgaccaagggacaaatttcatcgctggagccaaggtcatcaaggaaaattggaccacagacttactcacactcgaagtgcaagaacagctggctcatcaaggaatcacatggaatttcaacacagcccatgcaccatggaaaggcggcacttgggaacgactgatcggcattactaaaaatgccttgaggagaagcattggacgcagacttctcactttcgatgaattcggcacgctcgtcgttgaaatcgaagcaattgtgaaccatcgtccgttgacttttgagtcagaccgcgaaccagacccggtactcagaccggtcaattttttgatcccgtacggatcaacggaaaccaattttccgtcaatggcaacggatccggaagatccagaatatacgccgaatcccaacaagctgaaaacgatgcttcagaaggctgattcaagactgaacagcttttgggaaatttggagatccgactatctcctttcactgcgtgaacgtgcaaaccaacggttaaacaacgaacgacaaactcctaacgaaggagacattgtgcttgtggaagaagaagcaaatccgcgatcagtctggagcttggcccgggtccttaaagtccaaataggacgggataacaaatcccgttctgcattaatttcccacaagggaaaagaaaaatggagagctgtaaatcagctctacaatttggaaattcaacccgaatttccagaaatccactccaccgctttcgtcatgagcaacttggacaacgacatcgacagcgtctctctcgccggcagtgaagatgaaatgccgcagccgaaaaataaattccgcattccgaaacgcaaacgggcatttcttcggccaatcccgcagcagcacagtcctcttcaaggaccgcgtcgcaaaagaagggagttacaagactccggattacgcaagctgttttgcgcaatatcagagccagaaggcgggagcaaggcaactactgaagctgtcaacgaaagccgcgccatggaaaaagcgccgcaaccgatccaaaaagaattcaacgaaaaaatggcgaagaaacagagagagaaggcacggataaaaacatcggatcgattaaagcaaaaactcgccgatttgtcaagtgtatctgcacaaacggaagcggaaaaagatgaacaacagaaggagagagaaatccacgatcagcagcgagctgaaaggcgaaatgaagtaaaagaagcattcgaaaaaccatcgcgcaaagaaagagaagaagcacgctcattttggagtgcgaagaaggccgaatcaatgaaagaaaaaacaaaaggccgaccaatcgaggacatgccaaaaaacaacgaagttttactcacgtactgtcaacggatttacggcaatgataattggcagtttctctggaaaaatggacgcacttccagggagcttcatcagctcgaaacgcaaggatggacacttcatgaccagaaaggaaaaatggtcgaaccatccgaattcctcggtggtactcgaccatccgtgaacgtccgattcaaagaaggccactacaccaatctgacaccggaagaaatggtcttccatggcccaccggttagtgagagcgaacctgaaccggaaatcgtagtcacggaggaagtatcgtcctcagagcttcaagaagaaaacgagcgacgagtccgagagagcgggacacactcccccaccgagcaccgcacgttccgagaaccggaagagttgcgcgattgaatgttaccgaacgagagctggccgaaaggagaacgatacgtcggttgataacgattttaaccgagatgttctggtgaacgacacgagagctgtgccggagtgcacgtatcggcgaaattgcttcgactcgcgaaaagagcgattgagatggattcgaagattgcgagagcaatttctctgatgaacgcgaatgcttttcgacttggtccagcgacttttaaatcttcgcggcgaaacggtcgtcctccacgaagaatacgtaatgccgtccaccttgacaccgaagcagttggctgagaaattttggaaagaacaattcgtcaccaaaaatcggcaactcgttaagcaagaatcgctcattgatctgctgaagcaatggagcacttcgtgtgatcactttggagcattaatgcagctgaaccaatttgagccaataaagctcaggccaatctcaatcaagggaaagaagcatcagaattcgagaattggctcgaaaacctcaacaaattcaccgcaaatgtcgcttctcgaacaaaggcagccatagcaaaccagccctacagcaaccacgaaatcatttgcgttggcgatctggcggcagaagaattggcgaacgcctcgaggactcaatggttcacgcactacgcctcggacaaacttcatctatcccctgggcccgatgtacagcacatcattttctgctacttggccaatgaaagctacttagcaaaggcatcactccgtacgtccgagaactcgcaaagacggacattcaactaaccatagtgttagcaaaaacggacgacaaatcctggctcaaaaacaagaatgaatgctaccagttggctaaagcggccaaggcaggctttttcgtctaccaccggcgaaccggtgaatcaagacaattaaccaacatgatcttggcgcgagaagaagacgaaatcatggaagttgatccgacaccttcaacatcagccgcaagcagcagtggacttatgtccagaaacacaataaacacgctgatggtcatcagcatgttcgcgctgatgttccttcagccaacagcagcggcaccgttacgcattcatcgagcctcattaagccaaaatgcacaaagattcctccaaatggtatctgcacactacagcatactcacaactgcaccgccgtctgaattaacaatcactttgagcaccgcactcccaccagtaacttcgtgtggtacagcacaagcacaataactcgaagtgaaatgatgaccaccacgaagacaaatccatggacaacgacaacatgggcaccgatgaccactgccnaacacagatggactccaacgatgtcaaccagcgcatncactcgaacgacaaacgaacccgaatccatacgtcacaaagaaagaagc

SEQ ID NO: 600 - DNA, 4828 bp, Heterodera glycines
ttggtgcttggggatgacggaaggtcaattggactcctcccgggggtcttttcttttgtcctttttgagtgtacgacggaggtcaaaaggcgtgaacgaatacagatacaaattcatccgacaaataattattcggacttatttgttagggaaaagggcaaaataaaattgaacaatcggaggaacggcaaaagcaaatcagccaaaagggagtaaatcagcggataaattaatcaacctcaaccgaacaggaaaacatgaattaataaagaaatgaaaatgagaggaaacaacagccaaaaattgattatattaaattgtcattgcctttttaaacgctttttcaaaaaaaaaaaataataatttaaatattaaaggaacgaagctcccttggcaaatgtctctgctccctcttttctcaccattcttcacccaatggcatataaatttcccaacccaaacatctgtaggacctctgccgttgtaaattggtcataaaaaccattgacggattagttggttttattagaatttggcgacttggacttttaaaaatcagttgttttgtaagtagaagagatttttttatgaaattgggcaagaaattaactgaatgcattactgaaagtgtatttacgtattaaaattaacaaaaatgaagcagcaacaatactttcttaaagcaaaaactcggcaatgagttctgtgactgtgctgattaagccatcccagtgtcatcgtcgtcgtcgtcctgccctttgggtgcccttggctttatgccgcccatcggtttggccatgattatctaaatagaatgaatggccattaattgacaaagcgatgctcccgcaaatgtttgtcacctgatcaatcttcagcacagaaatggccgcgttcgtcgccaattttaatgccaacgatttcccggagtaaaggtcgaaaatgcccgcttccatcgcgttgcacaactttccactgaccgcgtccactccctcccatttcgaccccttttggtgcgctgcgtgtaaatcggtgagtgtttcagttggctaaaattccttttaaacgatttgtcacttttaaaaaatgttcaccttaagccctgcattttcggccaattgttttggcaaaatgtccaaagcagtagcgtattttttgatcgcatattgtcgaagtcccgattccttctcgccaataatttcaatttggtggcttaattccacttcagttgcaccagcacccggcaacagctgaacaaacaaatgataatgtttcattcgagccatcaaataaagataaatcgaatatttaaatccatttacaaatatagaatgaagacccccccccccctctcgattaattaggcggaattggctcactttgttgtctcgagtcagcgctttgtaagtgttcaccgcgtcgtcgattgccctctcaatgtcatccaccaacgactgggaagacccacggacaacaattgtggcaactttcccaacttcgcttttcttatcgaaaaccacaacctataaatttgttatggtctcctcgaactttttgcccatctttccacctgagtgtcgccaatttccttaagaaacacttcgtcacaatggccaattgcttcttctgacggtgcacaaatgcgcgcctgcgcctgggcacccaaagttcggcaaagtcttcgcaaatcgaatttcgaagtcaatcttaaatcattgaatggcttccgaaaacttctatcgtcacaccttacggccataattccatatttgttcaaaaaatgcacgtaaaggtctccaaatttgccggcagcgaccacaacattaacgccgacatccgaaagacttttcacttgggcttccacttcggactcctctgtcctgctgaattgcaacaaatcatccgccgtgttcatcaaaatagtcccctaaaaggaatccgatgcttttaattaaatgcaaaataatttgtttttttttttcatttttgcccaaaagcgaacctttgtttcggtttgcgtaaggtcaaatggacacgcgaaaacgaccacacgcgcatttgacgcgcctttaacttcgccttcagcaccacggcgaaaaagcattccatttgtcacgtacgaactggccactccggcgccaagaattttgcagattcgaatgttatcgacattgaacgcagtggtattgttttttggcattatttgaactaaaacaacgagaaatggagatagaaaaattgtaatactttaaagtttattaaataagtattaatttaccacaagctttcgcaacaagatcagaaattaactcgtaatggtccgtttgttttgagataagcgacgatttgagataggatcgaactttgacaatgtcatataaatcctcagcagtggaaacaaccaatcccggcaagagctcctcgactttttgaagcgcgaattcgtaacccgacgcaatttctactgcggtgattccctgaaagcgatacaacttaaattgtttaattaatcagcagaaaataacaaaccatgtcaagcaattgcagtgcgtgctccagaaacgatgcagccaaaatgaccacagtgttagtgttgtcgccaatttgcttttcctgcatttgtgcagccatcaccaaaattcgggctgccggatgctgcacttcgagttcattgagaatcgaaacggcgtcgttggtgacgaaaagtttctccaaacgattgatcaccattttgttcatcccttagagagtcaattaaaacttttaaatgaatttaaataccatttggtccataagcagaacgcgtctgaagtgcaagttgcatgcaagcttcaatatttcttttcactgcttcttccaaccctttgaagtgctaggaataaacacgcctcatagttttgttagaaaatcaaaataacaaaccatggccccctccttcataaagcgggaataccctgactttggaattgaaagcgccatattcctcaataacaatacgaagcaaaaagttttatcctgaacaagcaaaaattagagaccggaatttccaaaaatgccgggccgggccgggctgatttttccagaatcaaccgggttccgggcccgcctctcaaaacccggtcaacccggttagcccggtcaacccgggtttccccaaaaatcgccgggccgggttgccgggcccgggaaaacccggtaccgggcccggcccggtccggtctctagcaaaaattatgatttattgaaacagaaaaaaacttcctttcaaatttaaacaagcaagcggagaatttcaacttgaaatgtacatgggcaaaaacgaaaagcctatttaaatttattttgctggtgatatgtctgtctagctcttctttaacttatttgttagagttaaagcaaaaagagagacaagaaaaagagatgaacgatggatggacggacggatgacttgagaaggagtccgccgaggtgacttaagctcaaacgaagcattggaggaacgagcaatggacggagaaaggaagcgaagagcaaaggcaaagcagcggttgtagggaaaatatgttttaactgggctatgctatgccttcctttctgtttattgaaggtacataaggaagggaaatgttgtgttaagaaacggaaagaggattacggggtgatggcgagggccgggcccctgggggaggggcgattggatattgtgggtgaagaggaagacccaattttctatttacctactttccttgctgttgcccacattctcacaaatataatttgcccttgagataaattttcccattgcctgtgcctgtcaatttgccttttgccatacataaatattattgactttcaattttaggttttcactttttcaatttttatcaattacaaagttggaagtgaatatgcctaaacaaaagcctaaaaatgatatcaacgaactcaagcaggaagtgtccatggatgagcataaaattccacttgaggaattgtttcgacgatttggaagctccaaggataaggtaactttaaatgacctagtcttttcaattgttactatttcattcaaatggttactgttgcttatgccagggattgaccaaagcgaaggcgaaggaggtgtacgaccgcgatggtcccaatgcgctttctcccccacgaacaaccccagaatggatcaaattctgcaaaaatttgtttggcggctttgctcttctgctttggattggtgctatcctctgttacattgcgtattctgtcgattgctttaccatggaacgaccaagcaaggacaatgtgagttcatgtccaatttagttttaaccaatacatttccagctttatctgggcattgtgctgatgtctgttgttatcatcactggctgcttccaatattttcaagagcgcaaaagttcgaagattatggaatcattcaaaaatttggtgcccacttacgcattggtcattcgtgatggggagaagacgcaaattccgtcgagtatgttggtggcaggcgacgtcgtggaagtgaagggaggcgaccgcgtgccagcggacattcgaattgtgtcggggcacggcttcaaagtggagtgagtgctgtgtttgtctaattgctaatggttttggtgcttttcacttgaagcaattcttcactgaccggagagtctgagcctcaatcgcgttcggcagagtgcacaaatgagaacccactcgagaccaaaaacattgcatttttctcgactaatgctgttgagggaaccgcgaccggagtggtcatttacactggggacagaacggtaaggcaacttgggaagtattgata

SEQ ID NO: 601 - DNA, 2265 bp, Heterodera glycines
  misc_feature (2141)..(2141): n is a, c, g, or t
  misc_feature (2165)..(2165): n is a, c, g, or t
tttgtttaaggtcatgggacgcattgcacattggcttcggattttggatgccgggatgacgccaattgcacgtgaaattgagcattttatccatttgatcaccggcgttgctgtctttcttggcgttacctttttcttcattgcttttgtcctcggatatcattggctcactgctgttgtttttctcatcggaattatcgttgccaatgttccggaaggtatttttttaaattcattaaatccaatcattttaatattttttcaaataggtctgattgccactgtgacagtctgtttgactttgacggcaaaacgcatggcctcgaagaattgtttggtgaaaaatttggaggcagtggaaacacttgggtcaacttcgacgatttgctctgacaagacgggcactttgacccaaaatcgagtcatcatcattttccattgaattttttattcaaattccttcagatgaccgtcgctcacacttggttcgaccagcaaatcgaaacttgcgacaccactgagaatttcacgggcgacagacacaaggctcgcgagacggagacggcactgttgcgagtcgcctctttgtgcaacagggccgagttcaagcctggacaggtcggaatcggcgttaaacggaggccctggaattgtttgtttaggattcggttccgattctcaaaagggaatgcaccggcgatggttagacttttgccttatgattaaattaatcattgacaatattccgttccaattttagcttcggaagttgctctgctgaaattcacagaaataaccgttgggaatgttgttgaatatcgtcaaaagtatcactttaatagcatttttgtgtaacaatacaaattttagacatcgaaaaattgccgaaattccattcaattcgactaacaaataccaagtttttcttttattacatcgcataactctgtttatttgctttcagttgtccatccatgaaaccgacgacggccaccccggttatttggttgtgatgaaaggcgcacccgaacgcattttgcaacgctgcagtcacatgctgcttaaaggacaggtgggaaatggtaccgacggaacagattgacacatttttaattaaggatgtggagatgacccaccaaatgcgcgaagacttcgaacgtgcctatttggagttgggcggaatgggcgaaagagtgctcgggttttgcgactttcgcttggaccacgacaaatttcccaaggtttttggagtcttaaggttctcccattgctttttatgttttttagggatttgagttcgatgttgaaggccccaactttccgatcgaagggttccgttttgtcggtttgatttcaatgattgacccgcctcgtgctgctgttccggacgccgttgcgaagtgccgtagtgcaggcatcaaagtggtgatggtcaccggggatcatccgaccacggccaaagcaattgccaaatcggtgggcatcatttcggagggcatggaaactgtcgaagatatcgccgttcggaaagaaatttctgtggaccaagtcgacccgaggtcggtgttaacggaaaacggtttgagattcgaaattcagagaagccaaggcgattgtaatccatgggagtgatttgcgcgagatgtaaataattgacccataattgcaattcttccttttttgttttttaggaatgaggaccaattggccgaagtcatcaataaccacgatgaaattgtgttcgccaggacttcgccacagcaaaaactgatgatcgtcgagggatttcagcgtcagggacaaattgtggcagtcaccggcgacggagtgaacgattcgccggcactgaaaaaggctgacatcggagtggcaatgggtgggcaaaaagtcggagaacgtaatgaaataaatttgtaggaattgccgggtcggacgtgtcaaaacaagcggcggatatgattcttctggacgacaactttgctgtgatttattattataattatttgtttgttattttttaattctttgaacattcagtcaattgtgaccggcgtggaggaaggccgtctcattttcgataatttaaaaaagtccattgcttatacgatcagctctaacattccggaggttgtggtttttangtttcctaaaaacttccattttanagatcttacctttcctgatgtatgttctgttcggcattccacttccctctcgcactgtgaccattctttgcatcgatcttggcaccgacatggtcaaaat

SEQ ID NO: 602 - DNA, 3725 bp, Heterodera glycines
ttcattgacctacggacaaattggggatgattcaagcctcggctggtttctttacggtttgatgatcaaacttattgttagtttataacccccaatatttcagtacttttggataatggctgacaacggtttttttccaaaggacctttaccaattgcgtgcgcaatgggattctcgtgggattaacaatctcgtggacagttacggacaagaatgggtagatgattaatgatcaacaaaacttcctttttatccttatcatcaagataatttaagacttacacggaccgaaagattctcgaacacacttgtcaaaccgccttcttcgttagcattggtacgattttttgtgccaaatcaaaaatttaaagaattccttcaaaacgacaaaccgagctatctaattgtattccgtttaagtgattgtccaatgggccgaattggttatttcgaagactcgtcggaattccattgtccagcaaggcatgtccaattgggtgttgaacttcggcttggtctttgagactttgttggctgttttcctctgctactatccgggtttggacacaagtctccgtatgtatggacttcggtaaatcgctttttatcattttgtccacatttttatcacgtttcctaaggttctcttggtggttccctgcactgcccttcgctattctgattttcatttacgatgaaattaggcgctttttaatccgtcgtttccctggcggatgggtggagagagagacgtactactgaagaatgatgacggtttaatgtgaagaagttctgcaaaacataaaccaaagcgttttttcagatcaaatgtaattggtatgtgtgtatgttattgtataatttggctgttattctgtaaataaattgttgttcttttcatggtgttttgtttgtttggttctgtccattattacttttgcctttcttccgattagtcccccgtcgttcgttacgcctgcacattgcccccctgggatgactttcggtttcgcagtccctcctccgcccgtccgttcgcatcgttcagaagtcgcagcattccgttggccgtcggcgttggcactgcggcggaatgcgtcggtcgcttcggctgctcctccccgacgtgttcgttcagccagtaggtgttcacctcgcccttgcccttcaccttcacaatgcctctcttcgtcagtttgtaccgtcccacgcccatcagtttaagcgccgttggctcggacatttgaatttggtttggcgcagcgttgctttgcatgcgcgaggcgaagttcacctgcgaatggcggcacatacacttacaattaaccaaccatcagttttggatactgtcatcataccgtatctccgaacagacagtagcgcggggctttgatcccgatcactccggctgcgattgggccgcaatggtagccaattcggagttgcaacttccactcgggaaagttggccgccttatatgtgtaggaagcttctcggaattccagcgccacttcactgatttcgaacacgtgacggttgtcattttcattgggcacgccggaggctaccatataagtctaaagaagggggaatggtcacggaattcgggaggacacaatcaatcaatgatccccccccccccctttttttttgctgatcagtccatccgcgggtcatcgctcacctctcccgtcgtctccactttgtaagcgtcgtggttgcggatgatgttgttgaaagtggagaacacttggttgagaaagtcgaccacttgggtcggtgggaatttgctgagcactgttgagaagtcgacctgatcagaaggaactgatttgtgtgctttgtgttggtcggcctcaccaactgacagaacagcaccgtggccgagtcgtacgagcgcggctccaccgactgttgctccttcacaaatgccattcggcggtgcctttgtcccttccgtccctccccccccccccaaccacacgcaccttcaactgtttggcaatcgacgggggtaacatttcatgcagcagccgttccgtctcttctcgtgccaccgcgagttccgcgtttcgttgcgccaccaaattttccaaattcagcgcgtgcttttcgttcatccgtcgcatttgatcgattaaattgccctgcgatgcctaaattgtcagcagttttcatctttgagttcgttctgtctttcctcccccaccccctctcatttttttgcctggaacacgttggaaaacacttgggccaaatgacggagtttgggcctcagttcggggttcctctgccagcactgttccatcgcgtccactaactgtcaaaaaacaatcatttcgccttttgccgtttttctctccaattgccggcttctcttctggcgaagtgttctccaggattggcttcagacttcttcgcttcacctcctcaatgatctctttcgggctcaaagttgtgcgatcaaacggggcgagacgaaacaaaatgtggtaaagagccatgccaaaactgaaagtggcatttaattgggcattaaataaatgaatttggacctgtacacgtcgcctaagggcgtgccgcggggatattccctgccataggcaatttcactaagattttccggagcgatggttaaataagctgaaaggaaagcatcgttttgagcagtgaaatgctttcaaacttgtcattggaataatctcgactaatttgagctgttcgcgttgaatacagcagtttagcaaattgcaaatgccaaaattggtcaatttgagcacccaattggagtcgatcagcacattttgcaggttcagcaggccgtggtatccgacggaggatttgtgcaaatattggatgccctttttgtgaaggaggggagggggagaaagaatcatcagcaaattgaaactttgagaatgtcgcggagaaaggcagagcggaaagtgttgtccaattggaagtcaaagtcgttgatgtaatcctagcaaataattgagaagcttttccgtgccgtcctcactctctctctctcttctctcgccccctctctttctcttctctctctctcacttcctctctctctcgctcacctcgagagtgccgcgttcgaccagcgaatggcacatgtaaaagcggtccccttcgttgtaggagatgcccatgaatgtggtctatcaatgacaattattataaagagccaatgaattggtccgatttttaaattctcttttatttgaccaaattgtcgtggtttagccgcttcagttcgaaaatgaaatgcaggtccgtcttttcccaacttatgcttttcatctgccgcaacacaatgaattcggctttgttcgtgccaatcaaagcgtacgcttgcaattgtcgccgtttgctccacgcgccttcttggccaagtccggtgccctttccctttgactgaaaccgttttattttacgtaaatgtgccataatttacgatgataacgacctattgggtcctttaattatccttaatttgtcatgccgagtggaaatggatgaatgaaatgacctgtttgttctcgatgactttcaactgatttcgcgtaattcgccaatgcattcggaaaacatccaatcgctttctgcaattaattaattacccccaataattatccttcaaaaccactttctctgcactccgtagccaattactgccaaaaggattagcaaagcgatggctaccgccgctg

SEQ ID NO: 603 - DNA, 4512 bp, Heterodera glycines
  misc_feature (3058)..(3058): n is a, c, g, or t
aatgggacagtgccaaaaggtgggggagtgagaggccgaagtaccgtcgaaggtttgtctccgcatattcgaagagaaaagcggttgagaggggtcggaggtccacgaggagggcgaggagagtgccgatgcggcacagaaggcgaagcagccgttgtaagcggacagagcggggagaaggaagttctgcaatgggatttcccctcggtaggcaatgcgcggcaatgtcagtgggccctttgcccaccgtgttaaagccacgcgtgccgtaggcggacgccaatttttgttgttgctgctctcgctgggagtcgaatggcgacatcacaaccacactcccagcggcaatttgcattctgagcagcgaactctgctgactgtccgtgccattgatgcacgcctcgagttgcactgggcacacgagcagaaccatatacgactgtgagccgaggtcgtcaatttggagggaattcagcatggagccaaggcggacgaaagtgccgtcgatgaggaccactgaatgccaacactttctatagtgggcggtggtgatgctcgagagtgcgactcccgagtctccgctattgtcgttttttgtctcagtctcgagttcgatgcaaaattcatactttctctgcgttagtttacctttggtggcggaacggagtcgaagccgtgcctttgtccaactgtccacgctgttctggtcgacttcgacagtgtccgtcacattcagtctttgctggattccgttaaagcgttccgcaaatacttgtgacaaactcttccacaaaggcggcttttcaatgtccgtattgatcggaccgaccaaaacaatctgagcggaagaattcgattaaacaaatatggcctaaaacatttaacttcgctttggttcatcgcgccaatgaattgggccaccgcttgggccattccgtacacatttgtgtctgtgacttgtacgacagtggggaaaagctctcgacgaagtaaagcaatgctggtgccgacgcggttaattaccggcactaatgagttaaaatattttcaacaattagacagatggttttgcctcgccagaaacgggcaagtcggcccaactcgcgcgcctcctccgcacagcgactgcccacaaaagcttgcacattttggtagaaatacaactcgccaacgtggacagtgccaaaggaggcgcttttgttttggttttcactgatggacgaaaagtcggacaaagtgccacagccgcaagagacattcatcattctgtggggggggggggtgaacagtccgagggctgtcgttgtttctcctccgttggtttgccttcgcattgtttccccccccccccccctaattttttgccatttattttttcaatttttccaaatattcactcactgaatctcttccgtcgtgcattttccctgcgcgcgcgcgtcggtcaaagcctggagacagagggcgacgagcaaagggtcagattctacgaggccgactttgagcaaggacagaacataagggaggagaaggagaagttggagcagtaccacggaaaagggcatttggtgaggaaaaattcaacgggagaatggacaattggggggggggggggggcttgagcgcggaaaaggtaaaataagtcggaaaagtgggggggggggattacagcacaattcgcggttaattgccacgcagggggacggacgaaagggtgccaattagtgagctcatttgcgcaaaagccatctccacaatggcaaacaatgcttcatcaaagtttattttgcattggcttcattttttggttttaaatcactttttcactgattccattcacaaaatcattattttatttaactgcccttttctgttttattttttcccctttttcatttcgacatttttgccactttttcactcgttaatttcttttcgttgctaggcaaaaattgtgccattttcatttccatttatcgttgaatacaattgttcttttcaatgcgctttgcttctgattaatgcccgtgtttggactcgttttgttctcgtcgttaacaaaagtgcttttgccactttttccctgtttttctgtgtccgttgccgcttttcctctcatttttaaatcagtgacttcgtcccattgttcgttctgctgctgcttttggcaatgattggcctttgattcttccgatttccctcccaaaatgccattatcccctgtcctcattctcttccgcttccttccgcttttccttctcctcctccttcccccagccgttgttccgcttcagtgttttcaaactcagcattcgctttccgcttctctgcagggcaatgccctcagctgtccctcctcctccctctcttgcaccaaatccaccgatttcaacatgcaaatcatcgcgcgcacctgtcaaagcacaaattgcacggtgagaaactaaaaatacaaaaagaaataattaatttctttgcggttggccattgattgattaataattacgtttagttccccaacggcactctctcctccgtgccgttgtgcttcaattcgtcctcaaatacccagtcgtattgctgctgctacggcgacagttgcaacggaatggcgaaggaacacaaaaatggactaatgaccttcttattgttgttcttttgcattttaatgggagcgatggcaatgaaaaacaaaatttgaaggaaaaaggcaaatattaacagagataaaaatgataatagacaattcaaatcagtagggaaaagtaaaactgatcagaaagagaaatgtacatgatcaatcgatccaaactagaattgaatggtcactgatcaaaataaaaatcaccgataagtcttcaaatgaaaatgagctaaattagtaacgacagaaaaggaccgaaaaaagcaaattaattggtggtgccctaatattgtcgtgttatacttcaaccatatatcgggtgctttcatgctcttatctcattttggcactcaataacaagtaatggctctcaagtaataccagacatctcgcccccagcggatggcgaagtgngcgaaggtggaacactttcggaattggacatttgcagactttccaaaatatcattaaaaggaagcaaaagaaaatcaaaaaaataaattatagaagaataacagcagtgaaaggaatgaagaaaaacagtgtttatcattctgcaggcaacaaaatcaacaaaagaacgccgcatccctgtgaagaatcaacgttcacaaattttgcggaattattccatccctctgagccaagcgcagaatgcaatcatccgactcgccctgcgaaaccgaatttttttaatataaatcccttccaattacgaacgactgaccatgaagcgcaactttccacaaatggcgtacttcgtcgttttgccggtaatcattcgcccagtcgcctggtccacctcgacaacctccaattgaatagaagcgtggtctttagccgaaatgattcgagaagacgacgaactgacaagaaagaaaaataaaagtaaacaaaagattcaagaaagcatttaccatttcctcgggacatataaatcaacgaaatctcccgcgtcgttttgcattttgatagaagtaagtaaagctaacaagataaaaatggtaccgtataaaaataaacaaatatagtacgtcataaaatcataatgacaataaagcagaaggaaatattcgtttatactttttaatcattgtatttaaactgacaatgagtttctaataacttggtttctattatattgatacaaattacggttttttggaagcatcatcaagctttttggcctcaattttgcctgccttttgaatgacattgtatccggaggttatcgattcgtcacgaaatgcagggaaaacctcccacggtgtgttcaagtcaaacttccggaactcttgtgtcatttcggttggctcataaatcactcggttcagctcgtggtcccaacgcagttcgacgtatccggacaatgggaagtcttttcgctggggatgactaaaagtgacaacgccataaacaaatataaatacaaaaaggaaaatgaataaaataaacttgcccttcaaacccgtaatcggtcaaaatacgtcttaagtctgggtggttgttgaaccaaaccccgtacatgtcgtagatttcacgttcataccattcagcaccggaaaagactggagtgatggaatcgattggagcaacctggacaatgaatcgaatttgttatggtgaaaaaccaattagaaaaacgcacttcgtcagtgtatgtccgaactctaatcctcgcattgaatcgatgcgacaaaagagcgtaaattacttcaaaacggttcttacgcgtaggaacgtccaagccacaagcgaaaataaaatttgtgaattcgggcgagtgatgccctttgagggaggccataacgggcaagacacccagtgggtggatcagaacttccaattcatccccaccaagcaaactt

SEQ ID NO: 604 - DNA, 2347 bp, Heterodera glycines
aagagagtcagcttctccccgcttttgttcatcaatcacgtattttgtgcctattttacttttttttaaacattcagcaaaaaagttgcgtacttgtctgtttttttacttcctgtgcttgtgcttcagtaccaggcgcagcataacctccggtctgaaaacggaatgctgttctggcgttatatatcggttgaagtgtttttatggttttcctgagcatattcggtcgctattcaaacatctaaaattgaagtaaagtgaaagaaatactcctctccctctagatgaaaagtgacgttcaaaattgaaaaggattggagacgaaaatgttattcatccacttaaccctcagattccaaaagctgtgcatcagtgtatttgatttatagtacaaacataatgccaataaaggaaaataaatttttaattctttttttttccttagctagtgtataaaaggtggaccatttttgagttcttcatactaacattttatgcaactacctattttcttttgccgaaaagtgaggggcgccatcggtattattgttattatttcgaccacttcatttaatcgcttcatatattcgtttaatcattttttaatgaccattcctaatttagccaaatattcaaatataaataaaaccaatggctgtcaaagacgacccaccggaaattaggggtaagttgtgggcaatcatgaagattatttgtcccacaaaaaaaaaaggaataaaaattcaaaaaacacttttttaggggttatttggtgcgctgagcacgaatttgaccttcttttgacttaatttcgaaccccgaacccggattcgaacatttgaaaaaattcaaattttcaatttttgcaaatattgctgatgcattgccattggtggcaacttttttcagttggtatgaaaaccgggacatgatcaggggactttgtaagattttcattgtttaaaaccaggataaagagaggagttaggatgttacccctgaaatttagtaacctaatgttttcgaaagggtgaatttaggaagttccatttagaagctgaagagacttttcaatctggcaaaccatttctactcccatcgtctaattacctctggaaaaattttcgcgaattccgtttccatcctttggacaaaatccaaagaaaaatggcgtttggccagctccaattctttcagatcattatcgactaaatttggacaaaacttgcttttgtgaaacttttgtgtgacttacacttcactttcgtctcactgatcaatttgtccaattcggccattttctcagctgaaaagttgtgcttctggcgcaccatttgacttaaattgcgttcaatttttttactaaacagacaagagaaaatatatatgaatttgtttttggaagggataaacaattatgtttaggatttaacctttttagggatcgtattaagaagcgggcaaggatttcttgggaaccatattccccttttcgggaaaaactggaatgttgtcgcaaaaaatctgcttatcaattctcgatacacggtttttaaagtttaaatttaaatttaacttcgatattattttggcgtaatgttttccttccatttaaatttttttcttcgttcctttcctcaagactatagagttgtacgggatcgggaattttggacaaaccgggaccgggaccaaacgcatgaaaatcagcaaaattaaacggagaattgctaattttcaaattcagaccccccccccttactttttcccaattttgtcggattggggcggcgagtgacgacgaaatcccaataaaaatgattgaaacggaaagcatcgacgagttggaggaggctgcatttggggagcatagtgaacgcgcggagggacaacgccctggcggacggtcggacgacgccaatttttacggtccctccgcgcggcgttcgccttcctcaatgaccagcggtggcagaggcacaacaacagtccacacacgcaatttgctcgctttttggtgagttatttgttcttgcattttcaaaatggaaatttagcgattccaccgtcaattttagtgtacaaaaaatcgcattcttcacaaattcgatacaaagcaatgtagaaaaatccaaattttaggctcttaggcctttgcaacaatttcggttacgtggtgatgctcagcgctgcccaaggacattttggaacggtcggcaacgctgcaaaacgacacggttctatgcattataaaacgaatcaaacttttgaatttttataaactttttttttgcacttttggcccctctacgcgttctcgaaaaagaaatctgattttgcgataaaa

SEQ ID NO: 605 - DNA, 492 bp, Heterodera glycines
aacatattctgtatcaaaataaacaaaaaaaaaaaaattttcaaaaaggccactttccatatagcgccgcaattttttttattcgccactcgattcgtttcctaatacttcattcttctgcaggtaaccagcttcataattgtcgcattttccacttctttctccgtcggattgcttggttcgaaatagcaaaaaaacttcaattttttattttttgcaattttaggcgtaatttttgccagctttggtgccggacttggcgaagtcacttacctgtcgctttcgtcccattttcatgggtaaggaaattttgacatcgtccaatcaccaatttcttatgaaaaaaagatcaccgaatttatgtttgaacctaaaatctcgccgcctgaaactttttcataaaaaaaggtaaaggcccttttttcggcgttttatgatgtgttgctaccttaaggaaaaaaaaattttcttataaacttttttttctttcgg

SEQ ID NO: 606 - DNA, 1465 bp, Heterodera glycines
aaaaggaagacggaccggaagacaaacgccaccagaagagggagagaaacgactgggggtggggaggggggtaattagtgggggggggatcaaattctgttggttgactgataatccatttgctgacggacaagtcctttatcgcccgcacccccgcccattcgcgcatttttgtcattcctctctccatctctcctctctctctctctccatctctctctctcctccccccctcactctctctctgctgatcattccatcccatccgtccttttgcgtgtgcattatcttcctctctcccccaccctccggcgttaattcgattatcccatcgcctcgtgttagcgttgatcaaagatgctcgccgacaccgtccaataattgtcgattgctgaaggcgttgagttgaaagagcaaagaaagaaagaaaacggaggggcgatcattgggcatgctaaattgagcgcaaatgcattaatccgattcaaagatttggagaaaggacgggggataatttgacgaagggatttgtggggcagaaaaattgggtgattttggattaacgccatggcattccttccaaatttggcgttttgttttcattaattttttcttcctctgcttacgccattgcatctgtctttcctttttctgttctgtgtctctgctcgttcactacaaccacacaataatccactcaatcgccaattagtgagtaattaatgtccccgtggagtcactgaattgactgatgactgatcgaatggtccgtccgtcctccgccgatcactctttcctttcgtcttcccatcgttttatgtgtaaagtgtttaacggggaacacacacacaaacgatgacaaaatgcaggtgctgtgagagaggggggggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccattttttctaggcttagatcaaatgcgattttcggcactctgataattttagcgctcataatgggatgtataaaggcgattgtagaaggaattggaagcgctaaatttgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgattgagaagctttttgagcgtaattacgatttttacttagaccatttttttctaggcttagatcacatgcgattttcggcactctgataattttagcgctcata

SEQ ID NO: 607 - DNA, 2723 bp, Heterodera glycines
gttttgattggtcaaaagcgatcgactgctcaaatgccgaccgaatcggccgacaatggcattccgctgaccaaaagacagtgccgggcagaaacgtaaaagccaatcgcacggctttcattcggccgacgtcccttgtgatttgatcgcccttctcatccattcctcctcaattctgtccatttgagtcagttttcagatgctttttttcaatcctcacaaattatttttgttttcaaattcgtttttaaacatttattgaagtagaaagaaattaaattgaataattttcttctaatttatcaataaaagttttttatttcttcgaaattaaagcagatagggcgtattgtccgttggtgatatggggtcaatggcaactcgtacaacattgaactcatatcttacaaaaaaaaagacggattcggactattgaaagccaaaattccgggaatccgagaccgggctctgattccacaggttcgaattaaaaagtttggcgatttgcccagcctctggatcctgttcaaaaactatcaaatttgatcggtcattttccgaaggctcgaaccaatttatagcataatgtcattattttatcctaaaatttttaaagtttgacgcaaaatttgattatttttggataaattctgttagcaaattgcactaaaattttccccggcggcgcctaccggcaccaccggacccaatcgccagcccattttagagtttctttgcattgtattgtttttttattgtcttatcgtaaggtacacttttaagtattttttgattgattgcgcatgatgagaaagagcgtaaaaaacgaagccaatgtgagcgaatactatgaacaaaatgaaatggatggcatccataaaattaatgtgaataaaaatgtggcacaaataattaagtgaactgaagaaaagtgacgaatggagcaaatcaaaatccgaaatagaggcaaatgactgcgaatggaatggaagtaaaatgaaagaatgagaaagaaagaacagcaaaacattaacggatggtaccggtgtgttattatcgtatcatgggaatacagaaagaaggtagatgatcagcgaaaggcaacgattaattctttctcatcttacgcactttatccgcctgttttgtctccgtcttcaccaccaaatgacgtggcaattccatctgactgatcgcgcgtctctccgccaattggggcatctgcgaacggaaggaacactcggctccggaacagttttgctgccgctgttgcggcaggtcggcagaagggcgcgggatggggccggcgccgcaataggtattgctgatacgccttgaaattgtgggtggatgagttctgtcacgggtgtcatcaatcctcccatcccataatcccaaccctcccccccccctctccctccacacacatcggactgttcgtcgtcgcttttgtcggcggtgtccgcactgtctgtgggtcgtcctccgcctccttcggttggtactttgcgcttcgttctaccgccgcttctctttcgcgcttcagtttctccaactccgctctcatccgggcgaattcgtccgcccgttccctcagctcgtcttccatcgtccgcagtttcgtctctctccccgcacatttcgctcggaattcctcttccctccgcttgcactctgtcagaaatgctttcttttccgcttgtaattcctcctgtttttgtcgcaatgattccaatctttcgggcgtttcccccgacggacttttgcgcgaacgtaaactgaccaattgcaagtctttgctgaaaagagagagtggaaccattgtcagttcgattggttttgacaattatgtccttacagtgccgattccttcttcagccggtcgttctgcgaacggagccgaacattgtcccgaatgatctcagtcgcggcttttctcgagattggattcattttttgctaaattaataagtttccattcattatgttaatgactctctttcggtaacattcgttttgcactctctactctttgattttttaatttttcgtattttaaaaatagataaaatgccattctgagacaaacggatcatccgcctctttcattcccaccggaagtttccggatttcgttgtccatttctccgtcctcttcctccgaactttccacgtgatggcccccggcgggcactgtcgtgtgccttcggatgggatggactcctccggtggaggaagccgaagagccggacaaactttctgtaagaataaaaatactaacaaattctgccttaggaaggggtgggccccgctcgactttcgtttcaattttcataaaaattagccgaccgtttttctaccactaatttactcactttgttcggccgacccatgcccatggtaagtgcggactctgcgcggttttttcttccctccgccttcagcgattttcgtctgattttcgcaactgtccgatgaaccgacaatttggttaaattggtcgtctgagccggacgaactaaaggtaaaaagcattcattggcattaagaaatcaaatggacaaaataagagttcaatctaaggccaacgacctctgtgacggagtgtcccccgccgccccgaggtcgtaaaggtcgtcaaaaaaggagggcaaatccgcgtcccgcgctttctgcgccctctccaccaaattggcgagtgcaccgttgcgtttccgggccaat

SEQ ID NO: 608 - DNA, 3249 bp, Heterodera glycines
  misc_feature (2018)..(2018): n is a, c, g, or t
cgtctggtctggtctcttacaaccccttttcctttctcctcctgcttttcctctgtcgtctaatttctctccctccctcaccattttctctctctctctctctctccccttctccttttgtctctatgtgtcccacgcctctctctttcgctgtttctctctcatctttccccgttgtgttttcctttaccgaatattttctccaactctctctgccaattgtccattttggtttggtattccttctcagctacggaagtgccttccccgattgaacgttggctcagctcgaaaatgcgtcgcttggacaatcggacgaacttcggagcattcgttttcgcctgttttatcgcgtggacgcactgttccatttcgggggaagttggaaaagcgagttggattctgaacgtaaggaaataatcattggaagaattggtaaacgaagcgcacaagtcgggctgttccttgtcagtgacaatcagcagcaaactcttcctgaattggtcggatgtttctctcgataacaaaaaaagagtgaacctgcgcagattctcgccctttacgagagtattgaacaacggaataacgcccgagtgactgttgtgacgaaagaattggaggggaaactgaagggaaaacgtcaaaaccgagcaaatcgccaatccatccgcaaggacggataaaaagggagcgagatacattgttggggggggggattaactcaatttattacaatgcgattttaagggttttgccacatgaaaagagcgtaccccctatgggacaaccaatcgcccgctccttctcctgctgatcactcacttccttcctttccattcctacgccgcccattccgcccgttgccccactggtgccaatcgaagtgcctttgggtcgcagaaacacaatgatatcgtcacagagaagcaaacgcactgacagtgaatagaattacagtaacaccgcaataattggataagtttgccaaatacggggggaaggggggggggtgggaaataatccaaattccgtaaaattcgaacatcgtaagcgcgttaaaagtgacccccgcgccccacccccttctattgtttcccgtacattccacgtcgggcgaagtcatcgtctccctccaaaaaactctctgcaccaaatggaccttccgtccccactcattctcagcgaacgcttcttcgatgggttcgacaaggtcggcgtaggtgaagtcctgcttggccttggggtcgatctgtcaaagggccgtggttattccgtttttttcacttcgcccaccaatttgcctgtgcttcccttctccagtgcctttttcaccgcctcccattggattttgcgttcgtggcgcaaaagttcgtcgttaatttccgaggcgaacgatttgacagcaaaatgagccttttgcattttcaatttttggtcggacagcgattcgtattttaaaatctgaagtgaacgtattggaaaggaatgaatgaatgtgtgcgccacctgctcaatgagaattgggtatttggtgagtcgttgggccaccaaaagcatgcaatctttgaaggagcggtctttgtgctcactttcgtggaattcgaagaactgaacgggaaattaagcgtttagtaacctgttcaacttgattaattgggttggaattcaaatgcacgggaaatgaatgctcaaatgctttttccccgtctccgctgcttaccttccgaacgatcgctttttgggccaaaagcgcggcgaacaaagcgtggctgtgctcccgggccaaacagaaagtcgtgtaggagtgaataacggcggaccggaaaaagaaaagattagtaattatgcattaatcactcaccgaatttgactgtcgacgaatacttcgcaaataacgtcggaaatgtcaggcacaacagcttcacccgaggagagaattagaaaacgacggagcaaattcagatggaagtcgaggagagtgtcaaggacttccggaacaagctgaacacaacccgtanataatgtcaaaggacggacaaacgcaacaaatcggttaaataaaattcctccggacaccaactccattttaagtacctaacctatcgcaaaaagcctcaaaaaaatcattgtgcttggttcggcaaatgcttgcctttctgacagtgcctttgtccaaaattccgttgcggatgagtccctcctggtacacctgacgaagcagtacaagcacttggcagtggttcttctccgtcatcatcagctcgtaaatgatgttttgcctgattaagcgggaacagcaaacctaacaattaggacaacacaacacgcaactgcccttcacctttttctttcgccattttccaatttcagtgactccgtggggaatttggctgcccaactcgtttcctcctcttcccaaatgttcaggtcgtcccaaagaggatcgtttctaaaaacaggccgaacatagaaaaaagggacgaacaacacgaacagttgggaacgcgaaaaaatggcgggagaaagcatagagacgaagtcggggatttgttcaaatgaaaaggccgccgaactcggcgactgtgccaatgtgagctttttggggctgtcggacagatgaacatccaggggacctgagaaaatggaatcagtaccaacaaatggctaataaaaattataaagttaaaggctggatgagcaaattttttaaaaatgaactttgaccttccaccggctttacggtcggtgccaccgaaaatcgccgatggaaagactcaacaggcgaagaacacggagacgtcaggccttcttctggcgttctactttcgcccttctttttcaaaaagcgaaccaaatgacgcattttctgttcgacgttttgaagcccatccaattgtgagattgaagattttcgtcgttttttggagggtgatttaggcagcggtaaataactcatcattttgtcactgctcgtcctgtggggcaaccgccaaccctcaaaggcacttccgtccccctcaattccctccgcttcttcatcgtaaaaacattttctctccaatgccctcaaatccgtttgtgaagtccaatttggtctcccaatttggtggagctgctgcaactgatgttgcgcacttcctcttctctgagctgtttgttgttttcgtctcataaatttcatttctcgtggcgaaggtgaacgacaacttccgcattgtaaagagtcgcgctgaggggacagtaaactcg

SEQ ID NO: 609 - DNA, 1567 bp, Heterodera glycines
cgagggccgaactgttcagcttcggctccccatcttcgctcatcatctcaagcatattgagcagttcgatttcctcctcttcatgttccgtgtcgcctaattggccgctctcttctctcagtgtgtgcagaagcgaaatgcatgagccgggttgagaaggcaagtccgactccaccgaccgtgcagcaatgacactcgttggcaaactgggacgacggaagtcgaaatagaggccgggttttgacctagcagcagaattaaaggatcgttgtgtcatggagggagacaacaaagcaaatgaactaaggaatatttaaaatgaagtgggcggtgcggtgaggaaaggagaaaagcaatgactaaacacactcatttatcgatggggagtcatcgtttgaatgggcggtcgagaacgccctgcccactgttccgtgggtattatttctcgagagtagtcgagcatttgcctcatcatcgtcgaggtttgttccgcattttgtcagtccccgttttttctttgagaggtcgtttctctcaaattcttccaccagctcggctactctgttcagtaacggcactgattcgcccttaagccgtgctattttcactcgtgatgcttttcctgccgattgaatttcacgtttaaaggcaacttcgcaacatttgttcatcctttctctctgcagctgccattgctcacaaaatccgctgcttaaactcctattgtgttgtggtgaaaactttcgggagggggtggaattggagatgagttgatgaacaggaagaggagaacgaacagcgcttggtggctgatcgggaaacattttgacataattattctaaacacgaaaaaacttacaaataaagctttgagtgctattatttgacaatacaaatgcaaatgaatgaatgatagagaagggggagggagagaatgaatcggtggccgactaaacgaatataccttaatggttagcaaatatctaacgtgatcatttgtattttatttttttgcaattcaccgattcaaatggcaacattttgataagtttggaatgtgacaatgcgtgctccgctcgttgctttattgagaaaggaatggcactgattcaaactgttcacaaccaaaaaggcgaggagaacagagcgggtgaaaaagccaatcgatcccaattgtcaccctcaaaaaatgtttgtcagcttattcgtaataccattcgtcaatcaaaccaatcacaaaatggaatattgtaccaaatggcggaatgtaaaaagagaggagaaatgaaacggaatatgataatgaggaggaggcaatgacacagcaaaggcaaaaagatgacatcacgcaaaagcatttggtatccgataactcttacagaataaaatttgctcatccagacaaattgattttcattatcacgacccgcaaatttaaaaaagcaaaaacccaccgctgtcatcgtttgacttctcctctttgccaaatttggagtcgctttgctgacaaaaaagattggccaagcttctgttgccttccttctaaattgatttgatacagtttcag

SEQ ID NO: 610 - DNA, 1756 bp, Heterodera glycines
aatggtgccgagaagtgccgagttcgcctttgactccctctttttgtccttttctgttcttaaaatttttctgcttatttgaaaaaattgagagggatcaatgagcagcatttttaggccatttcatttattcacaatgaaacaacccttcctgacaaaaagctgaagcaaaagcagtttcagcgaaacggtgccgtctctgtccgtcccacctttccttttcggcattcgcatccttcggaccgttgtcggtgttgtcgttcgtcttcggtgccactttgctccccctactggccttgcgttcgcttccaaccagcaattgccttagagatgagctgctcacactcgccccacgctgtttggccaaaagtttggcaccttctctcagtgtcaccgtttccgttttggcaatgtccgattgtctttttccattgccgtttttcttcgtcactcccttctctttcgcttcatcttttgtgtttccattcttttgctcaccgtcctgctgcattttgcttttcgccataagaatttgagcttttgtcacatatgagcttcttctccgggctaattgtgcctttccaatgcctttttttcgctttaaagttccgttggtttggaaactaatcgaagatttacgcggtatattgcaatgattcttttttctgggcatagtcaatgttgttgatgttgtttttatgatattcaattgcgatgagatcacttttttggagttttgggataaattatgcaaattttgctgctgattttgagggccttctccacttgtgattgatacgaaatgaagcgcatccaaattgttgcccaagtgcaattggacgtcgtcactttgttccccgtcttcctgctgttcaactgtccttgacattcgtttttctttcaagaacatgtccaacttcagactgtcctcctccctgactctgtacttctccttcagcgatgtcgttcttctcactccaccagacgtggccatctctccttccgcagcctcttccaacttggtcaaatcgcatgctccaatcagagaaaagcgctgtgttgcgacaattttggggacagttgggcttttgatgggatagcttctttcggcctcttgtcccgatcccagcgaattgttgttccgaattcgcactgtctgcgtattgctgtgtgtttcttcttcgtgcacagacaaaactgcctttggctgggctccgttcccgaactgtcgcttcttcttgtccctgtcctcccccatctcttccattagtgtgcccagccgtaagctctttctctgctgaacactctttttccgatagtctctcattgcttcatctttgtcttcttcgcttttcctccttgaactttggagttcgtcaaccaaatcattcttttccgtgcacttatcgctgttctcatctttccgtccccaaaataaattccatttaaagctcctccggcagaaattttcaccaaacgtcgacttattcatattatgcttgagcaggttgctgtcggaatattgcctttttgtgacgaatcgatcgaccaaattcaataaaacgttggatgacgtgggaattgaatgtgcacatggcgcggaaagtgttgacacggaagagttcctgcgcttacaattgcttttcgttttcctctcatggcgttgttgctgttgttgttggttaacttttgagctgcaaacgaagaaagtgaaggggaaaaagccaaaagcataagaaaagcgcaacgatggaaa

SEQ ID NO: 611 - DNA, 1714 bp, Heterodera glycines
tggatgaaagcacaacgaacttcagcagacggtgtaaaagaagaacaaatcgaggggcgacccttaaaggatggaagaatgagtcaacaaaaagccatttcataaaggaactcctcaaacagacattgtcattgcacaggtgccgctgcttctcaatttgtgtcaaaaggtgtggccttagagaaacggccgccgtacgtttggccaaatgagacgcgtccggtaagtcccgtccgcctttcttcccccattcctcctctcctgcgactttctccacctcaatgtgccgttgctgtccaattgtattgtcgtcgacaggaacggcatgtggagaagggctacgcatcttaaaacaaacagatcaggtacaatatgcacaactccatttttatccatcacttttatttgaatcgcatcggcaaactccgcttgatcggtgtccagcaaaagcatttctctcctcaaaccaatgccatgcaaaagatggtccgccgaaattgaacgacggtgttccaaggaattttgaagaagtgcattctgaagaagaaaagatggacaaatcagttattgccggttgaactgactttatctaagttcgcttctgtccttcttccataaaatttctccgccgtttccccattcagccgacttataaaatcaaactctctgaaaatgcttttacattattacaaaagagcggaaaacccacgcactcgtcaacttcgtcttcatcgcccggggcatgtacggatggttctgggggttcgtgtaaattggcctcgtcgttttcagtctccgagtagtcgggaatgggcgaaaaaggttgacaatgaacaaggcacgggtccaagcttttgtcgttttcatgtttctgtttttgttgtggcaaacctgaaaaagctattagagttaaaatcaaaaggcgttgatcaacaggcattctctcgacccaccgttcaacactttggccaaatgaaccgcgtccttcacaacggcactcgatcgtcgccgatgactttcccgtctctctgcggcggatcgcctttttctacgctggcgcggtgtcgaatttcccgaagtattgtcactcggtgtgggttctttggtcggttgacattcagccgcgtcactcgtcgatattatcattttgtcctctccgcctaaaaaacgaaaatttgaatgactaattataagggaatactataatcaaaaatctatttcctaatgagtgctaaaagatggatggtttggggataaattcatcgacaaagaagaaatgcattttccaataaaaagggtgcggtgttttgtgagaacgttggaatgtttggcgtctgttttttaactgggctttggttttccttttccctttgctcctcaattcctttcccaccttctctctcttcagattcctttccttcctccaatccactgactgtgtacgctctccccttcaaatcaaacaaagtttgctgctcatactccgtgaaatgatccaacgaagaccgagaaactcgtcgattctcttgcagaaacttaatttttttacaattcaaataaccaaagaaaaactgtgttgaatttaaaactaagatgagaatggtaaaaaaaaattcaaaaaacgtttaaacggttttttcggcgctatatgcaaagtggtgaattttggattttatcaagaagtaaaaacaaaaaggcgggaccctattgatat

SEQ ID NO: 612 - DNA, 1442 bp, Heterodera glycines
ctcgaattagatgtcagattggtgatcagcaacctctaaaacctcggatagcacaatgttcatggttttttatcacaaaaaaatttcgcataacaaaagggcccccctttactttttgataaaattcaaaattgaccactttgcatataacgccgttttttcaatatttgtgcaacgctaaatttaaatttaaaataattgcataattcttccatcttacaattagcgtgggattaattaatttaaaatagccattgatcttaatcccattatttaaagtagggtagcgtccccgactccgaaaatttaggcaattttcgggtaaactccaatatgctccgcatcccgactccgaaccgtcaccccgagtttttatgggaccaataaaatacatgattaccaatagaatttaataaacggtttacctcagttgggcgcgcacagttgggcgctcacgtttgggcgccaacatgtttttccacttaaactttctataacttttttctttgtcacccaaatccaacttttaggtatcatttgaaagcttaacatgtttcgaagctttttctaagctattgcttcgcgattagacaattatcaaaaaagttattcatgaaaattgcgaaaaagtcaaaattttgaagtttttacttaataaaattttttataagcaagaaaattttttgttttttgtaaggctaatagagcatgttaagagctttcgaatgataccaagattgttggattttggatgacaaataaaaaagctatagtagaaaaacttgctggcacccaaccgtgcgcgcccaaccgagcgagtccgtttaataaatgatagaaagtttgtgtccgataatttgatcatcaactacataataaaccaaaagaatgtgttttctctattttaatgctctttattctatttatggggttttcagggtcgctgatcacgaatctgacattcatttggaccaatttcgaatcccggacccgaattcgaacaaaaaatcgaaaattttaaaatgcatttttatgttcgtatctttaatttgattcagcccacctcgaactagctgaccctgacttttctcaccccgaaggtcaacaataaaaaaaaattttcataatttttattgcattttaataataaaaaaatcggtaatagttaagaatgttccccacctttttctgaaaaaaattttcaaaatgttttttcgagaaaatggcgtttttagggttttcagggtcgaggaatccgattctgacgctcaattcgacccattccgaaccacgaacccggattcgaacaaaaatcgaaaattcgatttttcaaaaaattaccatttactcaacaaaattgaacggaaatgcatgaatgtgtgaatgaatcaattattgccacggataaaattgggaaacatgcaaccaaaaattataaaaca

SEQ ID NO: 613 - DNA, 860 bp, Heterodera glycines
accccgacccccgacatttttgggcattttcggggaaaaccccgactcccaaccccgacgcttccaaccccgacccttaaccccgatcggggtcggggttaaatatacacccataagaatggcatttttgtgggggaaaaggcaaaacatttatacaaaaattgatttttttaaccatcttgacaaatttttatgaaatatatatagacgtattgaacccaattttattttctttgaataaaaattcaattttttgactaattcatgaaaatttacaaaaaaaagaaataaaaataaaaatttaccagaaattcataaatttttggtgaaaatatgttacaaaatagaccttaaatttcaaaattcacccggtgctgcctatcggcatcgccggcgccacaaaaaaaaacctattttttcttaaaaaaatttggcccaaaatcgaaaaaatcatcatttttttggacaaaatctgttgacaggcccatccaaattttcaaaatttttcacggcagcgcctatcggcaccgccgaacccatttctcctaaacgtctttagaaaaagagcgccgcaaaaaaaaagaccaaaaaaagagttatacagattttcgctgaaaattggccattttaaatgccttaggtatgtgtttttaattaattctatacaaaatatttgataaagaaaataataaaaagcacataaaattattattacgaaatttaaatatttttaagtaaaaatttataaagttttttgactatttggcataaggcaaaaattgaaaaaccccgaccccgaaccccgaacgatttggcaaccccgaccccgaacgccgacacttccaaccccgacgtcgggg

SEQ ID NO: 614 - DNA, 2106 bp, Heterodera glycines
cttttaatttcacattttgttcacttttgtttacacacacggaaacgaactgaaagtcatccctgatactcatcagtgcttcaataaaatcgtttaaaccattttagattaaaaatcaaaatcgaaaaattccaatttcgactttattcgaattcaggccggtattataaataggttgaaatggagtgctcagtagagaccggaaatttcaaatttgcagatcccgctgcgggattggaactcaaaattctttgcgggacgggatcccgcgggattaatcccgcattttgcaaaaaatgtgtgattgcggactgggatcccgcaaaatcccgcgggggatcccgtcccgcgccggtctctagtgctcagcacctcaaaatacccaaagaaacttgttaaagaattcccagaaaaaatttaaaaaaaaaatttcgggaccaatgatcgacatgattgctctttaaatttggcggcgagttggccgcggcgagttaggcggttcccgggtcaatggcacccgtacaaaaggcaactcgtattttaaaataaagctgaatcataagcctaagcttaggcctagcctaaagcctaggcccaacctaagcaattgtacgagttgtcatgacacttccgatggtaccagggctggttcgcggacagaaaaatcccggggtgcggatctcaaattacctcggattcaaaatcgaattatctgggtacaaacatttcgcctactgtttttccggggatgactatctccgctggatcctaagtttgactcaaaagctgcaaaatttactcatttttgggcagaatctgttaggaattccactctgatttcaaagaagtttcgcatagtgcctattcgtcgggtcggagtcgtttcggtgttataaaatggtatctcaatgcgttcatttgtcttttgcgctgttttcaatggcggattcataagacgcagaggatgacacgcgaatctgtgggtcggcgacattgtcagtagaagagagagatgaggaaggggaagacacaatttgatggtcgactgaagacggactctgaaaaaatgaaaaagcattccgtaaccgaggaatgtccttcaaaattatcaactgagtgttaaagaaaactgttaacgatttgccaccctgagcaccgttttgacgacacgagagttactgtcggtagagaaacggtcagttacagtatccctgtcaccgatggctgacttaacacacgggtcatagatgttgatcctggaaaagaatgatggatttttgctacaaccgagggttgtagccagacaaaacacacattgatccgttttcagtctctgccatcacttccgattcgtcgtcactgtccatgtccgggtgaacaaaaatgacatccagcaccaaatgttcacttttacgcatctaatatttgtcggccacaaaaccgaaaaagcctgacaaaatctcacttccctgctgagcactttaacagcttcagaatgctggacggaccgcaaatcgatgccattgacacagagaatggcatcaccgacgaagagctgctcagtacgttcggctggttggccgggatggacttctgagatgagaatgggcactccatgctcacttccgccctaaacagccaaaacattctcaaaagggcatgtgccccactgtgatggaaattccgaggccttctccgcgacctttgcgcactttgactcgtctctgttggcttttgcttttgtaaagcgaatgctttcggtggtcaaacgaatgtcgaagatcatttttggatttgttttctcttccacggcatgctttgatcaccgttttgtgtcggtggaggtgaatttcggcctccaactgattccaaaggcggtcgtactctttgccacgcatttctttcccaagcaattggatttgttggattcttccaatgcgatttatttacataattacttttcattaactttcgaatgctttttctttaccttcccgccaattctttgtccaaatatttcgctgctaatcgagcgccgtacacttcgctttggagtagatttattgcagaacgcaaatgcaaattttcttcttgaatcaaacgtaa

SEQ ID NO: 615 - DNA, 2667 bp, Heterodera glycines
aattatgctcagcaaaatcagcacccaattttctaccgggagcaatcatttgcaaaaaaaaaggaaattaattaattatatatttaccgtatgtcatgtaaaaaggttgtccccgataccgtacaccgggatttttatgacataaaattttcgttatggtatcgacatttcgattctcgtattaacgtgctccgcattaattacatgaatgaaatttgacccggcgatggaataatttagtcgaaattttatttaaaaatttaaatgacaccgatgggagcggaattcttacacttttttggtctcaattagaagcacagaataaacccatgtgcttttttggttctttttggagaatgaattggtttgtttcttcccttttttgcgtctcattcgtcgaaattctttcacttctcattttgagtggctaaacgagttaattaccccattttgtttctttccacgcccccccccccccgtcgtccatttcttcgaagttaatccctcccattggcgatgcttattgaaaattgaaagtgggttttgaatccacaggccactcaaaaaacatttcccaaattctttcagcatattaaccgacattttttttgatgtcaaacgttcgaatgcaaaaattggaaaatgaagaacaatgttaatgaaagtggaaagaaaatgggagccaaattaagaaaaacggaatgaaagtgtaccctcaaaagaaaggggggggggggggataaattgggaaaagtccaagaaaacaaaggatgggagaaagctcataacgaaaagtgacaaaaagaaaaagagtgggtaaaatgaaaagggagaaaaggcacactcggcaagtgcttaaaccgacccaaaaaggaaaagcatgcatttgggagggaagcgcttgaaaagaccgtcagcagatggttggccaaatttcccagcccaacccatccaattttgggactgatgggcggtccccgggggatttccgtcgcccgtcttaacaaactctgtgccagcggaaagtaaaatatcgaaaattagaaaaatggaatttaagaattgttcatataatgtaacacctgagaaaataatttccaatgaaaatttagtcatccgttggattaattggaatatccgtcgcaatgaatctgaaagcattgtctgcatcgtccaatggcaccgcctttctccgctggttcggcacttcgacttgggacgccgcttttttggtaaaaagatggcagaaaagtgtagaggaggggaagaaagaaaaacagggcgaacacaaagcttaagcaacggcgaaaacagaattggcaatcatttgcaaaagacaccttatgaaactgcaaatgacgaggaacatggacacctttggacaaattgggattggttttcgtatttgtaagaaaatatttacctgaaaaaatgcatgggtttccgaaaaaagcataacaccgccggccagaatgcctgaaatgagttggtaaagcgggggattcagcccaaagccactggaaagtgcggccatgccgacgggtctaacggcgccacggacagccctttgcacgcggtgctgggcacatccgtcggaagcgaccaaagcgccgaagcgaagcgtataatcgaaggacagcccaaccgccaaaacgatgatcactccttccaaaacgccgatttcccagcctaaaacgacgcgaaattcaaatgaatgagagaaaattggactcaattgttacccataaacaccaaagctccaattgttgtgaggacaatacaaaaaatagtaaaagtggcacagaaagctttccatctgagaaaggggggaaatgagagaaaaaggaaaagcgaagggagagagagggaggcattgtaaaaccaaccgaaggatcaaagaggaaaagatgaagacgacggcgaatgaaacgcaaattgactgaaggggggggggaagggaaatggggaaaagcgaaggaaagagacggacggacaacggaaaacaaaggcacaagtgttctttaaaatttaaaataattatttttattaaaaaccaaaaacatggaaaataggctgataaaaatcccagaatttccatcaatttaaaattgaatgcctaattctctttgctttcacctaaacttggcttcttaaaaacaaaatcactggtgccattgtccgtccattccgttctcttttttgccgtgcctttttacagtcggaaataatcgccctttgcaagtcgaaccattgggacatcgctaaacatcaccgcaacacagaataaaactacaaagtgccaagctcagacctgtccattcggtggtgtaccttattttcataatttgtgaatcattaaaatgcacaaattaccatccgggaaggaaggacaactgctgagtgccaacagaaagccattggtcgaacagagcgaacgcggcggaaagattggcaaaacggtgggagtagcgcaaatgggtgggcaaaagtgcctggaaaaagcgaatgctttgtcgaattggtggccggcatcgcccacggtgtatccgatgagtcgatgggtgggattgtccaaaatgaggtgtcgttgtaattggtgagaagcacggatgtggaatggcggatgcaactgtcccactgtgcggctacaaagtgcggactctgcac

SEQ ID NO: 616 - DNA, 2185 bp, Heterodera glycines
tttggccagcttctgaacgacgtcaaaatcgaaatcagcagcatcgaccaactgacggaaaaattctggatggtgtgctacaaggcgaaggatgagcacgtggtggagcacgacaccagcaacgtcgccattgccctatggactacggcagcggccagagtgcacttcaattggtctacaggcagcaagatctggttcagcgctacgacacgcgcattttatacatggtaagagtgtgcaattaaaatgttcataataaaatattcgtttttcaggacaccgacagtatcttctatgacttcaagactgcactgggagacccgctgaagggtggcaaccagcttggggagctcgcggacgagtaccccaaccataccatcgtcgagttcatctgtggtaaggactttgtccaaaataatttgaataaatttctaatcggttttcagctggacccaaggcctacgccctttggcttcggaacaacgcaaccggcgaggacgagtacaagctgaagctgcgaggcatcacgctggactcgaacgcctgcacccgcatcaactttgagaagatgaaagaaatggtgctggagaagtggggcacgcccggcaaccatgtgcggttcgactaccctacgaagaacttccgcatcacgaagcagggcgacattctaactgtgccaatcaccaagcagttcaaccccaccgtgaataagggggtgctccgggaccgtggacttaaggttgtcccctttgggtatagctcatgggagtactgtaaggcccataaccccaacgaatgtcgctgtaagaaagaataatttgttcattttgtacttttatttttcaaaatcctcatctgtgacccaatattttttttctggaaaaccaatgaatttcaccaatatttccttttttccatccctcattcgttctttgtactttttctcgatcctatacattgtgttttcatcaatttgtacttttgttaactctggcaaataaaattttctcttcaactttgtgccataatagtccttgagcaaatagtgctgggggttggttgaccgagcctcatcaacggtgtacacatggtcagagtagttgggaatataaccttaagcacaaataaaaatacagaaaaaaaatggaggagtctctgtacctttctcgaatatgtgcttgggctctgggattctgaccgtttcccccgctttgatctttggtcttttttccgctggtacaagaccttcgccatagaccctcttccacacctccctcgcattgacgtcactgatttcgttaggcctaagtcccgtcgcacggcacacagagttattgatcgcagacaaaaacttgggcaagacatccacccacgcagaggtattcttggcagagaaatatttgtacagccgagtcttcagcgtgcgaatagctctctctgcgacggcagccttcttctttgagctggtctcatacttcttaatgccattttctgcgaagaactcctgcatgggtttggccacaaactccagccctcggtccgtgtacagtgtttccggaagttttggcatttggccaaacacctcctcaaatgcccttttaacgtccgccggcctcttactcttcacgggtgagccgaacatacgccgcgacaacacatccaccgccaacagcaggtaccgatagccgctgttctttcgcgaaagggcttggaagtctgccaagtccgcctgaacgtctgagccgatcacgtgaaaataacgtggacaaactcaccggtcatgaaccctccggggactgtgcgaaggcgtcggaacttctccctctttggcttaaacagcgtgtaggtggtgttccgctgcaaaaagtcatcaaagtcggtcctcttcagttttgggtgcttcttctttaccgctgcatagagtgcactcgcacccgcaaacccaccgggattggccgggtcggtgtatattttgtttattttttcgtccatttagagggaacaaatcctcccgtttgtttgacttgtccagacccaacgaatagtcgattaagtaggctactggcgagcggattctgtgcgagtttcctcatcaactctttggttccgcttggtgaaggggaattctccgggcgagggtccaccaggcgttcaatcgaccaggccaggtccgagtcgatgaact

SEQ ID NO: 617 - DNA, 2222 bp, Heterodera glycines
  misc_feature (2186)..(2186): n is a, c, g, or t
gttccaccaaacaaaggctgattgattgattcattgtttgattcttctactgtcattggacgaactgacaaaagagaacagcggacgaagagcggacttcgacacgtggcgacccattggccattgcgaaccgaattttcaaaggtggacagattcaaatttttgttaaaatttgaaaaagctagttggctagcaaaaattttaaaatgagttcgccaatattggatataattcaagggctagtcaatcgattagaggttgagttaaccaaagaaattccgataaatcctggtcaaaatgccaccccaaatacaatccaaagacatttgtacagagcaaaaaatgcttgtgatgagttaagcgaaattttggaagaaattcagagaaagcgcgtagaaatggcagaaagtttgcaaaaaattgcagttgcagcgcgcgaaaataaggaaagagtttatgtagacttttgtacgcatcttgacattgaggcaaaaattaatcgagcagtaattaagaaaaatgaatggcaaaacaaaaaagaacaattggaagatatttttgacataaaccctcaaaattcgctaaatagcacaattcttactccaagaaatcagcccatcaaaagagtgaaaattccacaaatacaattgaaaaaatttgatgggtcagttgaaaaatggataccattttgggagacattcagagtacatgtccacgaggatgattcggttaccaaaattgaaaagcataatttattagagtcaaatttagaaggggaagctaaggagctaattgagggaataccaatttcggaagatggttatcaaattgcaattgatttacttttggaaaaatacggtaaaagtaccaaactaataagggcactcaatcaagaaattaatttattcccaccaagcacgagtcataaagaagtaaatcacaacaaatatgagtcagaggcaacaatgaattttgcagtaaaatttagagaggaatggaaaaaagtacaaaacgaacaaaaacacaaaaattttggaagcaaaaacgatcaaagacggaggtttagctcctccccagaatattcagtggatcataaaaattctcaaaattcaaataatcaaagattttcgagaccacaaaacagatgggaaagagggaagaaaaaagggtccccatacccaaacaaatttcgttcaagctcaaatagctcaaattattccaacggctcaaattattcaaataagagtcctcctaaatttccacgtcatttttgtgaacaaattcactcaccagtattttgcaaaacatatcagacagctgagaaaagaaaggaacaagcaataaagaaaaaattgtgtttaagatgtttaagaaggggtcattttgccaaagaatgcttttcaaaaaagagaaattgcttattttgcaaaagcgcaaatcatcactcggctttatgccgatggtcaaaaatgaatgattcaagcccaaaacgaaaagattttgttaatgcaagtacaaaagaagtaaatgatgaagttttggcttcaaaaataattgaaagtattaatgcagcatcatgcttaattacccaaccaaataaaatatcagtgttaaaatgtcgatatgtcacaatttataatccattaaataaaaaacttagaaaaagggttttagcatttttcgacgatggcagtcaaaaaacttatattgaagaagaattagcaagaagccttaaattaacagtgattggaagacaaaaattagaactttctggtttaggtggagcaaatttgggaaaattcgaaagcccagtagttgaatttggcttaaaagcgagagattttaatatgttaatgattggaagagcaattaaaaaagtcttaaaagaaattcccgttttggactatcaggaaataaataatgatgaattaaagaaaaacaatatttcagttccatatttactcgatgaaccaaaaattaccatcgggaagcgatttttacaattattttgacattcgacccattaaacttttaattccttgggtttttggatcagcaattctaaaattggtaaatttttgagtggtgaatggaaaagtaacttggactcttataaatgggcgaaaatgtgaacacaaaggacgaatataacgtatcagccataaactcaagtgcaatacaatgtngaactgaaataactgatcaaatgggattggacaaaa

SEQ ID NO: 618 - DNA, 9630 bp, Heterodera glycines
gggattggggagacttatcagaaaaggaagaaaatatcgtttgaaaaaatgattaaaaatatttctttcaatggcaaaaggtaccaatcaaaattactttggatagaagaagaagccgaaaaattgcccacaaattttgcaatggcttacagtcaattaaaatcaaatttgaaacggttacgcacaaacccaaaattactccaattatatcataacacaattttggaacagattaatgaccaaggatcagtggaaataactaatccgttggtggacccaaaccaaaaaggacaaaaaattcattatttaccccatcatggcgtagtgaaagaaactagtgaacacactaaattaaggattgtttacaatgcaagtgctaaaagcggtaaaaacccagctttaaatgaatgcatagaaaagggcacgaatgaatacaatgatttaaccggtattcaattacgcacgaggttaaaaaatatattgattggctctgatattgctaaagcatttcatcaaattgaattagcacctgaagaccgaaattgtgtacgttttttgtgggtggaagatccattcgacccaaacagtccattaattcattaccgttttaaaagagtgacttttggtgtcatttgtagccctgcccaattggcattaaccattaaattgcatttagaaaaatataaccaccccattattaagcaattggctcaaaatatttacgttgataatttactagtgggaattaaccataaaaaagattttcaaatggtttacgaattgattaaaaaggtgtttgctaaagcaggtatgaatgtgcgtgagtttgtgtcgaatgaattaagtgagcttcaaaaactcccaaaggaagaccgaatcgaaaaagaaactgtcaaattgttgggaatttggtggaatgtaaaaaatgacgaatattttataaaaatgccaaaattcgaaccaaataatgctgtaacaagaagaaaagtactatctcaaatagctaaaacatttgatccatgtgggatgacatctccaataatcttagctgctaaactttttcgtcaagaaatcgaaaatggaaaaaacctaaaatgggacagtaaattatccgattcagaagaacaaaaatggaaagaactcatgcttacatgggaaaataaagagatcaaatatccacgaaaattatttcaaaataatctttcagaacatactaaatttcaattacacgcttttactgatgcgtgttcaaaagcctttggcgcagcaatttatcttcgaattgaaaatgaccaacaaatttattgtaatttagtttttgctaaaagcttagtggtgcctgctaatatgccaaaaggcaaaaggacaattccaaatttagaattacatgcaacaatgctatgtggaaaatatttaaattttgtaaaaatcgaattcgaaaaagaaattaagattcaaaattgcactatttggtctgattcaaccgacgttctcgattttgtaagaagtgaacgcaaatttgacaaattcattagaaatagggtacaaaatataaaaaaatggcatttgaaacatattaatggcaaaaataatccagctgatttagcgtcaagaggaacatcagtggaagaattacaaaaaagtgaaatatggtggaaaggccccaattttctttcagaaagtgaaaactcttggcccaaaacaatacgggaatatgacccaataaatccaccagaaataaaggaaaaacaaaatgttatttttgagataaattcagcaattaaagaaaaggatttttgtgaatttgaaaaatatttcgaaagattttcaaaatgggaccgtttaaaaaattcaattgcttatgcacttcgagcctttaaaaaagaggaccaaaagaaagtttcccaaaatatggaaaaaatttcggatatcaaaaataaaaaaaatggaaatgacataacaaaagaaattattaaattaatcaggcctttagaggctaaagaaatccttaaagctgaaaagctaattttcaaattaatccaaacaaattcgtctccaaccaaatctattataagaaatttggatttgttcaaagatgacgatgatttatggcgcacaaaaggaagaattttaaaaagtggtttaaattatgacactattaatccaattttcattccaaataattcatatattgcgactttattgattagagatgcacatttgaagacaatgcatggcggtcgcgaattggtgaatagcaaattgagagaaaatttttggattcctaaaagcagaaggaaaatttatgaaatattaaaaagaaaaaacaaataaaaatgcgggatttgtgcaaaatttacaaataataaatatacatatcctaaaaaccctcctctaccagtgtttagagtaaaagggaaaagtgcatttgaacatgttggaattgattattttgggcccctctcagtaaaaacattggatggcaataaaaaatgttggggagcaatatttacatgtttaattgtaagagcaattcatttggagttagtttccgatgtaagtgccgaaaaatttcttttagcatttcggcgattcattaaaagaagaagagtgccaaaattaattatttccgataatggtacaaattttgtattagcaagtaaagcattaaaacaaatagcacttgaagaaaataaacaaaatagaatatggtcagaaatttatcgtgatcctatgatacaaaatttttcatcaaatttgggaattgattggcaatttaattcgccatatgcgagttggcgcgggggagcttacgagagaatgataggacttgttaagacacatttaattcggagtttaggaaaacggttattgagttttgaagaattaatgacatatttaatcgaagtcgagaggattgtaaacgaacgccctttaagctatataacccaagatgaagtgattgaaccattaaggccaatcgatatattaaatccgacggatggagaacctttctcattgaaattagatccgacatttgatcgggaagacataaatgaatattttgaaaagaaaactaaaagagaagaattatttgaaatttacaaaaaggcaatttttaaaagtgaaatattttggaaggaatggagtgaaaaatacttattatcgttaagagaaaagcacattaacaaaaataaagatggaaataaatacccaaaaatcggacaagtagtaatcgtgagagaccaggataattatccatgatcaatgtggaaattaggaaaaattttcgaaattctttctgatagaactgttaaattaaaaataggaaaccgaatggcggaaagacccacaaaattattatatcccttagaaatagaggatgaaggcgaagaatagctataattttagataatttaattaaatattatataatctattaataaaatcaaatttatttatttatttaaaatatatttttaaaaaaaatatattgatactttaattttaaataataatatttttactcattattcatatcattattctgacagaatgagcgacagccaaagcagtgatgatgaactgatgtattcggcggatgagaatttcgagatgaaagtctcggttcaaagcagcaaaaataatgacaaaatttcggaagccaaaaaacattcaaattgccaaaaagatccgttggaggatccaccaaatttcgaaaatttattagataacagtccaaattgccaaaaagatccgttggaggatcaacaaaattttggaaaagattcgttggaggatcagcaaaatttgctgaaaaatccgttggaggatgaacaaaattttggaaaaaatccgttggaggaaaaaagtaaaaaattcaaaattcctgaggatttgttggtggattctcaaaaaccaaaaattcggaattatgtgccagaaaacattccaaaagtggtggcacggtcaattttggtttttattgtggataatcaagtggaaatcgaactgaggcaaataatgaggaagaaggaaatgaaggcgatggtttttcgaccgagaaagtgggacaaaaatacaattggcacagaaatcgaaattggcacgattactcaatgcatagtgatatggagagaaaccatggacgctgaactgttggcagttctaacaaaagttgaagaaatatgttacgaactgctatgcatttggattgtccccaaaggagtgccaattcatgttatgaagaaaaggtttccggcaattgttcgagtaccggaagaagaaaatatcaacaatttattaacgaagttggagcaaattggaatgccaattgagaaaaggggcgaacaaaaatggcacgagacagtggcaacaaacgcacagaaagtgaattggaaccaattggggaatggacgcagagagaaggccgcgggaagccattcccacaattcatttgtgccgccacatttttcatcatatttgccaacaactaccaaaatgttcttcccaactccggaaatgccgaaaaaaggtgaaaattttggaaaaatccaatcagaaaattttgatccctttgtggtattgggagtaaaacgaaagtctcaatctccagaatcaaattatgaatatgaagacatttttgaaggccctttgtgcacaaaacgaacaaaattttgggtaaactcaaaatgtgaaactacaaaaacagaaccgttggaggttaaaacatttttcaaaaacgaaaataaggaaatttatcagcctcattggaagccaattgttttaagttcaccttcaggcaaaaaaggagctttctttttcgggaaaaattttgttttttcaaattttcatccgtcttcttttatgatggatggctttaaatgggacaatgtggaacaaaaatactgctttgaaaaggcctcgtattttggctattttaatttggcaaaaaaaattaaattcaaagatggaattactgaaccaagtgaatttaaaaagattactgacaaagagatggaccaatataagtcctttgaagaaaatcccaaattttttgatcagtatgaatggaatagggttcgagaaaatgtcattcgcccaattttatgggcaaaattcacacaaaatgaaaaatttggtcaaatgttgttggaaactggaaaccttccactgtatgaggcctcagtcaattttagctggggcatcggaattgacattagagaaagacagctaattttttcaaacatggaccaaggatttaaaggcaaaaatatgtgcggtcgtctgttagaagacattcgcgaaaaacttaacccaatgaatacaggaaaccaaaaagggcaaacaaacccaaaaaatgaaaaagatttagaccaaattttgaaaaagattgaaaacgacaggaaaatctgtgttttcaaaactgaaagtattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaagatgacagttgccaattttttgacaaattgcgaaaaaagttaagagattctggaatggcattaacccggactctgataatcccttcccgaaatgtctccattttggaaatcacaattaattctgatgaccaagaaataaatgctcaaattagttgcaataatttgattggattgattaattcgaaatggtggcatgttgtgtacagttggatgtacgatttaaaactttatattttgccattttggaatgggctgacttttttgaaattcaccaaagtgctaatggaggcggcactttaaattcttatggttggacatcacttttaattttttatttgatgaaaattcctaaccccgttttaccaaatttgatcaaaattttaccagaaatttttgaaattcgaaatgttacatacacaaagaaacaaatttttgaagtactgaaacaaaaacttatttgggagacaaccaattcccagagcatttcttcactattcattggattttttgaattttatacaaaaatcaatttagaagagagccggttgaatatgaaagaaggaaaaacgatttttgggagaaaagtactcaggaaatgaaaatgcatttattcattttagagccgtttggggctttcaatgtcgcaaggagtgtgacacaaaatggatttatcaaaattaaaaatgcatttcatgtaacttgggaaaaattaaaattcggtattcataatccaaaaaagctgttagaagcaataaaaggaaaggaaaatgacgaaattatcgaagaaaaattgaatttgaacagaattttaatatctgatcaggaattagtccaaggacaagaggcaaacacaccaatggacagtgcgagtaagtcaagaaaatgggttcttaattcacaaaaatatttcttcaacgctttaatgattatcaatataataaatttctgtgtagccacccaaccaatgatttgccataatagagcccaaacaaaattggtccaattcaaaagggatacctcttcgtgcggaaaaatcagtagatttcttgaacaacccacccgagctttaatgctagatttatttcggccaaacccagacaattttcaatttgaggcctggagatgcataaaaactagacaaacacaaaaatacagaactgatttatttgggtacaaaattgaagaaatccctgatcaaattcttttaccaaccacttttgaagattgtcatcaaatggcaatttacaaaaaatgtgagtttggtgttttgtcaggagaaattggccaaaaacacaccaacaaaaaattaatcattgaacaatcatggtggaaaattgggttccaaaaaaccgagtccgaaaattgttttttgtcaaaaatcactttgtttggaaccccagggtcagacataatacattcaccagcagatgatacaaagaattgtaaatactcagatggacaatgccagttagaaaatggtgtttatcttttatgggagattaagaaaaacattaaaaatctttttgatgaaaaaacttgtgtttataaaagggaagaaaaaatcaatggcacttatgtcccaggtatttggatgtcaaatgataacaatcgggctttagtttttgatcaaaattcaaaaaaggtagagtcatgtggtgaaagattgcgtgttagtgcgcaaggatttgcaataattgaggaacaatttaaggaattaatgaaaaatgagaaaaattcgtttgatcaaaacataagaaacaaaagaaaaagattcaaacgttggaatactcctttctcaagtgaaatagagaatactcccttggacggagaagttcgagcaagccaattggcaatgcaattacaagccggtgctttttaccaaaacaaagaaattaagtcctctttccataaattaattgaaatggtttgtaaaacattggatgataatattttcaatgggtattctcatttaaacccttcattgtttataagacaaaaaactggtcaaacttttttagaagggcattggatttccgatgaaattttggaattttggggttgttcggcaattaatttctcctttgtcccgtctttagatggaaaatgttatgaatttattccattaaatttttctttagaccataccgaaaaacttttgataggatttttggatccaataacaatgattgtcaaagaaaatagtaaaatccaaacatgcactgagggacaatttaaaacaattttactgaacaataagctcataaaaataaaccaattaacaggcaaatatacttttattggagaaccaactatttataacatcaatcaaaaaatatggggtgaggaaaatttgcctatttttccggtacaaattttcaaacaattaattttaactaatttaacaaacaaacaaattgacatgttggaaatgcttcatgcattccgtactagccgaattattgataatagaccaaatgaagaccgaaaaatttggaattcaaaccaatttcgagcatttacctttcaaaatttaatcactgaaattgattggtggaaatatgtaattcgatcagtcattttagtcgttataattaattgggtctataaaatttataaatggaaacaaaaaatgctgatcagaaaagaaattaataagaggaatagtcaaaactttcagcaacaaactggtgccattcaaattccactggccgccctgaaacaacgtttcgttgggggagtgtcggcgcccacgaccgacgaagccgagatgccagagaatgccgaaagaattaaatgccaaaaacggaagagacggagaaaataatttttgaacaaatttgcatttaattatttattaatttaaatttcatttcatttctctattttattattcatccatatctttcatcctttgcttttgcgatcactttataagtcgttggagacaagaagaaaataagcgatagggaatttcacagtttaataaaaagcggaaaatgtccgtgagcggaaaaaagggggaaagatggaaaaattaaaaatctgttctcattcgcttaactttttaatccgttcaacatcttctctctccgattaaaaattatttattaatttcgaattttcgcaccgtaataaatatttgtcaccgggacattgtttgaaggttacggtaggggaaaatttggtactaaaaatcgtttcaccgggaaacgggaattggtccaccggggacttttgaaaacaaaatctgtcaaggggttggcccaccggaaattaaaagtgattggcaaactctaatttgttccaccaaacaaaggctgattgattgattcattgtttgattcttctactgtcattggacgaactgacaaaagagaacagcggacgaagagcggacttcgacacgtggcgacccattggccattgcgaaccgaattgtcaaaggtggacagattcaaatttttgttaaaatttgaaaaagctagttggctagcaaaaattttaaaatgagttcgccaatattggatataattcaagggctagtcaatcgattagaggttgagttaaccaaagaaattccgataaatcctggtcaaaatgccaccccaaatacaatccaaagacatttgtacagagcaaaaaatgcttgtgatgagttaagcgaaattttggaagaaattcagagaaagcgcgtagaaatggcagaaagtttgcaaaaaattgcagttgcagcgcgcgaaaataaggaaagagtttatgtagacttttgtacgcatcttgacattgaggcaaaaattaatcgagcagtaattaataaaaatgaatggcaaaacaaaaaagaacaattggaagatatttttgacataaaccctcaaaattcgctaaatagcacaattcttactccaagaatcagcccatcaaaagagtgaaaattccacaaatacaattgaaaaaatttgatgggtcagttgaaaaatggataccattttgggagacattaaaagtacatgtccacgaggatgattcggttaccaaaat

SEQ ID NO: 619 - DNA, 2383 bp, Heterodera glycines
  misc_feature (53)..(53): n is a, c, g, or t
  misc_feature (105)..(105): n is a, c, g, or t
ttttctttagaccatacccgaaaaacttttgatagagattttggatccaatancaatgattgtcaaagaaaatagtaaaatccaaacatgcactgagggacaatntaaaacaattttactgaacaataagctcataaaaataaaccaattaacaggcaaatatacttttattggagaaccaactatttataacatcaatcaaaaaatatggggtgaggaaaatttacctatttttccggtacaaattttcaaacaattaattttaactaatttaacaaacaaacaaattgacatgttggaaatgcttcatgcattccgtactagccgaattattgacaatagaccaaatgaagaccgaaaaatttggaattcaaaccaatttcgagcatttacctttcaaaatttaatcactgaaattgattggtggaaatatgtaattcgatcagtcattttagtcgttataattaattgggtctacaaaatttataaatggaaacaaaaaatgctgatcagaaaagaaattaataagaggaatagtcaaaactttcagcaacaaactggtgccattcaaattccactggccgccctgaaacaacgtttcgttgggggagtgtcggcgcccacgaccgacgaagccgagatgccagagaatgccgaaagaattaaatgccaaaaacggaagagacggagaaaataatttttgaacaaatttgcatttaattatttattaatttaaatttcatttcatttctctattttattattcatccatatctttcatcctttgcttttgcgatcactttataagtcgttggagacaagaagaaaataagcgatagggaatttcacagtttaacaaaaagcggaaaatgtccgtgagcggaaaaaagggggaaagatggaaaaattaaaaatctgttctcattcgcttaactttttaatccgttcaacatcttctctctccgattaaaaattatttattaatttcgaattttcgcaccgtaataaatatttgtcaccgggacattatttgaaggttacggtaggggaaaatttggtgctaaaatttgtttcaccgggaaacgggagattggtccaccggggactttttgaaaacaaaatctgaaaaatcaaggggctcaccaggaattaagaagtgattggcaaactctaatttgttccaccaaacaaaggctgattgattgattcattgtttgattcttctactgtcattggacgaactgacaaaagagaacagcggacgaagagcggacttcgacacgtggcgacccattggccattgcgaaccgaattgtcaaaggtggacagattcaaatttttgttaaaatttgaaaaagctagttggctagcaaaaattttaaaatgagttcgccaatattggatataattcaagggctagtcaatcgattagaggttgagttaaccaaagaaattccgataaatcctggtcaaaatgccaccccaaatacaatccaaagacatttgtacagagcaaaaaatgcttgtgatgagttaagcgaaattttggaagaaattcagagaaagcgcgtaaaatggcagaaagtttgcaaaaaattgcagttgctgcgcgcgaaaataaggaaagagtttatgtagacttttgtacgcatcttgacattgaggcaaaaattaatcgagcagtaattaagaaaaatgaatggcaaaacaaaaaagaacaattggaagatatttttgacataaaccctcaaaattcgctaaatagcacaattcttactccaagaaatcagcccatcaaaagagtgaaaattccacaaatacaattgaaaaaatttgatgggtcagttgaaaaatggataccattttgggagacattcagagtacatgtccacgaggatgattcggttaccaaaattgaaaaaaacataatttattagagtcaaatttagaaggggaagctaaggagctaattgagggaataccaatttcggaagatggttatcaaattgcaattgatttacttttggaaaaatacggtaaaagtaccaaactaataagggcactcaatcaagaaattaatttattcccacaaagtgacactgtggaagaagatgaaaaattgtacattaaatttgaaaaaatttgcagacaattgtcaagtttaaatcaagacatggatctatcccctcattatttatcgctagaagggaaattatcaactttagttctggacaagtattttgttataaaagatgccgaagataatcaaaattggaatactacaaaatttagaaatgctctatcgagagcaattgagcaaattaaaaaaggcaagaagtgagacaaaaaacaagtacgagtcataaagaagtaaatcacaaca

SEQ ID NO: 620 - DNA, 1975 bp, Heterodera glycines
  misc_feature (47)..(48): n is a, c, g, or t
  misc_feature (89)..(89): n is a, c, g, or t
  misc_feature (1822)..(1822): n is a, c, g, or t
  misc_feature (1911)..(1911): n is a, c, g, or t
  misc_feature (1918)..(1918): n is a, c, g, or t
  misc_feature (1947)..(1947): n is a, c, g, or t
  misc_feature (1956)..(1956): n is a, c, g, or t
ggaggtcttggaggggctatcactaaagaaaattggacgtttgaacnncagcagaaaatactatttatcccttaaccgtttgctatgtntagccaatctcttccggtggtttcggcacctccgaatgccccgctcatttcgtggtctcaatgggttcgtggcattttcctcatcccgtttcgctacctttacacaacggcaatggacgtgttcttcttcgtttgtacgtttgcaacttcacttttaaactatttgattaattaccaccgatatttagttgatttcttctttggagggcggccgccaagacgtccaatcaccggaaataatcgtcaaaagtgagcaccaagtttaattttttgtaattaaactgggtatttttgagacaccaaaattattatctgtcagtgttcattcgttaatttaaaaaacggcggtgttttaaaaatgaaagctaattttttttttgtggatttaaaagacgcaaaagtaaatttgggttctattgcacttaatgagtccaatggcattttatgagtccaaattcggagtttaaacaagctaaaatatacataaaacaaatttcatatcgaaaaaatgatgaattaagcaactgtactgctacataacatactgaatttgttgttgtcctttcagcaatgccaatccactggcacgagggcagcaggacgttttggcggatcgaatgtgaaaaatgattattttttccatatttttcgcaatttaattcaaaaattgcttccttttttcagcataatgcgtgaacaacaacaggtgtatgagtgtcatggacagaaattttgttgaatccatatataatcttgatcgtataaatttcgcttttccttaaaagatttggattgggaattttgccctagtcggacttttttaaaatatggggatcatcttcccacctaatccctgcgtttttcccatttttaaatatcttcgtggtcagtacgtagcgtaagccggtccttggtcatcaacaatttgccgaacgcccaactcaacggcccgcccatggatcagcttgtccgacggatggccgtataaaagaaagacgaaggaatgatgctcaccttcttccactacccttttccaaagtccaatttcttcccccaaaatttgcttttgctatccaattttcaaagatcgtattcaagtgatcatttttcatttcacatttcattttcttggtgtgtaataaaggttttgcgttgtaaaaccttgcgttcaaaagcaattgtgtgccatcccggccactcgaactccctgacattctcagggacggtcttaagccaatccggcaaattataataaaataaataaaaccaaaacaaaaactttttccaatcacttcattttcacataaaacattcatttcctaaaacgaatcaaaagttttggattcagccgcctcggttgacgtctgttctttaaaccgggtcagacgaagtcgaaacaaccgcagtcagcggccacagattaagagtctggtgctctcgattcgacttagcattttcaaaattccgccaaaaatcataaaaaaggtccaacgatcaatgtcggctgggattagatcagttttaggtcccgcaacggctagggttagaacgaatttgaatgagggactagcactcttacacaatcaaaatgttaccgccgaagcactcatccgtgcatctgaaaaaatcggccggagtgttaaattagtccagggatacatgcgggactgggacagaatcatggctgggttagacggggacgcaagaactgcggaggaagcggtttatcttgngtttcgcccaggcggtgaacagctcggagagctcattgttgaagcaaacgaagcggtgaccgaattggatctgcgaaccgatcaattgncgcattncagtcgcaccaatgcaacccgcacaacantcagcaggncagtccaagtgcaaccatt

SEQ ID NO: 621 - DNA, 13742 bp, Heterodera glycines
agggcttccctttttaggcacaaaaaatcgcgaaataggcacctaaaaaggcataaaaaaaatcgcaaaataggcacaaaaatcaccaaataggcaccaaaataggcaaataaaattttttattaacgatttttaggtaacaaaacacgttaaaacttaaatatttcatttttaaatgaaattattaaatagtttaaaggcttttttcaaataagaccaaatttctaaaccaaaaatttttattaagaaaaaaatattaaattttgggaccaatttctggaaaaaaattttcatttcttaagggtatattttctgaaatttttttggggcatttcttaggggtgtgtttttcgtttttattacatttttgttaaggagttttttcaaaaatcccaaataggcacattaggcacaaaaaccccgaaataggcaaaaataggcattataaaagtcatcgtagacagcccaaaccaagcggaaaacgcatttttcttgcttatctgaacgtattaagtgcgcaaaaattttaggcatttgcctaaaaaaaaagccctagtgatgaacatagatcaaaataatgtttggggaagctacatacaatttacgaagacgaacatgcaaaaattaaagaccatcagcaccagagagagagagagagaaaaacaaaacaaaaattgatttacaaatatcctttctatgtacatttaagatacgcgtaacaaagacaaagttaaaggaggcggtgccgagtttggtcatggtctatgacagacatcaccaattcaaatccccgacgattctttactgtcaattcacattcattactaacttctcttttttttttgctccccttttcccatttttgaattcctaagcgaaattttttttacattcgattagggtatcttaaattcctacataatttgttaaatacatatgtacatacataaacacacaaacaaatataattagctaattaaataattaaatttcatggtacttttctttttagacactccctgatgctttgtcatggacagaaattttgttgaatccatatgtaatcttgatcgtataaatttcgcttttccttaaaggatttggattgggaattttgccctagtcggacctttttaaaatatggggatcatcttcccacctaatccctgcgtttttcccattttttaaatatcttcgtggtcagtacgtagcgtaagccggtccttggtcatcaacaatttgccgaacgcccaactcaacggcccgcccatggatcagcttgtccgacggatggccgtataaaagaaagacgaatgaacgatgctcaccttcttccactaccattttccaaagtccaatttctttccccaaaatttccttctgctatccaattttcaaagatcgtattcaagtgatcattttcatttcacatttaattttcttggtgtgtaataaaggttttgcgttgtaaaaccttcttgcgttcaaagcaattgtgtgccatcccggccactcgaactccctgacattctcagggacggtcttaagccgatccggcaaattataataaaataaaaccaaaacaaaaaaaatatttttccaatcacttcattttcacataaaattttcatttcccaaaacgaatcaaaagttttggattcagccgcctcggttgacgtctgttctttaaaccgggtcagacgaagtcgaaacaaccgcagtcagcggccacagattaagagtctggtgctcttagattcgacagcattttcaaaattccgccaaaaatcataaaaaaggtccaacgatcaatgtcggctgggattagatcagttttaggtcccgcaacggctagggttagaacgaatttgaatgagggactagcgctcttacacaatcaaaatgttaccgccgaagcactcatccgtgcatctgaaaaaatcggccggagtgttaaattagtccagggatacatgcgggactgggacagaatcatggctgggttagacggggacgcaagaactgccgaggaagcggtttatcttgggtttcgcccaggcggtgaacagctcggagagctcattgttgaagccaacgaagcggtgaccgaattggatctgcgaaccgatcaattgcgcattcaagtcgcaccaatgcaaccgcaacaacatcagcaggcagtccaagtgcaaccattcgtcgcacatcgcccggtcgtcccattgcccaccatgggactcttggatttcgatgggaccccatcccgttggagttctttctgggccaattttcgggacaatgttgaccatagaaacgatttatccccggctcaaaaattgtgttatctcatgggacaattgaagggccccgcaaaagacattgttttggggtattccactacggacgctgattaccccatagtaaaggaagcccttgtcgggcggtacggagatgagacaaaacgtgcccacgaattacgggccgaactcatccgacttccaaaagcgaacgccgcaactccgtctctccgtttgttctcggaatccgtcgaacgtatttgtcggcaactcaattcgttggaagctggccttgacgatagtccatacctgattacggcattaatggaaaagttgccaggcgaaatccgtctaaaactgctcgagcaggagagagatggtggtgccaaatggacagcccgccaatggaggcttggtctttctggactagtgcagttaagggaagcggtgaatatggatcgcgaaaatatgcaccgccaaccaccgaataatggcggagtaggggagcggcgccaaaacagccatcaaacatttcagacgcagcctcgccgggctttcccggttgtcaagccggttagaccggaaattcgaaaccccacccctccgccacgaaaattttcaccaaattgctctttgtgcgagagtggcgatcacaagccgactaattgtccgcgttatttcaccgcgaaaaaacggcagcagcgattaacagaacaaggtcgctgtcatttgtgcattagaagtggccattccgcggccaattgcgcaactaatttcaaatgttcaaaatgtggtgatcggcatcacttaatcgtttgtccaaaatttcgttctgaacagtccaccactcaaaatcgggactctcgaagcgtccatttttctggtgaaaatagaggcggcatgcgccagggtcttttagcctcagcgccggtgtcagccaccgctttgtcgcaccctggaaaaaagagaaatccatcatatttaatggtaagaaccacgccggtgtataactatcgggaacccgccaatcccacaagagctccagttttttgggaccctgggagccaaacttcatttatcgccactgatttaactaatgaaataaaaccgcccagagtttcttcagaagaaatgattgttgggggttttatcggtaatcaaaaggaaacatattcccgtttccactccccgtgctactctgttatgcttggcagggaggacggtggttgggagcaaattctgcttaaccaaacagacagaatcacgccgcctattgagtgtttggtagaaccaagaaattcaaacgaatttttgagtggtgatgaccaggaagggcctatcccgtattttttggaaccaaaaatcatgatcggagttcgtgaattctggcgttttattctggatcgtagggaaattcgaccgggaatttttgaaatccagacagttttcggaacgatttatgggggcgaagaaatggcagttgcctcgaaccccgggaattcgctaacctgcacaatcattcaatcagcacacattcagcctgagtcggacgtcggccgcttctgggcattagagtcaattggcataactgactgtccaaaattgaatgatgatgaaaaggcactgaaaaaatttaatgagtcagtttctgctgaccctgaggggcgttacgaggtagctctcccatggaaggaggagggagagtacccggcggaaaatttcagattagcattttcaagactttctgcacttatacggagactgaaggaatcgccacaactttttagcggttgtaacgacattatacaggaatatttagagaaaggaataattgaaaaggcccatcgcgctaaaagtccacaacatttcttgccccaccatacagtgatgggcaaaaagcttcggatcgtttttgatgcttcatcccacgaaaagggtgcccaatcattaaacgaaatgttattttcggggccaaatctctatcctgatttagccggaaaactcattcagtttagggccacaaaataccctatttgggccgacatagaaaaggcttttctgatggtaagtctgaaagaatcggaccgtgaattttcaaaatttttgtgggtaaaaaatatatttgcaccactttctggggaaaatctcctcgttttccgctttcggaggataacatttggaatagtgtcttgcccttttctattggcagcgacactccaacatcatttggaagcatttcccagtgagttagcagaggaaatccgggaaaaatctctgctttacgttgataaccttctgcttttggctgattcgcctgaggaagcacgcagaaaggcagccgaagcacaaaaaattttcgccgcggctcaaatgcgtctgtgcgaattcattgcggctgatccgtcaagtttggacgaaatacctgaaaatgatcgcctccgaaatgaggcaccaacggttctcggactaaaatggactatttgtgaggacaatttgtctttgacttttcctacggttcctagtccggacggtttaacccggagaacggtcctaaaaacagttgcgtccttttttgaccccttagggttatgttcgccttgtttggttggggcgaaattgtttttccaaaaattatgggatggttcaaaaggctgggacgatccaatcccagcggaagagaccaaagaatgggatgaaattaaagccctctgggcagcaaaaacgatgcacatagcgcgcttcacgcctcgaattaacactggcggaattcaattacatgttttcaccgatgcatcacctaatgcgtttgcctgcacggtctatttgagagctgaaatgccgcagggaattctctcgtcgttggcttacgctcgttctcggctccgcccgaagaaaatggcggtggaccaggcggatggtctcactatcccacgattagagctacttggaatcctaatcggatctcgggcagtaaaatttgtgcataaacatttaaattatgagatcgaacaaattaatctttggtcagattcgcgcattgcgctttcgtggctagcgtccaccgataaaatgccgatgtttatagcgaatcgtgttcgagaaattcgcgccaatcggcacataatcttccgctatgttcgctccgcggacaatcccgcggacctcgccacgcggccagtgacacctgatgagttaaaattatcagaattatggtggagagggccaaattggctcggcaaaacacctgaaaattggccggacgaactcaccgtcagcctcccaccggaggaaagcgccatttcagagccaattgtctgcgctccgttgaccactccgccggcagtgttcgattttgatcggttcagttcatggcaaaaactgatcagaacggccatgtacgcgttgaaattcctgtcagaaacgggaaaaaagaggaaattgctccccgaatttagagaggctgaaaattttagcccagattgtaataaattcacacacaattggatcattagaatagtacaggggacttttagccccccaaaagaaacttatctggataatgacggcctgattcgtctcaaatcaaggctttgtggcactggaaacccgggattcgaacatccaattgtcatcccatcagagtcgtgggtctgcgcccttctcattaggcattcacatttgaatttgtgccacgccggtgttgactcaaccttgacagatttcttgcaaaattattggtgccataaggccaggcggacagtccgctcggtcatcttcagttgtaatatgtgcaaaagggatagggcaaggaaatttggactcccgcctatgccaccccttccgaaaaatcgcacatgtccctctgccgttttcgaaaatgtcggcatggattttttaggtccaacactttacaaaatacccaatgaacagcccgcaaaggcttgggtcctattgatcaccagtttggcatgcagggcggtacatctcgaattggtgtcgtccatgtcagcagagcattttttgcttgccttccgtcgctttgtcgcgcgaagaggacttccaaaatcgatcctttcagatcacggttctcaatttgtgttggccaaaacactttttgagaaaaacactgaagtgtccatcaaatggacgctaatccccgcatttagcccatggtcgggcggggtctatgaacgactaaattctctcataaagaattgttttcggagagttttaggccgacgactcttgagctgggaggaaataaacacatttttagcggaggctgaggcctcgatcaactcaaggccgatcacttttgtatcagatgagtctgacggtcctctgccgctcagaccaatcgattttattgctcctagagcaaaccttgaatttgaaggaacggatatggaagacgaaagttatcgtccatcggctgctgaaaaattagccaccagatggtgggcaacagctaaatccattagaaatttttgggaccgctggtccagcgaatatttgctcctcctccgggagcgtaatcaaacagcacataaaggaccgcaccttaattctaatgtccaacccgaacttgggcatattgttttagtggaacgcgacgaatatccacgaaacacatggccaatgggtagaattgtgggactgaatggtcccgaagggcatccccgtagtgccgaaattaaaatgccaaatggacatatttggacacgtccggtctcaaaattagttcccttagaggtaaatccggacaataaagacttaaaccaggccctgtcgccgcggggagattcccgggagggaaatgaggagtcaaatgaagaattaacgagaaatcagcgatcagaagaacccgttgaaatggggcctgaattgatcaatgagtcaattcggcccaaggccaaattcagatgggcgaaaaatccgcctattcaaattcaacgggctagcaagacgccccgagcattaacatcgtctccagcttatttgttgtccatggtggcgattttcattctccttggggtaccgattgccgacgctttcgccctttcaacagcaaatcagcagtcgaatcagtcatcgtggataacctgtaatatgaagggggtcaaaatagaggccccagaagggtctaaaaacatagaattatgctgtgatgggatatgtgggaccagaaattacataaaaccattcgttttcccattactggaggagagtctcctctccggcttttcatgtcgggccacttattggtcgccacctgataacaccattcaacaaaatatagaatgtgcaccaatagacgtatgcactttattggactgctatttatgtgaaagccgaattttaaacgcacattgctcacccgcaatttcagcaatcctgattggaattctggctcttctggccggtttcatatgctgtgcactttgctgcttgttcagatggagcgcctggtgctacaaatcgcttcgaatgattgtcaaatgcatttttcgatgccagaaacacaaaaacctaaaatacacacgactccgaagggaatcctatggggataatagtgccgaagagggctattcgccacgaaattactacaggacaacgggtaagcctttaaccaaattgggctatgcattggccatttcggtcatggtttcaaatgttggatggactcatggtgatccagtttcgatcacagccaaaactgaggagtgtgaaacgagtccaatcagtaccgaatgccgtttaaattcggtgactttgttaaatttactcccggctggtcaaccggtggatcttatagtccggacaacggacgctgcggttttaggcaaaatcacattcaaattaaagggattagtacaagaatgtattcccgagtcggtgggattcattaggtcgtaccaagttaaaaccctggcgagcaaaagatgcccagggatgggctcatgttccggcaaaacctgtgaaaacttgttgcccaacggaaccgtttcagaattggccgaaggtaactcattcccaggtaattccttctgcttagacagcagcagcttttggttccatggatgcggtggaactaattccgcttgcttgtttttccgtaactacgcaactccgaccctaactggggaaggttctgtttatgaaatgttcagatgcccggcatggcaattccgaattaaaacggaaattaaagttagcttcagtgggggcattactattagtgaagagacagagctttactcgggtcgtacttttcacataaaaggggctaatttgtcggtcactccagccgtttttggcaacccggcggctccaataatgtccgaaacattttttggcggatcggacagtgctgttctcgttccgaacattgaacccgctttacattgtagaaacgaattagatgcgttgttaatgaaatgcgccctttcgttggacgcatgcacaaaatgccgtcccgatcacagcgaaggtattgttcgatgccactgcaaggaagtggacatcgaaagatggcggaacgacccgtctaaacgattaccactctcggtcggccctttaactcttaattatcgtaaacctaggcaggtttgggcggagtcggaatatgtacccgttcaaatggccttaaaaatggagggtttgactctaagcattcggaaagatatggccaaatgcataatcacaccagggggcttagcaggctgctatggatgtcggatgggaagccgttttaacttcacttgtaaggcatccctcggtaatcccctggcagatataatttgtgataatggtgcccgttgggttacacattgtccagaaaattcaataaaaatgaatgtgtcattatccctaaatgaaggggaggtaaaaaccgtttgccatgtatcttgccccgggggcattaccaattttacgatggaaggacttttacattatttgcctattgttagaggcgaatggaagatttctggaaataaagtcgaaagaggttctcaattgcccgacttttcgatactagaacatttttatcgagttttgagttgggtcctaggcggacctcaacttttcattgttgtgtgcgttttttgtgcaggaatcttcgggttgtacatttgtttgaagtgtaatccaattttccgtgcctatcgccgattgattcgagtagtcactctgatcaccatcttgttgatcactgcaccattggtcacatgtgatgagggcaccaaagatgaagagacgatcatcaaccagtcatggtcacaattcaaatttttgctttccaaattcaaggcagaattagcatggggcacttttctcattctggcatcggcaaacgtatatgccatttacataatctataaggaatggaccatacggcacggtgagccgcagagaaatcccatacgaaaggacagagtccagccaaggggtgatagaattatgcccggctttcgcctttgagacattcggcatttttttaacccatgtacaaaagcaaaaattaccatttttctcacaataattaatccataaatctttgatagagagggaaaatgtaaatcactaagcccaagacgggcagaaaggtggagcctcattagtataaaaaggaacagttggcctacaaaaattattctcaattttactcatctctttgcttacctgttcctttccacacttttgttcccatgtctcaacaaaaccaaccccaattcaccgctcctcctcccgctcccctctatccatacggctatgcgccgcactatggctacatgccaccacatgccccaatgggctaccaaccagtgccaaccgcaccaccgcccagttttgtgccacaacagcaggaatccgttccacaggctcatccgcagggcaatgcgacggttcaggcaaccgccgcgcaggccattccgcaaaattcggcctctgttccaccagcaactgccgcaccaattcaccaggtgcagcagaacaacaatggtcagggggtcgtcccccaagcgggccgtcaagcccaggacatgcaccagagcggaagccgttcacaggtggaatccatcccctaatttttttcacatattcctttattacctgtttcttccctccacaaattttccttccactcacgaattttatcattaaccatttcccagcacggaccggctccgtacgcattccgtcgcaaaggaaaattcggcgttgccaaaccggtcaatttcgggccccctccggccccgattcctcgagtttctgaggtgctgctccaattggtgaccgagttcaccaacttcaccaccgaatacacgcgcaacttcaacgcttttgcgaccagtttttcgtgtgattttaacaattacgcgacggagttcgcgcagttctcggcctgggtccgagagaatgctcatcaatttgggggcaaaaacgcttccggccaggcggctaatgaaacagaagacaaagaagaggaggaggaggaggaagaggaaaccgaggccaacgatgcctaagaaggaaacccctggctggggggaacttctgtcatggacagaaattttgttgaatccatatataatcttgatcgtataaatttcgcttttccttaaaagatttggattgggaattttgccctagtcggacttttttaaaatatggggatcatcttcccacctaatccctgcgtttttcccatttttaaatatcttcgtggtcagtacgtagcgtaagccggtccttggtcatcaacaatttgccgaacgcccaactcaacggcccgcccatggatcagcttgtccgacggatggccgtataaaagaaagacgaaggaatgatgctcaccttcttccactacccttttccaaagtccaatttcttcccccaaaatttgcttttgctatccaattttcaaagatcgtattcaagtgatcatttttcatttcacatttcattttcttggtgtgtaataaaggttttgcgttgtaaaaccttgcgttcaaaagcaattgtgtgccatcccggccactcgaactccctgacattctcagggacggtcttaagccaatccggcaaattataataaaataaataaaaccaaaacaaaaactttttccaatcacttcattttcacataaaacattcatttcctaaaacgaatcaaaagttttggattcagccgcctcggttgacgtctgttctttaaaccgggtcagacgaagtcgaaacaaccgcagtcagcggccacaatgagcaggcgctggccattgacaagcaaaaagcggagcaactcaaaatggaaaagcaacgggcggaggcggacaaaatgaacaacaggaaggcatttttggcacgaaaacggggcgaagtggcggcaaacattggcaaaacggcggcggaaacgaatggcaccggcggcggcactgtggcggaggagaaggacgaggatttggtacgcattcggctcgtgttcccgagttctgcccgcatggaacagaactttcgccactccgacagtctcgaggtatgtttttttgtgtgtagttcgacgacagcaagcagtccaacagctggttattctcattgcatcaagaaaaaagattatttccatctttcaagcgttttatgatgcattaaaaagtttttcacaaaaattgttacaaaaaatcgctaaaaacttttttgaaaaatttttttttcttaaaattttataaggtttttcttttttgaaaatttccgggatgagggaatagggacaaaacaaacgtcaccgaccgaaacgtcaccgcaaaatttttagttaactagccctaattcgaacaaaaaaaatttttttttagaaaattcaaggaatgaaacaaattcggtggcaggcctcattttgggggtgtactcgggaaacgtagtgtagcaccacccatctcaattcttctttaaaattggtgttaaattccctccatttcacagcgtctcttcgatgttgccttcatccatccggactgtcccgacaatttctctctcttcaccaatttcccggtcaaacaattgaactgcgcgcccgactggtaccggagcgagtttcgtcctgctgccgctgctgctgattcggtgatggaaaaaaatgccgacgacgccgactccgttgttggcacttttgctgacgccggcctttccaaatcggcaaatgtggtggtccgggacaacgacgcataaaatgccatgccattgaatgcctgcggagattgcgagaatggggaggaatctgctggatggatggacgggacattcattcattaattattattattatattgttttgtgtgttgtattgctctcttcgctatgctattgtaaaccaggcccgtatcccgtgaaaaattttaaaaattggcaaaaaaaattatttgaaaatttttacagaaaatgtcccgatggcgccttaacggcacattgtaccatcatttttgaaaatttggccccaaaatggcaaaaaaaaagccatttttgggacaaaacctgcttcatcactagggcgatgaaaattttgaaaaattaagccctccccccaaaaattttcctggatacgatactgttggcaacacagcagcatttcccctctcatttcattccaattgtgaactgcttgctggtcatcttcctatgtggtgttctgttttcccctggataaacacattaattttattttagttgacttctgctgcatacctgctgaacaaggggggggggggggaaggaaagttggtggtaatgctttctcttattacagatttattaccttttgactttctgtttttgccatttttattttttttgacattactttatttttattaagtattactgataattagagttacaattaataattctttgtgttcacttaaatgccgacctcgattccatgactaccaattacaaacatttcctgcttcctaccccataattatcgaattctttatatttacgaataccaattttaaatattaatcgcattccaattaactcaaattttcctgatcatgtccacaagacatcatttaagaattgacagtgatctatctctatttttttaaattcattattttatagacttaatttacccatttttgtaacaaatcatcttctcaattagctttatatactaaaaatattataaaaatgctaaacactcgttttctaaaatttacgcttttttcagtttgttttttattccaaataaattttaccattttccatgacaaaaaaaaaacagatttgtggaagcaattaatgtgccaattgtgtcataggttaaggcaaccatcccgaaaaactattgttttttgatgatgtcatttatgatttttttttcttatttgactttgataaaaaagtaaccttacccccatttttttccttttcattttggcc

SEQ ID NO: 622 - DNA, 1934 bp, Heterodera glycines
aagagtgagaaagagaaaaaagtcagcgaaaatgtcgatcgtaactatgaaaaaagaaattttataaagaaaaattgccttattttttaacaaacttcattaaaaattccaaattttctacgatcgactaaactcaatttgtgaaaaacttatcgatcgtaagagaaaagtgggtaaaaaccccaaattttgccggcttttaaaaaattccaaatttttacgatcgactaaaatcaacattttccctttcgtctataattgtctttaaaatttggcttaaaagcataaaattggtcatttttaggtgcaaaaaaaaatttttttttttggaaaaagtagcgtaaaaaagtggtatgaaagttttcctaggcgttcaaaatttttaaataagactggcagaaaatttttattgatcgactaatattttggttggacaaattatgattttgctttgtttgtttgttaacattagagctaggggaatttgtgccgaaggtaccccctccactttttgaaaaaaaaattttctcgagaagtcattttagggatttcagagtcgaagaacacggacaaaaatccaaggctgccaaaaatggcctagatttattaaaacggagcgggaatttttttttaattgatacagtactacttttgtccatttacagtaatcgcgacaatgtaaggaaggattgagcaagaggaggattaaaaaatgcttaaagcggacgcataaataaagaaccataaaaaagagaaaggcgaatggtcagaggattaagcatggtttgggtgggagaagccttaccaccagactgaggccgagggttcgattccctcccaggtcgaaaaactgtgcacacctctccatgcaattacaattccaacaaaatattaaatacattgaaaatgaattaataaattttaataatttctagttttttttttcttcaaaagtttatgataaaaaaatctaattaaggtaacttggcagcaattttaaagaaaaaaaaattaattaactaaaaagaagaaaataatttaaaattataaatatttttttcattttccaaaaatcgctgaaattttttccgtgagaactgtcagaaaggatgtcactagatgatagacaactgatgagaaaggtgatctgattgaccaaaaaaatgttatcagactaattagatttagcacaaaggaaaattctatcgtgaaaaaacttacagttttataaaattggaaagttgatcagcgaattgtgagcaaatgagtacaaagtttaaagtgattagaaaatatcatgccaattacgaacagatgatgaataagtggaatattgaaaataattgagcaaattaagataaagtgatcggtaatgattaaaggctaggtgtaatcaatagcatttaaaatggagcaattaaaatttatttactataaaaaagttggcatcgttgagcagaccggcaaaaagtcgccatcgtttgcaatctgattaatttaaaatttggagaaactcgagagtcttgagtgtgtacaattaatatgacatttttccgacgtcatttcattttttcgtttgttaaatgatgtcagtttttgcgcttttcagtgtcacaatttttggtgtccactttcacgccgtttttgaggaaaatgcaagtatcaaacaaaatgagcacaaacaaagacaataaataacaaaaaatgaaatcattttgatgaaatattagtatgtagagaccggattgtgcagcatttgctgaaattttttgctaacttggggcgtgctaataagcatgaaaaacgcatttctaacttagtttgaggcttctaagtccatctttttcatgctgatttttgcttaaattggtttttttcgtgcttcctgctgagcacgccattttggcgctgaatttatcattttcatgcttatt

SEQ ID NO: 623 - DNA, 1191 bp, Heterodera glycines
  misc_feature (9)..(9): n is a, c, g, or t
tagatattntggaagattgaatgtaatgtttagtaggccagtaagcctaagaaattccattttagaaattgtactcgtaatattaaatttttagagactattttcccatttctagtgctcgttttgcgggttatttagggcctgcctgcccaatattgcctgttctcactgccataaaaagtgaattcttcaatgttgtaaaaattactctcatatttttcccggcgacggcagctaattcttttaggcatttttatatcccacaaaaaattgtcaggtattgaaagctgaagattttgtaatttttcttatctaatataaaatccaagtattattttttttttggctatccttattggcaaatttaataataaaatatgcaaacatttcctgtcaaaaataattgttgagaaaatcaatcattattgccatttccggcgtcaatttaataatcaaatttaaaaacatatccaccggcaaatattaattgatcaaatccatttgctttataaattgcaacaaccattatgctgtcattagataatcatgtcacaaatgaaagccgtatttcttttttttatttttgggcattattattgctcgcttcacgaaatcggctgaaggaaagagtttgttttctttagataaaagcaaaattttaaataaaatttatttcttagaaatggcgatgccgggaatgtgaaatccgggatgatgccaaagattggtcatattttcactggtcttttggcactgtcctccgtcgcaccgggcacggtaaacgcttcccaaacgggtggagcagtccaatcagttcaacaacaatggacatcaccacctcaaatgccgggccaaaatttaatggtaagattagtaaaatgtcctattaatttttgaaaaaagcctcaggaaacgccgatatcaatgaaaaatcgtgaactatcacttggcggaaaggaaagtttcgaaactgcggtttatggacaatcaaaggtagaaagttaaaaaaaatcagattggttagttcatgggagcagtcaaacaagaaaatatggacagaagaacatgcttgaatttgctcattgaatgcttttccttccttttctgataccttttcataatttattctttggcatttatcaattccctagtttaataactttgccctaaatgttttcgatcggtgtcgtt

SEQ ID NO: 624 - DNA, 4337 bp, Heterodera glycines
  misc_feature (46)..(46): n is a, c, g, or t
ttaaaaacggaaaatggaacgggaatcatattggggaaacattttncgggaataaatggagtaatgtacagaaattttcataagtgaaaaagaaaattatgacgaccaaaacgagttcagaatgggtataaatatcataaatagcgggcgaaatgaagaaatgggagaaatggagaataatgataagcaagttttagacgaagtggaaaatatgaacaaaaaaggcagattaaacgagtccagcaaattaaatggagttacttacgagagccattctttttttaaaacaattgatcatacagaaatggaactcttgacgaaagacgaagagcacgttctcaaatcactggaaaaatcgctacaatcgcagatgttagcggttcggaaaagtttcgctgaaagtgaggggtcgaaaatgccggtggaggacgaagaccaagtagcaccactaatggacgagtggggagaaaaggaggaaaagaaggaaaagaaggaagagaaaggaatgaaggaaaacaaaaaggaggaaaagaaggaaaaggaggaaaggaaggagaagagggaagtgcctaggaaaaaggcggaggaagaaaaacgaagcgcaagtgcggtgacggtcggagaagaagtcgtgtcaatcgtggactccacagaagaacgggaacaggagcgggaacaagaactgttcctaaacccgcaggtaacaaatgagcgcatggctttttgggaatcaacgctgtataatcattgcacaaaaaagacgtggcggaaaaagaggccaaccgaaagacggcagaagtgggagtgacagtcggctcaaaaaaaacgtgtttggagcgagctggagcctcctgtgttgcccgatgagccaatctcgaaatttagcgaaaaaatgcatcgatgcgcagagatcgaccaaaacacgaagaaagcacgtgtggtgatggatacactcctcgcaattcgagagaatgcgctcgaactgagcgaccaggcgcaaaagggtttccgtgaagtgcaaaaatgggtgcaaagattgaaaaatttgaagtggaagaagaaaagaaagaaaaaagtgggagtggttggacatcccccgtgacaggaaatgccgtgaagtgcaggagaagtggttggacaccaccagggactggaaattcggtgaagtgcttccgctgtggacgctgtggacgcatccgtcattttgcacgtaattgtcagaatacttccacaaaccaatggacgcaaggaaatcgcggatggccatcacagcaacctttgccgaacgaaccaagcacttcacaagcaaatgctgactccgtggtcgacattcctgaagagaccgggcttcggccaatgattaagcgatgagaattgttgcattttttagtccctaacataaaaaaaacacaaaaacacacaaaaaaatgcaacaaaaaacaataaatgatcgaaaaattagctttaattgttgggaaaacaatatgggcggcctgggacgaccaatcacatttcattaaccaaattgggcccccgccccgttcctcttttttgtgtcccccgttcccggccaataatcattctgttcgggagagggattggcttagccaatctcccaatctctctccctcctcccgctaattatcccgagaccgaactgggagtcccttcccccatcccacatttactcattatatataattgtattgtgcgcacattactcgaataaagggcatattcaaatgccgccgttgggatttttggagagggacactttgcctatttcagcaacaaacatcaattccctagtttaataactttgccctaaatgttttgtcgctttttataaacattatttgttgcacgaaaaattattttaaaaaaatcattgagttatttatatttgggatacaattaaatcgttgaccgtggtggtcacccggacaccatctcaagttccgattcgcaatttggtgataataattattaaaatgcattaataatttccgaaacgaacctcacaaatcataaaaaataggaaaaaagcatccagatgggaagaaaaaagtggccaaaaagaatgaccaccgaagtgattttttttataaatatttattattaagttgttttttctttatttttaatttttggaattaccaaaataaaagggaatccatatttttggattgaaaaaatactgaaacgaatatttcttagcttgattttgctatatttcggtttgagatttttgaatagtatttaatgatattgaagatttgggaaatttaaaaaaggaggcgcttgaacattccatttgaatatcttttaccgtatatgctctaattatagcccatgggggattatttttcaacctcctcagaaaaggggggataattagagactaggggattatgatagagggattatttttcaaaacacctcgtagactgggggataattggagactgcgggattaatagagactgggctataattagagcatatacggtagttaattttcttgtattatcctcaaccattaaatggttgttttattaatattattttaaataaattatgacaattaattttaataagagaaaaaaaatattatacttttgcaacctaaaatattaatttattttcgagtatttttcctttaattaagaagatgaaataattttttttttcatttttaggcctttttcgtcataatttacctattttgacagtttttatttcattttgtatgcatgttttataaaatgttctttcttcaattaacaaatttcttgattgattatttacagttttgctaggtttatatacgaattaaggaaattaattatacatttgtgcataaaaattttgaccaaactttgtcttcaaattattccatggaacatttttgactatttctcattttaaagaaatcataaaatgcttggctgctccgctttcttcaaaaggatatttttacgatcattaaaaattatttttattttattcattcgatttttcatcccttttatttatagtcgtaaaaattcaacagacatataaaagacaattctcgacgagacattatacaaaacaaagaaataataattaaaaaacgaagccaaactaacgaatgcttttttcaattttcctccttctcatggtcatttttattatttgttttatatttaaaaaataatttttatgttaattagtagggatgcaatttaatttagtcacggaaaacagcaaaagaggcgctatataggaaaaaaaataattaaatttccaaaaaacatacaatagataaccaaaaaatttttcaaaaatatatttgagaaagaatcgctgagaacattttcatttagggttatgttttcattttttgaaaatttttaggttcaatattagagttgttttttcccttttattgaatttttgttcaggaattttctaagaatctcgaaaaaggcaaatataggcatttcgtaatagcaaaaaatgctaaatttcaactcagacaattacaaccaagcaaaaaattcttaactcaacgaaacaattatttaataattgcatcccctaaaatatttttatttttaaattgcataataatttagacagccgaatttgcgagcggaaataattcgtcagaattggacattggcgatttctacaaaaatagctcatcaagtgatgtttaaaaaaacaaaaacaaaatttaattgcctcttttcagttccaatttataagaatgctcgcacttttgttcgtgagttcaatgccaaaatttaaaacggggattttgcatgtttttccatattttttagcaaaaaacagtttaaatttcaaataatatttgccggatttccttaatttcttatatctcactggttttgtgatttgccacttttatgtgccatttctcctcatttgaccaccgcggctgcgctgcgctccgtatgccgtgacactttttgggaggcacacacattggacctgttcaccagaagtggcacagtggcatacgaactgggcggaaccattgccaaaattggcactgtggtgggcagaattgaagatgccatccgcgcattaattccacaatcaactcaagaaaaaggtactgtacaaaaaaataaataaaacttaattggaaaaaacaatgtaattttttttgctcctggcattaaaataagaaggaagaatcgccgatgccaattagtgttttaatgacatttattatcagattttgcaataaaatggacaattttcttaataattaatttcagataatgaaaaattatcaaatgcaaaattgatttttttgaacatta

SEQ ID NO: 625 - DNA, 1163 bp, Heterodera glycines
attattttcatattatttaattatatttcataaaatgtaaaatattcaaatagaaactatccttttttaattaaaatgctcaagggccttaaggtcccgaaaaatagataccttaataaggcctaaaaataataaaaatatgtgcaatattattaattgaacgaaatgaatcatccattttgtttagaaaatcatatatttgacacatataattttttttttaattttttgtttatgataaacattttttggatagaatttgaattttttgggtggttcagattgtacgcaaagctttgttcaatttgtataaatttttaatgaacattaaaaaaagattcaactaacttttaaaatacaacaattttaatacaccgtattcaggtgctcgctaatgactacaataaaaaaaagacatgaattgacgtaaaaaatgtggacattaaaaaatattattatgataaaatttgttttatgcaatctttgaataaaatgttctcattatgtttaatcaatgatccatttctctagcagaacaagcaataaaggaataaactcaaaaaataaaattcacttgaagtaaatgcgtaattattttttatttattcgttaaaaaaaaaactaatttccatggcaacatccaaatcaataggtatgtgcaagagtctcgagaaattctacggttttctgtgatctcggggtcatttatcggtctcgataaaatcttttcctccacgtacaaaggataaaattgtaaaaaaaatctggaaaaactgaagattatcgccaattttgattttgtataaaattatatgtcattcgcttccttacgatgagagaagccggatggtgccatttttagagcgcggcgacaagtttgagccgagttacagacccgggactgaaatgtcatttacccttgggactgaattgcccaatgtctaaaaatgcgttaaagttcaaaaaatgtttgtggtactgaatagttcaatgtataaaaatgcattaaagttcaagaaatgtttcgatcgatcgctctagggtaaaaattggcaatttcaagcagtttttatattcaaatttaaaaaaattatcttattgccgcgaagcggcacgccaatggcgagcaagcgatgacggagcaagtagtggggtgcccgagt

SEQ ID NO: 626 - DNA, 807 bp, Heterodera glycines
  misc_feature (64)..(64): n is a, c, g, or t
ctaaaagtaaattgttaaattatttaaatgtaaattttcccctgcagaattttaaacaaattantgggaaacatcaaccgacggagatggctccctgcttttattgccgctaattttgccattgccttaaactccggcttctcagcttccaagcgctaatttaggacaaatgacattaatcaaatgaaaaattgctttaatttgaacggaaatgtttgctttgagtgatgcccacacgaacaccgcatggcacactccactgcttatgctttgcaattttggcacggattatttggcacttttgccaccgccattccgcacactcgcctccttaatcaaatccagggtcgttaaaacagattttccccgtaaaaataaaagaaaaacaaaagttcaacgcgccggattaaaaaaggcacatcatcaatttggccaaaactaattaattaattgggcgaggaccgaaatggaaattggccgcgtggcgctggtgccgagaagcccgtcaatgcctgctgcctgctgggggggggggggaggaggaggagcggtgattagccgctgcatagtaatccgccgctaaatgaaatccaaagacatattaatgatgtaaggtgctggtaaacattaagcggacggaatttaagcactaattgtatcaagggcattttcatttgcagttcgagtgccgaaatgcgaacagatagaacgaattccccaaaaatgaagttggccaaatttgaaaaggcgcacagcacgacatggcttctaagattattaatgccaaaacgaaaaaaatgtgcgggg

SEQ ID NO: 627 - DNA, 3330 bp, Heterodera glycines
gtgaggatcgaatgataatatcatttatataccagggatgggccgaggtttcgtttttctcatttcgcctttcgcattattcgcattttttggcgtttcgcatttcgcttttcgcatttcgctttttggcgcgaaatgcgacttttacacccctaagaattggattaaattcccacaaaatttttcaaaattttacctataaataggctaattttcagtgaaaacctgtttataaatgaccaaaatttccaattttttccccggcggcgcctatgggcaccgccgggccccccaaaactcctattttttcttagaaaatggcccaaaatcacaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaattttaaaaaatgacttttgctttatgattttaactattaaaaagttgcagaaaaaatttcgcttttcgcattttcgcatattttggcttttcgcatttcgctttttttttcatttcgcatttttcagtttcgcaaatttcgcttttcgtatttcgctttttatttttcaatttggcccatccctgttatatacaaaatcaaaattggcggtatgttcagttttaccaaaaatcttttaccacatcttttaaagtcttcggcttctgccatgcatttgtgttgttcaatcttcgccctgggtttcagaattgctgcttaacggatagaccgtagcactgatgctgctccttcgcttacagtgtttcgcgaccggagtacagtaacgccgctgataaaggtgacccggttactgtggaacactttattgtacagcatgcggcaatcctcgcgtattgttttgttcaacgcccagtaaatcaccgggggaaatcctagggcgaaaaatctaattaaatattataagcaacagccgaccgtggacatggaacctaaaaaacgaatttttggaaattaattgccagccaaaattatgggtttgaccaagcaaattcagcgagagtgatcatccactgatgggcttcgttgtattgcaaatagacgtaaaagaagccggtcaaagaatgcatcagcgaaatcaaaaacacttggataaatgtctgagaatttaagaagtcataaaattaaatttactatcttaattggtcaaatttctgacaataattaagaaggcaatcctaaatcaatttgtttttaatttgcgctaaaaatctgtttctactgggtgactctgattgtgtaggtgctagtcaatgcgcgagaaagtgcataaatgatgacgtcacaaaaaggggtcggggtcgttttcgcgtgggccgttttcgcgtggggcgagtttttgaactataatttttttatttgtcaaccaaatccaataatcttggtatcattcgatagccctaagtgttctctattagcctacaaaatttggaaaaatttcgttaaggtccaaaaaagttatggtcagaagagttcaacaaaccaaattttccaactttttttggctcgaactttttttatactgaacgaaattttttggaattttgcaggctaatagtgcatctggagggctttcgaatcataccaagaatgttggatttggttggcaaagaaaaaagttatagtccaaaaactccgccccacgcgaaaacggcctggcccgccaaaagatgcttttagtgccattgaattttttggtctttttatttgccgcttttctcatgaagtaaaattaaatgttggagaataatcggcacagtttggttttgccgaactgtttaatctgaatgttgtgccatttgtgcaagagttgtgccaacaacggcaaagaagctttaattggtcatcaaaataaatccgagtttaacatcggtcgattaatctttgtttaaaccagaaatagagaattcagaaaattacagagcttatgaaattccaaaaaaaaattctgttataattaaaaaaataataatatttatgttgaagtttactgttataatgtgaatttccgttttaattttaggaccaaaaggtaaaaatgaaaaatcccaatttaaacagatagaatttttttaaagttttttcttttcccaagggggttatgttatcattaattaatgcctctgtataaaattgtgagtccattaatgaatttttgcagagaaatctaatttattactaatctttcatttttttaattccttcccatttttgcgtccatattaatgagtgcttttgctttgcattccaaattaatagcatgccaatttgtctaatttaatggcaccacctcacgcgcccccgctttttttcacatgctaaaatttaaatgaaacttaacaaatgaaaattattttgaatatttaaatctcgttttaataattgaaaaattattttaaaagtatttttaaaattaattatctttttgaaaagcttaatgtttgcagttaaataattaattgtcaataaataaataaatatattaaaatttccctaaagtatatgggattaaggaaggtgtgtaaaaaatttaccgttcattatttattttaagtgctctcaattgtcggaaacggatgtgtaattcctccgcccccccccccctccccttggtccataatattttggattatctttggccccttctgtttcacactctttggcacggctaattcttcacgtgaccatgtgaccaattgaatgaataatgcggcgccgggtgccgtgccgttggacggcggaagtcagtgacggatatatgagtgatgcccccctcccgcagtgccatcctatccggtgagggggcgaacgatgggaatggcacttcctttacaaatttaagtgttaatgggggagaggggacgatgagctcaacatttggggacgggaagggatgaaattaacagttaaaaagggagaaaaatgctaaaaagttcaatgccatccctctcattgggggaggagctttgaagggaatggcattttgtgtaaaacaaatttaaagggggcaatgacattattgggctaaggagtgaaaaaatttggctaaaagaggatgaggaagtagcacaaaaactgtaataattgcatggcatattcccgaggctaaataatggaccatacagcaaaattgccggggaat

SEQ ID NO: 628 - DNA, 2006 bp, Heterodera glycines
tatgcttcagaattgagtaaggctattaaaatgctcgctgaccagggaagataaattcaaattaatctttatttattataaaagaggaaatttccagacaatcatatctagatccagaagaattaaataatattaatagaattctttaataatttaagtttaatgtgttatttaatcattttgccaatttacgatcctttatcaaattgttatctatttatcaaataatgtttaaattaaaaattgtgatttttagcaaaaaaataaaaatttttaatttggagtccattttaaggattgccgggtttttgcaaaattgcaaaatattaaaattttatttcgaaaagaccacgaatccgacgggaaagggtaaaaagcccacaacccaccttcgctcgtaaagtgtccaattcggaaatataagtgccaaattgttggcgattcttacgtatatcgaagaaaagtttggcagctaagataaagtaaatgattggacaaaggaaagccacgccaatgtcgtgcacaacttggatcggttcttcgtactgaattttggcaattataataatccaattttagattggcaatttaaaatgtgcaactttgacagatttcagtaaaactatcgcttcttttcatttttaatagttaaattcaaaataatatattcactaaatttgtttttattaacgatagataaaatcgaaaattcctaaggtttcaaagcatttcgttttcctcccaaaggatctaaagtgcgcgctttttcttaattatttagagaataaactaattaatttccaaatttttataacgaaaaataaattcgccagaaataaatgttttttaaaactttttcaaagctgcacacttttataagctaaagaaacttcattttcggttttgtgatagccaataaatgggttgtaaaaccaggcaaagaaaaggccgctgaacacgggcggctttatcaaaacggcccaataaagcgcataaagggaacagccgatgatccaataatttatgcggcgacccgagaacagaaaatgcgaggcacgggcactgctcagctcgagacagcggttgagtgccaaaacctgggataaattggtaattataattttatttcagcagtgtcttgtgagaatgggtaaaatcctgtcccagttacgaaattacggatccctttttttggtgcctcggaattagtaaccctcctccgttctgttcaatcaaaattccggactaatatattaattaattcatccattaccaaatccatcgtactttcggcaatataaattgcttaaaataaaagaaataaataaataaatcatgtgagttaaaaactcgatgcggtcatcccagcgaagtaaatcagtgtcggattggagcagaaaacggctccgcggaagctgagcaacgcgcttaaatagcccaggacgaacatgttgaccaggtcggtgatgccgatgtaaaacaacattttgtagcaagaattctcgcgcatatgcttccaaatggagtaaatgcagggcaaatataggacctgcatagttcgaaaatgttcgaaatagggtacggatttttatagatgtttcattttttctgactttctgagaactttggaagacagaatttgttttagttgctactgttaagcaactgttggctctgttatgatttttaatatatattcctgaaaccataaaaacatagaaatcctcttttatggattatatttaatattttctaccgattttttaatttttagtcatttttcctaaaaatgttggtgatttcggtccaatagatggagaaactgatcaaaaaagttttgatcaggacaccaaaaatgatcggataaggaatcattagtataatcacgtacgtagtaaatggtgcacagaatgcaaattacgattgactcgggcacaaattggcgctgctccaatgggacggagtcaatgatcacccccagtgcaattgtacaaccgttcgtattc

SEQ ID NO: 629 - DNA, 2202 bp, Heterodera glycines
  misc_feature (1332)..(1332): n is a, c, g, or t
  misc_feature (1344)..(1344): n is a, c, g, or t
  misc_feature (1387)..(1387): n is a, c, g, or t
gcgttcgaaaatatttttgaccatattggtcagttttatgttgtcaatgcttaaattattgtgcatttttcgtgcaataaacatgccgcgctcatttttgagctaaatacataattgagtgaaaatttgaaaaaaaactttaaaaaaatcatagacatggtgaaaaatcatagatttgatcttgtcatatgacaaatctgatggcatattcatgcttagcaccctcgataaccccaagtgaagtcattaaaaacagactttttttcattgttattatgggaccaataatctccacctaatcacgaagcaatatcttagaaataacttctaaatatgttaagcattcgaatgataccaacatgtggattttgttgacaaagaaaaaagtttgagcgcttttgggggttttgtcaaagtttttaaagatttgacagttttcaaatttttcatgtaaaattcagaaattctttatcaaaaatgcaataaaaaataaatttttttttgacacgatgacatttttgtcgacatgttcaaaaaaattaaaaaaatttttcactaaataaatcagccgaaaaataatcccccagtctccatttatcccgcagtctctaattatccccccctttttatgaggaggttgaaaaataatcccccatgggctataattagagcatatacggtatttattttaattatgttaaaaattttgaaaaaatcaaaataggaaaaaaacgccctattttcggtgagaaaagtccaaaagtatttttcttgaacatttctcatttaaaataaagccgctgaaatttttaaaacctaagaatctcgaccctaatacctaataattaactgaaaaatttaatatttcgtttagaaaattaagatttttcctttttataaagaagtaatttttcgtgaaaaagattttttaggtcttctttcttctagttttgaaacataaattgtgaaaaaagcattttaacctcatctatattattcagggctcggatcgtaccaagtcactttccaagtacataacggggaaaatttgtgaaatccaagtacacataaaaatttgtagaattgagattttttgcctttcaaaaccattttttgtggcggtttttcatgaagggaggggggggggggggtccggcagtgccgataggcgccgccgggaaaattttaaaaattcggtgtaatttgttaacagattttcaccaaaaaatgacaaaatttttgcgattttggatcaattgttaagaaaaattgtgcgttattttttggggttgggcggtgccattggcgctgccgggagaaaaattagaactnttgtaccttttntaaacagattttgactgaaacttgtctatttctaggttagatntagtaaaaattaatgtttgttgacaaaatccaaaattttaaatttttttaataaaatatatatttttactttcgtactcaaatcaaaaatcccgatttccaagtacaattttggaaaaaagtacagttaaaattttccaagcacaaaatccgaaatccaagtacgaatccgagccctgatattattatattttattcaaagtttgagttctgacttaagtaaaattcttttaattaaatgattattttcaatttggaagaagttcataaaattgaagcgttagataattataggaatgaaattatgggttatagagatttttgaatttatatcatacaaacaaaaattatatattttgaacatataatttaaaaagcttttttgatggttatgttttattaggaccttcaatagtttcgataaaaaatagcttgtaaatttgtagttaggaagcagaaaatttttaaaattgaaattagtgactccaaaaaagtacaaagttcttgactgcttttatgtttgctttgccaaaattatcggtagcttataatttagaagagataactaaaattatggtccaatttcttatttttagaaaaatatcaatgttatgttaaaaatatttgggagataatatttttaagaaatctcaaaaatactattaaaataaaagaaatgaaaaaagtaaattcgcaaatgcattttatataaaataaaaaaaggacggcatcgcttttcaacaattaataagtaaattttttaagaaagaaacggaataataaaagtgcattaagaagcacaattaggaataagaa

SEQ ID NO: 630 - DNA, 1468 bp, Heterodera glycines
aatttttctcaaaattcgtctccagtattttttattattcacaattgtattttttttatatattttataatttaagcatattattgatagaataagcttttttgccatgtcattacttgtgaggtggccaatttatctctttaaatttaaatttaaaaaataattttgagttaaatgtaaagagtgaatccttaacagttttgatctgattttccttgtaacttttgatcagttttctatcaataatatgcttaaattataaaatatataaaaaaatacaattgtgaataataaaagtgcaatgcattgaatgggtaaaatatattgatggattttttgcctccaaataatatttaaaaatatttaaaaataatatattcaaaataattattaattaattaaaatcatttgttccgtactgaaatgacccgcctcttctgatcacccacatcgatacttttgacacttcgactcatagatacttttgacactcgactcaccacggcactgaacccgtactcgcagagcaagaacgcaactattttgcgctttcgggcgtttttagcacctgttttgcacttttttggcaactattttagtactatttcgttatttgtagcacctaaaagtccggtctctagttgaagttcttaatgacaattattttccatttttactattaaaagttcgtctacatagttacaaagatcataaattaatgtttaatacaggtatattatcaataaatgattgatttttttttaataacgcatttctgcgttgaaatttttgaattctcatgtcattatcggtcactagaaatcactattttggcgattcgcactaaaataatgaaaattcactattttgtcactattttttttatctatttcgacttttttggaaaattccttaacaaaaatgcaataaaaacgaaaaaattcacccctaagaatcgagataaaaaaattgcaataagaatcgacctaaaaattttaaaaaatacacccctatgaattgaaaaatgttctcaaaaatttatcacgcaaattttttttttgaaaaaatttttgatttaaaaatgtcaatatttgctaagaatttattagaaaggaaatatacctcattttgaaacagcaaatagtgaataaaaattttttctgctcaattttaggctgaaaattacatcactattcgtcactatttcggactttttgtcactattttgtaactattttggcatttttactcactatcttagttaactatgtcgagatttttcgtcactaaaagttgagaccctagtgataagtaacttgattgttgaaaaacctaacgtgaacttaaagatatagaagttcgttatacttataaaaaaaactttttgtttctaaagacattttaatcataactagagacccgcaaaaaaggcaccaaaaatcgcgaaaaaggcactataataggcacg

SEQ ID NO: 631 - DNA, 3081 bp, Heterodera glycines
aaaatacgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacattccgtggcttggacactttgtgggggtgccataaaataaaataaaaaggtacatgcctcaaaatccggtcccttgttatgctgatcatcaaaataagtaaacaacacaaacaattttgaattagcgcgtctgaaatgcctttggcgttatgtttttatcttcagtggtttttgtaagatagtaaaggtaaaggggaaaaggcggagttcgagtccgttgcacaatattatattatttattattttttcggtctattaaaggcataaccgataaccctgtaaatgtcttcctatatgtccaaatattcatcttcattttatacgcctgcaaccgaacccaactgccactgcgctagcattcgtaaattgggcatttgcgcttctgccgcatttacgggagctgccctttacattaaccttgtggaacagccaagccgtctgcaattggaaaccgctgccgcgttgaaacagtttaaagagagttacacacgtgcgattcccatgcaagtatgtataagatgcaaactaatgcataattgaagcagaattttccctcatcgaagattaactattctatatttcttaggctggtttggcaattctttctggcattgttggcatcggtggtacaattaagactggcgagaaggcttgggcttttggcgctgctttaatgttggccaatattccatacacttttctatgcgtttttccagtcaacaaacgtttgctggctaccaacgtaacaaaataaattggaattggaaggggtggagcccaaacaaaaaatacaaatttaactaagggagaacacttatggcctggttattatatgtagttcattaaaatatcgtaaaaattgagctgaacacgaaccatttaatagcaaaaatcctaagatttttaaaacccagaggtggaatttttttttttgatttctctcctctccccgtaaattggactgactccgccaaaaggtgtaccgacatttcgccaacttgacatctcgccaactgacatctcgccaactgacatttcgccaactcagccaaaaacattcatttcgccaactcaaccaaaaacattcatttcgccaactcagccaaaaacattcatttcgcctactaagccaaaatctgacatttcgccaactgacatttcgccaaatagttaaaaaaattaaagaaaaaaaagtaaaaagagtaaaaaaatgctgtgttaatatcaaatacagccctattccagtttacacgtccaatcagtgaccatcatcatttcttatgtcctgttcggcgcgcttttttcaactatgttcagcgcggcaccgctggagttcaaggatggctggcgtatttgccaaaacctacattggcaccactcaattcgagattgatcgcggggcggaggcatttgaaccgcatgctgatgtcggacactttcttctgcgtcgcactcgaagcacaactcgtaaatgcacctattctgtcatgaaatttatgaaatttttcaattttagcgttcagtatttcccaggcatccataatgacaggcagtggaccaatacaattcggactgcattcgccacaaccttcaactccaaccattccattgtcagaagaatgcagcttattccacgctgggaacaagacatcgtctgtcctccacgtttcccgatctcgttttggaatgtatacaccagggctcaaatggcaattgagcgaacgaacaacggcatggaagccgcgcatggacaatttgcagtaaaaaatttcatcggaaaacattttttggtattttcagcgtgatctcaaccatcatccatcattgagtgacttcattgctgcattcatgaaggacatcaacaaacagttggacatcggacgcgcagaacagctccagaaaagcactaaacgacgacaacggtacgtcatcaaagaacaaaatgtggtgcggatccttgacgaggccgactttgaatcggaagaaggattgacaaacgccttgcacctgctcgggatcgtgatgcaaggctttgcggagggacttcacgtccgtggaaattcagagaatggtgaagaaactgaggccgatgaaaattgattttaaacattttcatattattgtttttttttgatattttatatattttatgaagatttctttgcttgaagcacttttataataaatttaatatcattatatagttaaaattcaattttcgactagttggcgaaattagttggcgaaacgtcagattttggctgagttggcgaaatgaatgtttttggctgagttggcgaaacgtcaggttggcgagatgtcagttggcgagatgtaaagttggtgagatgtcagttggcaaaatgtctgattttggctgagttggcgaaatgaatgtttttggctgagttggcgaaatgtcagttggcgaaatgtcatgtagccgtactttactcgtgtccttcgtaaatcgatcagttaaaagttggaattctcttgataaaacaatattagcaacaaattcgattaatacagggatgggattcgtccttgaatggcaaggacgtccttgaaattgggccctctttcttgaaaataaaaaatgtccttggatgcaaggacgtccttgaaattgggccctctttcttgaaaataaaaaatgtccttggatgcaaggacgtccttgaaaatgagcatttggaaaagtggaaaaaataatcaaaggaaatttggtaaatttttgaatttataacatatttggatattaaattatggcattatgtcaattttttgctcatagttgagaattattattttttattatagcggggtcagcgccttcggcgcatcccccgctag

SEQ ID NO: 632 - DNA, 1198 bp, Heterodera glycines
aaaaacattcatcaatcccttttcatggctataaaaatgtttgttttttcgctttgtctcgcatttgaaaaaaaataaaaatttctaacgcaattaattattctgctctttgtgtgacatcattcggaactcggccaaaattgtgctaattgccacaaaaatgaaccgacggtaagcaattttaaaagtcacacaaattcttcatttatttaactaaactttttcccatttcagttggatttgcaacgacgtttggatggacattttcccatcctttgaccgtcctcaactcggcctcaaaatggcacttctttcgccacgttttaattcgctggtggacaaacatttcgatggcaaaagcgaattgacaatttggagaccaatcgaaatttttccattgcgcgaccgtccgctgcccagcaaaattcgctttaaagaccttcggattgagtaatttaaaatcagagctgtcgcaataaaagctttccttccatttttaggtacattgatcactccgtcatcgcttttcttcgttcaaatcaccaaattttcgacaaaagaggcaccaatttagatttgtggatttattattcaaacaccacggatggccagcggatttgggatgtttttgttcgtgaaatttggccaattttttctgaaaacattcgccacttgggcttttacgatgctgttaatttggacaatttgcttcgtcgcacttcgtcgacaattctcactgatctcaaccaattgaattcaatcaatttatttggtctgtcgcccgctgcatttggtgatgattttgatgtgccaaattcaacaatttctgctggccaagcattgtccaaatggttgcactctccgagaaaagatggccaacccaagcgattgcgttgcgataattacaacgcacaagggaacactgattggatcaacaatttcaaggaggtgaccataataacgacaaattactgattttgttttccaaattgtttagcattttcttcgtgccaatgccatttcttccgtcagttacgaaattcgtttttctgttcatgcgccgtcaatacaaatggtgccatttgaattggtgaacgaatggacaaaggaaaagctgacattggctaaagcaaagggatgggacaaccgatggataatgaaacgatgcaaaattggagaggcagcggcggtcaattgg

SEQ ID NO: 633 - DNA, 2260 bp, Heterodera glycines
ctaatcatgacacataaacaaaaagatacaaaaacattcatctttcccttttcatggctataaaaatgtttgttttttcgctttgtctcgcatttgaaaaaaaaataaaaatttctaacgcaattaattattctgctctttgttgtgtgatatcattcggaactcggccaaaattgtgctaattgccacaaaaatgaaccgacggtaagcaatttgaaaagtcacacaaattcatcatttatttaactaaactttttcctatttcagttggatttgcaacgacgtttggatggacattttcccctcttttgaccgtactcaacttggcctcaaattggcacttctttcgccacgtttcaatgcgttggtggacaaacatttcgatggcaaaagcgaattgacaatttggagaccaatcgaaattcgtcgcaaggacaaaggaccagaaccgaaactatctgtacgaatcgattacaaatttgtggaatttccattgcccgaccgtccgttgcccagcaaaattcgctttaagaaccttcggatttagtaattaaaaatcaaagctttatggcaataaaagcattcattccattttcagttacatttatcactccgtcatcgcttttcttcgttcaaatcaccaaattttcgacaaaagaggcaccaatttagagttgtggcttccttattcacataccacgaatggccagcggatttgggatgtttttgttcgtgaaatttggccaattttttcggcaaatattcgccatttgtgcttttcccatcgtgatcatttggacaatttgcttcgtcaaatttcgccgacaattctcatcgatcttaatcagttgacttcaatcaaatcatttggtctgttgcccgctgcgtttggtgatgattttgatgggccaaattcaacaatttctgctggccaagcattgtccaaatggttgcactctccgagaaaagatggacaacccaagcgattgcattgcgcagacaaacaaacgaacttcgattggatcaacaatttcaaggaggtgtggcccaacatttttgtgatttttgttttcctatcaaattgtttagcaatttctccgtgccaatgccatttcttccgtcagttacgaaattcatttttatgttcgtacgccgtcaatgccaatggtgccattcgaattggtgaacgaatggacaaaggaaaagctgacattagccaaagcaaagggatgggacaaccgatggataatgaaacgatgcaaaattattggggagacggcagtggtcaattgggaagacggaaattgggacaacaattgtaacagtgtcttcgtttggctttttcgtaccactaattgcatcgggtgagcaattaaaaaaggcatttaattttgtttaaataattaaaattttgcttaatttagcccattgtctccgccaccagcagaagaagccggacaaaacatcacaaaagggccgtcatctgaactgacaatgagtgatggacaaacgaagaaaaacagtgatcagccgcagaaggaatgaatgaattgagaatgatcgaccgagcataattcaaatcagtgatcaaatgtatcttataagaaaaaacctctcaaatatgtatatgtaaataaatcggatgcataaaaatggcaaaaaatatacgaaaacctaaaaacaaaaaaaaatgaacaaaaaaaacaacttgttttttgtgcgttttaacccggcaacttaatttgaattgttagctaaatatgctggataaaattcgggatcattggtcccataaaaaaggtcaaaaatgctcgttttaagcgatactgcaaatttgaaaacttggaattagcgtaaaaggttcgaattctgggtaataatgcagaattgtggtcccgacgtggtgcccccccccatttttcggcagaaaatttttttgttttaaaaagccgtgaaaacatgcttctaagggttttttgggtctctgatcacgaatatggtatttattttggtctatttcgaaccccggactcgaactgaataaaaagtcgaaaaatcaaaatttcgaaaaattcattttatgttcgaatctgagcagaatgattatttttaggtgatggttttctgattaattttggcttgttttaatctattttagaagttaaaatgatttttttaattaatttcagatattttgttcgaattcgagtccgtggttctaaataagccaaaataaatgcatattcgtgataaacgaccc

SEQ ID NO: 634 - DNA, 7090 bp, Heterodera glycines
ttttgtgatttttgtttttccatcaaattgtttaccattttctccgtgccaatgccatttcttccgtcagttacgaaattcatttttatgtgcaagtgtcgtcaatgccaatggtgccatttgaattggtgaacgaatggacaaaggaaaagctgacattggccaaagcaaagggatgggacaaccgatggataatgaaacgatgcaaaattattggggagacagcggcggtcaattgggaagacggaaattgggacaacaattgtaacagtgtctgcgtttggcttttcagtaccactaattgcatcgggtgagcaattaaaaaaggcatttaattttgtttaaataattaaaattttgcttaattaaggccattgtctccgccaccagcagaagaagccggacaaaacatcacaaaagggccgtcatctgaactgacaatgagtgatggacaaacgaagaaaaacagtgatcagccgcagaaggaatgaatgaattgagaatgatcgaccgagcataattcaaatcagtgatcaaatgtatcttataagaaaaaacctctcaaatatgtatatgtaaataaatcggatgcataaaaatggcaaaaaatatacgaaaacctaaaaacaaaaaaaatgaacaaaaaaacaacttgttttttgtgcgttttaacccggcaacttaatttgaattgttagctaaatatgctggataaaattcgggatcattggtcccataaaaaaggtcaaaaatgctcgttttgagcgatactgcaaatttgaaaacttggaattagcgtaaaaggttcgaatggcatttattttggtctagtacttttccatttaaggcccacatatttaaatttcaaaaaagtcaataaagagttcgttaaatatccaaaaacagcgctgcagctattcgtgaggcataaatgcaataatttaggccaaaaaatcatcgaatgagtccgtttggtattttttcagtgttcacgctaaatgaattcgcacagataaaaacccaacatttgacgaaatttgaatgtgtgtcccccaacctaattcttaaagaatttttttaaaatacatccctaaaaaagtgaattttttcgaaatttattattcagcagcaagaagacaatgtcacagaaagagacatggacatatttacaataaatgtatatatcacagacagagacacaatctatcctcttttaaattggcagtcaatgttatcacggcgatctcgagaattcaatcctcctctcattgctgcgcagcagcagcaccgccaccctcctgacttccgctcgcgctcccttccgtactttcttcatcggagtcggactcgccacttccttccgatgattgctccacatccgattcgagctccggcagcacgcacacctcggcaagagagacgccagagaacagctgaaatgccaataattttgatgtgccgctgtctgtccttgtgccgcaaaacctctgccactcaatcactgaccttcctcaactcgtcgtcatcgcgcgctgcagttcggatgtgaaatgcactgagacgcttcatgccttcggcctgcgtgatctcgccaattttcttgagcagctcgcccgtgatgtgttccagcacagcagtcatgtagaccggcactccgttcgcgagacgtttggcatacggacctgtggatgtgaacaggaaagggaatgtatgattcgattgtgaatgaaacaaaatcagaatatggtgttgtcctgtattccaacatacccttcttcatcttgcgatggacacgaccgacggggaatttcaatccggcatgaaaagaacgaggctttgcacgatgacggggcattttgttgtacagcagtagaagacagttgaactttgatcagagcaacgaaataataatttgatagacaatgaaattttttcacattttacccatttatatagggaaaattcgctgaattgcaaaagcacaacgcggagttttgtcgtttcaaacaatttgatttgaaaagttagccatataaactgaaacaaaaacaccaaaatgtaccataaaatgattgacctgaccaaattatttttgttcatattttatttctttggtactgaagtttccattttcattgggactcagttgtcccagtgcttattaaatggcgccggttcgacttaattccttgatttttagacttagctcgtcgagaactttaaaaaagtcaataaagagttcgctaaatatccaaaaatagcgcttcagcaatttgtgaggcataaaagcaacaatttaggctaaaaatcatcgaatggatccgtttggatttgcagtgttcaagatttgacgaaatttgaatatgtggcccccaattcggaaattgtatttgatggcccagagccaaaaattataggttttcttaggtgttaaaaaaagatttgtaaaatcaaaaaatatgcggcaaagcgcttaaatccgttttttaacaggttaaagtgtggaaggaaaatgaatagaatagggcacactatttttcataaacataaatcttaaccctagcaataactggccgaattccaaaggattacatatatattttatacatatatacacattattccacatacaaaccgaattggcagcatacaaacacaatactacacatatgtggtaacatacacaggaaatgaatgaatgaacacatcaaaaatgggggacacaaatatcacacgacagacaattaaatgcgaaattgttcgtccattattatcgaatgccatcgccgtccgccgcgttcattcattgcgcatcaccacgttgtgtaatgttctcctcccgacggcactgtcgacgacgtcttcaattttgtctggtctcctcctccgagcattgtcgtcgtcttcacttttgtctggtctcctcctccgagcattgtcgtcgtcttcacttttgtctggtctcctcctccgagcattgtcgtcgtcttcaattttgtctgggccccgcctcgttccattgttgctgttgatggcgctggtcgtgatggtccaattgagcgtaagcttttcggcatcagcattcgaaatgagaacggctgcttcgtcttcattgttggcatcttggacatcattccgcttggcaccgccgtgatcgcaccaccaccgcttcgtcctccacgaccatggccatgcccagaagctgaggtcggcggccagtccctcgaatccgttggtccctgccgcgatttgtagtaactgcttgacactgctgtcgaaagctcatcgttgtcgtggccgaaacggcgttcgcggcacaaacagcaaatcacaacaatggcacacacaacaacgaggctgaaaaagggggaaaacgggaaatgattttgattgatgatggcattggcaaaatgaaagccctggaaaactcacacgagcaaaacagagacaccaatgatgatccatagcttgacactgagaccagcaaattcatttgtcgaagtcgtctcatcggttggtttcttgtgcttaacacgagtcgaagcgctggaaaaataggaaaatcagaaaacggaattgaggcggctctattgcatttttctcgacctttaaaaaattgcacgggaaataaattaaacggaatttaaaaactcgttcttttcacatttgtttcttttttttaaaacttggagaaaaccgaaagttttaaggtcgtggaaattgcaatagaacatccgccgtttgggctgtgcttttttttgtttacccatggcaacagttgaaaatgatcagagtaatgaacaacagacggagggcattttgaaggacagtggaagacatagtgggagaaatgtgaatgaatgaatgttaatgcacaaaaatgggggagacgaaggcgcttttatagcggagaaaaaagggatttagcaaaagcaatttttgaaaaataacggattaaaaagctttttgttcgaattcgggttcggggttcagaattggccgaaatacatgtcatatttttgattagcgagcctgaaaacctcggaaaacatgttttagtatgattttcataaacaaaaaaaaaatttgcgaaaaatgtgggaggggaaagaaaattttgtataaaaggacaatttttcacgaatgcgaatcatttgcccaataaatttgctattcaatcctttttattcctcgccattttctgcccaaattttcttcatcgccgccgctaacaacaacgtaattcaatgtcttcgtcaacaaataatgatggagcccaaaacaacgccaaccccaacaacacgcattcgcctgggcgttcatgcaactcgcacaccatggccattctgacgccgatcaaaggacaaccgacggaacaatcgcatcagcaccaccaccatcagcagcagcagcagcaacaaccgacgcaacacgtgcccatccagcgggaagacatcgcaacacagacggaccaacaagcggacgaagaagcggcgacagcaccagcactagtagcagcagcggtgacgcaggcgcaacatcagccgaagcagcagcaaccgccgccacaagtgaccaccaccaatgcgaattcgacaacaccgccaacgccgcaagtggagacaagcaacaacaacaacaaacggtagagttttggtgccattggacgggagggggagaggatgccgtcaaccaacaattttggttgatgataatgccatttttagacatcccaaattgttttctgcaggttttaaccccgggaaaccctaaccgacgtttttagcaattttttttaaagatttcagagtttggccctcctccctttgaattcatgggcattctctgttttttcacataaaacagaaattacgcaaaaaattttcctgcttttcagtgatccaaatgtgatggtggacgaccagcagcaacaacagccgaaacaacaacagatggtgccgccgccttctccactgcaaaacatcggacaaacgatgcgcaaagtcaaatcggccactaccccttatgaagcgctgagatgtgagctgatcgatgcgttggtggtgcagcccaaactacgacaacagcagaacaacaacggcaacaacgacggcaccggcaacaacgacggcaccggcaacggacatcgcggagggcttcgcaggcaaaaattcaaatcaatttgtcaccctcccccattttcccctctttttcaggtcaatttcggtgatcggtgacaattggttgtcctacgattgggttgaaagcgatcagccgatggaccaaattgagtaaaattcattcatttcaaattgtttggcactttttaatgcttttcccctttgtttaagcaatcagcaagagcagccgatcatcgacgatcccaacaacaacatcaacgcggatgaggggggcttggttgaccaaatcagcggcgcggtcgcttcactgtccacaatcaaccttggccctgtgtacaccgctgttggcaacggggtggactactttgggcacctgtggcagtatcgggtgagccaaaaatgccaaatttgacggatttaattgaatttcccctcctccgtttttcagctcttccgtttcgccttcatccttctgtgcttctactttggcatgggcttcatggaacggttggctgtcgcgatgatcgccgcatgcgtccgctgggcttggccaccggtgcacttcatgctcggctcgtcacggggaacgctgttctatttgacggactggttcgcatggatggaagactttttgtcaagttgggtgtgcgacatggccaacaggtgcggttttacggtgtgggggcacacggtcgataccgtaccaacactactaattccccacaccccattttcagatactgtcatcaatacggtgtgatgtgcgacagtcagtgttcctttgtcagccgaacgcagcgcgcagcttccttcaccggacgtcgcttctgaaggatgatacgcgagatgaaatgaattttgataacgatttttgatggcgacattgatgtgtatgtattgtatattctgtctattatggttctgctatttgagtacgtccgtgtatattgtatatgtactgtattgtattttgtatccatatggcatattcaattccaattttaacgcctaattttgtatacccatgttgtgttgcatgcgttcataaactttgtaaaattatatgtactcaattttatcagtgggctataaactattttttaggcgttttttgttattttttcatgactacattttccaagttttggactacaacttttttcattgttgaccaaatctaacaatcttggtatcattcgaaagcccttcacaagccctattagccttacaaaaaaccaaaaaaattttagcttgtaaaaaagttattaagaaaaaacttccaaaattttggtttttttgttatttcatgttataactagggatgccaaaaatatggaccaaaaatcgcgaaatatggacataaaatggcaaaaatctcaaaatatgaaataaatggcaaaaatgtcaaatatggacataaatttttcaaaattgagtgcaaaatttcttcaaatttattggttgaaattgcatatgagatacatttccaaattttttgactcggtaaggcgctttgacaaagacggctttcgttttgcaattagtcggtcaacattcggaaattggtctcgaattttttcggcaattacgggcaatcattttaaaagaaaaaaaacataaaagctaaaatttattaatttttttagcgcaaaatcaacaacaaaagcgaaattttcgcttttttgcttatttttgacacaaatttattaatttttaagaaaatttaaatttattcaatattctcgagaaattttggcgaaaaaatgattttttgaaaaatttttcgggttttgggctcaaaaaggctaatttagctgctgggggccgtctaatagaggtttttttgaaaaatgccaaaatatggaccaaaatgccaaaatatggaaaaatatggaaatatggacataaatcgcgaaatatggaaaagcaggggtcggggtcgggggggg

SEQ ID NO: 635 - DNA, 893 bp, Heterodera glycines
ttctcttggtttctcttactgttacattattcagtttatactttcgaatgataccaaaaagatagggtttgttcgaacatgaacaaagttattgtataaaaacccgggattgtcaattgattggactcataaaagtcgattggactcataaactgcaatagagccaaaatccgttccctaatcatgacacataaacaaaaagatacaaaaacattcatcaatcccttttcatggctataaaaatgtttgttttttcgctttgtcttgcatttgaaaaaaaaataaaaatttctaacgcaattaattattctgctcttttgtttgacatcattcggaactcgtccaaaattgtgctaattgcaaaaaaatgaaacgacggtaatgaattttaaaagtcacaaattcgtcgtttatttgactaaactgttttcccatttcagttggatttgcaacgacgtttggatggacattttcccatcctttgaccgtcctcaacttggcctcaaaatggcacttctttcgccacgtttcaatgcgttggtggacaaacatttcgatggcaaaagcgaattgacaatttggagatcaatcgaaattcgtcgcaaggacaaaggacctgaaccgaagctgtctgtacgaatcgatgacaaatttgtgccatttccattgcccgaccgtccgttgcccagcaaaatccgttttaagcatcttcggattgagtacttaaaaatcagagctatcgcaataaaagcattcatcccatttttaggtacatcgatcactccgtcatcgcttttcttcgttcaaatcaccaaattttcgacaaaagaggcaccaatttacatttgtggcttccttcttcacataccacgaatggccaacaaattgggaca

SEQ ID NO: 636 - DNA, 1579 bp, Heterodera glycines
tttctttttctcacctcatcggtgccgtgcgtatgttcaggatttggacacggccctgttcatccggcagtgatatttctagttgcacttccatccgtcccggtctcagcaacgcctcgtcgatcatatccttgcggttggtcatgccaatgacaagaatgttgttcagctgctccaccccatccattttggtcagcaattggttcaccaccgtatcatggacgccagtagaagatccgccctaagaaatttgtacaaatccgtttgtttaagcggataaaatggctttcactgccgaaatggtgattgactgttttttaccatggatcctctttgtttgcagatggcgtcaatttcgtcaaaaatgataatgtgcagccccgagttgggcccgcatcgtcgccattcctcctcagcgtcggcgaacaatttgcgcatattagcctcagattcgccgacaaatctatctggtctaattacaaatgtcaacagtttcggtcggacttgctcagaatttcgggcccattgacaatctttggttcgcgtgcgttgaacattttgccgatctgtcgcgcgattagcgttttgcccgtccccggggggccgtagagcaaaatgccacggacatgcttcatcgctgaagacaaagttacaaatggaatccaaaaaactgcaaggcacaaatcacccaacccatttgttcaatgaattcgggcggaaaaacgcgcgaggcgaaagcgcggcggaaaacggaggaaaattctttgtccaatccgccgatgcccaactgttgaaagtcccaatcgggattgaccagcgcacgatgggacgactttctgaaaagggaaatgatcaagaaatagcactgaacgagattaggcaccctatactacggccgatcaaattcatctgtgaattttcaggccgatcgaaaatgaccacggcattcggactaagcggaccgaacgaaagctaaaatatgtaaattaagtgaactaatgatcaaacaaacgaccctctaggtcatcgattaattgaatatcagaacctcctccggtgccgtgttcagattgatggcgccttccatccgttccaccaccaatttcagtgtgtacgtcgtcgtcgtgttgttgttgtccaacagatttacttttcccggaggcaattttcctcttccggtgccccgcttctgctgcacatattccatgggagattcctggccgacggtgaataccgtgttggcgaattgcattagaaattcctgggccattgcatttgtgtccaatggttcggatgggtttgacctgaaagaaaaagacaaattggactaattaattcgcctccccgggctttacggcttctgcttcttttggaaatcgacaattagtgaaattgaagtgataatccattgatcagaagggaacgaaaacggctgaatctaaaattagcaaatgccattcattggtttgccttgagaaatgtttccgctttgacctgaacttctcggccaacttccactttcgtccattttctctggggcatgaaaaagccgatctccccttttccgcctgcgcatggt

SEQ ID NO: 637 - DNA, 3703 bp, Heterodera glycines
tccactttcgtccattttctctggggatggaactcctatctccccttttccgacctgcgcatggttagccactgataagtgataatggtgggccggtccaccggtgagaacttttacgtatcttgccaaaggttagacttattaaatgggtcattaagctaattgaagaactttgtcaaatttgcatcgatgtccctttcattcacataaactttgttcgtcaatgcctcaacaggtgatggaagccttgtcacttttaagcgaagaatcgatctgcttaaagatgtcagcaataaacaaaaattgtgcaaggaccaactcagaacagtgaaaatgtggaataataatcatatatttattattttaaaaatatgtgccaaaatgaaattgaaataatttacaaaattttaaattatggcaattaagagacaacattaattgtgcagaaaatacagccccaatgtatagcaaattccctgggtttggaaaaataccggctcttgtctcgtgacatgggaccgagactctcgaaccaataaataaattttggaattattatgagttcataattgcctatattttaattaattaacttaaatttttacattattaacttcaattattctttcacatttgcactgtatggagttctcccccccccccccccccaattcgacctttcctcttcagtttcctttgaatttggatttgcgaggtgaactcccaggaagcagcagcaaagtattaaaataatattcattcttttcatttcttggcttagaaatcgaaatatgtaaaagataaaaataaaataaaggtatataaatattttgaggagcataaattggcacaaagaaccaaaacggcaccaaatagacaaacaaaaaaacttttttgctatttttaaacgggaaaaatttttaaattgaaaacaaaataattcaataattaaaatactattgagaaaaaaaatttcaactcaatttttgaaaaaataaattttcggcgatgagtttgtgaaaattaccatattttttgcaactaacaataagacagactttaggccgtaaatttgtaaaaaattaccaattttaagatgggttttttttgaaaatttttaggtctatttttagggtttccttttttattgcatttttgtaaagaattttctgaaagtcgtaaaaataggcaccaaaaatggcgaaatatgcaaaaaaaggcatctgcctaaaaatgggtccctctttagaaataataaatgctatgaattgggataaatgaaaatttatgtgtaatatctcaattatattgttatcttattgtcaatcaatgcaattctgcatgacggacctaaaattcaataataataaaaaaaataatatatttaaatatttgtaggataataaatcgtaataattaagactggtggtaagtagagctgagcgggaccgggaccgggaattttgggcaaaaccgggacttaggtactcatttgtatgtttttttcagtaccagttccggtctcgctcagctctagtggcaagtggtagctcaagtggtcctttttatatttaagaaaaattcacaaaatgtttatttttagcaaattaaaaagatgatataaaattttgggctattgaaatatattaaaaaaaaactttaaatgatgttgctcttcaaaaaattcaaaaatattaagtattacgtttttatgtggacccgaataatgttttatttttccataaaaattgcttcatatcaaacaataattacatttaaatttattaatattagtgctgcttttttaggttcgccccattggtatttttagattcgacctgcatcaatagaagcaacaccgacattttatgttttcgattccaatttctttcagctgtatgcattttatagggaatataaatgtgaaaaacatctaaacatttaatttgtatagatacatattcaaatttaattaatattcaccggatgtgattttgttgtttatttgtttttaaaaacaacaaattcactcactaataaattagccggatatgccttgataagaaatataaattttctctaattacaattttaattttaaataattgctaaagggtaagatgcatttcgtgtcgtttgtagcggcgcttcttacagtatttctggccgttccatgcgcctcgatgaattgttgtggacaaatcgacaacaaatatgtcattttaccacgaaataattattcggtgttttttgtttccggagattttggtgaatttaaatattataattagagccatttttagtcaaaaaaaatcgcgaaataggcattacattaattaggcacaaaaaaaggcaaataacattttttattaacactttttaggtagcaaaacatataaaaattaatcaaaaaacttaattttgcttatatttcaactattttaacgttttttaaataaagacaatttttaaaccaaaatttttgtcaagaaaatataattaatttttgggaatcagtttttgtgaaaacttttttcaattcttagggggtgtatttttcatttttcttgcatttttgttaaggatttttccgaaaattctgaaaaaggcgccaaaagtggcgaaatagtcacaaaaattggaatttaggcattagcacaaaaattccaaaataggcaaagttaggcattataaaagtcatcgtaaacaccccaaacctagcgaaaacgcgtttttcgtgcttatctatgcgtatcaagtgcgcagaaatttaggcatttgactaaaaatcgaagcactaattttaatccctttttaatatttaaataaaagaaaaaattaatattttatttattagggctgaaatagttttaccgagtaccgagaccgaagaatgacaatgagtaaaaaaccgagaccaagaaacgtgaaatcataaaatccgatattaactttttagtttttagcaattttcaattttagtacattgtagaatttctcctctcggtgatttcaaaaacccgagaaagaggagtgaaaaatcgagaaccaaaccatcccgaacagccctaaaatgtatgaaatttcagctgacccaactgacaaaggagtgaaaaatcgtgtcatctatacggataacggtcaatttaagtggaatattaggaatgctgtgcgagattttgacactaatgccaagattacggtgctcttgtgtttgggcgatgagtaccgtgtgtatggccaatttgcggattatgatgcgatggaagatgagatgggtgaacggttccacgaagtgtttcaagtggtgtacaataattaccccatttatgagattgacgaaacggtgccaattgaacacgacgtgccgattgagtacgaagacgaaggccattcgacatgcacaattcaaaagtcagtttaatcaaattcaaaattaaattcaaattcaaaaattgttaagcttattttttaggtgatcgaatttttgacaaatattaggaaaataatttagaatctttaattgaaaaccaaagaaaatgatgtacaacgaacggattattcatttgaaatatttaccccaaaatgagcatggatttaatttatttcatgtcattttgtaaaaattgtttttttttactctatgataataaatagggaacggatttatatgtgctaaaacgccaaaatatgtgctaaaaac

SEQ ID NO: 638 - DNA, 5130 bp, Heterodera glycines
  misc_feature (49)..(49): n is a, c, g, or t
  misc_feature (95)..(95): n is a, c, g, or t
caaatattaggaaaagaatttagaatctttaattgaaaaccaaagaaanatcatgtacaacgaacggatggatgattcatttgaaatatttaccncaaaatgagcatggatttaatttatttcatgtcattttgtaaaaattgtttgttttaaactctacgataataaatagggaacggatttatatgtgcctaaaaaatcccaaaatatgtgccaaaaactgaacaaaaattgcttaataaatatgtgaattcctcaaaaaagtctatttttttatcaatttcgctagagaaatctaatcaaaaatcagttcaatgttttttgacgtaaatttctttctcactctgtaaagatttattattttccggaattttttctctaaatttaaattttgccataaaattaaaaatcgtgaaaaggtcaaaaattgcaaaaataaaaattttttggacaatttgccaaaaatttgggtgccaaaaagcacttcttataaaaaaaatttaaattaaaaaaaaatcgccaaaatatgtgctaaaaactgtcaaaccctcaaaatatgtttttatgagcaaaaagtccaaaatatgttttatttatttgtgtataaaagtcgggacttttatttgcatattttgggttttcatgcatattttgccatttttcgtcaaatattttcccatttgaatatctcttaagaaaaaaattttgattatgcctaaaattaaatccaaatctgaattgatgcgcgagtgggtcaactgccgaaaaccttaagaaatttttgatttgcaattgcaaaaacaaccaataaaatttatgaggaataaaattttttaaattattttgcacccctaattttcaagttttttgtgcatatttggtgcatattttgcgatttttatgcatatttggcattttatttgcatgtttaggtgcatattttggtcatttttcatgcatattttttgcagccctgttgattagacttggcactattcgtcttttttaaaatttttattatatgctaaaaaaattacattttttataaaaatattttccaaaattcctactcaatatttttcgttttaagggtgtttttttgtttcccaaaagttgcctatttagttatgattagagaacgtaagaaggcacaaatgtttaataggcataaaaaaattgggaaaaagcacgaaaatccagaaaaaggcatgaaaaaaggcatttgaaaattttttattaaggatttttagcgagcaaaacgcgtaaaacttaatcaaaaaacttaatttagtcatttaaatgttattaaatattttattatttttctcgaataaggaaaatttttaaaccaaaaaatttttatcaagaaaaaaaattaaattttaacgatcaatttttgagaaaatttttcatttcttagtgatttaatttttgaaattttttaagaccatttcttaggggtatattttcccgattttattgattttttaatggaatttttcaaaaaaacaccaaaaaggcatttaaggcacgaaaactcagaaaaaggcaaaaaaaaaaaaaaaaacagtttgatccggaattttgttcaattttggacttctcgtgcgataacatatgtgtgaaaacatgtaaattaaaaaaaaatttctgggttcatgttttgcgcttattttgcgatttaattgcatatttggccattttcagaaaaatctcttctcctctccatccctccctttcactctctctctctcatttctctctcactcactctctgactctcactctctctctcactctctcccactctctctctctctcactctctcccactctctctctctctctcgcactctcactctctcttctctcactctctctcttctctcactcactctctctctctctctctcactctctcccactctctctctctctctcgcactctcactctctcttctctcactctctctcttctctcactctctctctcactctctctctctcactctctcgctctctttctctcgttctctctctctctctcgctctctctctctctctcgctctctctctctctgatcaattacaaatcattttcattgaaaaagcgaaagcgattgaataaatttcaaagattgtgaataattcatcactaaattctcattacaattttccatttattctcattaatgtgaatggttcgtcctctaaacgagttttttttttaaagtgtcccgtggaaccaaaatttggttgacgcatttattttgcaaaatgagcaaaataaaaggcaataaaactaattaattaattattgcacggatcattaagaagaatcttttaatttcctccctaagaatttttccaaaatgtttccgttccgttttctcttcgttttcgctttcgctttgctcactttgtgcggcttttctcacatgacattggcacagcccggaagcaatgggccaattggcgaacctaacaaaatgttgcgcatccgccgttagtgattattaagcgacgaattgtaaaaaattaattaaattaaaaagtttttcaggggaaaatgaacgcaaggaaaattgacgttttccatggaacgaaccaaagaggatgaaaatgaccgaagaacaaaaaacactattagcaattaaattccgttttcattgttactttttagggtggtgttttggtataaaatcaaaaggttgatcactaatgaccaatgtggcaataaatgaacagcaaatgaaaatgggtggtgacttggattaatctataacttaaataaatttttgagctttaatttagggagtggtaagtttttatgaagccggagggaccttcaattttaggaaaataggaataatcttttttacaaaattttgctctttttaatttttatagtgcttattaattcaattccccaatagaaacgtatgattgtgatttttttgtacaaaaagctcagtcattaaagctccataattacaccattttagcagtcatttacaatcgaattcaatattttttttcgttaataagcattctgtgaaaatttcagcatgagagaacaaaattactttatttgacttggacggtcccaggagctgcggcgccgacaccattggccaatggcatttgctgctgctgcgtttgttgccgattctcgaccacttcttggtacggaggtggctgctgcatctgtgaagattccgatagaccacgtttaattgatcaaattcagtttgaggggtcattaattgtggctaatttgctttgcaatttgtgcccaaccacaaaaaacacctgttgctgctgttgttgttgctgcgcaactgttgccgtcccgggcgttgtgatgccattctgttgctgctgtttttgctgttgttggtgctgaagcgcagccattcgttgtgcggccatttcagtctcgcgcattttccgctccaacaacattttggtctcttccgcctgtttcggcatatttttcaacattggcaagcgaattgcgcctgaaatggcacaaccccacaaaccctcagctgggatagttttgcgcgttgcgcttccgcctcggcttcgctggcacgtcgtgcctgctcaatggcctcctgctcggagagacgcgcccgttccgcgatcaacatttgcgtctcctcggcacttctgatcacattctgccaaattaagggggggggggagaaagcctttaaatttggctcctaaatttttaaattttagtgctcgatcacctgcatggcgctcaactgttccgacagatggttcagttctgcgcggtagcggtccctctcctgctccgcctgcgcgcgctgctcacgctcgcggtgcaaccgcacctgctcctcctgcaaaggtttaaaaaaatcatacaaaaaataatttaaaaccccggatttaatcagggaactttttgctttatgagtttctgctatatcatttttattgcttgtacaataatcgcttatttgttagcaatagctaatcattaataaaatgccaaatccaaatgaccatcaaactaatctttgatcagtgtttttttattggtcattttccactgatcactttttgctgatcgactgttctctgatcagttttgcctttaccattctgcgccttcgctgctcgtctgcctgctgcttcatctgttgcacctcgagcaggtcgggctgtcgtctgcgcaggtaaaggttatgcgtgccaacacagaggtcgagaagtgactgaaacatggggagggcaaatatttaaacaagcttcttctgtgatccgctggaaattgtggctcccggtaaattggacaccagaaaattggacaccgaaaattggacactagaaaattggacaccaatggaaatttggacaccggaaaattggacactgttgtaaataaaaattaaaataaacaaaatatattaataaacaaaaattttggtttggcctaaaagatctttatcttaatctgcacatatgttgtttataagcgtaaataatatggaaatgaatttgttattatttttgtaacatcagcaggagaagaaaaacatcatatcattcataaagaaaaagttttattacccatttttcgtgcattatttggcacattgatcaatcaccccccatttttggtgcattcggagttagagggaaaggaatgaagcgcaaacagctttatattgagcaagatgaaaatcttcgggaaatatttgcaacgcgtgccgatcgtcatcccctccaatatttgagggcaattgcctaccgaatgcctgatccactctaagtgccttaatcatttatccacaccatttaattttcaacctaattcctgggtttattttttaaaagcgaaatttggtgtccaattttcctttagtgtccaaaattccggcggtgtccaaatttctgtttggtgtccaattttccggtgtccaatttaccggtccccggaaattgttccaaattaataaaaaattatttaaatttgaaattgaacaaaggcataattaatgtcccgggttatttgggaattgcaaaattcagttccattttcgtgaaaatcgaatcaagcacagccgggcgtcatccacagcctcccccatt

SEQ ID NO: 639 - DNA, 2303 bp, Heterodera glycines
attgaaaattttagtaatatttttttttactaaaatgtgattcaactaaatcctcaaggtcttgctaacactatgaattctccccttaaaagcagggcatcttcaccagcatccgttaatctcatcagtggccagaatcagggacgggcgaaactcagcttcgtaaagtccgggttttttgaacttcgagcttccgggtaaattactcgaagtttagagaaaaacatacccctaatgataggctcaagaactatgaatgacactttttcaaatttaccaaaaatttttgatcaaaatcttaataaaacaactattttttaaaaagcgcgccgcaaaatttttttccaattattcgttaatgtattaattggtccaaaaggcataagacttaaaaaacttttcctggcggtgcaattttttgtaaaatttcgtgcttcgaaaacctcgaaaatttcgggtttttgggcttcgaacttcgccttcgcgtaaaaattgggcttctccatcggcttcgagtgctaagccggtcttcggccgtccctggtcaggataccgtgtacgtaccctaatcggatagtattgtgtgccgtacatgtccaactcctcggccacacacagaaactcctcttccgcctcctcctttgaaagtccgctgttgttggcccaccaattgcggattttctgttcccacatttcggccgtcagttcgtattgttgcagcaccgacaccggcaacagtttggccaaatccaactgttgctgctgttgttgttgttgctgatcggcctgctgttgttgttgcggttgctgctgctgttgttgttggccaatgtctccgtacagtgcctggaccgcataggaagccaaaagaatggcctagaacattggaaaatggcagagttagccgggatagggatttttggaaaaacagtgcccgaattcacaggaacattgaaagccaggattaggatctaggggggccgggaccggaaaagcctgggtcccgggaccagtcccggttgacattacaataataaaaaaaatatttaaaccaatggggcgggtgaactacgcatgtaaaagaagaaaagaaaaccaaaattgaaattctaaaaagcaattttttaccgcctccgacggacagtacaaatccatggagagaatggactggcgaatttggagaaagaacaaatgccgggtcaggtcctggatcagctcgaccttcaccgactcggggaagaatttgaccaggaagaggaagtgcagcgagccgtcctcctgtttcggcacgctttggtcttttatctgttggggagggaaaatgggcaaatgcaaagccaattaattaattataattaatcgccgtgattttatcatggaaacttaaacattttaaaaatatatttggaatttttgctggatttcggtggaaacaataaaatttttttttgataaaacatttatttttcgcttttttgcgcgaatacccttttgtccatttgaagccaacaggtgaagcctttgcggttggtgaagcacaacccaaaataccatatctcccgaaggccgatgattttgcatacggtgtcgaacagatgttggcccagcgaatccctctgaaaaatgagagattttaatattcgtatttaaatttaaaatcgcatattcacataaaaataattatatttgacctcaatgctgagctcgttcaggtcagcgtccatcgtggtcaccttcactctgagaggctttccatgctcagttagccattccaacattcggcccataattaaaaacaaatattgacgagtttaactaagttttttcagctttgtccgataagcaacataaagtttttttttacctaaaatttaattgtcacccattagtaattagtgagtgtatttaccttttaattattctttttttaattgatagggacggacgaatttagatttttcctgggttcaactctttgctttcccacccaattttgggcccgtttctcccctcccgccccccccccccgccagcgccacgccacgcaatttccgctgtggtttaatttagtgggcaaaatgtgatgcgaatgattaaatacaattctaaatgatgatgatgatgatgatcaattattattatttaatgtgttggggcgggtgaaaacggcgggagaacagcagaagaagaagaagcagcagcggaagaagaagaagacgaaggaagaggaggaggaggaggagaaggacgattctcccctgggggggggcacacattcgatggaatgttgggagttggggggg

SEQ ID NO: 640 - DNA, 1982 bp, Heterodera glycines
aatcctttttttccattttttgcatatcacaaaaaattctcattccattcaggaaattttttcgatataaaatattgtctttgtgataaaattaatcggattatttgaaaaattgaaaatggttttttttttaaagttttgactgatttgagtgaatgaaataaacaaaattttttggaatttttattttttgtgttcgtttttatcacaattaccattaatctcattttataattttacaaattaaaaacactcacagaacaaaggtcgatttactaatttgaccttagcggagtttctgccgacccaaaattgtacataaaattagaaaaatgcctttatttagttaggtcaattaaagggtgggaacaaaaagcaaaagaatcgcacaaattaaatcccgggaacaattagtgatggaccaatgattagataagggagaatttaaataaaagacagaaattgagaatagagactgaatttcatgaaaaaaacattttgtggttttgacacaaaaaatattgccaatttctcagggtttagcatatattttaaaatttggtaagaaaaatcactaaaatggaaaaagaatgaaaaaaataggccgaagcagaaaattttctaccattaaatttcgttttggaaaatttaaagataattatagcattagaatttaacaactttttaaaacctgtttattttcgttcggttttgcccatatttattttatatttggcttttagcacataaaatttggtcttaattgatgaggagagaagcgcaaaatgttcgttgtgaatgaatgtttacaaatcaaaaatattttcacagccccgcttcacgaattccgtccagaagcagctgcactcggtgcttttgctcactctgtttcacaaagtccagcagttcgagcatccgcttgatcccaatcgatacatcgctgttaattgccgaataattaaggctttaaatatgattaaatgaatcttttttcccgaacgggacagccgtatcaaaaattctatttatttaagtaaattagatttttgtattttaagtaaattttgggttgctgaaattgcgagcttttagataattcaaattgcgagttattgtaatcaaaacccgatttttcacagcgccctgatctcgataggtgattcgaatttggctcccttacttttctaaattttattatttgattttttactctctgctgcggagttcgtcctcaatttgtctgatctcctcctcgctgaaaatgttggcctcccccagcaccgccatgacgtggttgacagtgtgcagctgttcaactcggatcactttgctgaacacactgagcatgtcggcctcgtacaaaaactgctcattcgatgtagtggccaacataagcagacgatgattctgtttcgaaaatcaaataaagaaattttggagcaagaagttgcctgaggcggtcgtttcgcaagcagtacaagaagtgtttgcaacaccatgttcgaatagcgtggtccaattggtgagtaatccatcagtcgttcgacgttgtcgatgatcacacagctaagcggcgatttgtacgcgtcttcgaaaatctgtcaaatcattttcaaaattgaaaattctcctcaaatttcaccttccgaattttggcacatttttccgcttcactgtatccaaccatctcttcgggagtgcaaactttgatgaacggaaactccgaatccttggcaatttgcgcagccaaaaaggatttgccagtgtttggaggccctcaattgtataaaattaattttgtaaacggattaataaatatgctggtgatggtgattgactgccttttacctgttagcaaagctcggacgaacccgcgcgtgtcgggcgcagcggtctctttgatcagaaggcgtccctcctccaacactcgcgagacgcaatcgccccacaggcaaagaccgccgtacagcagccgattcagc

SEQ ID NO: 641 - DNA, 1585 bp, Heterodera glycines
tgcttgattgtatggaattcgttgctgttgattgtgctgtatgccttgctgatttatgttgtgtcggtacatttcagagttgtgatgtaccgtgttcatatttggttgttcaacaaactgaacgtattgttgaatcggtgcgctcggagtaccatactcatgttggtaattctgatgctgtacattctgccgtcccagattcatttgatggataactctctgtggttgtgctacagacgtaggattgcgttgctgtcgtgttacaatttgcggttctccgtttatcactaattccttttccaatctagcaataacactaaaattttctcgaacttgatccatacccatttggtttgctaccctgttttccactggggtcgacgcaataggaaaagaaattgggagtaaattttgctgacgttctaatctcacattttcaaacatacgcccagcgtcaaaatctgttagactcacatttctgttgtgaacattaaaagttcgctcttccaaattttcaaagttttcgaaattcaaacctccaaatccgtttgcattgtccacttgttcgttttcgttttctttgtcctcctcaccatcacgaacatttctttgtcccacgtccaacaatgcatcatggatttgttcagtgttcatcattggttctgaaaaatttgaatgctctgacatcccgtcctcattttgtctcagtccattttccgtattgtttctgttttctctaaagatttcctgcccttcctggttaagaatgattcccgcattctgtgctctctgcctagttaatggcggacttcgcactatcattgttctcccagaaaatcaatttataaccaaaattcaaaatttccagcgcccaggtcgtttgcaaattcaaccaaattacgtagttcaaaatttccgttttcttcaaaaacaagttgaaaaccactcaggtgtcaaatcgttccgataaatgccgctttgctgcacctcccaggtgacaatggcgagaggtttatttatttctttaaaatttgtaatccaacaatccgttagccaaagagggccaatgatttgaggggcgagcttcttcgtctcctaatcaattataaaaaaaagatatttataaattaatctacatatcacagaacaatgagcaaaagcagaaaatttaatatatatttacgtaaggattttttataataaaaaataataaagccacataaaatatactaaattagttaagtaaactttgtcggtaatgttgaaagaacttgaaaccaagcggtcatctcttgacttttaatgaaagtagaataatatactgtattttaattttataatattttctataataatatattttatatttattgaaaaagtttgacattatttttcttttttatataatttcaattcgataatggtctgcctctttaataatttttatttttttccattaaacaatttaatttttaatcatacttcaatatttttcctgaaataactaaatccacagacagttgattttaccttttttcaaatccaaaatttggtgtaaatccaatgatattcaatataaattttt

SEQ ID NO: 642 - DNA, 1643 bp, Heterodera glycines
attggttctgaaaaatttgaatgctctgacatcccgtcctcattttgtctcagtccattttccgcattgtttctgttttctctaaagatttcctgcccttcctggttaagaatgattcccgcattctgtgctctctgcctagttaatggcggacttcgcactatcattgttctcccagaaaatcaatttataaccaaaattcaaaatttccaccgcccaggtcgtctgcaaattcaaccaaattacgtagttcaaaatttccgttttcttcaaaaacaagttgaaaaccgctcaggtgtcaaatcgttccgataaataccgctttgctgcacctcccaggtgacaatggcgagagatttatttattttctttaaaatttgtaatccaacaatccgttagccaaattatattatcgtctcgcccagagactgataaatattcagaaaatttcgtttgttctaacttttcgattttacacccagtacttcacttatagaaaacaaaattcgagtgcttcttacctgctttaccaggagcgccaaataggacaaaattccaaattaacttaaacaagcactgaatttgttggactgccgccaccaaataaactcaaatcaaaagcaaagtcaaagaccaccaattttataagagaaaatcataatatcggagatgaaaaccacaaaattaaaattaacaacgaacagccaaaacaaaagaaaaatagggagggaacaatttaatcaacaaaatgccaatacaatttaaatataaaatgagagctcaaaagtcaacttaattactacagcagaaactatcgaaaaaggcgtctctgccgcaaaaggtcaattattcggctccaaaaggtggggttcgcgcaggaagaagcatcagcgtcggcactgtttgcttcattcgcaaaccgaggattgccacggccgcgatagggaagacgagcgttggtgtacgggtggtgacgagtcggaccaaaggaatggtggcgatttgtccaaatttgagaaaagcgacggggcggtcacccagacctcccctcccatggttggcaaacgacgtcccggatcccgaacagtaccgtatttagggggggggggggtacacggggtacgtaccccgccttcgggcaaaaggtggcgagtcccgtcgttgataatttttcctgcccgcgactttctcgtcagaatgatcgatctgctcagccctgagtcggcacactgtccaatacaactgatcagtctctgaatccctcggtgatccggttcggttttcacggatcccgtcattgatccctgcccttgaacggagcgaattagagacgaggtaacttctcagatttcacaatgcccgcatcgatgccaaatgcttcccttcgattttgatcattcactggtttgcgtgcattaccccatttcggtctgcttctgtcataatagcttcgttcgtacctcgaccgatcgtgctcatatttcgaaggcacattgtggaggtgttgagctacgatccttcatgtactctattcctaaatttcctttcgatcctctagatagtacctttgcagcctcgatgattggcggaacttcaatttcgcttccccaacttttcttgatccgcttttttacgaatccgat

SEQ ID NO: 643 - DNA, 2964 bp, Heterodera glycines
agagagagagagagagcggaggagagagaaagacagagagagagagagagaaagaaagagagagagggagtgcggagagaaagagagagaaaaaagagggagaagagagagagagataaagaaaaaagagagagagagggagtgcggagagaaagagagagaaaaaagagggagaagagagagagagagaaagaaaaaagagggagaagagagagagagagaaagaaaaaagagagagagagagggatgcggagagaaagagagagaaaaaagagggagaagagagagagagagaaagaaaaaagagagagcgagaaaagagagagagcgagcatttggcaatttaaaaaatggataattattttagaaattcccatataattatttaattgctttcctttgcctccttttccatccgttcttttcttcatttttcggatgttcgccgccttcgaatggcaaatgcatttctgtccaaatgccgaatttgttatgaaaacggatgacgacacaattgttgacttggggcggtggaaactttgggtcgggaaaaagttcagaaaacaagcggaggtgaagggaggcgccgcctttttcggcgtcgttttggctaaaacgcgcccattccgtcgacgtggccacaaatggtaggctaatttcggcacttttgccgtgtttggatttgggctttcttccccctcctcctcccttttaggtacgtctcgaagaaatctttccccggagacattttcccggactatatgcaaggggccacttatttcggcactacccaagccgttcgagcagtgatggcacacacttcggaggtggtcggtttcaacatggacgacttgctgtacacgggcattttggccgaacgcgccaaaccgccggtgttccgatttaacagcggaacagtacatttcagaggagagcagaaagtgcgatcgaaaggactaaaattcaactctaatttgtggcattatgtctcctcgcattcagatttggccacggaaggaatactgtaagaatggcgtgcctttgatgttcgcggcgtacagcggaattcgaacgcggcacttcaaaaatgtggaggagtacaaaagggcgtaccaaagaatacgcacagtgaaatgctaataataatcacaacgaatttcgggaaagtgatcattcagaagccttgacctgcattttgtcatttttcttttaatattttgttacttttttgcacatatttcgcttttccttcccattatcgttgcatttttcaatggttaccctcccccaataggacaaaattccaaattaacttaaataagcactgaatttgctggactgccgccaccaaataaactcaaatcaaaacaaagtcaaagacaaccaattttataagagaaaatcataatatcggagatgaaaaccacaaaattaaaattaacaacgaacaaccaaaacaaaagaaaaatagggagggaacaatttaatcaacaaaatgccaatacaatttaaatataaaatgagaggtcaaaagtcaacttaattactacaccccgcccctatggaaaaaggcgtctctgccgcaaaaggtcaattattcggctccaaaaggtggggttcgcgcaggaagaagcatcagcgtcggctactgtttgcttcattcgcaaaccgaggattgccacggccgcgatagggaagacgagcgttggtgtacgggtggtgacgagtcggaccaaacgaacggtggcgatttgtcaaaatttgagaaaagcgaccgggtcggtcacccagacctcccctcccatggttggcaaacgacgtcccggatcccgaagaagacgaagctctacgagagtcacccagactactcgtagagggtttttggacgacggacttcacggtgcggatattcaacgccttatcccctggaaacggggattgggtaaaaagccacgctttaagcgctcgaatccctgcgtctttcaaaactccctcaggtgaaataaggtgttggttgaaggagttgccaaaacggaagatttccaaaattgagcggccattttccgtggtgctaatggaacgaaattgagcctggtcaatgaaagggcgcattttcatgaccaattcttcatattgagcagttttggcatgaacgtaaggagggaaggtgatgaagaagtcgacatgctggaaacgctcacaaagtgtcgtaaagatgtccaattggtccagcacagcttctgttgtctcgccggccatcagagagtctcgtccgacgaacaccaaggcagctttcactttgcttgacaaaacggtcggctttaaaatacggattacttcggccaaactgccctcctttccgacaaaggctgttttctccattgcctctgccaattgctttgccgagctgtctccgatcacaacccttggctcctcaacgaatgccacagcgtggtgaatgtgccgagcccgtattttttccaaaatccacggtgtttcggcaaaagtctgctcctagccggacttttccgaatccttaagaatttccaagccctcgggtgccatcattcccactcttttgtatccgctgtcctccaaggcatgctttgcacattggcactgctccacccaggattccagtgctttttcttgatcggagggcgaagggaatctcccagattccacataatctccccttttcccagaaaaaaggcacatttccattcccgggccgccttcgaggatcattttgatgaaattgcgggcagccgacatggacgagacggtgccgcctctcagaaggaaaacggccatcagagcctgcaatggcgtttggactatggcactcccaatttctgctgtgccaagtgccgggtcaagctctcccaaagttaatttttcacagaattcgtgttcagttcctgtgcacttcgaattccaccgaaaattcaccctcggtcgact

SEQ ID NO: 644 - DNA, 1487 bp, Heterodera glycines
  misc_feature (1443)..(1444): n is a, c, g, or t
  misc_feature (1450)..(1450): n is a, c, g, or t
  misc_feature (1467)..(1467): n is a, c, g, or t
taagaattccacggttcttcgatatgttcgaccgaagttgaaatgggtatattatggccacacaattggcctcaattttggacgcgatggagcaggattatgacgagaagacactcagaaagttgcgaattcatctgaattaaatatggaaaatcaaatgatgattaagactgatccgcaaattcgacgccgacggatcgggcaaattggaatttgacgaattttgtgcgttggttttcactgtgggaaattcggtggacaaagaaacgctgcgtaacgaattgaaagaggcgttcagactgttcgacaaggaggtcattctttcattcggtctttgaccatttgtccccttcgatttgttgaccatttgtccccttcgatttgttgaccatttgtccccttcgatttgttgatcatttgtcccttttcagggcaacggatacatttccacgcagacactgaaggaacttttgcacgaaattgcgcccgacctcagcgacaacgaattggacgctgcggtagacgaaattgacgaggacgggtcgggcaaaatcgaatttgaaggcaaagcaaaatcaaacaaatacaattacctaattaaaacccaactttaatttacagaattttgggaattgatggccggagagagcgaataaaacataaaagaccaaacaaatgattggcatggcgaaaaaggcatttgaacatttgattttacacttttttcaaactgaaaagtgaaagtgtttaaatcgcaaaaggaaataaattaattataaactgtaaaattacaattataacagttgcaaagggaaagaacttcgtttatttatcttttcactgttccaatgtattcaatttcattttcgctgtcgtcgtccacaatttctcccggggaaagcattggacaaacgaattggtgacaaattgtcggcttttcctcctcctcaaattcgtccctagggtccgttggatcactaaaaaacattcaaaaaattaccatttgctgaaatgattatgaaaaacaaataaaaatgaatgcgccgcgctttgcctggaaaaatcggaaaagagtcggagaatcgctttggcgcgttcggaggggctgagattctgacgggcgaattcggccgacaatttcgccacttcggtgggcggcccatcgaaggcgccgtcgaagtcggcacagtccaacaaagggaaagttggcaaatacttctgacacattggcaaataactgaaaatgggaaaggaaagggtaaattattaatttgaaaatattgaaaatttaatgaagtttttttaattttgtttcgtttccactgccattggacccatggaaaataaaatgccattggcccaggggggtgtcttttccccccccccctctcttttcccctcacattcgctgttcctttggctgctcttccgctgcttcgcatnntaccanagcgcccgcattctcancatcagcagatgcaatttcc

SEQ ID NO: 645 - DNA, 4517 bp, Heterodera glycines
atttatgtagtacattgataatgtacatttctggtaaattctttaattatatccatttttattgtgaaatgctcacttgatcaagggcgtatccagggagtggtcttaagacattcttgtccaacttgacgaggaacaaattgagggtaaaagttaaaaagagtaaattagggaattgacaatgtttaagaattccaacggttcttcgatatgttcgaccgaagtcgaaatgggtatattatggccacacaattggcctcaattttggacgcgatggagcaggattatgacgagaagacactcagaaagttgcgaattcatctgaattaaatatggaaaatcaaatgatgattaagactgatccgcaaattcgacgccgacggatcgggcaaattggaatttgacgaattttgtgcattggttttcactgttggaaattcggtggacaaagaaacgctgcgtaacgaattgaaagaggcgttcagactgttcgacaaggaggtcattctttcattcggtctttgaccatttgtccccttcgattttttgaccatttgtccccttcgatttgttgaccatttgtccccttcgacttgttgaccatttgtccccttcgatttgttgatcatttgtcccttttcagggcaacggatacatttccacgcagacactgaaggaacttttgcacgaaattgcgcccgacctcagcgacaacgaattggacgctgcggtagacgaaattgacgaggacgggtcgggcaaaatcgaatttgaaggcaaagcaaaatcaaacaaatacaattacctaattaaaacccaactttaatttacagaattttgggaattgatggccggagagagcgaataaaacataaaagaccaaacaaatgattggcatggcgaaaaaggcatttgaacatttgattttacacttttttcaaactttgaaaagtgaaaatgtttaaatcgcaaaaggaaataaattaattataaactgtaaaattacaattataacagttgcaaagggaaagaacttcgtttatttatcttttcactgttccaatgtattcaatttcattttcgctgtcgtcgtccacaatttctcccggggaaagcattggacaaacgaattggtgacaaattgtcggcttttcctcctcctcaaattcgtcccgagggtccgttggatcactaaaaaacattcaaaaaattaccatttgctgaaatgattcatgaaaaacaaataaaaaatgaatgcgccgcgctttgcctggaaaaatcggaaaagagtcggagaatcgctttggcgcgttcggaggggctgagattctgacgggcgaattcggccgacaatttcgccacttcggtgggcggcccatcgaaggcgccgtcgaagtcggcacagtccaacaaagggaaagttggcaaatacttctgacacattggcaaataactgaaaatgggaaaggaagggtaaattattaatttaaaaatattgaaaatttaatgaagttttttttattttgtttcgtttccactgccattggacccatggaaaataaaatgccattggccaaggggtgtctttcccccccccccctctcttttcccctcacattcgctgttcctttggctgctcttccgctgcttcgcattttaccaaagcgccgccattctcacaatcagcagatgcaatttcctgaaaatataaaaaaataaaagatagaatttgcatattttttgctctctccccccatttttactctctttctctcccattttcctctctctttgctcctttttttctcccccttctcttccttttcctcttccttttcctcctttttcacctttcgctctttctttttctgctgctgcgtttcttccttctcttctgatgcggtggaagtgcacataaaaatcacttcttcttcttctcctcctaattcttctgcggttgaatgaatttcgtcgacgagttccattgtctgtgcaaatacgatgaaataaattattgtgtttgtaaataaaaaataaataaaacatttgcattgtttttttccaacaaaatgtgcattttttcccgccctcgcggggaaaaaagggaaatgaaacggacgaaaggaaagagaatgaaatggactaaaaaaagactgacaaatatgtctctctttcgcttgatcgtaaagtttcttaagatgatagcaaggaaaagttttttggcggatttttttaaataaatggcgaaaaaattgaaaaaaaaattataaaatataagaaaaatgtagagaaaaaaaatattgcacataaaatcagtcatttgtggtcgctttttcacacaaaaagggatttaatttttaattttcatggaatgtttttagaaatcatcaaaaaacgaagttggcttaaagaaaacacaaataaaaactgcgaaaatcgccctacgaatgaccgaatgaataaacaaaaattacagagaaattaatgggaaagaaaagaacgaatgggcaaaaaagtgagaataaagggagaggggggggggatttgggactaaaaggattaataaacgattaataaacgatgaccaattcgggggaaaggcgcaaataaaggggaaactccgcaagtaacgctcaaggccaaaataggctgaagagagtacaaattgagttcgggtcaattctattctcggagttttgaatatcaaacctaaaaacacaatttgtgatcggccagcagatgcgaaaggcaaaaatctaatggcatttgttaacagaattgttcgaaaaatgataaatttgaattttgggtgtgactttgagctaatttttcaaaaaaattctgggcaaggaagggccgacaagtgccgccagagaaaatttttaatttcaatttaaaaaaggattaaaaatatatttaatttgtaaggttggaaaaaataagacagactgaaaattagccactaggccatttgtacattgacataatcgatttaaacagtatataaaagcacaaatcgccaaatttctacttgcattttttacaaaatttcgaccgattttcaatttttcaatttttttttactttagtttttaatcgattgtgccctctcagttactctgatcacactttgctctctcatttccccacagtctccgctccctctctgattctctcccacctgctgctgtctctgcctttgctgttctatttcgtccgcttcgtcctccgtttctgatgttgttgaagtgcacacaaaaacgacttcttcggcaccgttttccttttccttttccttttcttcttcttcggcggatgagtgaatttcgtcgatcagttccatcgcttggggctgtccgacggcactttttgacaaatgttgcgattttctcctaaaccttcgtcgtttgcggcgttttttctgtcgtttttcgttcataatattattaaataataataattattattaataaatatttaaattaattttccctttttatttctaaagactaaaaagttaaaataaatgaaacaattaaacatgaaatgaataaattattattttttgttgaaaagggactcttttttgatttgttcagctttttcaaatgaaacattttcttgcgaatgaatgcgactttttgtttatcccttctcttctctttcccaccaatgaaatgataaaatgcgacgacaaaacaaaacactttttatttttatcttttaaacgccgcctaaacaaatgaaaaattcggagataatttgagtttattgagaaattttgtattaatattaaaaattttaatgggacattttaagtgagtcatccattaattaattggttaattaattaattaagcgattttcttttggaaattcatcgacaaaagcattggacaaagcatttggcctcctccgtccgtttcttttcgttgttcgaaccgccgccaaaaatgcctttgattctttgccaaatgcttttatttgcgccttgggcgaatttcagccgacattccgaaaaacatgggcccttaacaaaaagagaaaaaggttggaaaacggcggagtaaaaactgggctcccagataaaaatttcaaaattaatatttgaatttatttaaaaataaaaaaattaataaaatttggttttgttttttggtggaaataatattttgtaaaattgtgaacagataacatcggaattgacgttgatttaggctaacaaattcagtgtttcaatggcattttattttataccaaaatcaaagaaataaacacttaatttttagaaaaagtcacacatagaaaaacaacattcgccataaatttggaaatttgggttttttaaaacagatttttgagaacttttcaaaaaggtacaaaatcagcaaattagcatttaaaaaacagcattgcgtccttaaaaacaacaaaatactgataaatcagcacatctcatctctgggcttcctaaataaaaagtatgtataggaaaggttggaacccttccccccccc

SEQ ID NO: 646 - DNA, 2271 bp, Heterodera glycines
  misc_feature (1758)..(1758): n is a, c, g, or t
tattatttttgacaaaccgtgaagtcgtacttttttggtgtacaacacctgtcgggtgggccaaatcctcccccccccccccccctctcttctctctctctctctgtgcccttttggtctcatcccttgcttatgtacttttgaattggttgttggttattaaattgctctcctgtcactgatcagtgatcaatccttcccattttgtttttgatttgtccctttttctttttcccctttttctttttcccctttttctttttcccctttttctttttcccctttttctttttcccctttttctttttcccctttttctttttcccctttttctttttcccctttttctttttcccctttttctttttcccctttttctttttccccattttccctttgtcattcgcttctttttccatccccgccgcacctccaaaagcgccacttcccttctctgtccttcgattgtcacttcttcgatttggtctttgatgtcgacacatttcccttcgtctcctctttttgtgcgctcttctccaaacacttcgatttgctgatcaaatgggggtgagagagggattaatttgaattgctaattaggttagtaattaaggagtatttaagggcatgtgaattgtacatttttttaaactccaaaggggtgggggattcacaaaattaaaaagtgataatttgcattcttttcagttagtaataatacatatatttcacatttaccttttcttcggtttctgtcaaaatcaattgcattaacgcaaaaataatcgaacagaacaaaataaaaagtttcattttactgctttaatgcgtaatttaatgagattctttccttccgcagaataaaagctgtaattttatgctgcttttgtccttggatggcaaattcttttcaaggactttctttggaattaaggacggatgacataacacggataataaggttaatgatattttgatgttgcaacgttcattcaacatattatttgtgagtataatcaatgattgaggatggttttggttggttcggtttttgtaccaaatgtttattgactgtaccaacaaatcgttttgagggggagggggcggcggcaccagcggcgacactttgcgcattcgccggggggggggggcggcgattgttgcggcgaaaggcgggcgaatttaatatgacaaaaaagtgtcagtcaaactggtatttattatcattattattattactaggcattcattttcacattctcgtggtctgttgtacattctcactaataatgaaattatatggaaaatgagaaaaaggacaaaaaacggggagggaatggccccgcggtcacatttttgttgaattttctatgattcattttgccattttttcacaatttgtccattaattcattttggtatatttaattctcggtaaattttttaaataaaacataaatttatacacaaaaataaataatgttttccgatctttccagaaaatgtgaaaaatgagatcggtggcaaagagaaaaatcgaattaaaacaaaaaaaagaaaataaacacaataattaataagtaacaacagcagcagaagaatgacttggaagagcgaagatcacacaaaacaaatataaacttcttcaatattttagcaccaaagcaaaaagtggcggaaattggcaaaaaaaaaaaaatgaaaaaggaggaggaggaggaggaggggggaggtaaaattgaaccatcattccaatcngtcagttggcacccccccccccccccgctctcccatttcggcatttttccgattattttatgccgattgttgctgctgctgcccctcattgctgtcactccttccaacaatgctccacatccaaattcgtccaactccgtcgccgatcagaagtgatcggtggtctttggttggtcggatggctgtgatcggtgccggctgagaattgccaaccaaaaaagcggtgtgctcgctcagaatacgccttaaccatggccaatataatgtggagaatgactcaattgtcccacttcagtcggaactccctcctccatttggttttttccatgccatttggccacttttgccggtgccgttgttcttccgcttgttcatcgttgttgctgttcgtcttctgcgtcggcgtcgtcggctgctgttgctgctgcgacgtttgtctgctgatggtggacgagtgggcggtggacgccgtggagagcgtcgaatccatcgacgacgaagcgatgggcaccg

SEQ ID NO: 647 - DNA, 3268 bp, Heterodera glycines
  misc_feature (3208)..(3208): n is a, c, g, or t
  misc_feature (3244)..(3244): n is a, c, g, or t
aagcgcacgcttgggcacgagacgcgcggagggcaacgatttggagacggacagagaagcggagacggaggagggagcaggggaaagcgagagggaccagacgaaaacggtgcctaaggagggaatacggtggcattttgaaaagggcgcaaaacgaaagaattgccggtggacagtccggcgaacatttggcgaccgtccgtcgtcgccatgcaggtgatctcgtagacgtcgttggtctccaaaacgcaggacgactgaacggaacaattgcaatggacagagaatgaatgattggggagttcgcccaccttttcattgcccacggcgccgaaacggacggaacggtcgtaaaagccccaggcaaggaaatagcagggcggcaccaacactttattctgctccaacaccaccgcttggttgccccgctcgccgaccacaatttcacctaccgccgtccgcaattctttcaccggacgggcggaaacgcgcaacgcctcggggcaatggtaaaagaggcggggaacagtcaaaccggggacgggggacaccggcgggggaacgccaggcggagaagcacctaaaaatgggaaagcatagcacttaaaatgcaatatgtgaatatatatacgcaaaatctttcgctggggatgcggttttttgaagagttgggcggggatttggccaaaattattaatgaagccgagcgtggcgttgcgcgtcagtgggtcctcaatggtctcaatgtcaatgctcgtctcatagaacaggtggtggaacacgttgttggcctcccgtgcggcatcacctgcacaagaaaagacaaaaatttggttaattctctcgtttaattgccccttttttaattggctacagtccgatcacttaaaaatgttttctcattttgattctgttcttttgctgatcaaccaatgatcacgaccatcctttttcattaacggaatgatcagtgatcacttcggctgatcagtccgattcagtattcacccgtctgtttgtagccgaatatcaaatcgatccattcgtgcaaatgttccgacacgaagtcgcactccaacgcctgccgatggagtcgtacaaattcgtacgcgtccccatgagcccacgccggcaacagaacgtcgtccagccgagtgccgttttgtttgatgcccaaatcgaaggcattttcgttgagaaacatttcgggcaggaaaaagaactcggggatcagctccttcacgtccgccatgttgtttctggccgcactccaaaaagcgtcccgcacggaatggaacattctgtcggccaaatcgaagtgaccgccctggggggggggagaacaattagagcacttaggggggggggggggggtaattaaaaatggagatagaaggaaagggttggatgggacagagagaacctggagtttaaggaactgttgagtgaacggctccaatcgaaccaaataagagagtacaatcatcgcactactgtagtgggtaccgtacatgtacggcggcgttcctcccgggtcgtcccactcgcggaaccgtttaaggaattgggcaagccgatcagggttttgggcacctgaaaaccaattccaattaaatttaatggttatttattgctattcgcttacccatcggcttgctaaaatcgcggaaaatggaagggttggttaggtcaattcggtccgagtcgtagtcggccaacacccagggaaacacctgaacagcgctaattagttgcttaatagcccaattagaacagggccaaaatgccaccgggtattggctcaagtcgttgtaggaacggccggccaaagtgttcagatacatcagataatggaagttggagatttctcctcgctgccatttgtgggtgattgactgttgctgtcccgtcagaagttgggcgatcagagacgaactcgtctcggtgggccgcagcttcttctgttcgttcatgaactgggccacgtcgctggacgcgttcttcgccatcgaaaccaacttctaaatgtgcgggcggaagaagtttttatgttgaaggagtagatttagtcttacaatagtggggttggtactaaattggcccctccttccactcgccccccataaatggcctaaaataaatgtgagactcaattggcccctcgccccccacaaattccatttcctccctccacctgaaaaacgtggtcgcgcactttgcgcggaaatgccaacaaaaagttgcgcccgtccgtgctgaacacttcgagtgcaatttgctgcagcaaatagcgccgtttgtgcacctctttgatgtcgtcgtatgcgaatttgttgcactggcggttcacttttgtgctgaggggccgcgagcgacagcccattgcaatgtacggaatgattgggtcgtggaacctttgggggaggtgggggatacggtaggggcaaagaacggggaagaacatacatacggtaggtgagaggacaaaatgactcactgttctggcaaaaagtccaagtcgcggatttcgcgcgtcttcagcaaagtgaatccgtccaccacgtaaaaatggtccttcccaaacagcaaaaggccctccattatgtccaatccctggacacgagcacaacggaacatcgaatggagctgaaaaagagggcaaaccaacgttaaaatagggaaaagaatttaagaaagtttgcccttggcaataaatgccatttaaattacggtcttttccaaaacacatttttcctaagtttttgagtggctttttcctgtatgccatgttacgctttgtcttggcatgcttttcccttgtacactttgtctcgtacactttcccctcaccttttcgccctgctccaacagtctgagcagtgtctgattgtctggcccttggccgttcgtcgcttcgtccgtcgtccaattgtccttgcgcttgtgccgtttgttcctctgttgctgctgctcttttttctgctcgtccatgtctttctgctgctgttttccattctcttccgcttcttccactttctctgcactgtctgcttcttttcccaatttttgcgttccgttttcctccactctctcgtcctcctcttccatctcttcctcaatctcttcgtcgcattcgttctcttcactttctctttttctctttccgtcttcctctccatttgcgatgtttttctccgaatatttttcngcatttatttccaaattcttttctaccattcgcttnattgttgacatgttcaattctaaa

SEQ ID NO: 648 - DNA, 2812 bp, Heterodera glycines
aattaagttcaaattgtcataaattgcgtcgctcaccctcaacagattcgatcggttgctgatcacttccgttttgtgactgatcactgcccattccttccacgctctgatcagtgatcgcccctcccggacttggcattaatcctgccttaaagtctacaatgcgttcgtccatcgtttccgctctcgttttgctcatccgttcccagtaggcttttgcatcgcgtgaaattgccactttggcacgcaatggtttcgcgttgggcccttccaaatacggacgatagggataatggcgatagaagtcggggtttggcacaagtttccgccgaatccggcacggcccctctgtgatgtccaactgaaatttgtcgaggagggagccgtggttcgggcctaaattgaaatttaaaaagaggaagttcaagtgccaagaatggaccccaaagtccgcgctctctgatcagctccgtctccgcgttgtgccattcttggatggaccacttccgcacatgcgaatgccattcgtgataacgctggcaacgatttctgatcaattctcgcaccaaactgatatggacctaaaaacagtcacaagaataccgtagcactcagacaatcgatccactacagtaccctgatccacatgtaaaatgtctccggctctaccctaagccgtgcgtcgtcaaagtgcgccagtgcgtccagtccctgcttggactcgacgtcgtccgccgaagtgttggcaaaactcgacatggcagttgacttgcgcaacttgcggaggccactccgcgcaactcggctcagcttcgtctgcagttgtgtcggcaacattttctgtgcgttcagcagacgcacagcggacgaatcctggcgaggaaggcaaaccgattcaaattggcagttatttggcattttgttggacaaataaaagtatgtatgttcaagtgcctgcttgttggagttgactttgcgaaaaggcgccgactgtttgtgagtcgacgaattgaagccacgcgcggtttgccgcctcgccgcatttggcgcgtgacgtgaacaggtccaagtccaagttgcccttcttcagccactcctccagcactgcctttttgtgttgccaaagaatgccccaaacactttgtgcacaaatggacacctattggccaatgattttgccaattttgagtcttttggccgacctgcgcagtgccacgctccaattcgcgattccgccggtcctgcaagtcgaactgaggccggtcggagagcataaacaccaaatggacgagcgcagcgtaaaacagcgggtccacgttggacttgggggtcagaaacagctgctgatttctgacaatggcatttcgggaaaacatttatgccaaactcggcatttgccttccgctagtcgatcacctgacaatttcggccaaagtgtccaacacacacatttgcgtgtccacgttgtcaatgggccgcgacaaaaggtacaaaatgaggcggaagagtgaggcgatgtgcgcgtcggtgcattggagctgagccgccgctttgtttgaggcgtgggcctcggccaaaagctgaaaatcattggacaataatcaaagtgttatcacaaaagtgataaacagtgccttcagaaaacacttgaaaatgcgaattgggttccctttgtacagacaattccaaacggtgtcaatgacacgcgacagaaagcggacgacgctggcggaagtgcactcggacgattggttcagttgggcctttgcccccaggggaacgaccagcggagccgaggccgagttcagaaagaacattttgctggccatgaaatggtcgagacaggcgttgaccagctcggtgaacagaaggttctgcctgttgtgggtgggtccattgcagtccatgtactgtaggggaagggcatactgtagcaagttattaaagaatggcatacggtaaaaaacaaacaaaggcactcaaaagtaaatgagaaaaaagtcgaaatggtgttttttgaaaatggaatttgcctcgatcagtgcgtcgaacaaaggctccgtccgcgcttcgttggccaaacaaaggtcattcagcagaatatttgtcagcagctccaaactctgtttctcacagcgatttttgccgtctaaaataattttaattttattttaaataattatttaatttttttagttttttttgcgtttgcctcctcctgcagctgttgttgaagcagcatattcctcagcaaatgttctctccgaatttggcgtttgtgccgaatttggcaagggaaggagcgaagagaataaaacgacaacgaaagacttaacattaattagtcaattaaatattaaaatagtcattagggtaattaattaattgcctcggtgtgacaaatggcaaagaattgagaggaattttggtagagaaaattgaacagttggagaagctgaattatttgtttattgataaaattaaattttgctttacacaccctcaggggataatttgtgctccaatcgttggcattttgttcaccgctctcttccgcttcaaattgcctgtgaattgtggcacgaatagtggccaacagagacacaatgacttcgggacaaaattgggcacgttcaatcgcatcggcaaccgatctgaatattcccaagttttggcaacgatcaaatgccaacatttggccaaatcagggcttatgctgctgatggcattcaaaaaattctgatttttatgattttgtctccgtctccgctcgtttacaattatccccttttcctactgtatcccctccccc

SEQ ID NO: 649 - DNA, 1788 bp, Heterodera glycines
tttttggtactgaaagtgtccatttttcactgggactcagttgacccagtgcctagatggcatcggttcgaatttataccttgttttttagacttagctgatccagagctttcgagtgatacctaatttgtccgaatttgactgttttaaagggtcagtggccccctttttcactcaatttttcgagttttaaacaggttcaaaaaccggttttttggcatttccgcaactggagagctacggctatcgaatgatactaataatgtttaatttggatgcttcttgaaaaagggtgcactaaagttgacaaaaataatttatggtcgtctttttttatggcctgtgaactgcaatagagccgcttttatttccataaaactgttttttaattactcaatccgaagccatttaaagcaaattttgctgggcaacggacggtccggcaatggaaatggcacacatttgtcatccatttgtacagacagcttcggttctggtcctttgtccttgcgaatttcgatcgttctccaaatagtcaattcgcttttgccatcgaaatgtttgtccaccaacgcatcaaaacgtggcgaaagaagtgccaatttgaggccgagttgaggacggtcaaaagaggggaaaatgtccatccaaacgtcgttgcaaatccaactgaaaaaagttttgttaggtaaataaatgacgaatttgtgcttaccgtctgttcattttttggcaattagcacaatttgctgttgaatttcgagtcacacaaatatatagcagaataattaggtaattgcgttggaaactttatttttatataatgagaaacaaagcggaaaacaatcttttttaacgaaaatcactagggatgtcaatttaatgtaaatacatatttttttccttgattccccatgctctaaatagtaggaaaaacactttcttttctgtgtttgcgtacaaaaatcgggacttttatttacatatttcgggattttatacatatttggtacatattttgaggattttttacgggaatttttaaaattccttaaaaaaaaatcaaaaatttcggcaaatttttcattttttacatacgtattctgagaatttttgcaaatttatagaaatttcttctaaaaaaattaaaaaacttttttagaaaatgtactcctaaaactagcaaaaattaatttttaaaatgttaaaatgtgattctaaacctatttaggtcatttttatgatgacattttgtgccttgttttgttttcatagaggaaaagaaacagaaaattaaaaaatataaagattaatagagaaaggatgagtagtagagagagtgcagtgtttgcttctctgtcggcgcgggtgggagggttagaatggtgccatgtcattacttaaaaaccatcataatgggcgttacttaaaaaaccatcataattaaaatttttgcttataactttgctctaaaaagaccaaatttttgatgtttgctatcattcgatagatctaaattttctttatgagcctgtaaaatttcaaaaaattttattaagcttaaaaaagttatggccaaaaatgttcgaaaatcaagtttttttgagttccccgagctataacttttttgaaacttaacaaaattttttgaaattttgcagactgatagataacacttagtgctatcaaatgatatcaagaattaaaaatttggttgctttcgagcaaagttataaataatttttcgacaaaaatttttcataatgatggttttttaagtaacgaccc

SEQ ID NO: 650 - DNA, 6507 bp, Heterodera glycines
gatttatgacaaattttggttatttttttaataaaaatctgtaacaaatcgattaaaaacacaaaaaatttttccgggcggcgcctatcggcactcgacggagccccccctgtccatcctccaaaattttttgaaaaaatgcgacgcaaaaaaagcgtttttaaagcaaaaaagtcgtcgcttgacttttaatcggaagggacagaaaaattttggcataaaatgaccgattggaagaggaagaaaaagggaacgcaacagaggaggacccaccaaagaggagaatattttgcaaaatgatgacatttgccgggcgttttaccttatccccccacccccaaatcaatcaaataaataatcaatttgacggataatttttatccaattcatttgtaaaagttaaatccacatttttcaaaaatttgaaaattgactaacgtaatgataaaagtcaaattcctaaatgattaaaatggaaaaacgtaactcgtgcgcctgcatgaattatttcaggattcttatgagcattttgaaatagtttttcaagtttggtaaaagactttgacattatgccagggcacccatcgtccatgctccgtttccaaggacggtatgccgatttgcaaggacaagtgggaaaaattcatgaaatccaagaacatttaaattttttattttaaacaatgaaaaacggttaatatttattcattcaaatggcttgtagttttcatttttccaacatatttttgttttcacgggtcattttcctcatttgcgacgacttttattctgctttaaaacgttttttgtggcgcgctttttccaaaatatttccgggaaacagataaaggggtcggcggtgccaataggcgccgccggggaaaaatttgttaactgattttcaccaaaaaatgcggattttgcgattttgagataatggcgatgaccacattttacttttcacaacacttcttgcgggcgctttttgcgaaaaactttttttggggatgggagtggagaaattataacacttttccaaaattgatcatttttaagcgtcaaaatttaaaaatagaaagaaaggccctgggggtgccaatatgcgccgccgggaaaaaaattgggaatttttgtgcaatttaggaccagattttgcaccaaatatgttataaattaaaaatttatcaaatttctttgaatcttgttaaaagttttccaagtgctcattttcaaggacgtcattgccattcaaggacgaatgggaggccctgcattaccgtaaatatttcataggaatggctgagatccaaccctttgttatttgagaaattcggtgattaattttcttttacctttggtaaaagacttttttgggtgagtataaatatgtaatataagcaataaaatttctaaggaataaaaagatacacacagaaaaaaaacaacacatcgtcctaatttgaaaatttggtagcaattttatataaaaacggctatttttgaggatttttttccaaaaatcagcatttcatcaaataatcagctttgacccctagaaatgagcaaaatgcttacaaaatcagcagagttgggaaccctgtacatacccaagggatgcgaagacattcacaatgagaaatgcacgagtccaaacaaaggagaagcagaagctaattaaattttaaattatattttagaataaaaaacggtaaataaataaaataaataggggagcaaaatagaatttagtgctaatttggattttggtgatgaatggttttggcatctttcatttgtgcttttatatgccatggtttctctgcccatctctgctgttcccattttggttctcttctctcagattaattgccattgattaatctgtccattgattttccttgggttaatttgagtggcttaatgccctcctctgccagtgaatgggaacggacggcattttctttgctcgcacacggcactttgggaaaagcaacctaatcctcaaccaaaaaatgaaaagcaaaatgaattgatttgatttatgctcttctgaggccgaaagtgatcagaatcagctaaagcttataaaatcttttgagaaattatttttttatgttttaaaattggtaattccaggcaaaatatctgctaataaatctcaaaattcttctcaattttatttaccttttttcttaatcactttttcacatttaatcggaaattttagtcagttagacaaaacgaaaacaatttaagtttaaccattttatttttccattaaaaatttctttaataaaaaaatcaaaatgttccattttaacaaatcaaattaggtaatccagaaattgacaagatgcgaaatatgcgtcaaaatccaaaaatatactaatgacctcctaattggttccgcgattcggtgataattaatcttccatcatatactattagctttggcaccaaaagtaccatatttgtttgtattttcttttctccttttggccatcccttcccttttattcgtttttcatatcagctgaccgaagaatgagctcaaaaaagctcgagaaatttctcattcggtgcacattttgacaatggcattaatgccgtcgtccacctgctgctgaatatctctgctgagtggcgctgttcctccccccccccggcgccatcaaataaatatttgtaatgcaattaagtttgccccattaatttctgtcctttttataacacttttccccgcctttgctgaattcaattttccgttatcagtgtatatagaagttcaagcagtacagcaaatttcgatgggaaaggagatgaagatggacaacagcaaaaatggagaaacaagggaagaggaggaaaaggaaggaaaatagcattagggaaggaggagagacggaagagaaagagaggaaaaggaaaaattcggcggaaggaggaggagaaaagagagaggaacagcagcaaatcgacactttaatgttgccggtgctaattgctaattttgtgtgtcgtaaatccctcgtcaaaatcccgaaaattaattgtcacaagtttcaaggagaaattcatacattcgatagataccaaaccatttttatacatccgatttatttaccgaaattgagagttttttctttataaaatgcatttgatcacggatgaatatgatcggtcgatcaatcattcttaattaattcatttcttcttctggggttgatcgctgtttttgttgttttgtccgtcactcatttcgccctttttcgctgctttgtcccgcttcttcttccggtggcggagacaatggccttaattaagcgcaatttgaattatttaaacaaaattaaatgccttttttttatttgctcacccaatgcaattagtgtcactatcaagccaaatgatcacattgttacaattgttgtcccaatttccgtctttccaatgaaccgccgctgtctccccaataattttgcttcgtttcattatccaaccgatgccccattcattttccttggccaatgtcagcttttcctttgtccattcgttcaccaattcaaatggcacaatttgcattgacggcacgcgaacaggaaaatgaatttcgtaactgatggaagaaatggcattggcacgaagaaaatgctaaacaatttgagtggggtcggaattccaatttccgaaattttgggcctcattttttcgaattttatagaatatttttttcgaagctagagctgggttcaaggggtaaaccaaaaatacgtttaatggttcttaaatggcgtataattaaaaggtatgatcattttttggcgtaaaacgggccgagacctcggaggaccgggaattcccgccccggtccgtacaaccctacttttaattgttaatttctttcattattttttggtacagaactgtctatattcaatgggactcagttgtccctgtgcttaggtggctcccgttttgacatttttctttgatttttagacttaactcaccaagagctttcgaatgatactaaatttggtaatactacccgatggtaccacaacttttttgaaaaaaaaaatttttgttttcaaaagccgtgaaaaaatgttccctggggtttttggggttgctgatcaccaatatgacatccatttcgactaatttcgaaccccgaacccgaacaaaatttcgtaagttcaaattttgcatttttcgtctaaaaatgggtaatcacatggaaacattctgaagtggtaccatcggtagtattaccgtaaatttgtctgaatttgacctttttaaaaggctaaattgtcctattttgtccattttttcggtaaacaaaaaattgtatttcactatgaaatcgttgggtttacgccaaaaaatgattataccttttaattaacgccatttaagaccattaaacgtatttttggtttaccccttgaacccaactcatagttcaaaaaagctcgagaaatttctcattcggggattttcagcagtatttgttcctgctcccccctccctccgcaccacacctccttgaaactgttgacccaatcgaagtccgcttgtgcgttcaaatttctgccaaaacgaaatcgcttgggttgtccatcttttctcggagagtgcaaccatttggacgcctcaggcaacaaatcaccggaatagattgaattcaattggtcgagatcggtgagaattgaatgcgaagtgagacgacgcaatttgtcaaaaaggatgccattgcaaacgcccaagtggcgaatgttttcagaaaaaatgggccaaatttcacgaacaaaaacatcccaaattggctggccattcgtggtgtttgataatggaagccacaaatgtaaattgatgcctcttttgtcgaaaatttggtgattggaacgaagaaaagcgatgacggagtgatcaatgtacctaaaaatggaaagaatgcttttattgcaatagcttttgatttttaattactcaatccgaaggttcttaaagcgaattttgctgggcaacggacggtcgggcaatggaaatggcacaaatttgtcatccatccgcacagatagcttcggttttgttccaatgtccttgctaatttcgattggtctccaaattgtcaattcgcttttgccatcgaaatgtttgtccaccaacgcattgaaacgtggcgaaagaagtgccaatttgaggccgagttgagcatggtcaaaggatgggaaaatgtccatccaaacgtcgttgcaaatccaactgaaatgggaaaacagtttagtcaaataaacgacgaatttgtgacttttaaaattcttttaccgtcggttcatttttggcagcaattagcacaattttggacgagttccgaatgatgtcacacaaaagagcagaataataattcgttggaagctttatttttttaatgagtcaaagcggaaaacaaaagatttttatagtcatgaaaagggaattggtgaatattttttgtatatgaatagagagagccctgatttttttttgatttttttgcgttttttgaattggtgaatattttttgtatacacggcgattcaattttgggctccaagtacaaataagtttattatttatttagtaatcagaacgccaaaactttgcaaaacttaaaattttttggggattttcccttgtaaaaatagaagagccgatctagagttaaaaacttaagttccataaaataaacttggaatcgctagaggaggtcaaaatataggcctatacaaaatttcaagaaaatctgacccgaggaaaatttttttgaccctagtaaaaatttcaataattttaattcttttttagccaagtccacaatttaaggccaacccaaataaaatttacaatattctccagaattttcccttcaaaatgagcataaaatggttttatttgctctagtattcaccaagttataagctaagaaaatttcataaaattgtcgatgttgtacgtaaccaacgctttttgaatatgattttttattgacacgaaaacttttattaatgaaaaaataattctgccttcttctgtaaaagaagaaattgaaattaacacacaacataaggaggactcgaacctgagaccccccttttggtgactaacgcacagaccactaagacgaaatgaatagagagagccctgatttttttagatttttcctattttttacggattgtacttgatgaaagaaacacgaaaatcacattttattaaaacaatttttgaagttttttgccttcaatggggttggacaatgtttaaatgggaaacgaaaaatcattgacaaaaacggaaggggcggaaacattttggcataaaatgaccgattggaagaggaagaaaaagggaacgcaacagaggaggaccaccaaagaggagaatattttgcaaaattatgaccatttgccgggcgttttaccttatcctcaaccaacaaatcaatcaaataaatcaatt

(The sequence listing continues in the following parts.)

What is claimed is:

1. A method for suppressing a peptide coding sequence in a *Heterodera glycines* pest, comprising selecting a target polynucleotide sequence of a *Heterodera glycines* pest genome comprising at least from about 24 contiguous nucleotides, expressing the target polynucleotide sequence as an RNA sequence that forms a double stranded RNA structure in a plant cell, and providing said plant cell in the diet of said *Heterodera glycines* pest, wherein uptake of the contents of said cell by said pest results in the morbidity and/or mortality of said pest, and wherein said target polynucleotide sequence is SEQ ID NO:22219.

2. The method of claim 1, wherein said RNA sequence comprises contiguous nucleotides from at least two or more target polynucleotide sequences from two or more different coding sequences of a *Heterodera glycines* pest.

3. The method of claim 2, wherein each of said two or more different coding sequences are isolated from different *Heterodera glycines* cDNA sequences.

4. A method for controlling *Heterodera glycines* infection in a soybean plant comprising:

a) transforming a soybean plant cell with a DNA construct that expresses a dsRNA molecule in said soybean cell; and b) regenerating said transformed soybean plant cell into a fertile transgenic soybean plant that exhibits resistance to infection by *Heterodera glycines*;

wherein said DNA construct comprises a polynucleotide sequence comprising at least about 24 contiguous nucleotides of SEQ ID NO:22219, or the complement thereof.

5. The method of claim 4, wherein said DNA construct comprises at least one selectable marker providing herbicide tolerance to the transgenic soybean plant.

6. The method of claim 5, wherein said transgenic soybean plant exhibits tolerance to the herbicide glyphosate.

7. A transgenic soybean plant comprising the double stranded structure of claim 1.

8. A seed produced from the plant of claim 7, wherein said seed comprises said structure.

9. A plant grown from the seed of claim 8.

* * * * *